United States Patent 7,745,391 (HUMAN THROMBOSPONDIN POLYPEPTIDE) - sequence listing, part 128

SEQ ID NO: 355816 - DNA, 3211 bp, Homo sapiens
gggagtctggattataatcgcgacctaagatactggtcaaacatgccttatttcgagatcgatagggtctcaccatgttgcccaggctggtcttgaactcctggactcatcctaaagtgctggcctctcattccctgtctgtgcacacctcacggcaagggccagcctgtttcctcccggtcacctccaaatcttgctgcttttaattcaactcagaggtatgcacttgaggtaggagggcaggggaagtggggatggcaggacatggatggcccttgaggcattggctctgggtgtcatgggctgtgagagtcaagaagggcagtggcctgcctgacttgggttcgaaagggtcactctggccactgcggtgagaactgaaactagccaggccaattctccattgttcctgctcttccaggtaggagaatattagattaggtctggagtcagaaggtagcaggggctgggggttgcagggggatgttgagaagaagtggtcctttggtcagggtgggaagccaacaggatttcctggtgcattggaggtgaaagggaagaggcgctggtggttgtgctttgggcctgagcagccagaagccgttgccatcacctatgacaagggagacagcgcctggggcagagcccagtatggggtgcattcagggtagatcaggaggtatgagtgggcagtgggcgagccaggctgggggttgtgggggaggcctgggttgcaggtttaagcgtgggacccacgtcagattggtggtgggtcatgcatgctggggtggctctcaggtcctccctgctggcttcccactcccaggggctttctcctcccagattccttagctgggtgaggggcaggacagagccctttcctagggaagcccggcaccccctgctgtccagggaaggggagtccttctagcccctgacagcttctctgcccctcccctggcctccccaggcctagccagggttgagttctcacccacctgtgccgccctgccttgttacctggaagcacagccttggggactgagcaggccctcactgtcactttaagaagggaatcagccactttgtgctcaccacctctggggaaggtgtgagaggagagaaggaagtggctgtttggctgctgacaacatgaagacttcctgcgatgagaacagaggcacaggtgccggccctgcagcccccagaacccggactggagggggccatggggcgccggaccctggccctgccctgggtgctgctgaccctgcgtgtcactgcagggaccccggaggtgtgagtacaagttcggatggaggccaccgagctctcgtccttcaccatccgttgtgggttcctggagtctggctccatctccctggtgactgtgagcagggggggccccgatggtgctggggggaccacgctggctgtgttgcacccggaacttggcatccagcaatgggcccctgctcgccaggcccgctgggaaacccagagcagcatctctctcatcctggaaggctctggggccagcagcccctgcgccaacaccaccttctgctgcaagtttgcgtccttccctgagggctcctgggaggcctgtgggagcctcccgcccagctcagacccaggtggggccggggtgaggggtccaggagggcagggaggggctcgggaactggccatccatctgattcttgcctctgtgcccagggctctctgtcccgccgactcctgcccccattctgcgggcagacctggccgggatcttgggggtctcaggagtccttctctttgactgtggctacctccttcatctgctgtgccgacagaagcaccgccctgcccctaggctccagccatcccacaccagctcctaggcactgagagcacgagcatgggcatagcgcgctggctaggactccagtaccgtgaagggaggcagtgagagcagacatctgtgcctcattcctgatctcaaggggaaagcaagaacaagggaggcttcctcaggatctcgaacctgcggaaggaggaccagtctgtgtacttctgccaagtccagctggacatacagatcagccctcaggcagcccctccacagggcccctctcctgcctggacagctctgctggtctccccgtcccctggagaagaacaaggccatgggtcggcccctgctgctgcccctgctgctcctgctgcagccgccagcatttctgcagcctggtggctccacaggatctggtccaagctacctttatggggtcactcaaccaaaacacctctcagcctccatgggtggctctgtggaaatccccttctccttctattacccctgggagttagccatagttcccaacgtgagaatatcctggagacggggccacttccacgggcagtccttctacagcacaaggccgccttccattcacaaggattatgtgaaccggctctttctgaactggacagagggtcaggagagcggcttcctcaggatctcaaacctgcggaaggaggaccagtctgtgtatttctgccgagtcgagctggacacccggagatcagggaggcagcagttgcagtccatcaaggggaccaaactcaccatcacccaggctgtcacaaccaccaccacctggaggcccagcagcacaaccaccatagccggcctcagggtcacagaaagcaaagggcactcagaatcatggcacctaagtctggacactgccatcagggttgcattggctgtcgctgtgctcaaaactgtcattttgggactgctgtgcctcctcctcctgtggtggaggagaaggaaaggtagcagggcgccaagcagtgacttctgaccaacagagtgtggggagaagggatgtgtattagccccggaggacgtgatgtgagacccgcttgtgagtcctccacactcgttccccattggcaagatacatggagagcaccctgaggacctttaaaaggcaaagccgcaaggcagaaggaggctgggtccctgaatcaccgactggaggagagttacctacaagagccttcatccaggagcatccacactgcaatgatataggaatgaggtctgaactccactgaattaaaccactggcatttgggggctgtttattatagcagtgcaaagagttcctttatcctccccaaggatggaaaaatacaatttattttgcttaccata

SEQ ID NO: 355817 - DNA, 5677 bp, Homo sapiens
  misc_feature (4963)..(4964): n is a, c, g, or t
gggagtctggattataatcgcgacctaagatactggtcaaacatgccttatttcgagatcgatagggtctcaccatgttgcccaggctggtcttgaactcctggactcatcctaaagtgctggcctctcattccctgtctgtgcacacctcacggcaagggccagcctgtttcctcccggtcacctccaaatcttgctgcttttaattcaactcagaggtatgcacttgaggtaggagggcaggggaagtggggatggcaggacatggatggcccttgaggcattggctctgggtgtcatgggctgtgagagtcaagaagggcagtggcctgcctgacttgggttcgaaagggtcactctggccactgcggtgagaactgaaactagccaggccaattctccattgttcctgctcttccaggtaggagaatattagattaggtctggagtcagaaggtagcaggggctgggggttgcagggggatgttgagaagaagtggtcctttggtcagggtgggaagccaacaggatttcctggtgcattggaggtgaaagggaagaggcgctggtggttgtgctttgggcctgagcagccagaagccgttgccatcacctatgacaagggagacagcgcctggggcagagcccagtatggggtgcattcagggtagatcaggaggtatgagtgggcagtgggcgagccaggctgggggttgtgggggaggcctgggttgcaggtttaagcgtgggacccacgtcagattggtggtgggtcatgcatgctggggtggctctcaggtcctccctgctggcttcccactcccaggggctttctcctcccagattccttagctgggtgaggggcaggacagagccctttcctagggaagcccggcaccccctgctgtccagggaaggggagtccttctagcccctgacagcttctctgcccctcccctggcctccccaggcctagccagggttgagttctcacccacctgtgccgccctgccttgttacctggaagcacagccttggggactgagcaggccctcactgtcactttaagaagggaatcagccactttgtgctcaccacctctggggaaggtgtgagaggagagaaggaagtggctgtttggctgctgacaacatgaagacttcctgcgatgagaacagaggcacaggtgccggccctgcagcccccagaacccggactggagggggccatggggcgccggaccctggccctgccctgggtgctgctgaccctgcgtgtcactgcagggaccccggaggtgtgagtacaagttcggatggaggccaccgagctctcgtccttcaccatccgttgtgggttcctggagtctggctccatctccctggtgactgtgagcagggggggccccgatggtgctggggggaccacgctggctgtgttgcacccggaacttggcatccagcaatgggcccctgctcgccaggcccgctgggaaacccagagcagcatctctctcatcctggaaggctctggggccagcagcccctgcgccaacaccaccttctgctgcaagtttgcgtccttccctgagggctcctgggaggcctgtgggagcctcccgcccagctcagacccaggtggggccggggtgaggggtccaggagggcagggaggggctcgggaactggccatccatctgattcttgcctctgtgcccagggctctctgtcccgccgactcctgcccccattctgcgggcagacctggccgggatcttgggggtctcaggagtccttctctttgactgtggctacctccttcatctgctgtgccgacagaagcaccgccctgcccctaggctccagccatcccacaccagctcctaggcactgagagcacgagcatgggcatagcgcgctggctaggactccagtaccgtgaagggaggcagtgagagcagacatctgtgcctcattcctgatctcaaggggaaagcaagaacaagacctgtgaagggaaggagggtggatcggcctgactggccctgggaagcacagaggagcctactgggaccagggaagagactgacaagagaagggaggcctgtccctgcctgcttctgtctcaagaagattgttatcacttcctctggtgaaatcctgccttcctgtccccacggcccctcagctgatgccaccttactctggagaggatgggcagagcctcctatggagggagccctgtgggtcaccaaagctccagtgaccacccccgggcaaagacctgcagatcccctgttagagacgggcccaggactttgtgcggggtgcccactgttgctctgagccttcacttcctcagggaggcttcctcaggatctcgaacctgcggaaggaggaccagtctgtgtacttctgccaagtccagctggacatacagatcagggaggctgtcgtggcagtccatcaaggggacccacctcaccatcacccagggtgagtccagctgccctggcaccaaggaaccttcctggttcagccataggctcaggtgtgtggagggaatgacctgaggggctgtatgagggaacaacctcctggggctcccctatgcctgagttcctgcaactcagaagttgaggcccagagatccaggtagagggggctccagtcctgggactgccctgcaagtcatgtggcctgggacagggcttctccaagctctgtcccctcctgtgtagggcagggaggtcagaggggaccctgcagatccagtctcatgtctgggggtcaaggggtggcctcgagagggaccagtctctgtgtaggggaccgtcagccccctcaccccttgagcaagactgtggtccctgcaccaagggagcaggcctggggtgggaagaggccagctgggctgtggtggtgcctggggactgcatgggagcccctgccagggagggagagggacagaggacaagctgggggctctggtgcttgggctgggggctgagcgcctgtgacctccactggcttcctccttctcctctctgaggactgaatctggggtgcagcagagcacagactcaggcccgcctttcctctccctgaaagagcctgcgctggccttggacagagaaagggatgagaagtgaggctgagtgcggtggggtctgcagggatccaggtgggaggggcccagccagccaaggtgaggcccagcccctcagcaggaagatgggcactggggcccttgggcagggctgacttgacacttttgtgtgacttgagccactgtgcccagcctgaacaccctttcctggtaaaacactccacaaaccaggaagagaaggaatgtactgcaacaaaataaaggccagtcatgcaaggcccatggctgaaagtctttcagtcattttagatgaaagactgaaatctttgcctccaagatcaggaacaagagaaggatgcccgctctcactacttctattcaacacaggatttgaagtcaggccgggcacagtggctcacgcctgtaatcccagcacttttggaggctgaggcgggcagattacttgagcctatgagtgtgagaccaccctggccaacatggcaaaaccccatctctactaaaaaaaaaaaaaaaaaaggatttgaagtcctggccggagcaattaggcaagggataaaaaggcacctaaggcccttttgcaataagaagccagatggataaaggaagtgctggtcaccctggaggtgtactggtttggggaaggtccccggcccccacagccctctggggagcctcaccctggctctccccactcacctcagccccctcaggcagcccctccacagggcccctctcctgcctggacagctctgctggtctccccgtcccctggagaagaacaaggccatgggtcggcccctgctgctgcccctgctgctcctgctgcagccgccagcatttctgcagcctggtggctccacaggatctggtccaagctacctttatggggtcactcaaccaaaacacctctcagcctccatgggtggctctgtggaaatccccttctccttctattacccctgggagttagccatagttcccaacgtgagaatatcctggagacggggccacttccacgggcagtccttctacagcacaaggccgccttccattcacaaggattatgtgaaccggctctttctgaactggacagagggtcaggagagcggcttcctcaggatctcaaacctgcggaaggaggaccagtctgtgtatttctgccgagtcgagctggacacccggagatcagggaggcagcagttgcagtccatcaaggggaccaaactcaccatcacccaggctgtcacaaccaccaccacctggaggcccagcagcacaaccaccatagccggcctcagggtcacagaaagcaaagggcactcagaatcatggcacctaagtctggacactgccatcagggttgcattggctgtcgctgtgctcaaaactgtcattttgggactgctgtgcctcctcctcctgtggtggaggagaaggaaaggtagcagggcgccaagcagtgacttctgaccaacagagtgtggggagaagggatgtgtattagccccggaggacgtgatgtgagacccgcttgtgagtcctccacactcgttccccattggcaagatacatggagagcaccctgaggacctttaaaaggcaaagccgcaaggcagaaggaggctgggtccctgaatcaccgactggaggagagttacctacaagagccttcatccaggagcatccacactgcaatgatataggaatgaggtctgaactccactgaattaaaccactggcatttgggggctgtttattatagcagtgcaaagagttcctttatcctccccaaggatggaaaaatacaatttattttgcttaccataaaaaaaannaaaaaaaaaaaaaaaaaaaaaagtgggggggggggggggcaagaaaggatttaaaaaacaggtggggggggggggggacaaataggggatagagaaagagatgcacacacaagcgtgccccccaaaaaaaaaactgagggcactaacacaacacgagggttcggggtgcctccccacaaaaaaaaaaagccaccgcggagaggaaacgcagcaccgtgttcggacaacaaacccaccgcagagagggcgtacagaggaaggacaaaaccgggcgagccatcacccagaggacgggcacacaagagacagcacgaaaaacaagtaccccccggcgggggggaaaacaacagcagcagcagcaggaagacaaaaggacaaggcaaagaggggcagacacagaacgcgggcggaacagcagagggaaccggccaaggacaacaggagcacaggagagggagcgaaagcggagagagaggacggagcgttgcacacgcgaagcagacaggcggagacaggaaggaggcgcgcgagaagggacacagcaagacgacaggagcgaaaacagaagcgagagacggggagcgagggcaacggacggcagcgacgcagagacgcggcgcagcgccagggagagaggagaaccgcgagagcgagaagacgcggggagggggaggaagacgcacaagaagcgccaggagcagccacgaggcggg

SEQ ID NO: 355818 - DNA, 3019 bp, Homo sapiens
gggagtctggattataatcgcgacctaagatactggtcaaacatgccttatttcgagatcgatagggtctcaccatgttgcccaggctggtcttgaactcctggactcatcctaaagtgctggcctctcattccctgtctgtgcacacctcacggcaagggccagcctgtttcctcccggtcacctccaaatcttgctgcttttaattcaactcagaggtatgcacttgaggtaggagggcaggggaagtggggatggcaggacatggatggcccttgaggcattggctctgggtgtcatgggctgtgagagtcaagaagggcagtggcctgcctgacttgggttcgaaagggtcactctggccactgcggtgagaactgaaactagccaggccaattctccattgttcctgctcttccaggtaggagaatattagattaggtctggagtcagaaggtagcaggggctgggggttgcagggggatgttgagaagaagtggtcctttggtcagggtgggaagccaacaggatttcctggtgcattggaggtgaaagggaagaggcgctggtggttgtgctttgggcctgagcagccagaagccgttgccatcacctatgacaagggagacagcgcctggggcagagcccagtatggggtgcattcagggtagatcaggaggtatgagtgggcagtgggcgagccaggctgggggttgtgggggaggcctgggttgcaggtttaagcgtgggacccacgtcagattggtggtgggtcatgcatgctggggtggctctcaggtcctccctgctggcttcccactcccaggggctttctcctcccagattccttagctgggtgaggggcaggacagagccctttcctagggaagcccggcaccccctgctgtccagggaaggggagtccttctagcccctgacagcttctctgcccctcccctggcctccccaggcctagccagggttgagttctcacccacctgtgccgccctgccttgttacctggaagcacagccttggggactgagcaggccctcactgtcactttaagaagggaatcagccactttgtgctcaccacctctggggaaggtgtgagaggagagaaggaagtggctgtttggctgctgacaacatgaagacttcctgcgatgagaacagaggcacaggtgccggccctgcagcccccagaacccggactggagggggccatggggcgccggaccctggccctgccctgggtgctgctgaccctgcgtgtcactgcagggaccccggaggtgtgagtacaagttcggatggaggccaccgagctctcgtccttcaccatccgttgtgggttcctggagtctggctccatctccctggtgactgtgagcagggggggccccgatggtgctggggggaccacgctggctgtgttgcacccggaacttggcatccagcaatgggcccctgctcgccaggcccgctgggaaacccagagcagcatctctctcatcctggaaggctctggggccagcagcccctgcgccaacaccaccttctgctgcaagtttgcgtccttccctgagggctcctgggaggcctgtgggagcctcccgcccagctcagacccaggtggggccggggtgaggggtccaggagggcagggaggggctcgggaactggccatccatctgattcttgcctctgtgcccagggctctctgtcccgccgactcctgcccccattctgcgggcagacctggccgggatcttgggggtctcaggagtccttctctttgactgtggctacctccttcatctgctgtgccgacagaagcaccgccctgcccctaggctccagccatcccacaccagctcctaggcactgagagcacgagcatgggcatagcgcgctggctaggactccagtaccgtgaagggaggcagtgagagcagacatctgtgcctcattcctgatctcaaggggaaagcaagaacaagggaggcttcctcaggatctcgaacctgcggaaggaggaccagtctgtgtacttctgccaagtccagctggacatacagatcagggaggctgtcgtggcagtccatcaaggggacccacctcaccatcacccaggccctcaggcagcccctccacagggcccctctcctgcctggacagctctgctggtctccccgtcccctggagaagaacaaggccatgggtcggcccctgctgctgcccctgctgctcctgctgcagccgccagcatttctgcagcctgagggtcaggagagcggcttcctcaggatctcaaacctgcggaaggaggaccagtctgtgtatttctgccgagtcgagctggacacccggagatcagggaggcagcagttgcagtccatcaaggggaccaaactcaccatcacccaggctgtcacaaccaccaccacctggaggcccagcagcacaaccaccatagccggcctcagggtcacagaaagcaaagggcactcagaatcatggcacctaagtctggacactgccatcagggttgcattggctgtcgctgtgctcaaaactgtcattttgggactgctgtgcctcctcctcctgtggtggaggagaaggaaaggtagcagggcgccaagcagtgacttctgaccaacagagtgtggggagaagggatgtgtattagccccggaggacgtgatgtgagacccgcttgtgagtcctccacactcgttccccattggcaagatacatggagagcaccctgaggacctttaaaaggcaaagccgcaaggcagaaggaggctgggtccctgaatcaccgactggaggagagttacctacaagagccttcatccaggagcatccacactgcaatgatataggaatgaggtctgaactccactgaattaaaccactggcatttgggggctgtttattatagcagtgcaaagagttcctttatcctccccaaggatggaaaaatacaatttattttgcttaccata

SEQ ID NO: 355819 - DNA, 4989 bp, Homo sapiens
gggagtctggattataatcgcgacctaagatactggtcaaacatgccttatttcgagatcgatagggtctcaccatgttgcccaggctggtcttgaactcctggactcatcctaaagtgctggcctctcattccctgtctgtgcacacctcacggcaagggccagcctgtttcctcccggtcacctccaaatcttgctgcttttaattcaactcagaggtatgcacttgaggtaggagggcaggggaagtggggatggcaggacatggatggcccttgaggcattggctctgggtgtcatgggctgtgagagtcaagaagggcagtggcctgcctgacttgggttcgaaagggtcactctggccactgcggtgagaactgaaactagccaggccaattctccattgttcctgctcttccaggtaggagaatattagattaggtctggagtcagaaggtagcaggggctgggggttgcagggggatgttgagaagaagtggtcctttggtcagggtgggaagccaacaggatttcctggtgcattggaggtgaaagggaagaggcgctggtggttgtgctttgggcctgagcagccagaagccgttgccatcacctatgacaagggagacagcgcctggggcagagcccagtatggggtgcattcagggtagatcaggaggtatgagtgggcagtgggcgagccaggctgggggttgtgggggaggcctgggttgcaggtttaagcgtgggacccacgtcagattggtggtgggtcatgcatgctggggtggctctcaggtcctccctgctggcttcccactcccaggggctttctcctcccagattccttagctgggtgaggggcaggacagagccctttcctagggaagcccggcaccccctgctgtccagggaaggggagtccttctagcccctgacagcttctctgcccctcccctggcctccccaggcctagccagggttgagttctcacccacctgtgccgccctgccttgttacctggaagcacagccttggggactgagcaggccctcactgtcactttaagaagggaatcagccactttgtgctcaccacctctggggaaggtgtgagaggagagaaggaagtggctgtttggctgctgacaacatgaagacttcctgcgatgagaacagaggcacaggtgccggccctgcagcccccagaacccggactggagggggccatggggcgccggaccctggccctgccctgggtgctgctgaccctgcgtgtcactgcagggaccccggaggtgtgagtacaagttcggatggaggccaccgagctctcgtccttcaccatccgttgtgggttcctggagtctggctccatctccctggtgactgtgagcagggggggccccgatggtgctggggggaccacgctggctgtgttgcacccggaacttggcatccagcaatgggcccctgctcgccaggcccgctgggaaacccagagcagcatctctctcatcctggaaggctctggggccagcagcccctgcgccaacaccaccttctgctgcaagtttgcgtccttccctgagggctcctgggaggcctgtgggagcctcccgcccagctcagacccaggtggggccggggtgaggggtccaggagggcagggaggggctcgggaactggccatccatctgattcttgcctctgtgcccagggctctctgtcccgccgactcctgcccccattctgcgggcagacctggccgggatcttgggggtctcaggagtccttctctttgactgtggctacctccttcatctgctgtgccgacagaagcaccgccctgcccctaggctccagccatcccacaccagctcctaggcactgagagcacgagcatgggcatagcgcgctggctaggactccagtaccgtgaagggaggcagtgagagcagacatctgtgcctcattcctgatctcaaggggaaagcaagaacaagacctgtgaagggaaggagggtggatcggcctgactggccctgggaagcacagaggagcctactgggaccagggaagagactgacaagagaagggaggcctgtccctgcctgcttctgtctcaagaagattgttatcacttcctctggtgaaatcctgccttcctgtccccacggcccctcagctgatgccaccttactctggagaggatgggcagagcctcctatggagggagccctgtgggtcaccaaagctccagtgaccacccccgggcaaagacctgcagatcccctgttagagacgggcccaggactttgtgcggggtgcccactgttgctctgagccttcacttcctcagggaggcttcctcaggatctcgaacctgcggaaggaggaccagtctgtgtacttctgccaagtccagctggacatacagatcagggaggctgtcgtggcagtccatcaaggggacccacctcaccatcacccagggtgagtccagctgccctggcaccaaggaaccttcctggttcagccataggctcaggtgtgtggagggaatgacctgaggggctgtatgagggaacaacctcctggggctcccctatgcctgagttcctgcaactcagaagttgaggcccagagatccaggtagagggggctccagtcctgggactgccctgcaagtcatgtggcctgggacagggcttctccaagctctgtcccctcctgtgtagggcagggaggtcagaggggaccctgcagatccagtctcatgtctgggggtcaaggggtggcctcgagagggaccagtctctgtgtaggggaccgtcagccccctcaccccttgagcaagactgtggtccctgcaccaagggagcaggcctggggtgggaagaggccagctgggctgtggtggtgcctggggactgcatgggagcccctgccagggagggagagggacagaggacaagctgggggctctggtgcttgggctgggggctgagcgcctgtgacctccactggcttcctccttctcctctctgaggactgaatctggggtgcagcagagcacagactcaggcccgcctttcctctccctgaaagagcctgcgctggccttggacagagaaagggatgagaagtgaggctgagtgcggtggggtctgcagggatccaggtgggaggggcccagccagccaaggtgaggcccagcccctcagcaggaagatgggcactggggcccttgggcagggctgacttgacacttttgtgtgacttgagccactgtgcccagcctgaacaccctttcctggtaaaacactccacaaaccaggaagagaaggaatgtactgcaacaaaataaaggccagtcatgcaaggcccatggctgaaagtctttcagtcattttagatgaaagactgaaatctttgcctccaagatcaggaacaagagaaggatgcccgctctcactacttctattcaacacaggatttgaagtcaggccgggcacagtggctcacgcctgtaatcccagcacttttggaggctgaggcgggcagattacttgagcctatgagtgtgagaccaccctggccaacatggcaaaaccccatctctactaaaaaaaaaaaaaaaaaaggatttgaagtcctggccggagcaattaggcaagggataaaaaggcacctaaggcccttttgcaataagaagccagatggataaaggaagtgctggtcaccctggaggtgtactggtttggggaaggtccccggcccccacagccctctggggagcctcaccctggctctccccactcacctcagccccctcaggcagcccctccacagggcccctctcctgcctggacagctctgctggtctccccgtcccctggagaagaacaaggccatgggtcggcccctgctgctgcccctgctgctcctgctgcagccgccagcatttctgcagcctggtggctccacaggatctggtccaagctacctttatggggtcactcaaccaaaacacctctcagcctccatgggtggctctgtggaaatccccttctccttctattacccctgggagttagccatagttcccaacgtgagaatatcctggagacggggccacttccacgggcagtccttctacagcacaaggccgccttccattcacaaggattatgtgaaccggctctttctgaactggacagagggtcaggagagcggcttcctcaggatctcaaacctgcggaaggaggaccagtctgtgtatttctgccgagtcgagctggacacccggagatcagggaggcagcagttgcagtccatcaaggggaccaaactcaccatcacccaggctgtcacaaccaccaccacctggaggcccagcagcacaaccaccatagccggcctcagggtcacagaaagcaaagggcactcagaatcatggcacctaagtctggacactgccatcagggttgcattggctgtcgctgtgctcaaaactgtcattttgggactgctgtgcctcctcctcctgtggtggaggagaaggaaaggtcagcagcggactaaagccacaaccccagccaggtagcagggcgccaagcagtgacttctgaccaacagagtgtggggagaagggatgtgtattagccccggaggacgtgatgtgagacccgcttgtgagtcctccacactcgttccccattggcaagatacatggagagcaccctgaggacctttaaaaggcaaagccgcaaggcagaaggaggctgggtccctgaatcaccgactggaggagagttacctacaagagccttcatccaggagcatccacactgcaatgatataggaatgaggtctgaactccactgaattaaaccactggcatttgggggctgtttattatagcagtgcaaagagttcctttatcctccccaaggatggaaaaatacaatttattttgcttaccata

SEQ ID NO: 355820 - DNA, 2671 bp, Homo sapiens
gggagtctggattataatcgcgacctaagatactggtcaaacatgccttatttcgagatcgatagggtctcaccatgttgcccaggctggtcttgaactcctggactcatcctaaagtgctggcctctcattccctgtctgtgcacacctcacggcaagggccagcctgtttcctcccggtcacctccaaatcttgctgcttttaattcaactcagaggtatgcacttgaggtaggagggcaggggaagtggggatggcaggacatggatggcccttgaggcattggctctgggtgtcatgggctgtgagagtcaagaagggcagtggcctgcctgacttgggttcgaaagggtcactctggccactgcggtgagaactgaaactagccaggccaattctccattgttcctgctcttccaggtaggagaatattagattaggtctggagtcagaaggtagcaggggctgggggttgcagggggatgttgagaagaagtggtcctttggtcagggtgggaagccaacaggatttcctggtgcattggaggtgaaagggaagaggcgctggtggttgtgctttgggcctgagcagccagaagccgttgccatcacctatgacaagggagacagcgcctggggcagagcccagtatggggtgcattcagggtagatcaggaggtatgagtgggcagtgggcgagccaggctgggggttgtgggggaggcctgggttgcaggtttaagcgtgggacccacgtcagattggtggtgggtcatgcatgctggggtggctctcaggtcctccctgctggcttcccactcccaggggctttctcctcccagattccttagctgggtgaggggcaggacagagccctttcctagggaagcccggcaccccctgctgtccagggaaggggagtccttctagcccctgacagcttctctgcccctcccctggcctccccaggcctagccagggttgagttctcacccacctgtgccgccctgccttgttacctggaagcacagccttggggactgagcaggccctcactgtcactttaagaagggaatcagccactttgtgctcaccacctctggggaaggtgtgagaggagagaaggaagtggctgtttggctgctgacaacatgaagacttcctgcgatgagaacagaggcacaggtgccggccctgcagcccccagaacccggactggagggggccatggggcgccggaccctggccctgccctgggtgctgctgaccctgcgtgtcactgcagggaccccggaggtgtgagtacaagttcggatggaggccaccgagctctcgtccttcaccatccgttgtgggttcctggagtctggctccatctccctggtgactgtgagcagggggggccccgatggtgctggggggaccacgctggctgtgttgcacccggaacttggcatccagcaatgggcccctgctcgccaggcccgctgggaaacccagagcagcatctctctcatcctggaaggctctggggccagcagcccctgcgccaacaccaccttctgctgcaagtttgcgtccttccctgagggctcctgggaggcctgtgggagcctcccgcccagctcagacccaggtggggccggggtgaggggtccaggagggcagggaggggctcgggaactggccatccatctgattcttgcctctgtgcccagggctctctgtcccgccgactcctgcccccattctgcgggcagacctggccgggatcttgggggtctcaggagtccttctctttgactgtggctacctccttcatctgctgtgccgacagaagcaccgccctgcccctaggctccagccatcccacaccagctcctaggcactgagagcacgagcatgggcatagcgcgctggctaggactccagtaccgtgaagggaggcagtgagagcagacatctgtgcctcattcctgatctcaaggggaaagcaagaacaagggaggcttcctcaggatctcgaacctgcggaaggaggaccagtctgtgtacttctgccaagtccagctggacatacagatcagggaggctgtcgtggcagtccatcaaggggacccacctcaccatcacccaggctgtcacaaccaccaccacctggaggcccagcagcacaaccaccatagccggcctcagggtcacagaaagcaaagggcactcagaatcatggcacctaagtctggacatgctgtgcctcctcctcctgtggtggaggagaaggaaaggtagcagggcgccaagcagtgacttctgaccaacagagtgtggggagaagggatgtgtattagccccggaggacgtgatgtgagacccgcttgtgagtcctccacactcgttccccattggcaagatacatggagagcaccctgaggacctttaaaaggcaaagccgcaaggcagaaggaggctgggtccctgaatcaccgactggaggagagttacctacaagagccttcatccaggagcatccacactgcaatgatataggaatgaggtctgaactccactgaattaaaccactggcatttgggggctgtttattatagcagtgcaaagagttcctttatcctccccaaggatggaaaaatacaatttattttgcttaccata

SEQ ID NO: 355821 - DNA, 2375 bp, Homo sapiens
gggagtctggattataatcgcgacctaagatactggtcaaacatgccttatttcgagatcgatagggtctcaccatgttgcccaggctggtcttgaactcctggactcatcctaaagtgctggcctctcattccctgtctgtgcacacctcacggcaagggccagcctgtttcctcccggtcacctccaaatcttgctgcttttaattcaactcagaggtatgcacttgaggtaggagggcaggggaagtggggatggcaggacatggatggcccttgaggcattggctctgggtgtcatgggctgtgagagtcaagaagggcagtggcctgcctgacttgggttcgaaagggtcactctggccactgcggtgagaactgaaactagccaggccaattctccattgttcctgctcttccaggtaggagaatattagattaggtctggagtcagaaggtagcaggggctgggggttgcagggggatgttgagaagaagtggtcctttggtcagggtgggaagccaacaggatttcctggtgcattggaggtgaaagggaagaggcgctggtggttgtgctttgggcctgagcagccagaagccgttgccatcacctatgacaagggagacagcgcctggggcagagcccagtatggggtgcattcagggtagatcaggaggtatgagtgggcagtgggcgagccaggctgggggttgtgggggaggcctgggttgcaggtttaagcgtgggacccacgtcagattggtggtgggtcatgcatgctggggtggctctcaggtcctccctgctggcttcccactcccaggggctttctcctcccagattccttagctgggtgaggggcaggacagagccctttcctagggaagcccggcaccccctgctgtccagggaaggggagtccttctagcccctgacagcttctctgcccctcccctggcctccccaggcctagccagggttgagttctcacccacctgtgccgccctgccttgttacctggaagcacagccttggggactgagcaggccctcactgtcactttaagaagggaatcagccactttgtgctcaccacctctggggaaggtgtgagaggagagaaggaagtggctgtttggctgctgacaacatgaagacttcctgcgatgagaacagaggcacaggtgccggccctgcagcccccagaacccggactggagggggccatggggcgccggaccctggccctgccctgggtgctgctgaccctgcgtgtcactgcagggaccccggaggtgtgagtacaagttcggatggaggccaccgagctctcgtccttcaccatccgttgtgggttcctggagtctggctccatctccctggtgactgtgagcagggggggccccgatggtgctggggggaccacgctggctgtgttgcacccggaacttggcatccagcaatgggcccctgctcgccaggcccgctgggaaacccagagcagcatctctctcatcctggaaggctctggggccagcagcccctgcgccaacaccaccttctgctgcaagtttgcgtccttccctgagggctcctgggaggcctgtgggagcctcccgcccagctcagacccaggtggggccggggtgaggggtccaggagggcagggaggggctcgggaactggccatccatctgattcttgcctctgtgcccagggctctctgtcccgccgactcctgcccccattctgcgggcagacctggccgggatcttgggggtctcaggagtccttctctttgactgtggctacctccttcatctgctgtgccgacagaagcaccggcatagcgcgctggctaggactccagtaccgtgaagggaggcagtgagagcagacatctgtgcctcattcctgatctcaaggggaaagcaagaacaagacctgtgaagggaaggagggtggatcggcctgactggccctgggaagcacagaggagcctactgggaccagggaagagactgacaagagaagggaggcctgtccctgcctgcttctgtctcaagaagattgttatcacttcctctggtgaaatcctgccttcctgtccccacggcccctcagctgatgccaccaagatgggtcagatggacgaggcctttgagtttgtgaagcagaggcgaagcatcatctctcaagatgggtcagatggactcgcactaaaacactgagatcggccaggtgcagtggctcagcctgtaatcccagcactttgggaggctgagctgggtggatcacctgagattaggagttcgagaccagcctgaccaacatggagaaaccccatctctactaaaaatacaaaattagcca

SEQ ID NO: 355822 - DNA, 294 bp, Homo sapiens
gcctcagggtcacagaaagcaaagggcactcagaatcatggcacctaagtctggacactgccatcagggttgcattggctgtcgctgtgctcaaaactgtcattttgggactgctgtgcctcctcctcctgtggtggaggagaaggaaagggtaagtgcccagaacgcactgtctcctcaagcttcccagctgggggtttctctgagcccacctgcagctaagggacttcagaaatatgcagaccctgctggctcccctcaagcccaccaaggccgactctggcctgtgctggg

SEQ ID NO: 355823 - DNA, 1300 bp, Homo sapiens
tttttttttaagagacaaggtctcactctgtcatccagactagagtgcagtggtgcaatcacaaatcacagctcacagaaacctcaaaccactggactcaagtgatcctcctgcctcagcctcccaagttgctgggactactacaggcaaatgctaccacacctggctacttttaattttttttttttttagagatggcagtcttgctatgctgcccaggatggtctccaactcctggcctcaagcaatcctcccacctcagccttacatagtgctgggattacaggcatgagctaccacacatagccaagtgtggctgttaaaagcagaggacgcagtgtttgctccaagagaaagtaaaggaaaagttgagaagtgggttttatagtataaatggaagaaactagagatatttttatgctgatggagtaaaagcaataaagggaaaggtgacccaagagaaaaagtaactaatagagatctctgagcagcagctgggcataggtggcaagactagtttgagagcaattaggacacaaattccagtgacagcagcataggaagaaatgacaggtgggacagagatatgtaagtttgttgagacagtggaaaagtagttcttgtgcaatggtttctattttctttataaaataaaataggtagtgagcataccagccaagaggcagggagcagggatagagtggttttctgaggaagaacgtggaaaagctctaaaatagccactactgaagaactgaccaggagcagagagaatgtggaacagctgaggctggagaccatgaatatgcagtggaccaacctgcaagactgatttttcctagtagcacccagcagtctacaagtacagagaaggcaggaacattgatccaaggctggatggatggaaggaaaaacaaggcaaaagctcacaataatggcaacaaagtcgttaaaatgatgtatcatggtgtgcctatgttggataagagagaaaaggcaggaaatggcgaaaagacagggagaaaaaaggtttggaatcagatcctaacatacagaattaagatgacaaataataggaccaactgggagctagatgaataggaggcaggggcaaaagaacagaaagtgtgaattaaagattttagtggcagagcaaatcccggtgatagtaaggcccaggctaaggctacatggaagactggctaaagtggtgtgggctgaaagtcaaaggagagtcaaaagaggtagagaaaacaagaggttatagtttttggtgagacatgctctttagtcccatagc

SEQ ID NO: 355824 - DNA, 597 bp, Homo sapiens
ctactagacacctgagcacataactgaagtctagaggaattgataagtccaggaaatatcaaccctcttaaattaaacaacttatcaaaatctctgacatgcaacaaaagcagtgctaaaaggaaagttcatagcattaaatgcctacatcaaaaagtctgaaagagaaggcaggaacattgatccaaggctggatggatggaaggaaaaacaaggcaaaagctcacaataatggcaacaaagtcgttaaaatgatgtatcatggtgtgcctatgttggataagagagaaaaggcaggaaatggcgaaaagacagggagaaaaaaggtttggaatcagatcctaacatacagaattaagatgacaaataataggaccaactgggagctagatgaataggaggcaggggcaaaagaacagaaagtgtgaattaaagattttagtggcagagcaaatcccggtgatagtaaggcccaggctaaggctacatggaagactggctaaagtggtgtgggctgaaagtcaaaggagagtcaaaagaggtagagaaaacaagaggttatagtttttggtgagacatgctctttagtcccatagc

SEQ ID NO: 355825 - DNA, 1716 bp, Homo sapiens
  misc_feature (1503)..(1503): n is a, c, g, or t
  misc_feature (1541)..(1541): n is a, c, g, or t
agacgactgtctgagagaggggccgctacgccgcacagcaaacaagctccgcgacgtttccaggacccggataatcccgcccttagagcagagccggaagaaggcgggacgaaccggaagagggtgaaatgctttcggtaggcactccacggctgtgaagatggcggcggctgcgtggcttcaggtgttgcctgtcattcttctgcttctgggagctcacccgtcaccactgtcgtttttcagtgcgggaccggcaaccgtagctgctgccgaccggtccaaatggcacattccgataccgtcggggaaaaattattttagttttggaaagatcctcttcagaaataccactatcttcctgaagtttgatggagaaccttgtgacctgtctttgaatataacctggtatctgaaaagcgctgattgttacaatgaaatctataacttcaaggcagaagaagtagagttgtatttggaaaaacttaaggaaaaaagaggcttgtctgggaaatatcaaacatcatcaaaattgttccagaactgcagtgaactctttaaaacacagaccttttctggagattttatgcatcgactgcctcttttaggagaaaaacaggaggctaaggagaatggaacaaaccttacctttattggagacaaaaccattcagatgcctttcttgaagaaacatttcttggattgttgaaagactttaataatttccaaagttccaaaagttgattttgatagtttttgccagtgttttcgttgcttttatggatgagtagattttcagagtttcttattctgccattctgaaagtgtctcactacctaaaccccagttttatttgtacagaattttaactgaatgtaagttaggcatgacagtctttgttaatttttttaaacaaaagatagccattaggactgggtacagtggctcacgcctgtaatgccaacactttgggaggccaaggtgggcagatgacttgaggttgggagttcgagaccagcttggccaatgtggtgaaactttgtctttactaaaaatacaaaaattagttgctcatggtggcaggcacctgtaatccaagctactcaggaggctgaggcaggagaatcgcgtgaacttgggaggtggaggctgcagtgagctgagatcacgctactgcactccagcctgggcagccagtgagattccatctcaaaaaaaaaagaaaaaagatattcattggattttctcttactaataggtatatattcactgtgaaaatggagacgatatacataaatgaaaagaagaaaatagtaatctataataccatgcagtgatatatttatcttcctattcttttgtatatgggcatgtttatattattttaaaaagggaatcttagagtatgtattatatgacttttttttgtagcttagcaatataacatggacatgtcgtcagtttggtaaatattgtattgcatcgttacttaaatgcttgtatagngtcttattgtatgagtacattgcaatttgttcaattcnctgttcttgaacttttatgagtttcattatcttggaattttatgcagtgttgtgattaatattttaactacatttgcttttaagtctttattttctgatctcagaagaattgtatattgggataagtttttaattctataacttaaaagtaaaaatcctttgtaattttatgttc

SEQ ID NO: 355826 - DNA, 1029 bp, Homo sapiens
agacgactgtctgagagaggggccgctacgccgcacagcaaacaagctccgcgacgtttccaggacccggataatcccgcccttagagcagagccggaagaaggcgggacgaaccggaagagggtgaaatgctttcggtaggcactccacggctgtgaagatggcggcggctgcgtggcttcaggtgttgcctgtcattcttctgcttctgggagctcacccgtcaccactgtcgtttttcagtgcgggaccggcaaccgtagctgctgccgaccggtccaaatggcacattccgataccgtcggtgagtattcacttcactaacgtctgaacctagaggagcaaggggtggggctacggcggcccaaggggtccatgaaggttccgcaaaagtctcttcaaaaggggtggggttgctgggatggtctgtgtggctagccaactgggacccacctccctggagtggaaagccgcgcacttctgtgattaggctagcgggaatgtaagggccacttcagcaacagaaaggagtggtggagcggcttctcatcagaaaaacagaactttcagtgcctgacttgagatgtaaacttgatgtacaaacggagagttgtttatctttcagatgtttcacagaatccagtgtccccgggttggataagaaagatatgtaaataggagtcttcatttctttctttctttttcttcctctgcacatcttggtccctgggtaattctgcttacgagatggttcgacttcgcttcaactttggaatggctattctaagctttactgtgtgactagaaagcatagagatttaagaaatgtgttttaacatgggaatggttaaaatggaagaaatagtacttaaaatttaatgtggtaaggctagtctttcatttggataattaactacatgggttgactctttctgccccttacccattttaaaccttatttcagtaacaggtatagtcctgtgagcagacaaaaaccagatgcagggaggaaatgctgaaaagcattag

SEQ ID NO: 355827 - DNA, 681 bp, Homo sapiens
agacgactgtctgagagaggggccgctacgccgcacagcaaacaagctccgcgacgtttccaggacccggataatcccgcccttagagcagagccggaagaaggcgggacgaaccggaagagggtgaaatgctttcggtaggcactccacggctgtgaagatggcggcggctgcgtggcttcaggtgttgcctgtcattcttctgcttctgggagctcacccgtcaccactgtcgtttttcagtgcgggaccggcaaccgtagctgctgccgaccggtccaaatggcacattccgataccgtcggggaaaaattattttagttttggaaagatcctcttcagaaataccactatcttcctgaagtttgatggagaaccttgtgacctgtctttgaatataacctggtatctgaaaagcgctgattgttacaatgaaatctataacttcaaggcagaagaagtagagttgtatttggaaaaacttaaggaaaaaagaggcttgtctgggaaatatcaaacatcatcaaaattgttccagaactgcagtgaactctttaaaacacagaccttttctggagattttatgcatcgactgcctcttttaggagaaaaacaggaggctaaggagaatggaacaaaccttaccttttatagaagaccataaataaaccactacagccc

SEQ ID NO: 355828 - DNA, 428 bp, Homo sapiens
ctagaggatcccccttttggggtctttgctcacagaatccagtgtccccgggttggataagaaagatatgtaaataggagtcttcatttctttctttctttttcttcctctgcacatcttggtccctgggtaattctgcttacgagatggttcgacttcgcttcaactttggaatggctattctaagctttactgtgtgactagaaagcatagagatttaagaaatgtgttttaacatgggaatggttaaaatggaagaaatagtacttaaaatttaatgtggtaaggctagtctttcatttggataattaactacatgggttgactctttctgccccttacccattttaaaccttatttcagtaacaggtatagtcctgtgagcagacaaaaaccagatgcagggaggaaatgctgaaaagcattag

SEQ ID NO: 355829 - DNA, 3009 bp, Homo sapiens
agacgactgtctgagagaggggccgctacgccgcacagcaaacaagctccgcgacgtttccaggacccggataatcccgcccttagagcagagccggaagaaggcgggacgaaccggaagagggtgaaatgctttcggtaggcactccacggctgtgaagatggcggcggctgcgtggcttcaggtgttgcctgtcattcttctgcttctgggagctcacccgtcaccactgtcgtttttcagtgcgggaccggcaaccgtagctgctgccgaccggtccaaatggcacattccgataccgtcggggaaaaattattttagttttggaaagatcctcttcagaaataccactatcttcctgaagtttgatggagaaccttgtgacctgtctttgaatataacctggtatctgaaaagcgctgattgttacaatgaaatctataacttcaaggcagaagaagtagagttgtatttggaaaaacttaaggaaaaaagaggcttgtctgggaaatatcaaacatcatcaaaattgttccagaactgcagtgaactctttaaaacacagaccttttctggagattttatgcatcgactgcctcttttaggagaaaaacaggaggctaaggagaatggaacaaaccttacctttattggagacaaaaccgcaatgcatgaaccattgcaaacttggcaagatgcaccatacatttttattgtacatattggcatttcatcctcaaaggaatcatcaaaagaaaattcactgagtaatctttttaccatgactgttgaagtgaagggtccctatgaatacctcacacttgaagactatcccttgatgatttttttcatggtgatgtgtattgtatatgtcctgtttggtgttctgtggctggcatggtctgcctgctactggagagatctcctgagaattcagttttggattggtgctgtcatcttcctgggaatgcttgagaaagctgtcttctatgcggaatttcagaatatccgatacaaaggagaatctgtccagggtgctttgatccttgcagagctgctttcagcagtgaaacgctcactggctcgaaccctggtcatcatagtcagtctgggatatggcatcgtcaagccacgccttggagtcactcttcataaggttgtagtagcaggagccctctatcttttgttctctggcatggaaggggtcctcagagttactggggcccagactgatcttgcttccttggcctttatccccttggctttcctagacactgccttgtgctggtggatatttattagcctgactcaaacaatgaagctattaaaacttcggaggaacattgtaaaactctctttgtatcggcatttcaccaacacgcttattttggcagtggcagcatccattgtgtttatcatctggacaaccatgaagttcagaatagtgacatgtcagtcggactggcgggagctgtgggtagacgatgccatctggcgcttgctgttctccatgatcctctttgtcatcatggttctctggcgaccatctgcaaacaaccagaggtttgccttttcaccattgtctgaggaagaggaggaggatgaacaaaaggagcctatgctgaaagaaagctttgaaggaatgaaaatgagaagtaccaaacaagaacccaatggaaatagtaaagttaacaaagcacaggaagatgatttgaagtgggtagaagagaatgttccttcttctgtgacagatgtagcacttccagcccttctggattcagatgaggaacgaatgatcacacactttgaaaggtccaaaatggagtaaggaatgggaagatttgcagttaaagatggctaccatcagggaagagatcagcatctgtgtcagtcttctgtacggctccatgggattaaaggaagcaatgacatcctgatctgttccttgatctttgggcattggagttggcgagaggtgtcagaacaaagagaacatcttactgaaaacaagttcataagatgagaaaaatctacgagcttcttatttacaacactgctgccccctttcctcccagactctgacatggatgttcatgcaacttaagtgtgttgttcctgaactttctgtaatgtttcattttttaaatctgacaaactaaaaagtttaacgtcttctaaaagattgtcatcaacaccataatatgtaatctccaggagcaactgcctgtaatttttatttatttagggagttacataggtgatgggggaaattgttaactacctttcattttcctgggaagtcaaggttacatcttgcagaggttgttttgagaaaaaagggcccttctgagttaaggagccatagttctatcaatgatcaaaagaaaaaaaaaaaaaagagaaactgttacagtatgattcagatcatttaaaaaagcaaaatcaagtgcaattttgtttacaaatggtgtatattaaagatttttctatttcagatgtactttaaagagaaatattagcttaactcttttgacatctgctattgtgacacatcccattgctggcaatgtggtgcacactccgaaacttttaactactgttttgtaagcctccaagggtggcattgcagggtccttaggcaatgttttgtttgcctttatgcagagaggtgctccaagtgctgtgattgagcaccgtgctagaggaactgtaatgcttcagaagttgtagcttatacaaaggaaacaggtcctgctggcttaatttaaacagttattgcatgaagtagcgtggaggccctggactgctgctcgttctttaggatggactgttctggtatctggtattggtttagagactgttaataagggacatcacaaggtgatgggattcatttgaagcactctatttctgttttaatggttttatccaattttgccttcccaagatttttgttctacataaaaagttcatgccactttttaatataaaaaaatttaacaaaattaa

SEQ ID NO: 355830 - DNA, 2768 bp, Homo sapiens
  misc_feature (20)..(20): n is a, c, g, or t
  misc_feature (22)..(22): n is a, c, g, or t
  misc_feature (38)..(38): n is a, c, g, or t
  misc_feature (40)..(42): n is a, c, g, or t
taggcctggtgatctagagnanccccacgcgcacacgntnnnatggcacatccgataccgtcggggaaaaattattttagttttggaaagatcctcttcagaaataccactatcttcctgaagtttgatggagaaccttgtgacctgtctttgaatataacctggtatctgaaaagcgctgattgttacaatgaaatctataacttcaaggcagaagaagtagagttgtatttggaaaaacttaaggaaaaaagaggcttgtctgggaaatatcaaacatcatcaaaattgttccagaactgcagtgaactctttaaaacacagaccttttctggagattttatgcatcgactgcctcttttaggagaaaaacaggaggctaaggagaatggaacaaaccttacctttattggagacaaaaccgcaatgcatgaaccattgcaaacttggcaagatgcaccatacatttttattgtacatattggcatttcatcctcaaaggaatcatcaaaagaaaattcactgagtaatctttttaccatgactgttgaagtgaagggtccctatgaatacctcacacttgaagactatcccttgatgatttttttcatggtgatgtgtattgtatatgtcctgtttggtgttctgtggctggcatggtctgcctgctactggagagatctcctgagaattcagttttggattggtgctgtcatcttcctgggaatgcttgagaaagctgtcttctatgcggaatttcagaatatccgatacaaaggagaatctgtccagggtgctttgatccttgcagagctgctttcagcagtgaaacgctcactggctcgaaccctggtcatcatagtcagtctgggatatggcatcgtcaagccacgccttggagtcactcttcataaggttgtagtagcaggagccctctatcttttgttctctggcatggaaggggtcctcagagttactggggcccagactgatcttgcttccttggcctttatccccttggctttcctagacactgccttgtgctggtggatatttattagcctgactcaaacaatgaagctattaaaacttcggaggaacattgtaaaactctctttgtatcggcatttcaccaacacgcttattttggcagtggcagcatccattgtgtttatcatctggacaaccatgaagttcagaatagtgacatgtcagtcggactggcgggagctgtgggtagacgatgccatctggcgcttgctgttctccatgatcctctttgtcatcatggttctctggcgaccatctgcaaacaaccagaggtttgccttttcaccattgtctgaggaagaggaggaggatgaacaaaaggagcctatgctgaaagaaagctttgaaggaatgaaaatgagaagtaccaaacaagaacccaatggaaatagtaaagttaacaaagcacaggaagatgatttgaagtgggtagaagagaatgttccttcttctgtgacagatgtagcacttccagcccttctggattcagatgaggaacgaatgatcacacactttgaaaggtccaaaatggagtaaggaatgggaagatttgcagttaaagatggctaccatcagggaagagatcagcatctgtgtcagtcttctgtacggctccatgggattaaaggaagcaatgacatcctgatctgttccttgatctttgggcattggagttggcgagaggtgtcagaacaaagagaacatcttactgaaaacaagttcataagatgagaaaaatctacgagcttcttatttacaacactgctgccccctttcctcccagactctgacatggatgttcatgcaacttaagtgtgttgttcctgaactttctgtaatgtttcattttttaaatctgacaaactaaaaagtttaacgtcttctaaaagattgtcatcaacaccataatatgtaatctccaggagcaactgcctgtaatttttatttatttagggagttacataggtgatgggggaaattgttaactacctttcattttcctgggaagtcaaggttacatcttgcagaggttgttttgagaaaaaagggcccttctgagttaaggagccatagttctatcaatgatcaaaagaaaaaaaaaaaaaagagaaactgttacagtatgattcagatcatttaaaaaagcaaaatcaagtgcaattttgtttacaaatggtgtatattaaagatttttctatttcagatgtactttaaagagaaatattagcttaactcttttgacatctgctattgtgacacatcccattgctggcaatgtggtgcacactccgaaacttttaactactgttttgtaagcctccaagggtggcattgcagggtccttaggcaatgttttgtttgcctttatgcagagaggtgctccaagtgctgtgattgagcaccgtgctagaggaactgtaatgcttcagaagttgtagcttatacaaaggaaacaggtcctgctggcttaatttaaacagttattgcatgaagtagcgtggaggccctggactgctgctcgttctttaggatggactgttctggtatctggtattggtttagagactgttaataagggacatcacaaggtgatgggattcatttgaagcactctatttctgttttaatggttttatccaattttgccttcccaagatttttgttctacataaaaagttcatgccactttttaatataaaaaaatttaacaaaattaa

SEQ ID NO: 355831 - DNA, 2948 bp, Homo sapiens
agacgactgtctgagagaggggccgctacgccgcacagcaaacaagctccgcgacgtttccaggacccggataatcccgcccttagagcagagccggaagaaggcgggacgaaccggaagagggtgaaatgctttcggtaggcactccacggctgtgaagatggcggcggctgcgtggcttcaggtgttgcctgtcattcttctgcttctgggagctcacccgtcaccactgtcgtttttcagtgcgggaccggcaaccgtagctgctgccgaccggtccaaatggcacattccgataccgtcgttgatggagaaccttgtgacctgtctttgaatataacctggtatctgaaaagcgctgattgttacaatgaaatctataacttcaaggcagaagaagtagagttgtatttggaaaaacttaaggaaaaaagaggcttgtctgggaaatatcaaacatcatcaaaattgttccagaactgcagtgaactctttaaaacacagaccttttctggagattttatgcatcgactgcctcttttaggagaaaaacaggaggctaaggagaatggaacaaaccttacctttattggagacaaaaccgcaatgcatgaaccattgcaaacttggcaagatgcaccatacatttttattgtacatattggcatttcatcctcaaaggaatcatcaaaagaaaattcactgagtaatctttttaccatgactgttgaagtgaagggtccctatgaatacctcacacttgaagactatcccttgatgatttttttcatggtgatgtgtattgtatatgtcctgtttggtgttctgtggctggcatggtctgcctgctactggagagatctcctgagaattcagttttggattggtgctgtcatcttcctgggaatgcttgagaaagctgtcttctatgcggaatttcagaatatccgatacaaaggagaatctgtccagggtgctttgatccttgcagagctgctttcagcagtgaaacgctcactggctcgaaccctggtcatcatagtcagtctgggatatggcatcgtcaagccacgccttggagtcactcttcataaggttgtagtagcaggagccctctatcttttgttctctggcatggaaggggtcctcagagttactggggcccagactgatcttgcttccttggcctttatccccttggctttcctagacactgccttgtgctggtggatatttattagcctgactcaaacaatgaagctattaaaacttcggaggaacattgtaaaactctctttgtatcggcatttcaccaacacgcttattttggcagtggcagcatccattgtgtttatcatctggacaaccatgaagttcagaatagtgacatgtcagtcggactggcgggagctgtgggtagacgatgccatctggcgcttgctgttctccatgatcctctttgtcatcatggttctctggcgaccatctgcaaacaaccagaggtttgccttttcaccattgtctgaggaagaggaggaggatgaacaaaaggagcctatgctgaaagaaagctttgaaggaatgaaaatgagaagtaccaaacaagaacccaatggaaatagtaaagttaacaaagcacaggaagatgatttgaagtgggtagaagagaatgttccttcttctgtgacagatgtagcacttccagcccttctggattcagatgaggaacgaatgatcacacactttgaaaggtccaaaatggagtaaggaatgggaagatttgcagttaaagatggctaccatcagggaagagatcagcatctgtgtcagtcttctgtacggctccatgggattaaaggaagcaatgacatcctgatctgttccttgatctttgggcattggagttggcgagaggtgtcagaacaaagagaacatcttactgaaaacaagttcataagatgagaaaaatctacgagcttcttatttacaacactgctgccccctttcctcccagactctgacatggatgttcatgcaacttaagtgtgttgttcctgaactttctgtaatgtttcattttttaaatctgacaaactaaaaagtttaacgtcttctaaaagattgtcatcaacaccataatatgtaatctccaggagcaactgcctgtaatttttatttatttagggagttacataggtgatgggggaaattgttaactacctttcattttcctgggaagtcaaggttacatcttgcagaggttgttttgagaaaaaagggcccttctgagttaaggagccatagttctatcaatgatcaaaagaaaaaaaaaaaaaagagaaactgttacagtatgattcagatcatttaaaaaagcaaaatcaagtgcaattttgtttacaaatggtgtatattaaagatttttctatttcagatgtactttaaagagaaatattagcttaactcttttgacatctgctattgtgacacatcccattgctggcaatgtggtgcacactccgaaacttttaactactgttttgtaagcctccaagggtggcattgcagggtccttaggcaatgttttgtttgcctttatgcagagaggtgctccaagtgctgtgattgagcaccgtgctagaggaactgtaatgcttcagaagttgtagcttatacaaaggaaacaggtcctgctggcttaatttaaacagttattgcatgaagtagcgtggaggccctggactgctgctcgttctttaggatggactgttctggtatctggtattggtttagagactgttaataagggacatcacaaggtgatgggattcatttgaagcactctatttctgttttaatggttttatccaattttgccttcccaagatttttgttctacataaaaagttcatgccactttttaatataaaaaaatttaacaaaattaa

SEQ ID NO: 355832 - DNA, 3496 bp, Homo sapiens
agacgactgtctgagagaggggccgctacgccgcacagcaaacaagctccgcgacgtttccaggacccggataatcccgcccttagagcagagccggaagaaggcgggacgaaccggaagagggtgaaatgctttcggtaggcactccacggctgtgaagatggcggcggctgcgtggcttcaggtgttgcctgtcattcttctgcttctgggagctcacccgtcaccactgtcgtttttcagtgcgggaccggcaaccgtagctgctgccgaccggtccaaatggcacattccgataccgtcggtgagtattcacttcactaacgtctgaacctagaggagcaaggggtggggctacggcggcccaaggggtccatgaaggttccgcaaaagtctcttcaaaaggggtggggttgctgggatggtctgtgtggctagccaactgggacccacctccctggagtggaaagccgcgcacttctgtgattaggctagcgggaatgtaagggccacttcagcaacagaaaggagtggtggagcggcttctcatcagaaaaacagaactttcagtgcctgacttgagatgtaaacttgatgtacaaacggagagttgtttatctttcagatgtttcacagaatccagtgtccccgggttggataagaaagatatgggaaaaattattttagttttggaaagatcctcttcagaaataccactatcttcctgaagtttgatggagaaccttgtgacctgtctttgaatataacctggtatctgaaaagcgctgattgttacaatgaaatctataacttcaaggcagaagaagtagagttgtatttggaaaaacttaaggaaaaaagaggcttgtctgggaaatatcaaacatcatcaaaattgttccagaactgcagtgaactctttaaaacacagactaggaggattggttggtcttttcttggatttgattatggaaagctacctgatgcatctggttgctggaggctgactacttttagatgtgctgtaatctttccagggtcttggcttattgaccttttctggagattttatgcatcgactgcctcttttaggagaaaaacaggaggctaaggagaatggaacaaaccttacctttattggagacaaaaccgcaatgcatgaaccattgcaaacttggcaagatgcaccatacatttttattgtacatattggcatttcatcctcaaaggaatcatcaaaagaaaattcactgagtaatctttttaccatgactgttgaagtgaagggtccctatgaatacctcacacttgaagactatcccttgatgatttttttcatggtgatgtgtattgtatatgtcctgtttggtgttctgtggctggcatggtctgcctgctactggagagatctcctgagaattcagttttggattggtgctgtcatcttcctgggaatgcttgagaaagctgtcttctatgcggaatttcagaatatccgatacaaaggagaatctgtccagggtgctttgatccttgcagagctgctttcagcagtgaaacgctcactggctcgaaccctggtcatcatagtcagtctgggatatggcatcgtcaagccacgccttggagtcactcttcataaggttgtagtagcaggagccctctatcttttgttctctggcatggaaggggtcctcagagttactggggcccagactgatcttgcttccttggcctttatccccttggctttcctagacactgccttgtgctggtggatatttattagcctgactcaaacaatgaagctattaaaacttcggaggaacattgtaaaactctctttgtatcggcatttcaccaacacgcttattttggcagtggcagcatccattgtgtttatcatctggacaaccatgaagttcagaatagtgacatgtcagtcggactggcgggagctgtgggtagacgatgccatctggcgcttgctgttctccatgatcctctttgtcatcatggttctctggcgaccatctgcaaacaaccagaggtttgccttttcaccattgtctgaggaagaggaggaggatgaacaaaaggagcctatgctgaaagaaagctttgaaggaatgaaaatgagaagtaccaaacaagaacccaatggaaatagtaaagttaacaaagcacaggaagatgatttgaagtgggtagaagagaatgttccttcttctgtgacagatgtagcacttccagcccttctggattcagatgaggaacgaatgatcacacactttgaaaggtccaaaatggagtaaggaatgggaagatttgcagttaaagatggctaccatcagggaagagatcagcatctgtgtcagtcttctgtacggctccatgggattaaaggaagcaatgacatcctgatctgttccttgatctttgggcattggagttggcgagaggtgtcagaacaaagagaacatcttactgaaaacaagttcataagatgagaaaaatctacgagcttcttatttacaacactgctgccccctttcctcccagactctgacatggatgttcatgcaacttaagtgtgttgttcctgaactttctgtaatgtttcattttttaaatctgacaaactaaaaagtttaacgtcttctaaaagattgtcatcaacaccataatatgtaatctccaggagcaactgcctgtaatttttatttatttagggagttacataggtgatgggggaaattgttaactacctttcattttcctgggaagtcaaggttacatcttgcagaggttgttttgagaaaaaagggcccttctgagttaaggagccatagttctatcaatgatcaaaagaaaaaaaaaaaaaagagaaactgttacagtatgattcagatcatttaaaaaagcaaaatcaagtgcaattttgtttacaaatggtgtatattaaagatttttctatttcagatgtactttaaagagaaatattagcttaactcttttgacatctgctattgtgacacatcccattgctggcaatgtggtgcacactccgaaacttttaactactgttttgtaagcctccaagggtggcattgcagggtccttaggcaatgttttgtttgcctttatgcagagaggtgctccaagtgctgtgattgagcaccgtgctagaggaactgtaatgcttcagaagttgtagcttatacaaaggaaacaggtcctgctggcttaatttaaacagttattgcatgaagtagcgtggaggccctggactgctgctcgttctttaggatggactgttctggtatctggtattggtttagagactgttaataagggacatcacaaggtgatgggattcatttgaagcactctatttctgttttaatggttttatccaattttgccttcccaagatttttgttctacataaaaagttcatgccactttttaatataaaaaaatttaacaaaattaa

SEQ ID NO: 355833 - DNA, 3321 bp, Homo sapiens
  misc_feature (3024)..(3024): n is a, c, g, or t
  misc_feature (3026)..(3026): n is a, c, g, or t
agacgactgtctgagagaggggccgctacgccgcacagcaaacaagctccgcgacgtttccaggacccggataatcccgcccttagagcagagccggaagaaggcgggacgaaccggaagagggtgaaatgctttcggtaggcactccacggctgtgaagatggcggcggctgcgtggcttcaggtgttgcctgtcattcttctgcttctgggagctcacccgtcaccactgtcgtttttcagtgcgggaccggcaaccgtagctgctgccgaccggtccaaatggcacattccgataccgtcggggaaaaattattttagttttggaaagatcctcttcagaaataccactatcttcctgaagtttgatggagaaccttgtgacctgtctttgaatataacctggtatctgaaaagcgctgattgttacaatgaaatctataacttcaaggcagaagaagtagagttgtatttggaaaaacttaaggaaaaaagaggcttgtctgggaaatatcaaacatcatcaaaattgttccagaactgcagtgaactctttaaaacacagaccttttctggagattttatgcatcgactgcctcttttaggagaaaaacaggaggctaaggagaatggaacaaaccttacctttattggagacaaaaccgcaatgcatgaaccattgcaaacttggcaagatgcaccatacatttttattgtacatattggcatttcatcctcaaaggaatcatcaaaagaaaattcactgagtaatctttttaccatgactgttgaagtgaagggtccctatgaatacctcacacttgaagactatcccttgatgatttttttcatggtgatgtgtattgtatatgtcctgtttggtgttctgtggctggcatggtctgcctgctactggagagatctcctgagaattcagttttggattggtgctgtcatcttcctgggaatgcttgagaaagctgtcttctatgcggaatttcagaatatccgatacaaaggagaatctgtccagggtgctttgatccttgcagagctgctttcagcagtgaaacgctcactggctcgaaccctggtcatcatagtcagtctgggatatggcatcgtcaagccacgccttggagtcactcttcataaggttgtagtagcaggagccctctatcttttgttctctggcatggaaggggtcctcagagttactggggcccagactgatcttgcttccttggcctttatccccttggctttcctagacactgccttgtgctggtggatatttattagcctgactcaaacaatgaagctattaaaacttcggaggaacattgtaaaactctctttgtatcggcatttcaccaacacgcttattttggcagtggcagcatccattgtgtttatcatctggacaaccatgaagttcagaatagtgacatgtcagtcggactggcgggagctgtgggtagacgatgccatctggcgcttgctgttctccatgatcctctttgtcatcatggttctctggcgaccatctgcaaacaaccagaggtttgccttttcaccattgtctgaggaagaggaggaggatgaacaaaaggagcctatgctgaaagaaagctttgaaggaatgaaaatgagaagtaccaaacaagaacccaatggaaatagtaaagttaacaaagcacaggaagatgatttgaagtgggtagaagagaatgttccttcttctgtgacagatgtagcacttccagcccttctggattcagatgaggaacgaatgatcacacactttgaaaggtccaaaatggagtaaggaatgggaagatttgcagttaaagatggctaccatcagggaagagatcagcatctgtgtcagtcttctgtacggctccatgggattaaaggaagcaatgacatcctgatctgttccttgatctttgggcattggagttggcgagaggtgtcagaacaaagagaacatcttactgaaaacaagttcataagatgagaaaaatctacgagcttcttatttacaacactgctgccccctttcctcccagactctgacatggatgttcatgcaacttaagtgtgttgttcctgaactttctgtaatgtttcattttttaaatctgacaaactaaaaagtttaacgtcttctaaaagattgtcatcaacaccataatatgtaatctccaggagcaactgcctgtaatttttatttatttagggagttacataggtgatgggggaaattgttaactacctttcattttcctgggaagtcaaggttacatcttgcagaggttgttttgagaaaaaagggcccttctgagttaaggagccatagttctatcaatgatcaaaagaaaaaaaaaaaaaagagaaactgttacagtatgattcagatcatttaaaaaagcaaaatcaagtgcaattttgtttacaaatggtgtatattaaagatttttctatttcagatgtactttaaagagaaatattagcttaactcttttgacatctgctattgtgacacatcccattgctggcaatgtggtgcacactccgaaacttttaactactgttttgtaagcctccaagggtggcattgcagggtccttaggcaatgttttgtttgcctttatgcagagaggtgctccaagtgctgtgattgagcaccgtgctagaggaactgtaatgcttcagaagttgtagcttatacaaaggaaacaggtcctgctggcttaatttaaacagttattgcatgaagtagcgtggaggccctggactgctgctcgttctttaggatggactgttctggtatctggtattggtttagagactgttaataagggacatcacaaggtgatgggattcatttgaagcactctatttctgttttaatggttttatccaattttgccttcccaagatttttgttctacataaaaagttcatgccactttttaatataaaaaaatttaacaaaattaaaaaaaaaaaaaaaananaaaaagagagacgagaaaaaaaaaaggggggggggggcggcaagagagtcccccggggggggccaggtagggggcccgagctttttgggaaaaggggggccacaaagagagaacaaataaaaacgcaacagggccaggataaaaaacgggaaggggaaacaggcacggggaactgggagaggccactaaacggggggggacaaaatgggaaaacacacaaaataaaaccccgggaaataaaataaaggaaggggcaaaccagaaaaagaggtaaaaatgaaaaaataaagaaata

SEQ ID NO: 355834 - DNA, 2306 bp, Homo sapiens
tattcttcattcatatcttctgcctcaaagagcctgccagaatggaaaagggaggctaactcaattaatcagtaattgattatgtatcacctgggtgcctggcactctgctgaactctagtgagtacagaggagtgttcccataggtgccagggagctggagaagggagcaggttagaggaaggacatcagcctatctggagcagagacctattaacttaggtatcagataagtagggtggggctaagtggaacactgggaaatctaggcctgccctgtgtgactacattctttttcctgtaagagtcagccttttgagaatctgtccagggtgctttgatccttgcagagctgctttcagcagtgaaacgctcactggctcgaaccctggtcatcatagtcagtctgggatatggcatcgtcaagccacgccttggagtcactcttcataaggttgtagtagcaggagccctctatcttttgttctctggcatggaaggggtcctcagagttactggggcccagactgatcttgcttccttggcctttatccccttggctttcctagacactgccttgtgctggtggatatttattagcctgactcaaacaatgaagctattaaaacttcggaggaacattgtaaaactctctttgtatcggcatttcaccaacacgcttattttggcagtggcagcatccattgtgtttatcatctggacaaccatgaagttcagaatagtgacatgtcagtcggactggcgggagctgtgggtagacgatgccatctggcgcttgctgttctccatgatcctctttgtcatcatggttctctggcgaccatctgcaaacaaccagaggtttgccttttcaccattgtctgaggaagaggaggaggatgaacaaaaggagcctatgctgaaagaaagctttgaaggaatgaaaatgagaagtaccaaacaagaacccaatggaaatagtaaagttaacaaagcacaggaagatgatttgaagtgggtagaagagaatgttccttcttctgtgacagatgtagcacttccagcccttctggattcagatgaggaacgaatgatcacacactttgaaaggtccaaaatggagtaaggaatgggaagatttgcagttaaagatggctaccatcagggaagagatcagcatctgtgtcagtcttctgtacggctccatgggattaaaggaagcaatgacatcctgatctgttccttgatctttgggcattggagttggcgagaggtgtcagaacaaagagaacatcttactgaaaacaagttcataagatgagaaaaatctacgagcttcttatttacaacactgctgccccctttcctcccagactctgacatggatgttcatgcaacttaagtgtgttgttcctgaactttctgtaatgtttcattttttaaatctgacaaactaaaaagtttaacgtcttctaaaagattgtcatcaacaccataatatgtaatctccaggagcaactgcctgtaatttttatttatttagggagttacataggtgatgggggaaattgttaactacctttcattttcctgggaagtcaaggttacatcttgcagaggttgttttgagaaaaaagggcccttctgagttaaggagccatagttctatcaatgatcaaaagaaaaaaaaaaaaaagagaaactgttacagtatgattcagatcatttaaaaaagcaaaatcaagtgcaattttgtttacaaatggtgtatattaaagatttttctatttcagatgtactttaaagagaaatattagcttaactcttttgacatctgctattgtgacacatcccattgctggcaatgtggtgcacactccgaaacttttaactactgttttgtaagcctccaagggtggcattgcagggtccttaggcaatgttttgtttgcctttatgcagagaggtgctccaagtgctgtgattgagcaccgtgctagaggaactgtaatgcttcagaagttgtagcttatacaaaggaaacaggtcctgctggcttaatttaaacagttattgcatgaagtagcgtggaggccctggactgctgctcgttctttaggatggactgttctggtatctggtattggtttagagactgttaataagggacatcacaaggtgatgggattcatttgaagcactctatttctgttttaatggttttatccaattttgccttcccaagatttttgttctacataaaaagttcatgccactttttaatataaaaaaatttaacaaaattaa

SEQ ID NO: 355835 - DNA, 2541 bp, Homo sapiens
agacgactgtctgagagaggggccgctacgccgcacagcaaacaagctccgcgacgtttccaggacccggataatcccgcccttagagcagagccggaagaaggcgggacgaaccggaagagggtgaaatgctttcggtaggcactccacggctgtgaagatggcggcggctgcgtggcttcaggtgttgcctgtcattcttctgcttctgggagctcacccgtcaccactgtcgtttttcagtgcgggaccggcaaccgtagctgctgccgaccggtccaaatggcacattccgataccgtcggggaaaaattattttagttttggaaagatcctcttcagaaataccactatcttcctgaagtttgatggagaaccttgtgacctgtctttgaatataacctggtatctgaaaagcgctgattgttacaatgaaatctataacttcaaggcagaagaagtagagttgtatttggaaaaacttaaggaaaaaagaggcttgtctgggaaatatcaaacatcatcaaaattgttccagaactgcagtgaactctttaaaacacagaccttttctggagattttatgcatcgactgcctcttttaggagaaaaacaggaggctaaggagaatggaacaaaccttacctttattggagacaaaaccgcaatgcatgaaccattgcaaacttggcaagatgcaccatacatttttattgtacatattggcatttcatcctcaaaggaatcatcaaaagaaaattcactgagtaatctttttaccatgactgttgaagtgaagggtccctatgaatacctcacacttgaagactatcccttgatgatttttttcatggtgatgtgtattgtatatgtcctgtttggtgttctgtggctggcatggtctgcctgctactggagagatctcctgagaattcagttttggattggtgctgtcatcttcctgggaatgcttgagaaagctgtcttctatgcggaatttcagaatatccgatacaaaggagaatctgtccagggtgctttgatccttgcagagctgctttcagcagtgaaacgctcactggctcgaaccctggtcatcatagtcagtctgggatatggcatcgtcaagccacgccttggagtcactcttcataaggttgtagtagcaggagccctctatcttttgttctctggcatggaaggggtcctcagagttactggggcccagactgatcttgcttccttggcctttatccccttggctttcctagacactgccttgtgctggtggatatttattagcctgactcaaacaatgaagctattaaaacttcggaggaacattgtaaaactctctttgtatcggcatttcaccaacacgcttattttggcagtggcagcatccattgtgtttatcatctggacaaccatgaagttcagaatagtgacatgtcagtcggactggcgggagctgtgggtagacgatgccatctggcgcttgctgttctccatgatcctctttgtcatcatggttctctggcgaccatctgcaaacaaccagaggtttgccttttcaccattgtctgaggaagaggaggaggatgaacaaaaggagcctatgctgaaagaaagctttgaaggaatgaaaatgagaagtaccaaacaagaacccaatggaaatagtaaagttaacaaagcacaggaagatgatttgaagtgggtagaagagaatgttccttcttctgtgacagatgtagcacttccagcccttctggattcagatgaggaacgaatgatcacacactttgaaaggtccaaaatggagtaaggaatgggaagatttgcagttaaagatggctaccatcagggaagagatcagcatctgtgtcagtcttctgtacggctccatgggattaaaggaagcaatgacatcctgatctgttccttgatctttgggcattggagttggcgagaggtgtcagaacaaagagaacatcttactgaaaacaagttcataagatgagaaaaatctacgagcttcttatttacaacactgctgccccctttcctcccagactctgacatggatgttcatgcaacttaagtgtgttgttcctgaactttctgtaatgtttcattttttaaatctgacaaactaaaaagtttaacgtcttctaaaagattgtcatcaacaccataatatgtaatctccaggagcaactgcctgtaatttttatttatttagggagttacataggtgatgggggaaattgttaactacctttcattttcctgggaagtcaaggttacatcttgcagaggttgttttgagaaaaaagggcccttctgagttaaggagccatagttctatcaatgatcaaaagaaaaaaaaaaaactcgaggtcgacggttccataagcttgtatttaaattcgcagctttcttacgggaagggaaaactttattcttaaaaagtggccccctaaaggttgttggcctttccccccccaaaaatttttttttacaaaaccaaaaaaaagg

SEQ ID NO: 355836 - DNA, 2514 bp, Homo sapiens
  misc_feature (2400)..(2400): n is a, c, g, or t
  misc_feature (2402)..(2402): n is a, c, g, or t
agacgactgtctgagagaggggccgctacgccgcacagcaaacaagctccgcgacgtttccaggacccggataatcccgcccttagagcagagccggaagaaggcgggacgaaccggaagagggtgaaatgctttcggtaggcactccacggctgtgaagatggcggcggctgcgtggcttcaggtgttgcctgtcattcttctgcttctgggagctcacccgtcaccactgtcgtttttcagtgcgggaccggcaaccgtagctgctgccgaccggtccaaatggcacattccgataccgtcggggaaaaattattttagttttggaaagatcctcttcagaaataccactatcttcctgaagtttgatggagaaccttgtgacctgtctttgaatataacctggtatctgaaaagcgctgattgttacaatgaaatctataacttcaaggcagaagaagtagagttgtatttggaaaaacttaaggaaaaaagaggcttgtctgggaaatatcaaacatcatcaaaattgttccagaactgcagtgaactctttaaaacacagaccttttctggagattttatgcatcgactgcctcttttaggagaaaaacaggaggctaaggagaatggaacaaaccttacctttattggagacaaaaccgcaatgcatgaaccattgcaaacttggcaagatgcaccatacatttttattgtacatattggcatttcatcctcaaaggaatcatcaaaagaaaattcactgagtaatctttttaccatgactgttgaagtgaagggtccctatgaatacctcacacttgaagactatcccttgatgatttttttcatggtgatgtgtattgtatatgtcctgtttggtgttctgtggctggcatggtctgcctgctactggagagatctcctgagaattcagttttggattggtgctgtcatcttcctgggaatgcttgagaaagctgtcttctatgcggaatttcagaatatccgatacaaaggagaatctgtccagggtgctttgatccttgcagagctgctttcagcagtgaaacgctcactggctcgaaccctggtcatcatagtcagtctgggatatggcatcgtcaagccacgccttggagtcactcttcataaggttgtagtagcaggagccctctatcttttgttctctggcatggaaggggtcctcagagttactggggcccagactgatcttgcttccttggcctttatccccttggctttcctagacactgccttgtgctggtggatatttattagcctgactcaaacaatgaagctattaaaacttcggaggaacattgtaaaactctctttgtatcggcatttcaccaacacgcttattttggcagtggcagcatccattgtgtttatcatctggacaaccatgaagttcagaatagtgacatgtcagtcggactggcgggagctgtgggtagacgatgccatctggcgcttgctgttctccatgatcctctttgtcatcatggttctctggcgaccatctgcaaacaaccagaggtttgccttttcaccattgtctgaggaagaggaggaggatgaacaaaaggagcctatgctgaaagaaagctttgaaggaatgaaaatgagaagtaccaaacaagaacccaatggaaatagtaaagttaacaaagcacaggaagatgatttgaagtgggtagaagagaatgttccttcttctgtgacagatgtagcacttccagcccttctggattcagatgaggaacgaatgatcacacactttgaaaggtccaaaatggagtaaggaatgggaagatttgcagttaaagatggctaccatcagggaagagatcagcatctgtgtcagtcttctgtacggctccatgggattaaaggaagcaatgacatcctgatctgttccttgatctttgggcattggagttggcgagaggtgtcagaacaaagagaacatcttactgaaaacaagttcataagatgagaaaaatctacgagcttcttatttacaacactgctgccccctttcctcccagactctgacatggatgttcatgcaacttaagtgtgttgttcctgaactttctgtaatgtttcattttttaaatctgacaaactaaaaagtttaacgtcttctaaaagattgtcatcaacaccataatatgtaatctccaggagcaactgcctgtaatttttatttatttagggagttacataggtgatgggggaaattgttaactacctttcattttcctgggaagtcaaggttacatcttgcagaggttgttttgagaaaaaagggcccttctgagttaaggagccatagttctatcaatgatcaaaagaaaaaaaaaaaaaaananaaaaaaaaaattctcttttcctcaaattaaaaaagaggaagagtttttacagagattataaactatttcagggcttagttacctctaattaaacctttctgcgttacaagaa

SEQ ID NO: 355837 - DNA, 1679 bp, Homo sapiens
tacatgatttttaaaaagtgtagtaaaaaacacataacaaatcaaccctcctaaccattctaaagtgcaaagtgctaactaggtgcacgtctttgccctcatccttcactgggtcttcaagtgaaattcctgaattagaggagttacacatttttattaaagcctaatcttatgtaaatatttgtttacataagatcttagctgactctatacatttccttctgagtgctgattttctgtccagaagcctagagcttttgatttagttgttcttgggtgaggtctggacatctgtatgttcaaaatcttcacaaatgtttaggaaccatttctctaaacatttaattaacataaagtactcgtggaagatgtttgcttggatagtctgtatagaagatatttggaatatagatcattttaacctaatatacttcaaccttttttttttttccctaggaacgaatgatcacacactttgaaaggtccaaaatggagtaaggaatgggaagatttgcagttaaagatggctaccatcagggaagagatcagcatctgtgtcagtcttctgtacggctccatgggattaaaggaagcaatgacatcctgatctgttccttgatctttgggcattggagttggcgagaggtgtcagaacaaagagaacatcttactgaaaacaagttcataagatgagaaaaatctacgagcttcttatttacaacactgctgccccctttcctcccagactctgacatggatgttcatgcaacttaagtgtgttgttcctgaactttctgtaatgtttcattttttaaatctgacaaactaaaaagtttaacgtcttctaaaagattgtcatcaacaccataatatgtaatctccaggagcaactgcctgtaatttttatttatttagggagttacataggtgatgggggaaattgttaactacctttcattttcctgggaagtcaaggttacatcttgcagaggttgttttgagaaaaaagggcccttctgagttaaggagccatagttctatcaatgatcaaaagaaaaaaaaaaaaaagagaaactgttacagtatgattcagatcatttaaaaaagcaaaatcaagtgcaattttgtttacaaatggtgtatattaaagatttttctatttcagatgtactttaaagagaaatattagcttaactcttttgacatctgctattgtgacacatcccattgctggcaatgtggtgcacactccgaaacttttaactactgttttgtaagcctccaagggtggcattgcagggtccttaggcaatgttttgtttgcctttatgcagagaggtgctccaagtgctgtgattgagcaccgtgctagaggaactgtaatgcttcagaagttgtagcttatacaaaggaaacaggtcctgctggcttaatttaaacagttattgcatgaagtagcgtggaggccctggactgctgctcgttctttaggatggactgttctggtatctggtattggtttagagactgttaataagggacatcacaaggtgatgggattcatttgaagcactctatttctgttttaatggttttatccaattttgccttcccaagatttttgttctacataaaaagttcatgccactttttaatataaaaaaatttaacaaaattaa

SEQ ID NO: 355838 - DNA, 1295 bp, Homo sapiens
  misc_feature (49)..(49): n is a, c, g, or t
cctcgcatctcatccattgtatcctccatattctacttctccacccccntcctcgtcgcgcttctaggtctagaacgaatgatcacacactttgaaaggtccaaaatggagtaaggaatgggaagatttgcagttaaagatggctaccatcagggaagagatcagcatctgtgtcagtcttctgtacggctccatgggattaaaggaagcaatgacatcctgatctgttccttgatctttgggcattggagttggcgagaggtgtcagaacaaagagaacatcttactgaaaacaagttcataagatgagaaaaatctacgagcttcttatttacaacactgctgccccctttcctcccagactctgacatggatgttcatgcaacttaagtgtgttgttcctgaactttctgtaatgtttcattttttaaatctgacaaactaaaaagtttaacgtcttctaaaagattgtcatcaacaccataatatgtaatctccaggagcaactgcctgtaatttttatttatttagggagttacataggtgatgggggaaattgttaactacctttcattttcctgggaagtcaaggttacatcttgcagaggttgttttgagaaaaaagggcccttctgagttaaggagccatagttctatcaatgatcaaaagaaaaaaaaaaaaaagagaaactgttacagtatgattcagatcatttaaaaaagcaaaatcaagtgcaattttgtttacaaatggtgtatattaaagatttttctatttcagatgtactttaaagagaaatattagcttaactcttttgacatctgctattgtgacacatcccattgctggcaatgtggtgcacactccgaaacttttaactactgttttgtaagcctccaagggtggcattgcagggtccttaggcaatgttttgtttgcctttatgcagagaggtgctccaagtgctgtgattgagcaccgtgctagaggaactgtaatgcttcagaagttgtagcttatacaaaggaaacaggtcctgctggcttaatttaaacagttattgcatgaagtagcgtggaggccctggactgctgctcgttctttaggatggactgttctggtatctggtattggtttagagactgttaataagggacatcacaaggtgatgggattcatttgaagcactctatttctgttttaatggttttatccaattttgccttcccaagatttttgttctacataaaaagttcatgccactttttaatataaaaaaatttaacaaaattaa

SEQ ID NO: 355839 - DNA, 914 bp, Homo sapiens
atctgtgcttcaaaccattccctacagaaaccattccctcaggtaacctcttacaaagttggaacattttcacagtccatctctcctccctagggaaaagctaggatttggggatgttggggattctacctgcttactctgcactgagctgggggagcggctgtagtgagctcatgcttgctagtccaaacttccactttgatttcagcaacttccaacctgggccctttgtttttagctctcggactcaggcaagacagaaaacagtctctcgtgcaggttccagaaaaaaaaaaaaaaaaagagaaactgttacagtatgattcagatcatttaaaaaagcaaaatcaagtgcaattttgtttacaaatggtgtatattaaagatttttctatttcagatgtactttaaagagaaatattagcttaactcttttgacatctgctattgtgacacatcccattgctggcaatgtggtgcacactccgaaacttttaactactgttttgtaagcctccaagggtggcattgcagggtccttaggcaatgttttgtttgcctttatgcagagaggtgctccaagtgctgtgattgagcaccgtgctagaggaactgtaatgcttcagaagttgtagcttatacaaaggaaacaggtcctgctggcttaatttaaacagttattgcatgaagtagcgtggaggccctggactgctgctcgttctttaggatggactgttctggtatctggtattggtttagagactgttaataagggacatcacaaggtgatgggattcatttgaagcactctatttctgttttaatggttttatccaattttgccttcccaagatttttgttctacataaaaagttcatgccactttttaatataaaaaaatttaacaaaattaa

SEQ ID NO: 355840 - DNA, 2052 bp, Homo sapiens
  misc_feature (1928)..(1928): n is a, c, g, or t
  misc_feature (1949)..(1949): n is a, c, g, or t
  misc_feature (1957)..(1957): n is a, c, g, or t
  misc_feature (1964)..(1964): n is a, c, g, or t
agacgactgtctgagagaggggccgctacgccgcacagcaaacaagctccgcgacgtttccaggacccggataatcccgcccttagagcagagccggaagaaggcgggacgaaccggaagagggtgaaatgctttcggtaggcactccacggctgtgaagatggcggcggctgcgtggcttcaggtgttgcctgtcattcttctgcttctgggagctcacccgtcaccactgtcgtttttcagtgcgggaccggcaaccgtagctgctgccgaccggtccaaatggcacattccgataccgtcggggaaaaattattttagttttggaaagatcctcttcagaaataccactatcttcctgaagtttgatggagaaccttgtgacctgtctttgaatataacctggtatctgaaaagcgctgattgttacaatgaaatctataacttcaaggcagaagaagtagagttgtatttggaaaaacttaaggaaaaaagaggcttgtctgggaaatatcaaacatcatcaaaattgttccagaactgcagtgaactctttaaaacacagaccttttctggagattttatgcatcgactgcctcttttaggagaaaaacaggaggctaaggagaatggaacaaaccttacctttattggagacaaaaccgcaatgcatgaaccattgcaaacttggcaagatgcaccatacatttttattgtacatattggcatttcatcctcaaaggaatcatcaaaagaaaattcactgagtaatctttttaccatgactgttgaagtgaagggtccctatgaatacctcacacttgaagactatcccttgatgatttttttcatggtgatgtgtattgtatatgtcctgtttggtgttctgtggctggcatggtctgcctgctactggagagatctcctgagaattcagttttggattggtgctgtcatcttcctgggaatgcttgagaaagctgtcttctatgcggaatttcagaatatccgatacaaaggagaatctgtccagggtgctttgatccttgcagagctgctttcagcagtgaaacgctcactggctcgaaccctggtcatcatagtcagtctgggatatggcatcgtcaagccacgccttggagtcactcttcataaggttgtagtagcaggagccctctatcttttgttctctggcatggaaggggtcctcagagttactggggcccagactgatcttgcttccttggcctttatccccttggctttcctagacactgccttgtgctggtggatatttattagcctgactcaaacaatgaagctattaaaacttcggaggaacattgtaaaactctctttgtatcggcatttcaccaacacgcttattttggcagtggcagcatccattgtgtttatcatctggacaaccatgaagttcagaatagtgacatgtcagtcggactggcgggagctgtgggtagacgatgccatctggcgcttgctgttctccatgatcctctttgtcatcatggttctctggcgaccatctgcaaacaaccagaggtttgccttttcaccattgtctgaggaagaggaggaggatgaacaaaaggagcctatgctgaaagaaagctttgaaggaatgaaaatgagaagtaccaaacaagaacccaatggaaatagtaaagttaacaaagcacaggaagatgatttgaagtgggtagaagagaatgttccttcttctgtgacagatgtagcacttccagcccttctggattcagatgaggaacgaatgatcacacactttgaaaggtccaaaatggagtaaggaatgggaagatttgcagttaaagatggctaccatcagggaagagatcagcatctgtgtcaggatggataagttctgaagatctattgaatagcatggngactacagtgaataatgtttngtgtattngaaaatngctaggagagtggatcttaaatggtctccccacaaaaatgacaagtatgtgaggtgacagatatgttaatgagcttgatttaatcact

SEQ ID NO: 355841 - DNA, 2042 bp, Homo sapiens
agacgactgtctgagagaggggccgctacgccgcacagcaaacaagctccgcgacgtttccaggacccggataatcccgcccttagagcagagccggaagaaggcgggacgaaccggaagagggtgaaatgctttcggtaggcactccacggctgtgaagatggcggcggctgcgtggcttcaggtgttgcctgtcattcttctgcttctgggagctcacccgtcaccactgtcgtttttcagtgcgggaccggcaaccgtagctgctgccgaccggtccaaatggcacattccgataccgtcggggaaaaattattttagttttggaaagatcctcttcagaaataccactatcttcctgaagtttgatggagaaccttgtgacctgtctttgaatataacctggtatctgaaaagcgctgattgttacaatgaaatctataacttcaaggcagaagaagtagagttgtatttggaaaaacttaaggaaaaaagaggcttgtctgggaaatatcaaacatcatcaaaattgttccagaactgcagtgaactctttaaaacacagaccttttctggagattttatgcatcgactgcctcttttaggagaaaaacaggaggctaaggagaatggaacaaaccttacctttattggagacaaaaccgcaatgcatgaaccattgcaaacttggcaagatgcaccatacatttttattgtacatattggcatttcatcctcaaaggaatcatcaaaagaaaattcactgagtaatctttttaccatgactgttgaagtgaagggtccctatgaatacctcacacttgaagactatcccttgatgatttttttcatggtgatgtgtattgtatatgtcctgtttggtgttctgtggctggcatggtctgcctgctactggagagatctcctgagaattcagttttggattggtgctgtcatcttcctgggaatgcttgagaaagctgtcttctatgcggaatttcagaatatccgatacaaaggagaatctgtccagggtgctttgatccttgcagagctgctttcagcagtgaaacgctcactggctcgaaccctggtcatcatagtcagtctgggatatggcatcgtcaagccacgccttggagtcactcttcataaggttgtagtagcaggagccctctatcttttgttctctggcatggaaggggtcctcagagttactggggcccagactgatcttgcttccttggcctttatccccttggctttcctagacactgccttgtgctggtggatatttattagcctgactcaaacaatgaagctattaaaacttcggaggaacattgtaaaactctctttgtatcggcatttcaccaacacgcttattttggcagtggcagcatccattgtgtttatcatctggacaaccatgaagttcagaatagtgacatgtcagtcggactggcgggagctgtgggtagacgatgccatctggcgcttgctgttctccatgatcctctttgtcatcatggttctctggcgaccatctgcaaacaaccagaggttcttggactcttctgtttactctgctaacatgagatgaccatgtcatcaattaggggtggtgcattgggggacagtatcagggctgtgtcatatagtggaaggaacactgggcctggaatcagaagaactgggttcctatctcagctctcctcttaacttcatgatttttggcatgcggcctctccacctctctggccttagtttcctttctatatactgagggggaattaaacccagcaacatgaagttcctttcagctctgacattttgtgataaatacacaggcatactatggaaataaattgcaagtttggtttcagaccatcacgataaagcagatattgagttacatacatattttgttttttccagtgcatatcaaagttatgtttacactattctgtagtctactatgtgtgcaatagcattatgtctaaaaaatatatgcacgttaatttaaaaacactttattgcca

SEQ ID NO: 355842 - DNA, 3702 bp, Homo sapiens
  misc_feature (1503)..(1503): n is a, c, g, or t
  misc_feature (1541)..(1541): n is a, c, g, or t
  misc_feature (2819)..(2819): n is a, c, g, or t
  misc_feature (3418)..(3418): n is a, c, g, or t
agacgactgtctgagagaggggccgctacgccgcacagcaaacaagctccgcgacgtttccaggacccggataatcccgcccttagagcagagccggaagaaggcgggacgaaccggaagagggtgaaatgctttcggtaggcactccacggctgtgaagatggcggcggctgcgtggcttcaggtgttgcctgtcattcttctgcttctgggagctcacccgtcaccactgtcgtttttcagtgcgggaccggcaaccgtagctgctgccgaccggtccaaatggcacattccgataccgtcggggaaaaattattttagttttggaaagatcctcttcagaaataccactatcttcctgaagtttgatggagaaccttgtgacctgtctttgaatataacctggtatctgaaaagcgctgattgttacaatgaaatctataacttcaaggcagaagaagtagagttgtatttggaaaaacttaaggaaaaaagaggcttgtctgggaaatatcaaacatcatcaaaattgttccagaactgcagtgaactctttaaaacacagaccttttctggagattttatgcatcgactgcctcttttaggagaaaaacaggaggctaaggagaatggaacaaaccttacctttattggagacaaaaccattcagatgcctttcttgaagaaacatttcttggattgttgaaagactttaataatttccaaagttccaaaagttgattttgatagtttttgccagtgttttcgttgcttttatggatgagtagattttcagagtttcttattctgccattctgaaagtgtctcactacctaaaccccagttttatttgtacagaattttaactgaatgtaagttaggcatgacagtctttgttaatttttttaaacaaaagatagccattaggactgggtacagtggctcacgcctgtaatgccaacactttgggaggccaaggtgggcagatgacttgaggttgggagttcgagaccagcttggccaatgtggtgaaactttgtctttactaaaaatacaaaaattagttgctcatggtggcaggcacctgtaatccaagctactcaggaggctgaggcaggagaatcgcgtgaacttgggaggtggaggctgcagtgagctgagatcacgctactgcactccagcctgggcagccagtgagattccatctcaaaaaaaaaagaaaaaagatattcattggattttctcttactaataggtatatattcactgtgaaaatggagacgatatacataaatgaaaagaagaaaatagtaatctataataccatgcagtgatatatttatcttcctattcttttgtatatgggcatgtttatattattttaaaaagggaatcttagagtatgtattatatgacttttttttgtagcttagcaatataacatggacatgtcgtcagtttggtaaatattgtattgcatcgttacttaaatgcttgtatagngtcttattgtatgagtacattgcaatttgttcaattcnctgttcttgaacttttatgagtttcattatcttggaattttatgcagtgttgtgattaatattttaactacatttgcttttaagtctttattttctgatctcagaagaattgtatattgggataagtttttaattctataacttaaaagtaaaaatcctttgtaattttatgttctaatagttttagcagtttggtgtgattacacagagcacatgcatattaaccaaaataagatcatattatataccattgtataattttttctttttattaccaaattggtacattgaatactacttcacctttttatggctgcttagtgttccattttattatgattttaataactcccaattgatgaacattggggttgttcccaaatttcccctattatgggtaaagttatgttcataatgtctagctatatttctgtgtacatttataatctttaggctaaattcctggaggtagaattgctagatccacatgtatgcacagtttaaaggtgctttttcatagcaatttatggccccaagaaagtgagagtgagtgtctttgtttatgttgctatgaaaggacacctggagctgggtaatttataaagaaaagaggtttatttggctcactgttctgtgggctatgaaagaagcatggtgccggcatctgtttctagtgagggcttcaggctgtttctactcatggtggaaggtgaaggggggagcctgtgtgtgcagatcacctggcaagagaggaagaaggaaagagggaggaggaggagaggaggtagtgggctttttttttaataatcaaggaaccaatagagggataactcattactgaaaggacagtggcaccaagccattcattagggattggctcccatgacccaaacacctctctctagaattcacctcaaacattggggatcaaatttcaatatgaaatttgggaggacagatatctaaaccatagcagtgagtttccatctttcctcacaaaaacaatggctgtcatcatttaaaatagattttatgcagtttgtctagttaagcaacaatttgttcttgtaaattgtatttaaaaagttatcgttaagccaggcgctgtggctcacacctgtaaccccagcaccttgggaggccacagcaggcagatcgctagagcttacgagtttgagaccaccctgggcaatatggtgaaacctcgtctctacaaaaaatggaaaaattagccagaaggtggcacgtgcacctgtagtccccgctacttgggagacngaagtgggaggatggcttgagtctgggaggcagaggttgcagtgagccaaagtcacaccacttcactctaggcgatagagccatacctcgtctctaaaacaaaaacaacagcaaaaaaattattgttgagggtgaaccttcatttatatggatattggcacttgtgctttcttcagttgtcttctgtgcacagcatactttgagttctactcaaggcttgagtcttgttacagtgattaaaactggctgaaaggtgagcctgttgaataccacaagtaatatttaggaatacttagtcaaaatatagtcaaaagaaatgaaagagttatctatcttttgatctttcttcctgaaaatttggtccaaggcaaataccttataatcctatttaaagaatattcacaggctgggttcagtggtaatctcagcactttttaaggcccaaggtgggtgaatcacttgaagccagggtttgagactagtctggtcaacatgacaaaaccctatctctactaaaaatgcaaaaattagcttggtgtggtggggtacacctgtaatcccagctacttgggtgcatgaggcctgagaatcacttgagnccaagaagcagaggttgtagtgagccatgattgcaccactgcactccagcctgggtgacaaaatgagactctgtctcaaaaagcaaaaaggatactcacaaattcagtacctccatcctatttcattaaagctctgattaaacatatatgtttatgggccgggtgtggtggctcacacctgtgatcccagcactttgggaggccaaggtgggtggatcacctgatgtcaggagttcgagatcagcctggcaaacatggtgaaacctcatctctactaaaaatac

SEQ ID NO: 355843 - DNA, 4068 bp, Homo sapiens
  misc_feature (1869)..(1869): n is a, c, g, or t
  misc_feature (1907)..(1907): n is a, c, g, or t
  misc_feature (3185)..(3185): n is a, c, g, or t
  misc_feature (3784)..(3784): n is a, c, g, or t
agacgactgtctgagagaggggccgctacgccgcacagcaaacaagctccgcgacgtttccaggacccggataatcccgcccttagagcagagccggaagaaggcgggacgaaccggaagagggtgaaatgctttcggtaggcactccacggctgtgaagatggcggcggctgcgtggcttcaggtgttgcctgtcattcttctgcttctgggagctcacccgtcaccactgtcgtttttcagtgcgggaccggcaaccgtagctgctgccgaccggtccaaatggcacattccgataccgtcggtgagtattcacttcactaacgtctgaacctagaggagcaaggggtggggctacggcggcccaaggggtccatgaaggttccgcaaaagtctcttcaaaaggggtggggttgctgggatggtctgtgtggctagccaactgggacccacctccctggagtggaaagccgcgcacttctgtgattaggctagcgggaatgtaagggccacttcagcaacagaaaggagtggtggagcggcttctcatcagaaaaacagaactttcagtgcctgacttgagatgtaaacttgatgtacaaacggagagttgtttatctttcagatgtttcacagaatccagtgtccccgggttggataagaaagatatgggaaaaattattttagttttggaaagatcctcttcagaaataccactatcttcctgaagtttgatggagaaccttgtgacctgtctttgaatataacctggtatctgaaaagcgctgattgttacaatgaaatctataacttcaaggcagaagaagtagagttgtatttggaaaaacttaaggaaaaaagaggcttgtctgggaaatatcaaacatcatcaaaattgttccagaactgcagtgaactctttaaaacacagaccttttctggagattttatgcatcgactgcctcttttaggagaaaaacaggaggctaaggagaatggaacaaaccttacctttattggagacaaaaccattcagatgcctttcttgaagaaacatttcttggattgttgaaagactttaataatttccaaagttccaaaagttgattttgatagtttttgccagtgttttcgttgcttttatggatgagtagattttcagagtttcttattctgccattctgaaagtgtctcactacctaaaccccagttttatttgtacagaattttaactgaatgtaagttaggcatgacagtctttgttaatttttttaaacaaaagatagccattaggactgggtacagtggctcacgcctgtaatgccaacactttgggaggccaaggtgggcagatgacttgaggttgggagttcgagaccagcttggccaatgtggtgaaactttgtctttactaaaaatacaaaaattagttgctcatggtggcaggcacctgtaatccaagctactcaggaggctgaggcaggagaatcgcgtgaacttgggaggtggaggctgcagtgagctgagatcacgctactgcactccagcctgggcagccagtgagattccatctcaaaaaaaaaagaaaaaagatattcattggattttctcttactaataggtatatattcactgtgaaaatggagacgatatacataaatgaaaagaagaaaatagtaatctataataccatgcagtgatatatttatcttcctattcttttgtatatgggcatgtttatattattttaaaaagggaatcttagagtatgtattatatgacttttttttgtagcttagcaatataacatggacatgtcgtcagtttggtaaatattgtattgcatcgttacttaaatgcttgtatagngtcttattgtatgagtacattgcaatttgttcaattcnctgttcttgaacttttatgagtttcattatcttggaattttatgcagtgttgtgattaatattttaactacatttgcttttaagtctttattttctgatctcagaagaattgtatattgggataagtttttaattctataacttaaaagtaaaaatcctttgtaattttatgttctaatagttttagcagtttggtgtgattacacagagcacatgcatattaaccaaaataagatcatattatataccattgtataattttttctttttattaccaaattggtacattgaatactacttcacctttttatggctgcttagtgttccattttattatgattttaataactcccaattgatgaacattggggttgttcccaaatttcccctattatgggtaaagttatgttcataatgtctagctatatttctgtgtacatttataatctttaggctaaattcctggaggtagaattgctagatccacatgtatgcacagtttaaaggtgctttttcatagcaatttatggccccaagaaagtgagagtgagtgtctttgtttatgttgctatgaaaggacacctggagctgggtaatttataaagaaaagaggtttatttggctcactgttctgtgggctatgaaagaagcatggtgccggcatctgtttctagtgagggcttcaggctgtttctactcatggtggaaggtgaaggggggagcctgtgtgtgcagatcacctggcaagagaggaagaaggaaagagggaggaggaggagaggaggtagtgggctttttttttaataatcaaggaaccaatagagggataactcattactgaaaggacagtggcaccaagccattcattagggattggctcccatgacccaaacacctctctctagaattcacctcaaacattggggatcaaatttcaatatgaaatttgggaggacagatatctaaaccatagcagtgagtttccatctttcctcacaaaaacaatggctgtcatcatttaaaatagattttatgcagtttgtctagttaagcaacaatttgttcttgtaaattgtatttaaaaagttatcgttaagccaggcgctgtggctcacacctgtaaccccagcaccttgggaggccacagcaggcagatcgctagagcttacgagtttgagaccaccctgggcaatatggtgaaacctcgtctctacaaaaaatggaaaaattagccagaaggtggcacgtgcacctgtagtccccgctacttgggagacngaagtgggaggatggcttgagtctgggaggcagaggttgcagtgagccaaagtcacaccacttcactctaggcgatagagccatacctcgtctctaaaacaaaaacaacagcaaaaaaattattgttgagggtgaaccttcatttatatggatattggcacttgtgctttcttcagttgtcttctgtgcacagcatactttgagttctactcaaggcttgagtcttgttacagtgattaaaactggctgaaaggtgagcctgttgaataccacaagtaatatttaggaatacttagtcaaaatatagtcaaaagaaatgaaagagttatctatcttttgatctttcttcctgaaaatttggtccaaggcaaataccttataatcctatttaaagaatattcacaggctgggttcagtggtaatctcagcactttttaaggcccaaggtgggtgaatcacttgaagccagggtttgagactagtctggtcaacatgacaaaaccctatctctactaaaaatgcaaaaattagcttggtgtggtggggtacacctgtaatcccagctacttgggtgcatgaggcctgagaatcacttgagnccaagaagcagaggttgtagtgagccatgattgcaccactgcactccagcctgggtgacaaaatgagactctgtctcaaaaagcaaaaaggatactcacaaattcagtacctccatcctatttcattaaagctctgattaaacatatatgtttatgggccgggtgtggtggctcacacctgtgatcccagcactttgggaggccaaggtgggtggatcacctgatgtcaggagttcgagatcagcctggcaaacatggtgaaacctcatctctactaaaaatac

SEQ ID NO: 355844 - DNA, 2895 bp, Homo sapiens
  misc_feature (11)..(11): n is a, c, g, or t
  misc_feature (64)..(64): n is a, c, g, or t
  misc_feature (696)..(696): n is a, c, g, or t
  misc_feature (734)..(734): n is a, c, g, or t
  misc_feature (2012)..(2012): n is a, c, g, or t
  misc_feature (2611)..(2611): n is a, c, g, or t
gctcttgtggngacacgatcatgaccaaacccggggggcgtggttcttttagtcaggtgtcccngggttagatatgtcgacagcgtcgtcttgttattttaaacaaaagatagccattaggactgggtacagtggctcacgcctgtaatgccaacactttgggaggccaaggtgggcagatgacttgaggttgggagttcgagaccagcttggccaatgtggtgaaactttgtctttactaaaaatacaaaaattagttgctcatggtggcaggcacctgtaatccaagctactcaggaggctgaggcaggagaatcgcgtgaacttgggaggtggaggctgcagtgagctgagatcacgctactgcactccagcctgggcagccagtgagattccatctcaaaaaaaaaagaaaaaagatattcattggattttctcttactaataggtatatattcactgtgaaaatggagacgatatacataaatgaaaagaagaaaatagtaatctataataccatgcagtgatatatttatcttcctattcttttgtatatgggcatgtttatattattttaaaaagggaatcttagagtatgtattatatgacttttttttgtagcttagcaatataacatggacatgtcgtcagtttggtaaatattgtattgcatcgttacttaaatgcttgtatagngtcttattgtatgagtacattgcaatttgttcaattcnctgttcttgaacttttatgagtttcattatcttggaattttatgcagtgttgtgattaatattttaactacatttgcttttaagtctttattttctgatctcagaagaattgtatattgggataagtttttaattctataacttaaaagtaaaaatcctttgtaattttatgttctaatagttttagcagtttggtgtgattacacagagcacatgcatattaaccaaaataagatcatattatataccattgtataattttttctttttattaccaaattggtacattgaatactacttcacctttttatggctgcttagtgttccattttattatgattttaataactcccaattgatgaacattggggttgttcccaaatttcccctattatgggtaaagttatgttcataatgtctagctatatttctgtgtacatttataatctttaggctaaattcctggaggtagaattgctagatccacatgtatgcacagtttaaaggtgctttttcatagcaatttatggccccaagaaagtgagagtgagtgtctttgtttatgttgctatgaaaggacacctggagctgggtaatttataaagaaaagaggtttatttggctcactgttctgtgggctatgaaagaagcatggtgccggcatctgtttctagtgagggcttcaggctgtttctactcatggtggaaggtgaaggggggagcctgtgtgtgcagatcacctggcaagagaggaagaaggaaagagggaggaggaggagaggaggtagtgggctttttttttaataatcaaggaaccaatagagggataactcattactgaaaggacagtggcaccaagccattcattagggattggctcccatgacccaaacacctctctctagaattcacctcaaacattggggatcaaatttcaatatgaaatttgggaggacagatatctaaaccatagcagtgagtttccatctttcctcacaaaaacaatggctgtcatcatttaaaatagattttatgcagtttgtctagttaagcaacaatttgttcttgtaaattgtatttaaaaagttatcgttaagccaggcgctgtggctcacacctgtaaccccagcaccttgggaggccacagcaggcagatcgctagagcttacgagtttgagaccaccctgggcaatatggtgaaacctcgtctctacaaaaaatggaaaaattagccagaaggtggcacgtgcacctgtagtccccgctacttgggagacngaagtgggaggatggcttgagtctgggaggcagaggttgcagtgagccaaagtcacaccacttcactctaggcgatagagccatacctcgtctctaaaacaaaaacaacagcaaaaaaattattgttgagggtgaaccttcatttatatggatattggcacttgtgctttcttcagttgtcttctgtgcacagcatactttgagttctactcaaggcttgagtcttgttacagtgattaaaactggctgaaaggtgagcctgttgaataccacaagtaatatttaggaatacttagtcaaaatatagtcaaaagaaatgaaagagttatctatcttttgatctttcttcctgaaaatttggtccaaggcaaataccttataatcctatttaaagaatattcacaggctgggttcagtggtaatctcagcactttttaaggcccaaggtgggtgaatcacttgaagccagggtttgagactagtctggtcaacatgacaaaaccctatctctactaaaaatgcaaaaattagcttggtgtggtggggtacacctgtaatcccagctacttgggtgcatgaggcctgagaatcacttgagnccaagaagcagaggttgtagtgagccatgattgcaccactgcactccagcctgggtgacaaaatgagactctgtctcaaaaagcaaaaaggatactcacaaattcagtacctccatcctatttcattaaagctctgattaaacatatatgtttatgggccgggtgtggtggctcacacctgtgatcccagcactttgggaggccaaggtgggtggatcacctgatgtcaggagttcgagatcagcctggcaaacatggtgaaacctcatctctactaaaaatac

SEQ ID NO: 355845 - DNA, 3125 bp, Homo sapiens
  misc_feature (1503)..(1503): n is a, c, g, or t
  misc_feature (1541)..(1541): n is a, c, g, or t
  misc_feature (2841)..(2841): n is a, c, g, or t
agacgactgtctgagagaggggccgctacgccgcacagcaaacaagctccgcgacgtttccaggacccggataatcccgcccttagagcagagccggaagaaggcgggacgaaccggaagagggtgaaatgctttcggtaggcactccacggctgtgaagatggcggcggctgcgtggcttcaggtgttgcctgtcattcttctgcttctgggagctcacccgtcaccactgtcgtttttcagtgcgggaccggcaaccgtagctgctgccgaccggtccaaatggcacattccgataccgtcggggaaaaattattttagttttggaaagatcctcttcagaaataccactatcttcctgaagtttgatggagaaccttgtgacctgtctttgaatataacctggtatctgaaaagcgctgattgttacaatgaaatctataacttcaaggcagaagaagtagagttgtatttggaaaaacttaaggaaaaaagaggcttgtctgggaaatatcaaacatcatcaaaattgttccagaactgcagtgaactctttaaaacacagaccttttctggagattttatgcatcgactgcctcttttaggagaaaaacaggaggctaaggagaatggaacaaaccttacctttattggagacaaaaccattcagatgcctttcttgaagaaacatttcttggattgttgaaagactttaataatttccaaagttccaaaagttgattttgatagtttttgccagtgttttcgttgcttttatggatgagtagattttcagagtttcttattctgccattctgaaagtgtctcactacctaaaccccagttttatttgtacagaattttaactgaatgtaagttaggcatgacagtctttgttaatttttttaaacaaaagatagccattaggactgggtacagtggctcacgcctgtaatgccaacactttgggaggccaaggtgggcagatgacttgaggttgggagttcgagaccagcttggccaatgtggtgaaactttgtctttactaaaaatacaaaaattagttgctcatggtggcaggcacctgtaatccaagctactcaggaggctgaggcaggagaatcgcgtgaacttgggaggtggaggctgcagtgagctgagatcacgctactgcactccagcctgggcagccagtgagattccatctcaaaaaaaaaagaaaaaagatattcattggattttctcttactaataggtatatattcactgtgaaaatggagacgatatacataaatgaaaagaagaaaatagtaatctataataccatgcagtgatatatttatcttcctattcttttgtatatgggcatgtttatattattttaaaaagggaatcttagagtatgtattatatgacttttttttgtagcttagcaatataacatggacatgtcgtcagtttggtaaatattgtattgcatcgttacttaaatgcttgtatagngtcttattgtatgagtacattgcaatttgttcaattcnctgttcttgaacttttatgagtttcattatcttggaattttatgcagtgttgtgattaatattttaactacatttgcttttaagtctttattttctgatctcagaagaattgtatattgggataagtttttaattctataacttaaaagtaaaaatcctttgtaattttatgttctaatagttttagcagtttggtgtgattacacagagcacatgcatattaaccaaaataagatcatattatataccattgtataattttttctttttattaccaaattggtacattgaatactacttcacctttttatggctgcttagtgttccattttattatgattttaataactcccaattgatgaacattggggttgttcccaaatttcccctattatgggtaaagttatgttcataatgtctagctatatttctgtgtacatttataatctttaggctaaattcctggaggtagaattgctagatccacatgtatgcacagtttaaaggtgctttttcatagcaatttatggccccaagaaagtgagagtgagtgtctttgtttatgttgctatgaaaggacacctggagctgggtaatttataaagaaaagaggtttatttggctcactgttctgtgggctatgaaagaagcatggtgccggcatctgtttctagtgagggcttcaggctgtttctactcatggtggaaggtgaaggggggagcctgtgtgtgcagatcacctggcaagagaggaagaaggaaagagggaggaggaggagaggaggtagtgggctttttttttaataatcaaggaaccaatagagggataactcattactgaaaggacagtggcaccaagccattcattagggattggctcccatgacccaaacacctctctctagaattcacctcaaacattggggatcaaatttcaatatgaaatttgggaggacagatatctaaaccatagcagtgagtttccatctttcctcacaaaaacaatggctgtcatcatttaaaatagattttatgcagtttgtctagttaagcaacaatttgttcttgtaaattgtatttaaaaagttatcgttaagccaggcgctgtggctcacacctgtaaccccagcaccttgggaggccacagcaggcagatcgctagagcttacgagtttgagaccaccctgggcaatatggtgaaacctcgtctctacaaaaaatggaaaaattagccagaaggtggcacgtgcacctgtaatcccagctacttgggtgcatgaggcctgagaatcacttgagnccaagaagcagaggttgtagtgagccatgattgcaccactgcactccagcctgggtgacaaaatgagactctgtctcaaaaagcaaaaaggatactcacaaattcagtacctccatcctatttcattaaagctctgattaaacatatatgtttatgggccgggtgtggtggctcacacctgtgatcccagcactttgggaggccaaggtgggtggatcacctgatgtcaggagttcgagatcagcctggcaaacatggtgaaacctcatctctactaaaaatac

SEQ ID NO: 355846 - DNA, 324 bp, Homo sapiens
aaccctggtcatcatagtcagtctgggatatggcatcgtcaagtaagtattaacttcctgtatggaagagcaaattaaaatgctgattaaattaaaacagtattgcatgttcccaatgtagtagttctgaaatagttgataaaagaaataattctgaaacaagaaaggtatttgaaattttgtagcattgtaaatgttgggaaaatgtgtttcattttccatacttccaaatatattccatacttccaaatatattccatacttccaagtccaaatgtattccatacttccaaatccaaatgtattccatacttccgaatatat

SEQ ID NO: 355847 - DNA, 431 bp, Homo sapiens
acatctgtttttcaccacttctttttctttgtctgcaggcccagactgatcttgcttccttggcctttatccccttggctttcctagacactgccttgtgctggtggatatccttctcattggcttgtttgatgatggtccattttctccccttggagatgggtttccattgatctttctgcaaagagtttttatcagttttgttaattactccttagtgtggggaacagtgcatgctaagtcttaacaacctgagggttcaggtaagcagttttttttgtttctatttttttaattttaaaaatcaaattggaaattggtgactgtggaccgagctcgagataaaatcttttggcttttttcttttaagtgagcatttcatcttgattttgcacttcttgtttgtgtacctaatcatttagtgttagagt

SEQ ID NO: 355848 - DNA, 642 bp, Homo sapiens
gggactttggttttaaggagcttgggagagaggaatgggaatagggtgaacacagacatctcaagcttgcttttctttcctagattcagatgcctttcttgaagaaacatttcttggattgttgaaagactttaataatttccaaagttccaaaagttgattttgatagtttttgccagtgttttcgttgcttttatggatgagtagattttcagagtttcttattctgccattctgaaagtgtctcactacctaaaccccagttttatttgtacagaattttaactgaatgtaagttaggcatgacagtctttgttaatttttttaaacaaaagatagccattaggactgggtacagtggctcacgcctgtaatgccaacactttgggaggccaaggtgggcagatgacttgaggttgggagttcgagaccagcttggccaatgtggtgaaactttgtctttactaaaaatacaaaaattagttgctcatggtggcaggcacctgtaatccaagctactcaggaggctgaggcaggagaatcgcgtgaacttgggaggtggaggctgcagtgagctgagatcacgctactgcactccagcctgggcagccagtgagattccatctcaaaaaaaaaagaaaa

SEQ ID NO: 355849 - DNA, 565 bp, Homo sapiens
atctgtgcttcaaaccattccctacagaaaccattccctcaggtaacctcttacaaagttggaacattttcacagtccatctctcctccctagggaaaagctaggatttggggatgttggggattctacctgcttactctgcactgagctgggggagcggctgtagtgagctcatgcttgctagtccaaacttccactttgatttcagcaacttccaacctgggccctttgtttttagctctcggactcaggcaagacagaaaacagtctctcgtgcaggttccagaaaagtcagaatgttggatgtacattccagtcatttccttccctctgcaaaaagaagctgggagctgagggtttcctctctatcatgtggtactgtgctgggtccatgggaagggaagaattatggcaagagggtgcctcaggtttttctgccgactttgattcagctggtttcatgctttcctatagtgcagaagaccctcaactggtttctggatttcccacaaagggaatttttccatgtgttattgaatcagtgtgtctgtagagggaaggagtg

SEQ ID NO: 355850 - DNA, 2964 bp, Homo sapiens
agacgactgtctgagagaggggccgctacgccgcacagcaaacaagctccgcgacgtttccaggacccggataatcccgcccttagagcagagccggaagaaggcgggacgaaccggaagagggtgaaatgctttcggtaggcactccacggctgtgaagatggcggcggctgcgtggcttcaggtgttgcctgtcattcttctgcttctgggagctcacccgtcaccactgtcgtttttcagtgcgggaccggcaaccgtagctgctgccgaccggtccaaatggcacattccgataccgtcggggaaaaattattttagttttggaaagatcctcttcagaaataccactatcttcctgaagtttgatggagaaccttgtgacctgtctttgaatataacctggtatctgaaaagcgctgattgttacaatgaaatctataacttcaaggcagaagaagtagagttgtatttggaaaaacttaaggaaaaaagaggcttgtctgggaaatatcaaacatcatcaaaattgttccagaactgcagtgaactctttaaaacacagaccttttctggagattttatgcatcgactgcctcttttaggagaaaaacaggaggctaaggagaatggaacaaaccttacctttattggagacaaaaccgcaatgcatgaaccattgcaaacttggcaagatgcaccatacatttttattgtacatattggcatttcatcctcaaaggaatcatcaaaagaaaattcactgagtaatctttttaccatgactgttgaagtgaagggtccctatgaatacctcacacttgaagactatcccttgatgatttggctggcatggtctgcctgctactggagagatctcctgagaattcagttttggattggtgctgtcatcttcctgggaatgcttgagaaagctgtcttctatgcggaatttcagaatatccgatacaaaggagaatctgtccagggtgctttgatccttgcagagctgctttcagcagtgaaacgctcactggctcgaaccctggtcatcatagtcagtctgggatatggcatcgtcaagccacgccttggagtcactcttcataaggttgtagtagcaggagccctctatcttttgttctctggcatggaaggggtcctcagagttactggggcccagactgatcttgcttccttggcctttatccccttggctttcctagacactgccttgtgctggtggatatttattagcctgactcaaacaatgaagctattaaaacttcggaggaacattgtaaaactctctttgtatcggcatttcaccaacacgcttattttggcagtggcagcatccattgtgtttatcatctggacaaccatgaagttcagaatagtgacatgtcagtcggactggcgggagctgtgggtagacgatgccatctggcgcttgctgttctccatgatcctctttgtcatcatggttctctggcgaccatctgcaaacaaccagaggtttgccttttcaccattgtctgaggaagaggaggaggatgaacaaaaggagcctatgctgaaagaaagctttgaaggaatgaaaatgagaagtaccaaacaagaacccaatggaaatagtaaagttaacaaagcacaggaagatgatttgaagtgggtagaagagaatgttccttcttctgtgacagatgtagcacttccagcccttctggattcagatgaggaacgaatgatcacacactttgaaaggtccaaaatggagtaaggaatgggaagatttgcagttaaagatggctaccatcagggaagagatcagcatctgtgtcagtcttctgtacggctccatgggattaaaggaagcaatgacatcctgatctgttccttgatctttgggcattggagttggcgagaggtgtcagaacaaagagaacatcttactgaaaacaagttcataagatgagaaaaatctacgagcttcttatttacaacactgctgccccctttcctcccagactctgacatggatgttcatgcaacttaagtgtgttgttcctgaactttctgtaatgtttcattttttaaatctgacaaactaaaaagtttaacgtcttctaaaagattgtcatcaacaccataatatgtaatctccaggagcaactgcctgtaatttttatttatttagggagttacataggtgatgggggaaattgttaactacctttcattttcctgggaagtcaaggttacatcttgcagaggttgttttgagaaaaaagggcccttctgagttaaggagccatagttctatcaatgatcaaaagaaaaaaaaaaaaaagagaaactgttacagtatgattcagatcatttaaaaaagcaaaatcaagtgcaattttgtttacaaatggtgtatattaaagatttttctatttcagatgtactttaaagagaaatattagcttaactcttttgacatctgctattgtgacacatcccattgctggcaatgtggtgcacactccgaaacttttaactactgttttgtaagcctccaagggtggcattgcagggtccttaggcaatgttttgtttgcctttatgcagagaggtgctccaagtgctgtgattgagcaccgtgctagaggaactgtaatgcttcagaagttgtagcttatacaaaggaaacaggtcctgctggcttaatttaaacagttattgcatgaagtagcgtggaggccctggactgctgctcgttctttaggatggactgttctggtatctggtattggtttagagactgttaataagggacatcacaaggtgatgggattcatttgaagcactctatttctgttttaatggttttatccaattttgccttcccaagatttttgttctacataaaaagttcatgccactttttaatataaaaaaatttaacaaaattaa

SEQ ID NO: 355851 - DNA, 3375 bp, Homo sapiens
agacgactgtctgagagaggggccgctacgccgcacagcaaacaagctccgcgacgtttccaggacccggataatcccgcccttagagcagagccggaagaaggcgggacgaaccggaagagggtgaaatgctttcggtaggcactccacggctgtgaagatggcggcggctgcgtggcttcaggtgttgcctgtcattcttctgcttctgggagctcacccgtcaccactgtcgtttttcagtgcgggaccggcaaccgtagctgctgccgaccggtccaaatggcacattccgataccgtcggtgagtattcacttcactaacgtctgaacctagaggagcaaggggtggggctacggcggcccaaggggtccatgaaggttccgcaaaagtctcttcaaaaggggtggggttgctgggatggtctgtgtggctagccaactgggacccacctccctggagtggaaagccgcgcacttctgtgattaggctagcgggaatgtaagggccacttcagcaacagaaaggagtggtggagcggcttctcatcagaaaaacagaactttcagtgcctgacttgagatgtaaacttgatgtacaaacggagagttgtttatctttcagatgtttcacagaatccagtgtccccgggttggataagaaagatatgggaaaaattattttagttttggaaagatcctcttcagaaataccactatcttcctgaagtttgatggagaaccttgtgacctgtctttgaatataacctggtatctgaaaagcgctgattgttacaatgaaatctataacttcaaggcagaagaagtagagttgtatttggaaaaacttaaggaaaaaagaggcttgtctgggaaatatcaaacatcatcaaaattgttccagaactgcagtgaactctttaaaacacagaccttttctggagattttatgcatcgactgcctcttttaggagaaaaacaggaggctaaggagaatggaacaaaccttacctttattggagacaaaaccgcaatgcatgaaccattgcaaacttggcaagatgcaccatacatttttattgtacatattggcatttcatcctcaaaggaatcatcaaaagaaaattcactgagtaatctttttaccatgactgttgaagtgaagggtccctatgaatacctcacacttgaagactatcccttgatgatttttttcatggtgatgtgtattgtatatgtcctgtttggtgttctgtggctggcatggtctgcctgctactggagagatctcctgagaattcagttttggattggtgctgtcatcttcctgggaatgcttgagaaagctgtcttctatgcggaatttcagaatatccgatacaaaggagaatctgtccagggtgctttgatccttgcagagctgctttcagcagtgaaacgctcactggctcgaaccctggtcatcatagtcagtctgggatatggcatcgtcaagccacgccttggagtcactcttcataaggttgtagtagcaggagccctctatcttttgttctctggcatggaaggggtcctcagagttactggggcccagactgatcttgcttccttggcctttatccccttggctttcctagacactgccttgtgctggtggatatttattagcctgactcaaacaatgaagctattaaaacttcggaggaacattgtaaaactctctttgtatcggcatttcaccaacacgcttattttggcagtggcagcatccattgtgtttatcatctggacaaccatgaagttcagaatagtgacatgtcagtcggactggcgggagctgtgggtagacgatgccatctggcgcttgctgttctccatgatcctctttgtcatcatggttctctggcgaccatctgcaaacaaccagaggtttgccttttcaccattgtctgaggaagaggaggaggatgaacaaaaggagcctatgctgaaagaaagctttgaaggaatgaaaatgagaagtaccaaacaagaacccaatggaaatagtaaagttaacaaagcacaggaagatgatttgaagtgggtagaagagaatgttccttcttctgtgacagatgtagcacttccagcccttctggattcagatgaggaacgaatgatcacacactttgaaaggtccaaaatggagtaaggaatgggaagatttgcagttaaagatggctaccatcagggaagagatcagcatctgtgtcagtcttctgtacggctccatgggattaaaggaagcaatgacatcctgatctgttccttgatctttgggcattggagttggcgagaggtgtcagaacaaagagaacatcttactgaaaacaagttcataagatgagaaaaatctacgagcttcttatttacaacactgctgccccctttcctcccagactctgacatggatgttcatgcaacttaagtgtgttgttcctgaactttctgtaatgtttcattttttaaatctgacaaactaaaaagtttaacgtcttctaaaagattgtcatcaacaccataatatgtaatctccaggagcaactgcctgtaatttttatttatttagggagttacataggtgatgggggaaattgttaactacctttcattttcctgggaagtcaaggttacatcttgcagaggttgttttgagaaaaaagggcccttctgagttaaggagccatagttctatcaatgatcaaaagaaaaaaaaaaaaaagagaaactgttacagtatgattcagatcatttaaaaaagcaaaatcaagtgcaattttgtttacaaatggtgtatattaaagatttttctatttcagatgtactttaaagagaaatattagcttaactcttttgacatctgctattgtgacacatcccattgctggcaatgtggtgcacactccgaaacttttaactactgttttgtaagcctccaagggtggcattgcagggtccttaggcaatgttttgtttgcctttatgcagagaggtgctccaagtgctgtgattgagcaccgtgctagaggaactgtaatgcttcagaagttgtagcttatacaaaggaaacaggtcctgctggcttaatttaaacagttattgcatgaagtagcgtggaggccctggactgctgctcgttctttaggatggactgttctggtatctggtattggtttagagactgttaataagggacatcacaaggtgatgggattcatttgaagcactctatttctgttttaatggttttatccaattttgccttcccaagatttttgttctacataaaaagttcatgccactttttaatataaaaaaatttaacaaaattaa

SEQ ID NO: 355852 - DNA, 2895 bp, Homo sapiens
agacgactgtctgagagaggggccgctacgccgcacagcaaacaagctccgcgacgtttccaggacccggataatcccgcccttagagcagagccggaagaaggcgggacgaaccggaagagggtgaaatgctttcggtaggcactccacggctgtgaagatggcggcggctgcgtggcttcaggtgttgcctgtcattcttctgcttctgggagctcacccgtcaccactgtcgtttttcagtgcgggaccggcaaccgtagctgctgccgaccggtccaaatggcacattccgataccgtcggggaaaaattattttagttttggaaagatcctcttcagaaataccactatcttcctgaagtttgatggagaaccttgtgacctgtctttgaatataacctggtatctgaaaagcgctgattgttacaatgaaatctataacttcaagaccttttctggagattttatgcatcgactgcctcttttaggagaaaaacaggaggctaaggagaatggaacaaaccttacctttattggagacaaaaccgcaatgcatgaaccattgcaaacttggcaagatgcaccatacatttttattgtacatattggcatttcatcctcaaaggaatcatcaaaagaaaattcactgagtaatctttttaccatgactgttgaagtgaagggtccctatgaatacctcacacttgaagactatcccttgatgatttttttcatggtgatgtgtattgtatatgtcctgtttggtgttctgtggctggcatggtctgcctgctactggagagatctcctgagaattcagttttggattggtgctgtcatcttcctgggaatgcttgagaaagctgtcttctatgcggaatttcagaatatccgatacaaaggagaatctgtccagggtgctttgatccttgcagagctgctttcagcagtgaaacgctcactggctcgaaccctggtcatcatagtcagtctgggatatggcatcgtcaagccacgccttggagtcactcttcataaggttgtagtagcaggagccctctatcttttgttctctggcatggaaggggtcctcagagttactggggcccagactgatcttgcttccttggcctttatccccttggctttcctagacactgccttgtgctggtggatatttattagcctgactcaaacaatgaagctattaaaacttcggaggaacattgtaaaactctctttgtatcggcatttcaccaacacgcttattttggcagtggcagcatccattgtgtttatcatctggacaaccatgaagttcagaatagtgacatgtcagtcggactggcgggagctgtgggtagacgatgccatctggcgcttgctgttctccatgatcctctttgtcatcatggttctctggcgaccatctgcaaacaaccagaggtttgccttttcaccattgtctgaggaagaggaggaggatgaacaaaaggagcctatgctgaaagaaagctttgaaggaatgaaaatgagaagtaccaaacaagaacccaatggaaatagtaaagttaacaaagcacaggaagatgatttgaagtgggtagaagagaatgttccttcttctgtgacagatgtagcacttccagcccttctggattcagatgaggaacgaatgatcacacactttgaaaggtccaaaatggagtaaggaatgggaagatttgcagttaaagatggctaccatcagggaagagatcagcatctgtgtcagtcttctgtacggctccatgggattaaaggaagcaatgacatcctgatctgttccttgatctttgggcattggagttggcgagaggtgtcagaacaaagagaacatcttactgaaaacaagttcataagatgagaaaaatctacgagcttcttatttacaacactgctgccccctttcctcccagactctgacatggatgttcatgcaacttaagtgtgttgttcctgaactttctgtaatgtttcattttttaaatctgacaaactaaaaagtttaacgtcttctaaaagattgtcatcaacaccataatatgtaatctccaggagcaactgcctgtaatttttatttatttagggagttacataggtgatgggggaaattgttaactacctttcattttcctgggaagtcaaggttacatcttgcagaggttgttttgagaaaaaagggcccttctgagttaaggagccatagttctatcaatgatcaaaagaaaaaaaaaaaaaagagaaactgttacagtatgattcagatcatttaaaaaagcaaaatcaagtgcaattttgtttacaaatggtgtatattaaagatttttctatttcagatgtactttaaagagaaatattagcttaactcttttgacatctgctattgtgacacatcccattgctggcaatgtggtgcacactccgaaacttttaactactgttttgtaagcctccaagggtggcattgcagggtccttaggcaatgttttgtttgcctttatgcagagaggtgctccaagtgctgtgattgagcaccgtgctagaggaactgtaatgcttcagaagttgtagcttatacaaaggaaacaggtcctgctggcttaatttaaacagttattgcatgaagtagcgtggaggccctggactgctgctcgttctttaggatggactgttctggtatctggtattggtttagagactgttaataagggacatcacaaggtgatgggattcatttgaagcactctatttctgttttaatggttttatccaattttgccttcccaagatttttgttctacataaaaagttcatgccactttttaatataaaaaaatttaacaaaattaa

SEQ ID NO: 355853 - DNA, 3397 bp, Homo sapiens
agacgactgtctgagagaggggccgctacgccgcacagcaaacaagctccgcgacgtttccaggacccggataatcccgcccttagagcagagccggaagaaggcgggacgaaccggaagagggtgaaatgctttcggtaggcactccacggctgtgaagatggcggcggctgcgtggcttcaggtgttgcctgtcattcttctgcttctgggagctcacccgtcaccactgtcgtttttcagtgcgggaccggcaaccgtagctgctgccgaccggtccaaatggcacattccgataccgtcggggaaaaattattttagttttggaaagatcctcttcagaaataccactatcttcctgaagtttgatggagaaccttgtgacctgtctttgaatataacctggtatctgaaaagcgctgattgttacaatgaaatctataacttcaaggcagaagaagtagagttgtatttggaaaaacttaaggaaaaaagaggcttgtctgggaaatatcaaacatcatcaaaattgttccagaactgcagtgaactctttaaaacacagaccttttctggagattttatgcatcgactgcctcttttaggagaaaaacaggaggctaaggagaatggaacaaaccttacctttattggagacaaaaccgcaatgcatgaaccattgcaaacttggcaagatgcaccatacatttttattgtacatattggcatttcatcctcaaaggaatcatcaaaagaaaattcactgagtaatctttttaccatgactgttgaagtgaagggtccctatgaatacctcacacttgaagactatcccttgatgatttttttcatggtgatgtgtattgtatatgtcctgtttggtgttctgtggctggcatggtctgcctgctactggagagatctcctgagaattcagttttggattggtgctgtcatcttcctgggaatgcttgagaaagctgtcttctatgcggaatttcagaatatccgatacaaaggagaatctgtccagggtgctttgatccttgcagagctgctttcagcagtgaaacgctcactggctcgaaccctggtcatcatagtcagtctgggatatggcatcgtcaagccacgccttggagtcactcttcataaggttgtagtagcaggagccctctatcttttgttctctggcatggaaggggtcctcagagttactggggcccagactgatcttgcttccttggcctttatccccttggctttcctagacactgccttgtgctggtggatatttattagcctgactcaaacaatgaagctattaaaacttcggaggaacattgtaaaactctctttgtatcggcatttcaccaacacgcttattttggcagtggcagcatccattgtgtttatcatctggacaaccatgaagttcagaatagtgacatgtcagtcggactggcgggagctgtgggtagacgatgccatctggcgcttgctgttctccatgatcctctttgtcatcatggttctctggcgaccatctgcaaacaaccagaggtttgccttttcaccattgtctgaggaagaggaggaggatgaacaaaaggagcctatgctgaaagaaagctttgaaggaatgaaaatgagaagtaccaaacaagaacccaatggaaatagtaaagttaacaaagcacaggaagatgatttgaagtgggtagaagagaatgttccttcttctgtgacagatgtagcacttccagcccttctggattcagatgaggaacgaatgatcacacactttgaaaggtccaaaatggagtaaggaatgggaagatttgcagttaaagatggctaccatcagggaagagatcagcatctgtgtcagtcttctgtacggctccatgggattaaaggaagcaatgacatcctgatctgttccttgatctttgggcattggagttggcgagaggtgtcagaacaaagagaacatcttactgaaaacaagttcataagatgagaaaaatctacgagcttcttatttacaacactgctgccccctttcctcccagactctgacatggatgttcatgcaacttaagtgtgttgttcctgaactttctgtaatgtttcattttttaaatctgacaaactaaaaagtttaacgtcttctaaaagattgtcatcaacaccataatatgtaatctccaggagcaactgcctgtaatttttatttatttagggagttacataggtgatgggggaaattgttaactacctttcattttcctgggaagtcaaggttacatcttgcagaggttgttttgagaaaaaagggcccttctgagttaaggagccatagttctatcaatgatcaaaagaaaaaaaaaaaaaagagaaactgttacagtatgattcagatcatttaaaaaagcaaaatcaagtgcaattttgtttacaaatggtgtatattaaagatttttctatttcagatgtactttaaagagaaatattagcttaactcttttgacatctgctattgtgacacatcccattgctggcaatgtggtgcacactccgaaacttttaactactgttttgtaagcctccaagggtggcattgcagggtccttaggcaatgttttgtttgcctttatgcagagaggtgctccaagtgctgtgattgagcaccgtgctagaggaactgtaatgcttcagaagttgtagcttatacaaaggaaacaggtcctgctggcttaatttaaacagttattgcatgaagtagcgtggaggccctggactgctgctcgttctttaggatggactgttctggtatctggtattggtttagagactgttaataagggacatcacaaggtgatgggattcatttgaagcactctatttctgttttaatggttttatccaattttgccttcccaagatttttgttctacataaaaagttcatgccactttttaatataaaaaaatttaacaaaattaatgtatttttctcatttttttcaaactttttctaaagactctttctgtcaaactcatgaaaaatttctttctatggcttttattctagattgtcttattttctgttaaaaccaatgaccacatgaccacaatcttcactaactcatactgcagtgaaagtgttaacccttaggtagtttctctacaactctttgctatggtgatttttaaaaaagtttcctaggaagtatctctgaggaacagcaatctgaagaactgactatattctcatgctaagtcattagccaaaagctggtggtattgttgcatgctgctattgcatattaaaacgtagcagatgaataatagttgtaatgcagcaggatagttggtcaaattatttttttagg

SEQ ID NO: 355854 - DNA, 1795 bp, Homo sapiens
atatgtattttttatttcccttgactctgatagtaaacctggccctctcagcagttgacgcctgtgttattttatggatatttattagcctgactcaaacaatgaagctattaaaacttcggaggaacattgtaaaactctctttgtatcggcatttcaccaacacgcttattttggcagtggcagcatccattgtgtttatcatctggacaaccatgaagttcagaatagtgacatgtcagtcggactggcgggagctgtgggtagacgatgccatctggcgcttgctgttctccatgatcctctttgtcatcatggttctctggcgaccatctgcaaacaaccagaggtttgccttttcaccattgtctgaggaagaggaggaggatgaacaaaaggagcctatgctgaaagaaagctttgaaggaatgaaaatgagaagtaccaaacaagaacccaatggaaatagtaaagttaacaaagcacaggaagatgatttgaagtgggtagaagagaatgttccttcttctgtgacagatgtagcacttccagcccttctggattcagatgaggaacgaatgatcacacactttgaaaggtccaaaatggagtaaggaatgggaagatttgcagttaaagatggctaccatcagggaagagatcagcatctgtgtcagtcttctgtacggctccatgggattaaaggaagcaatgacatcctgatctgttccttgatctttgggcattggagttggcgagaggtgtcagaacaaagagaacatcttactgaaaacaagttcataagatgagaaaaatctacgagcttcttatttacaacactgctgccccctttcctcccagactctgacatggatgttcatgcaacttaagtgtgttgttcctgaactttctgtaatgtttcattttttaaatctgacaaactaaaaagtttaacgtcttctaaaagattgtcatcaacaccataatatgtaatctccaggagcaactgcctgtaatttttatttatttagggagttacataggtgatgggggaaattgttaactacctttcattttcctgggaagtcaaggttacatcttgcagaggttgttttgagaaaaaagggcccttctgagttaaggagccatagttctatcaatgatcaaaagaaaaaaaaaaaaaagagaaactgttacagtatgattcagatcatttaaaaaagcaaaatcaagtgcaattttgtttacaaatggtgtatattaaagatttttctatttcagatgtactttaaagagaaatattagcttaactcttttgacatctgctattgtgacacatcccattgctggcaatgtggtgcacactccgaaacttttaactactgttttgtaagcctccaagggtggcattgcagggtccttaggcaatgttttgtttgcctttatgcagagaggtgctccaagtgctgtgattgagcaccgtgctagaggaactgtaatgcttcagaagttgtagcttatacaaaggaaacaggtcctgctggcttaatttaaacagttattgcatgaagtagcgtggaggccctggactgctgctcgttctttaggatggactgttctggtatctggtattggtttagagactgttaataagggacatcacaaggtgatgggattcatttgaagcactctatttctgttttaatggttttatccaattttgccttcccaagatttttgttctacataaaaagttcatgccactttttaatataaaaaaatttaacaaaattaa

SEQ ID NO: 355855 - DNA, 2377 bp, Homo sapiens
  misc_feature (2263)..(2263): n is a, c, g, or t
  misc_feature (2265)..(2265): n is a, c, g, or t
agacgactgtctgagagaggggccgctacgccgcacagcaaacaagctccgcgacgtttccaggacccggataatcccgcccttagagcagagccggaagaaggcgggacgaaccggaagagggtgaaatgctttcggtaggcactccacggctgtgaagatggcggcggctgcgtggcttcaggtgttgcctgtcattcttctgcttctgggagctcacccgtcaccactgtcgtttttcagtgcgggaccggcaaccgtagctgctgccgaccggtccaaatggcacattccgataccgtcggggaaaaattattttagttttggaaagatcctcttcagaaataccactatcttcctgaagtttgatggagaaccttgtgacctgtctttgaatataacctggtatctgaaaagcgctgattgttacaatgaaatctataacttcaaggcagaagaagtagagttgtatttggaaaaacttaaggaaaaaagaggcttgtctgggaaatatcaaacatcatcaaaattgttccagaactgcagtgaactctttaaaacacagaccttttctggagattttatgcatcgactgcctcttttaggagaaaaacaggaggctaaggagaatggaacaaaccttacctttattggagacaaaaccgcaatgcatgaaccattgcaaacttggcaagatgcaccatacatttttattgtacatattggcatttcatcctcaaaggaatcatcaaaagaaaattcactgagtaatctttttaccatgactgttgaagtgaagggtccctatgaatacctcacacttgaagactatcccttgatgatttttttcatggtgatgtgtattgtatatgtcctgtttggtgttctgtggctggcatggtctgcctgctactggagagatctcctgagaattcagttttggattggtgctgtcatcttcctgggaatgcttgagaaagctgtcttctatgcggaatttcagaatatccgatacaaaggagaatctgtccagggtgctttgatccttgcagagctgctttcagcagtgaaacgctcactggctcgaaccctggtcatcatagtcagtctgggatatggcatcgtcaagccacgccttggagtcactcttcataaggttgtagtagcaggagccctctatcttttgttctctggcatggaaggggtcctcagagttactggggcccagactgatcttgcttccttggcctttatccccttggctttcctagacactgccttgtgctggtggatatttattagcctgactcaaacaatgaagctattaaaacttcggaggaacattgtaaaactctctttgtatcggcatttcaccaacacgcttattttggcagtggcagcatccattgtgtttatcatctggacaaccatgaagttcagaatagtgacatgtcagtcggactggcgggagctgtgggtagacgatgccatctggcgcttgctgttctccatgatcctctttgtcatcatggttctctggcgaccatctgcaaacaaccagaggtttgccttttcaccattgtctgaggaagaggaggaggatgaacaaaaggagcctatgctgaaagaaagctttgaaggaatgaaaatgagaagtaccaaacaagaacccaatggaaatagtaaagttaacaaagcacaggaagatgatttgaagtgggtagaagagaatgttccttcttctgtgacagatgtagcacttccagcccttctggattcagatgaggaacgaatgatcacacactttgaaaggtccaaaatggagtaaggaatgggaagatttgcagttaaagatggctaccatcagggaagagatcagcatctgtgtcagtcttctgtacggctccatgggattaaaggaagcaatgacatcctgatctgttccttgatctttgggcattggagttggcgagaggtgtcagaacaaagagaacatcttactgaaaacaagttcataagatgagaaaaatctacgagcttcttatttacaacactgctgccccctttcctcccagactctgacatggatgttcatgcaacttatttagggagttacataggtgatgggggaaattgttaactacctttcattttcctgggaagtcaaggttacatcttgcagaggttgttttgagaaaaaagggcccttctgagttaaggagccatagttctatcaatgatcaaaagaaaaaaaaaaaaaaananaaaaaaaaaattctcttttcctcaaattaaaaaagaggaagagtttttacagagattataaactatttcagggcttagttacctctaattaaacctttctgcgttacaagaa

SEQ ID NO: 355856 - DNA, 1673 bp, Homo sapiens
  misc_feature (1600)..(1600): n is a, c, g, or t
  misc_feature (1613)..(1613): n is a, c, g, or t
  misc_feature (1634)..(1634): n is a, c, g, or t
  misc_feature (1647)..(1647): n is a, c, g, or t
  misc_feature (1649)..(1649): n is a, c, g, or t
  misc_feature (1668)..(1668): n is a, c, g, or t
agacgactgtctgagagaggggccgctacgccgcacagcaaacaagctccgcgacgtttccaggacccggataatcccgcccttagagcagagccggaagaaggcgggacgaaccggaagagggtgaaatgctttcggtaggcactccacggctgtgaagatggcggcggctgcgtggcttcaggtgttgcctgtcattcttctgcttctgggagctcacccgtcaccactgtcgtttttcagtgcgggaccggcaaccgtagctgctgccgaccggtccaaatggcacattccgataccgtcggggaaaaattattttagttttggaaagatcctcttcagaaataccactatcttcctgaagtttgatggagaaccttgtgacctgtctttgaatataacctggtatctgaaaagcgctgattgttacaatgaaatctataacttcaaggcagaagaagtagagttgtatttggaaaaacttaaggaaaaaagaggcttgtctgggaaatatcaaacatcatcaaaattgttccagaactgcagtgaactctttaaaacacagaccttttctggagattttatgcatcgactgcctcttttaggagaaaaacaggaggctaaggagaatggaacaaaccttacctttattggagacaaaaccgcaatgcatgaaccattgcaaacttggcaagatgcaccatacatttttattgtacatattggcatttcatcctcaaaggaatcatcaaaagaaaattcactgagtaatctttttaccatgactgttgaagtgaagggtccctatgaatacctcacacttgaagactatcccttgatgatttttttcatggtgatgtgtattgtatatgtcctgtttggtgttctgtggctggcatggtctgcctgctactggagagatctcctgagaattcagttttggattggtgctgtcatcttcctgggaatgcttgagaaagctgtcttctatgcggaatttcagaatatccgatacaaaggagaatctgtccagggtgctttgatccttgcagagctgctttcagcagtgaaacgctcactggctcgaaccctggtcatcatagtcagtctgggatatggcatcgtcaagccacgccttggagtcactcttcataaggttgtagtagcaggagccctctatcttttgttctctggcatggaaggggtcctcagagttactggggcccagactgatcttgcttccttggcctttatccccttggctttcctagacactgccttgtgctggtggatatttattagcctgactcaaacaatgaagctattaaaacttcggaggaacattgtaaaactctctttgtatcggcatttcaccaacacgcttattttggcagtggcagcatccattgtgtttatcatctggacaaccatgaagttcagaatagtgacatgtcagtcggactggcgggagctgtgggtagacgatgccatctggcgcttgctgttctccatgatcctctttgtcatcatggttctctggcgaccatctgcaaacaaccagagttgctttcccatgtctgaggagagaggagatgaccanaggagctatgtgnaagaagcttgaggatgaatgngagtccaacagancnatggatagtagttacaagncagag

SEQ ID NO: 355857 - DNA, 1526 bp, Homo sapiens
agacgactgtctgagagaggggccgctacgccgcacagcaaacaagctccgcgacgtttccaggacccggataatcccgcccttagagcagagccggaagaaggcgggacgaaccggaagagggtgaaatgctttcggtaggcactccacggctgtgaagatggcggcggctgcgtggcttcaggtgttgcctgtcattcttctgcttctgggagctcacccgtcaccactgtcgtttttcagtgcgggaccggcaaccgtagctgctgccgaccggtccaaatggcacattccgataccgtcggggaaaaattattttagttttggaaagatcctcttcagaaataccactatcttcctgaagtttgatggagaaccttgtgacctgtctttgaatataacctggtatctgaaaagcgctgattgttacaatgaaatctataacttcaaggcagaagaagtagagttgtatttggaaaaacttaaggaaaaaagaggcttgtctgggaaatatcaaacatcatcaaaattgttccagaactgcagtgaactctttaaaacacagaccttttctggagattttatgcatcgactgcctcttttaggagaaaaacaggaggctaaggagaatggaacaaaccttacctttattggagacaaaaccgcaatgcatgaaccattgcaaacttggcaagatgcaccatacatttttattgtacatattggcatttcatcctcaaaggaatcatcaaaagaaaattcactgagtaatctttttaccatgactgttgaagtgaagggtccctatgaatacctcacacttgaagactatcccttgatgatttttttcatggtgatgtgtattgtatatgtcctgtttggtgttctgtggctggcatggtctgcctgctactggagagatctcctgagaattcagttttggattggtgctgtcatcttcctgggaatgcttgagaaagctgtcttctatgcggaatttcagaatatccgatacaaaggagaatctgtccagggtgctttgatccttgcagagctgctttcagcagtgaaacgctcactggctcgaaccctggtcatcatagtcagtctgggatatggcatcgtcaagccacgccttggagtcactcttcataaggttgtagtagcaggagccctctatcttttgttctctggcatggaaggggtcctcagagttactggggcccagactgatcttgcttccttggcctttatccccttggctttcctagacactgccttgtgctggtggatatccttctcattggcttgtttgatgatggtccattttctccccttggagatgggtttccattgatctttctgcaaagagtttttatcagttttgttaattactccttagtgtggggaacagtgcatgctaagtcttaacaacctgagggttcaggtaagcagttttttttgtttctatttttttaattttaaaaatcaaattggaaattggtgactgtggaccgagctcgaga

SEQ ID NO: 355858 - DNA, 3641 bp, Homo sapiens
  misc_feature (1442)..(1442): n is a, c, g, or t
  misc_feature (1480)..(1480): n is a, c, g, or t
  misc_feature (2758)..(2758): n is a, c, g, or t
  misc_feature (3357)..(3357): n is a, c, g, or t
agacgactgtctgagagaggggccgctacgccgcacagcaaacaagctccgcgacgtttccaggacccggataatcccgcccttagagcagagccggaagaaggcgggacgaaccggaagagggtgaaatgctttcggtaggcactccacggctgtgaagatggcggcggctgcgtggcttcaggtgttgcctgtcattcttctgcttctgggagctcacccgtcaccactgtcgtttttcagtgcgggaccggcaaccgtagctgctgccgaccggtccaaatggcacattccgataccgtcgttgatggagaaccttgtgacctgtctttgaatataacctggtatctgaaaagcgctgattgttacaatgaaatctataacttcaaggcagaagaagtagagttgtatttggaaaaacttaaggaaaaaagaggcttgtctgggaaatatcaaacatcatcaaaattgttccagaactgcagtgaactctttaaaacacagaccttttctggagattttatgcatcgactgcctcttttaggagaaaaacaggaggctaaggagaatggaacaaaccttacctttattggagacaaaaccattcagatgcctttcttgaagaaacatttcttggattgttgaaagactttaataatttccaaagttccaaaagttgattttgatagtttttgccagtgttttcgttgcttttatggatgagtagattttcagagtttcttattctgccattctgaaagtgtctcactacctaaaccccagttttatttgtacagaattttaactgaatgtaagttaggcatgacagtctttgttaatttttttaaacaaaagatagccattaggactgggtacagtggctcacgcctgtaatgccaacactttgggaggccaaggtgggcagatgacttgaggttgggagttcgagaccagcttggccaatgtggtgaaactttgtctttactaaaaatacaaaaattagttgctcatggtggcaggcacctgtaatccaagctactcaggaggctgaggcaggagaatcgcgtgaacttgggaggtggaggctgcagtgagctgagatcacgctactgcactccagcctgggcagccagtgagattccatctcaaaaaaaaaagaaaaaagatattcattggattttctcttactaataggtatatattcactgtgaaaatggagacgatatacataaatgaaaagaagaaaatagtaatctataataccatgcagtgatatatttatcttcctattcttttgtatatgggcatgtttatattattttaaaaagggaatcttagagtatgtattatatgacttttttttgtagcttagcaatataacatggacatgtcgtcagtttggtaaatattgtattgcatcgttacttaaatgcttgtatagngtcttattgtatgagtacattgcaatttgttcaattcnctgttcttgaacttttatgagtttcattatcttggaattttatgcagtgttgtgattaatattttaactacatttgcttttaagtctttattttctgatctcagaagaattgtatattgggataagtttttaattctataacttaaaagtaaaaatcctttgtaattttatgttctaatagttttagcagtttggtgtgattacacagagcacatgcatattaaccaaaataagatcatattatataccattgtataattttttctttttattaccaaattggtacattgaatactacttcacctttttatggctgcttagtgttccattttattatgattttaataactcccaattgatgaacattggggttgttcccaaatttcccctattatgggtaaagttatgttcataatgtctagctatatttctgtgtacatttataatctttaggctaaattcctggaggtagaattgctagatccacatgtatgcacagtttaaaggtgctttttcatagcaatttatggccccaagaaagtgagagtgagtgtctttgtttatgttgctatgaaaggacacctggagctgggtaatttataaagaaaagaggtttatttggctcactgttctgtgggctatgaaagaagcatggtgccggcatctgtttctagtgagggcttcaggctgtttctactcatggtggaaggtgaaggggggagcctgtgtgtgcagatcacctggcaagagaggaagaaggaaagagggaggaggaggagaggaggtagtgggctttttttttaataatcaaggaaccaatagagggataactcattactgaaaggacagtggcaccaagccattcattagggattggctcccatgacccaaacacctctctctagaattcacctcaaacattggggatcaaatttcaatatgaaatttgggaggacagatatctaaaccatagcagtgagtttccatctttcctcacaaaaacaatggctgtcatcatttaaaatagattttatgcagtttgtctagttaagcaacaatttgttcttgtaaattgtatttaaaaagttatcgttaagccaggcgctgtggctcacacctgtaaccccagcaccttgggaggccacagcaggcagatcgctagagcttacgagtttgagaccaccctgggcaatatggtgaaacctcgtctctacaaaaaatggaaaaattagccagaaggtggcacgtgcacctgtagtccccgctacttgggagacngaagtgggaggatggcttgagtctgggaggcagaggttgcagtgagccaaagtcacaccacttcactctaggcgatagagccatacctcgtctctaaaacaaaaacaacagcaaaaaaattattgttgagggtgaaccttcatttatatggatattggcacttgtgctttcttcagttgtcttctgtgcacagcatactttgagttctactcaaggcttgagtcttgttacagtgattaaaactggctgaaaggtgagcctgttgaataccacaagtaatatttaggaatacttagtcaaaatatagtcaaaagaaatgaaagagttatctatcttttgatctttcttcctgaaaatttggtccaaggcaaataccttataatcctatttaaagaatattcacaggctgggttcagtggtaatctcagcactttttaaggcccaaggtgggtgaatcacttgaagccagggtttgagactagtctggtcaacatgacaaaaccctatctctactaaaaatgcaaaaattagcttggtgtggtggggtacacctgtaatcccagctacttgggtgcatgaggcctgagaatcacttgagnccaagaagcagaggttgtagtgagccatgattgcaccactgcactccagcctgggtgacaaaatgagactctgtctcaaaaagcaaaaaggatactcacaaattcagtacctccatcctatttcattaaagctctgattaaacatatatgtttatgggccgggtgtggtggctcacacctgtgatcccagcactttgggaggccaaggtgggtggatcacctgatgtcaggagttcgagatcagcctggcaaacatggtgaaacctcatctctactaaaaatac

SEQ ID NO: 355859 - DNA, 544 bp, Homo sapiens
tttcagatgacaaatgtcgacctaaatctgataactggcttattatgtaatttattggtgttattatagtagagattggtaatctacagtaagattttcagttaggatttgagattatgataataactaatagaatatttctaaattggaattagaagattgttgtatgacagagagtcaggacttgccatttggcaaacatcaaagtcattgtttggtgtgtaatagtacaaaatcatcttgcttaacagagaaaggatatctgttgctcccgaatgaaacaatttttctgaaatagagggcccagaattggtctctgacaattaataaagacatcaaagatagcaaaatgatttttatatcttagggccaatactaccaatttaataattaaaacaagttctggtgagctctgaacttggcagaattggtggcaacatagactttggattttccaaattccccacataaaacaaaggggatcaactagatagaaaaaccagaaacctttggaaatatctgttaaaaaaagaaaaaaaaaact

SEQ ID NO: 355860 - DNA, 473 bp, Homo sapiens
cccaccacaacacacacaccaacccccacaataggctagtacaggctggtgtgctcgcgtcgcatttggccgcctccctaccgctccaagcccagccctcagccatggcatgccccctggatcaggccattggcctcctcgtggccatcttccacaagtactccggcagggagggtgacaagcacaccctgagcaagaaggagctgaaggagctgatccagaaggagctcaccattggctcgaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagtggtgggtaattgtacaataaattttttttggtcaaattt

SEQ ID NO: 355861 - DNA, 442 bp, Homo sapiens
ttcgcccacgcgtcgcccgcggcgtcggtcgcatttggccgcctccctaccgctccaagcccagccctcagccatggcatgccccctggatcaggccattggcctcctcgtggccatcttccacaagtactccggcagggagggtgacaagcacaccctgagcaagaaggagctgaaggagctgatccagaaggagctcaccattggctcgaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagtggtgggtaattgtacaataaattttttttggtcaaattt

SEQ ID NO: 355862 - DNA, 538 bp, Homo sapiens
agcggaaactgagcaaactgagctgcgcagatgaggggagactcgtcaccaggcgtgcagtgggcactgctgggctcccccatcccgtcctaacccggaacagccccgggcaggaggcgtggaaagtcgagggggtaaaccgcgaatgctccaagcccagccctcagccatggcatgccccctggatcaggccattggcctcctcgtggccatcttccacaagtactccggcagggagggtgacaagcacaccctgagcaagaaggagctgaaggagctgatccagaaggagctcaccattggctcgaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagtggtgggtaattgtacaataaattttttttggtcaaattt

SEQ ID NO: 355863 - DNA, 436 bp, Homo sapiens
tctcgtgccgaattcggcacgagcgcatttggccgcctccctaccgctccaagcccagccctcagccatggcatgccccctggatcaggccattggcctcctcgtggccatcttccacaagtactccggcagggagggtgacaagcacaccctgagcaagaaggagctgaaggagctgatccagaaggagctcaccattggctcgaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagtggtgggtaattgtacaataaattttttttggtcaaattt

SEQ ID NO: 355864 - DNA, 471 bp, Homo sapiens
gtcctcaggacctcggatgattttggagccaaagctggggctgttgccacaaaagtagacatgcgggccgcctccctaccgctccaagcccagccctcagccatggcatgccccctggatcaggccattggcctcctcgtggccatcttccacaagtactccggcagggagggtgacaagcacaccctgagcaagaaggagctgaaggagctgatccagaaggagctcaccattggctcgaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagtggtgggtaattgtacaataaattttttttggtcaaattt

SEQ ID NO: 355865 - DNA, 1216 bp, Homo sapiens
  misc_feature (728)..(728): n is a, c, g, or t
  misc_feature (744)..(744): n is a, c, g, or t
  misc_feature (746)..(747): n is a, c, g, or t
agcggaaactgagcaaactgagctgcgcagatgaggggagactcgtcaccaggcgtgcagtgggcactgctgggctcccccatcccgtcctaacccggaacagccccgggcaggaggcgtggaaagtcgagggggtaaaccgcgaatgtgcgttgtgtaagccacggcgcagggtggggcgcgggcgggacttgggcgggcggggtgggcttggccgagctggcctccggggcaccgaccgctataaggccagtcggactgcgacacagcccatcccctcgaccgctcgcgtcgcatttggccgcctccctaccgctccaagcccagccctcagccatggcatgccccctggatcaggccattggcctcctcgtggccatcttccacaagtactccggcagggagggtgacaagcacaccctgagcaagaaggagctgaaggagctgatccagaaggagctcaccattggctcgaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagtggtgggtaattgtacaataaattttttttggtcaaattttaacaacacacaccacccacacncaacaccaccacaaananncaccaacctccacaacacaaaaaaagacacaaacaaaacaacacaccgcacaccaacaaaacaaaccgacaaacaaaaagagaaggcgaaagagtagcaaacaacaacacaacgcgaataacagagaaacaaacagcacggagggagggcggcgcgagagctagagcaagagcgagcggcgggaggggcaaatcctccgcgcacagcagcgccggcatagtgggtgtcaaggtcggcgagcgcccgcacagggacagcagacaagcatagcaaacttcaacaaaagcccgcgagcgcagccgacgatatttgacaaagcacacaacacggaggggagggggagcaagaacaccggacagggcgactcgagaggggatcggacaactgtcgaagagagcgcgcagcacatcgccatagaatcgtgaggaccgcgcacacatcacaaggagacgtggcacatctcgagcgc

SEQ ID NO: 355866 - DNA, 950 bp, Homo sapiens
agcggaaactgagcaaactgagctgcgcagatgaggggagactcgtcaccaggcgtgcagtgggcactgctgggctcccccatcccgtcctaacccggaacagccccgggcaggaggcgtggaaagtcgagggggtaaaccgcgaatgtgcgttgtgtaagccacggcgcagggtggggcgcgggcgggacttgggcgggcggggtgggcttggccgagctggcctccggggcaccgaccgctataaggccagtcggactgcgacacagcccatcccctcgaccgctcgcgtcgcatttggccgcctccctaccgctccaagcccagccctcagccatggcatgccccctggatcaggccattggcctcctcgtggccatcttccacaagtactccggcagggagggtgacaagcacaccctgagcaagaaggagctgaaggagctgatccagaaggagctcaccattggctcgaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagtggtgggtaattgtacaataaattttttttggtcaaatttaaaaaaaaaaaaattgagatagttctctctctccccaagtaggtctacaagaaggctaattccccttatcattagaaagagcttaatcacccgtttcagtgatccaggacgcttattaaattcagttgccttaattgtgggttacctagatccgtgttaggcccctttgctaaacatgtcaaagaaaagctaagttaagtactaacgattctaaaagggctcagggaattgaaacggtttgacta

SEQ ID NO: 355867 - DNA, 388 bp, Homo sapiens
gcggccgcctactactactaaattcgcggccgcgtcgacggccattggcctcctcgtggccatcttccacaagtactccggcagggagggtgacaagcacaccctgagcaagaaggagctgaaggagctgatccagaaggagctcaccattggctcgaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagtggtgggtaattgtacaataaattttttttggtcaaattt

SEQ ID NO: 355868 - DNA, 754 bp, Homo sapiens
agaacaccttatgtctaacccactcttatgttctgacccaccctcgaccgctcgcgtcgcatttggccgcctccctaccgctccaagcccagccctcagccatggcatgccccctggatcaggccattggcctcctcgtggccatcttccacaagtactccggcagggagggtgacaagcacaccctgagcaagaaggagctgaaggagctgatccagaaggagctcaccattggctcgaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagtggtgggtaccattgtgatactaaaaaaaaaaaaaacacacgaacaaaccaaaaaaaaatgttgttgggcggcacgcggggacccagagaaaggtttcaaaaacaatctcgtgtgggggccgcgggggcccaggagatggtcaggtcgccactgtggcccacaacggggtccaaaagagaaacccgggggccggatagggggtgggtttccccaaataaaaaaaaggcggggggcacccgagcgcgtgtggaccaccccagaaggggggtcgagggcaacggggctacaccgggagcaagcgagcaaaaatcaggcgggggggt

SEQ ID NO: 355869 - DNA, 746 bp, Homo sapiens
aaaaggaaataggccaggtacgaggccggtggtaatcggcaccgaggggactgcgacacagcccatcccctcgaccgctcgcgtcgcatttggccgcctccctaccgctccaagcccagccctcagccatggcatgccccctggatcaggccattggcctcctcgtggccatcttccacaagtactccggcagggagggtgacaagcacaccctgagcaagaaggagctgaaggagctgatccagaaggagctcaccattggctcgaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagtggtgggtaattgtacaataaattttttttggtcaaatttaaaaaaaaaaaaaaaaaaaaaaaaaaaaaaaaaaaaaaaaaacacccgggggcatctttttgcgcgggggggggaaaaagggggtaagaaagtgggccgatgtgtgcacaaaggagtttcctctggtggaccaaattttcttgtgttcaccaggggggaaaattcgccggagatccccataataaggaggccgaaatatataattcagaaaaccccgggttacccgggattataggcgctggcgaaaag

SEQ ID NO: 355870 - DNA, 892 bp, Homo sapiens
tctcgtgccgaattcggcacgagcgcatttggccgcctccctaccgctccaagcccagccctcagccatggcatgccccctggatcaggccattggcctcctcgtggccatcttccacaagtactccggcagggagggtgacaagcacaccctgagcaagaaggagctgaaggagctgatccagaaggagctcaccattggctcgaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagtggtgggtaattgtacaataaattttttttggtcaaatttaaaaaaaaaaaaaaaaaaaaaaaaaaaaaaaaaaaaaaaaaaaaaaaaacacaccaaaaaacaaagggggggggacgacaaaaaaaacccccggggggggccacagaagaggacaacaccaagactggggaacaacaggcggacaaaagagggggcacaaaatacgcgacgaaaggcgcggggcgcgcacacaaaccgggacgagaggggaaccaccggaccagcgggaagagcgagagaaaagagccaccaacaaaagacggcggaggggggaggaacacacagaggggacaaaacaactccaacagaagagacaaaacaacgagccagagagaaaaacaaaaagcagtcagacggggcagacggggtccacacaaagcagagtcaacagagcggagcgccaagcaaaaagggtacaaacagacgaagcacataacagccaaaaaatatacacga

SEQ ID NO: 355871 - DNA, 679 bp, Homo sapiens
gtcctcaggacctcggatgattttggagccaaagctggggctgttgccacaaaagtagacatgcgggccgcctccctaccgctccaagcccagccctcagccatggcatgccccctggatcaggccattggcctcctcgtggccatcttccacaagtactccggcagggagggtgacaagcacaccctgagcaagaaggagctgaaggagctgatccagaaggagctcaccattggctcgaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagtggtgggtaattgtacaataaattttttttggtcaaatttaaaaaaaaaaaaaaaaaaacaaaaaaaaaaaatgggggggattaagggggggggggggaaaaaggggtacggaaggggccagggggcaaagggtgtccggtgacccaagtttttggggtcaaaggggggaaatggggggggcccccataagggggggcgaattaaatccgaaaaagccggggtacccgggttaggacgtggggaaaac

SEQ ID NO: 355872 - DNA, 614 bp, Homo sapiens
acatataccaactgtggtagtctgaattgtcctccaaagatatcaggccctgaaactggtgagttttacattatgaaaccaaaggtgtgattaagttgaggatcttgagatggaaggattatactggactgtccaggtgggagcggtcgacggacgcgtccgtcgaccgctcgcgtcgcatttggccgcctccctaccgctccaagcccagccctcagccatggcatgccccctggatcaggccattggcctcctcgtggccatcttccacaagtactccggcagggagggtgacaagcacaccctgagcaagaaggagctgaaggagctgatccagaaggagctcaccattggctcgaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagcggtcgacggacgcgtccgtcgaccgctattcactcaaggaaaggttggataggattgccaaata

SEQ ID NO: 355873 - DNA, 535 bp, Homo sapiens
agaggtgcctggtgcatctgactcacatttacccacattctgaggccctggtccacatgtagaccctgagctgtagacccactctcccagcgggtaggggatgcttccagccggatatccatctctccaaatgaggaccagtaactgagaagtagctgaggagaagcaatgccaaagtgacatgggtccttggtgatgagggagcacagagccacttgcagagaggattgcctgggagggggaaggggaagaatccagggttgtcatcaccactgagtatggatttcacattctaacacattagaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagtggtgggtaattgtacaataaattttttttggtcaaattt

SEQ ID NO: 355874 - DNA, 933 bp, Homo sapiens
  misc_feature (384)..(384): n is a, c, g, or t
  misc_feature (466)..(466): n is a, c, g, or t
aaaaggaaataggccaggtacgaggccggtggtaatcggcaccgaggggactgcgacacagcccatcccctcgaccgctcgcgtcgcatttggccgcctccctaccgctccaagcccagccctcagccatggcatgccccctggatcaggccattggcctcctcgtggccatcttccacaagtactccggcagggagggtgacaagcacaccctgagcaagaaggagctgaaggagctgatccagaaggagctcaccattggctcgaagctgcaggatgctgaaattgcaaggctgatggaagacttggaccggaactaatggacctaggagtgtgaatcttccatggagtatgtcatccttcctggagggcctttggctttgnatctacaagtgaaggcccgtcaacgggctgaaacataacagtagggatatatggcagacagccctctggcgggtcctctctngagtcagaagtccatgtggttggcgctaattgtagcaagtagacacttgttgtgtttcgtgtcaagagttgtaacagacaaccacaatataaacatagacgatagtagcacattgaaacacacgaaccagagacaagaagacatacaatgcggggcgggcgacccagagacgggtgcccctccagaggcgcgcgcgaactttgacagagccatgcaaccaggattcgtatgcgaggcatagaagtggggcgtgcccccacacatgaggggagcggcgccagtctaaagatcacaggcgagcgagcagatcggagtgccccggagcatgccaagcatagcattgggcgaggcgtgggcaaaataaggcggcgccaggcaagagcgggcatatggtcgagggaaaggcaccgacggcggcgggccaggcgggggcgacccattgttggggcgcaaaaatcatcccccaa

SEQ ID NO: 355875 - DNA, 1292 bp, Homo sapiens
agcggaaactgagcaaactgagctgcgcagatgaggggagactcgtcaccaggcgtgcagtgggcactgctgggctcccccatcccgtcctaacccggaacagccccgggcaggaggcgtggaaagtcgagggggtaaaccgcgaatgtgcgttgtgtaagccacggcgcagggtggggcgcgggcgggacttgggcgggcggggtgggcttggccgagctggcctccggggcaccgaccgctataaggccagtcggactgcgacacagcccatcccctcgaccgctcgcgtcgcatttggccgcctccctaccgtgagttctctccaggagccctgggtactttccagggccagctgccctcacgctgggggtccagccatcccctgcccagttcagccgctggatccagactggggccatctgtggcgctcccccgctggagggatagtcaggagcagcagtgctgtgccaggcaggccttgggctaagggatcgcaatggggtgtgctcttttggggtgcggaagggagtgccctgggtgtgtcattgccaccatgtgtggccctgtgaagctgtgtttaagctgcctttgcagcctccattcccctcccctgcccagccatactcctcaacttctggatcccctgaaggacagttctcagctgtgcccaaagctactgttcctatatgcttcttagaatccttaagccacctctcttgccttggccctagtgtgctctctccttccccttcaagccctgggctgtctcctgatgccattgtgtgtggcctgagactgggtggttccaaaggaggcggggctagtgcaggcagcattattggggtgtgtgggtgagaagtccttgctcccatggcactgactaggccctctgctgccagctccaagcccagccctcagccatggcatgccccctggatcaggccattggcctcctcgtggccatcttccacaagtactccggcagggagggtgacaagcacaccctgagcaagaaggagctgaaggagctgatccagaaggagctcaccattggctcgaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagtggtgggtaattgtacaataaattttttttggtcaaattt

SEQ ID NO: 355876 - DNA, 630 bp, Homo sapiens
agaacaccttatgtctaacccactcttatgttctgacccaccctcgaccgctcgcgtcgcatttggccgcctccctaccgtgagttctctccaggagccctgggtactttccagggccagctgccctcacgctgggggtccagccatcccctgcccagttcagccgctggatccagactggggccatctgtggcgctcccccgctggagggatagtcaggagcagcagtgctgtgccaggctccaagcccagccctcagccatggcatgccccctggatcaggccattggcctcctcgtggccatcttccacaagtactccggcagggagggtgacaagcacaccctgagcaagaaggagctgaaggagctgatccagaaggagctcaccattggctcgaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagtggtgggtaattgtacaataaattttttttggtcaaattt

SEQ ID NO: 355877 - DNA, 826 bp, Homo sapiens
cgggaagataacttcggcttctggtggtgggtgggtgatagactctcaaaatccaaagcataggttttttctgggtgtgtcattgccaccatgtgtggccctgtgaagctgtgtttaagctgcctttgcagcctccattcccctcccctgcccagccatactcctcaacttctggatcccctgaaggacagttctcagctgtgcccaaagctactgttcctatatgcttcttagaatccttaagccacctctcttgccttggccctagtgtgctctctccttccccttcaagccctgggctgtctcctgatgccattgtgtgtggcctgagactgggtggttccaaaggaggcggggctagtgcaggcagcattattggggtgtgtgggtgagaagtccttgctcccatggcactgactaggccctctgctgccagctccaagcccagccctcagccatggcatgccccctggatcaggccattggcctcctcgtggccatcttccacaagtactccggcagggagggtgacaagcacaccctgagcaagaaggagctgaaggagctgatccagaaggagctcaccattggctcgaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagtggtgggtaattgtacaataaattttttttggtcaaattt

SEQ ID NO: 355878 - DNA, 589 bp, Homo sapiens
acatataccaactgtggtagtctgaattgtcctccaaagatatcaggccctgaaactggtgagttttacattatgaaaccaaaggtgtgattaagttgaggatcttgagatggaaggattatactggactgtccaggtgggagcggtcgacggacgcgtccgtcgaccgctcgcgtcgcatttggccgcctccctaccgctccaagcccagccctcagccatggcatgccccctggatcaggccattggcctcctcgtggccatcttccacaagtactccggcagggagggtgacaagcacaccctgagcaagaaggagctgaaggagctgatccagaaggagctcaccattggctcgaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagtggtgggtaattgtacaataaattttttttggtcaaattt

SEQ ID NO: 355879 - DNA, 1048 bp, Homo sapiens
agcggaaactgagcaaactgagctgcgcagatgaggggagactcgtcaccaggcgtgcagtgggcactgctgggctcccccatcccgtcctaacccggaacagccccgggcaggaggcgtggaaagtcgagggggtaaaccgcgaatgtgcgttgtgtaagccacggcgcagggtggggcgcgggcgggacttgggcgggcggggtgggcttggccgagctggcctccggggcaccgaccgctataaggccagtcggactgcgacacagcccatcccctcgaccgctcgcgtcgcatttggccgcctccctaccgctccaagcccagccctcagccatggcatgccccctggatcaggccattggcctcctcgtggccatcttccacaagtactccggcagggagggtgacaagcacaccctgagcaagaaggagctgaaggagctgatccagaaggagctcaccattggctcgaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagtggtgggtaattgtacaataaattttttttggtcaaatttaaaaaaaaaaaaaaaaaaactcggagagactaggtgcatcccggagtcgtccaagcccggtttgaacggctccccggaagccaaccgggaacccattgggaagggccaacagggggaccggcatagggcctgagccgggaggtgcagcagaagcatggaagaaacaatatgatgcagatcgggagcagatccggatccaggggatcacacaacaagggccgaaagggcgcgtgggccggcccccaagccgggacgcgagaacttccagaacggcgctcaaggatggcagggagtactgggagccataatgcatgggcccagaggggaggcccaggagaggacg

SEQ ID NO: 355880 - DNA, 1205 bp, Homo sapiens
agcggaaactgagcaaactgagctgcgcagatgaggggagactcgtcaccaggcgtgcagtgggcactgctgggctcccccatcccgtcctaacccggaacagccccgggcaggaggcgtggaaagtcgagggggtaaaccgcgaatgtgcgttgtgtaagccacggcgcagggtggggcgcgggcgggacttgggcgggcggggtgggcttggccgagctggcctccggggcaccgaccgctataaggccagtcggactgcgacacagcccatcccctcgaccgctcgcgtcgcatttggccgcctccctaccgctccaagcccagccctcagccatggcatgccccctggatcaggccattggcctcctcgtggccatcttccacaagtactccggcagggagggtgacaagcacaccctgagcaagaaggagctgaaggagctgatccagaaggagctcaccattggctcgaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagtggtgggtaattgtacaataaattttttttggtcaaatttaaaaaaaaaaaaaaaaaaaaaaaaaaaaaaaaaaaaaaaagaaaaaaaaaaaaggggggggggcataaaagttcctctctcggggggggggccaacagcttacgaatatgaaccccggtttttgtgataaaagggggtcccctataataggggaggctgattattatttaagacgcaacgcaaggggagcgcggtttttaaaaaacgctgggtcgtggggaaaacagggggcacaccgtggggggaaatcttctggtgggagaaacgaacccctcatccctcgtggggggggggggccacctaccggggggcgaaacaactacccctcatcgaaaggataatataatagccccctacgaaggggacaccttatactcaaacttccaccggctgatattgtgggcggttcaccacaatgggcgctatatcgcgcggcgcggctagggacattctggccttgcgggattttctctctgacacaattttactcgcggggccga

SEQ ID NO: 355881 - DNA, 1403 bp, Homo sapiens
  misc_feature (1025)..(1026): n is a, c, g, or t
agcggaaactgagcaaactgagctgcgcagatgaggggagactcgtcaccaggcgtgcagtgggcactgctgggctcccccatcccgtcctaacccggaacagccccgggcaggaggcgtggaaagtcgagggggtaaaccgcgaatgtgcgttgtgtaagccacggcgcagggtggggcgcgggcgggacttgggcgggcggggtgggcttggccgagctggcctccggggcaccgaccgctataaggccagtcggactgcgacacagcccatcccctcgaccgctcgcgtcgcatttggccgcctccctaccgctccaagcccagccctcagccatggcatgccccctggatcaggccattggcctcctcgtggccatcttccacaagtactccggcagggagggtgacaagcacaccctgagcaagaaggagctgaaggagctgatccagaaggagctcaccattggctcgaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagtggtgggtaattgtacaataaattttttttggtcaaatttaaaaaaaaaaaaagaaaaaaaaaaaaaaaatttttgggcggccttgggccctagaaaaagtttttaaaacccttcggttgggggcggggccccggtgggtagggacctgggccaaaaggggtcccaaggaaaccgggggccatgagatcagcgggtcggggttcccccacccaaaaaaaaaacgcgcgggggcaccgcgggggggttctggaccaaaccccagaagggagctccgggagggccataaaggggtcctataccaaacagggggccccaagggaggcgctccgataatcaaattatccgcgcgcgcggggggnnaaacacacaccaaccacacaaagaaaaacacaacaaaatagaaaacaacacacgcacgagaaagagacacagaacagaggtgaaggagacaaacagaaaaagacagggagagaggcgaagaaggacagaggagagaggaaaaggagcgagggggagaggacaaaagatcgacgacggaaggacgacgagacagaaagcgacaggacacgcgagaacaagacaacacgcgagcaagggaaagccgcgagaaaggcaaaggagggagggaacagacagagaaagccaagaagaagacagagagaagcggcaaaggaggagaatgcgaaacagagcgaaaaagagagagactggagaaggacgaaaaaggagggagcaac

SEQ ID NO: 355882 - DNA, 1194 bp, Homo sapiens
agcggaaactgagcaaactgagctgcgcagatgaggggagactcgtcaccaggcgtgcagtgggcactgctgggctcccccatcccgtcctaacccggaacagccccgggcaggaggcgtggaaagtcgagggggtaaaccgcgaatgtgcgttgtgtaagccacggcgcagggtggggcgcgggcgggacttgggcgggcggggtgggcttggccgagctggcctccggggcaccgaccgctataaggccagtcggactgcgacacagcccatcccctcgaccgctcgcgtcgcatttggccgcctccctaccgctccaagcccagccctcagccatggcatgccccctggatcaggccattggcctcctcgtggccatcttccacaagtactccggcagggagggtgacaagcacaccctgagcaagaaggagctgaaggagctgatccagaaggagctcaccattggctcgaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagtggtgggtaattgtacaataaattttttttggtcaaatttaaaaaaaaaaaagcgcctcggaggcgtcagctgttcaagatgaagtgaacatctccttcccagccactggtgcagaaatcattgaagtggacgatgaacgcaaattcgtacttctatgagaagcgtatggcacagaagttgtgctgagctctgggtgaagaatggcaggggttatgtggccgaatcagggtggaaacgacagacaggttcccatgaagcaggtgtcttgacccatggcgggtccggctgctaatgaagaaggggatctgtgacagaccagggacggcgaagaacggaacatcagtcgggtggcttgcggtgaaactgggggctcaactggttctgggacacaggcgagggatccgcgggaggaaacagggccgccggtgggcccaagattaggacccggaatcaaccccaaaaaggtcgcgatgtggaacgttaagggagaacggcaccaaaaggcgtccgtggaaggggttgagagca

SEQ ID NO: 355883 - DNA, 755 bp, Homo sapiens
agcggaaactgagcaaactgagctgcgcagatgaggggagactcgtcaccaggcgtgcagtgggcactgctgggctcccccatcccgtcctaacccggaacagccccgggcaggaggcgtggaaagtcgagggggtaaaccgcgaatgtgcgttgtgtaagccacggcgcagggtggggcgcgggcgggacttgggcgggcggggtgggcttggccgagctggcctccggggcaccgaccgctataaggccagtcggactgcgacacagcccatcccctcgaccgctcgcgtcgcatttggccgcctccctaccgctccaagcccagccctcagccatggcatgccccctggatcaggccattggcctcctcgtggccatcttccacaagtactccggcagggagggtgacaagcacaccctgagcaagaaggagctgaaggagctgatccagaaggagctcaccattggctcgaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagcggtcgacggacggcccgagaacttctgcatgctgcaggtgcagccaaaaaaagaaaaatgcattgtggtaaagggcccaaccaagacac

SEQ ID NO: 355884 - DNA, 989 bp, Homo sapiens
agcggaaactgagcaaactgagctgcgcagatgaggggagactcgtcaccaggcgtgcagtgggcactgctgggctcccccatcccgtcctaacccggaacagccccgggcaggaggcgtggaaagtcgagggggtaaaccgcgaatgtgcgttgtgtaagccacggcgcagggtggggcgcgggcgggacttgggcgggcggggtgggcttggccgagctggcctccggggcaccgaccgctataaggccagtcggactgcgacacagcccatcccctcgaccgctcgcgtcgcatttggccgcctccctaccgctccaagcccagccctcagccatggcatgccccctggatcaggccattggcctcctcgtggccatcttccacaagtactccggcagggagggtgacaagcacaccctgagcaagaaggagctgaaggagctgatccagaaggagctcaccattggctcgaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagtggtgggtaccattgtgatactaaaaaaaaaaaaaacacacgaacaaaccaaaaaaaaatgttgttgggcggcacgcggggacccagagaaaggtttcaaaaacaatctcgtgtgggggccgcgggggcccaggagatggtcaggtcgccactgtggcccacaacggggtccaaaagagaaacccgggggccggatagggggtgggtttccccaaataaaaaaaaggcggggggcacccgagcgcgtgtggaccaccccagaaggggggtcgagggcaacggggctacaccgggagcaagcgagcaaaaatcaggcgggggggt

SEQ ID NO: 355885 - DNA, 1704 bp, Homo sapiens
agcggaaactgagcaaactgagctgcgcagatgaggggagactcgtcaccaggcgtgcagtgggcactgctgggctcccccatcccgtcctaacccggaacagccccgggcaggaggcgtggaaagtcgagggggtaaaccgcgaatgtgcgttgtgtaagccacggcgcagggtggggcgcgggcgggacttgggcgggcggggtgggcttggccgagctggcctccggggcaccgaccgctataaggccagtcggactgcgacacagcccatcccctcgaccgctcgcgtcgcatttggccgcctccctaccgtgagttctctccaggagccctgggtactttccagggccagctgccctcacgctgggggtccagccatcccctgcccagttcagccgctggatccagactggggccatctgtggcgctcccccgctggagggatagtcaggagcagcagtgctgtgccaggcaggccttgggctaagggatcgcaatggggtgtgctcttttggggtgcggaagggagtgccctgggtgtgtcattgccaccatgtgtggccctgtgaagctgtgtttaagctgcctttgcagcctccattcccctcccctgcccagccatactcctcaacttctggatcccctgaaggacagttctcagctgtgcccaaagctactgttcctatatgcttcttagaatccttaagccacctctcttgccttggccctagtgtgctctctccttccccttcaagccctgggctgtctcctgatgccattgtgtgtggcctgagactgggtggttccaaaggaggcggggctagtgcaggcagcattattggggtgtgtgggtgagaagtccttgctcccatggcactgactaggccctctgctgccagctccaagcccagccctcagccatggcatgccccctggatcaggccattggcctcctcgtggccatcttccacaagtactccggcagggagggtgacaagcacaccctgagcaagaaggagctgaaggagctgatccagaaggagctcaccattggctcgaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagtggtgggtaattgtacaataaattttttttggtcaaatttaaaaaaaaaaaaaaaaaaaaaaaaaaatctggtgtgcgcgcgcgcgcgcacctacggcgcccttcgagaaaaagcgtctttcagaaacacattccggtatgggcgcgcgcgcgggggccaaatataggggaacagtggagcacccgtgggccaaaagcgcgtggtctccacaaggagagaccccggggcacaagacaaaagggcggcgggggggaatcttctctcacccaatatataaaaaaaaggcccccggcggggggaacaaccgcgagaggcgtgtcttctggacacaaaaatctttcgcagagagcgggagagttcgtggagggggcaccatcaacagggggggaattctatattaaacccgggggagcgcttcccagaggacgaaagccctaaaattttcaaatgt

SEQ ID NO: 355886 - DNA, 327 bp, Homo sapiens
tataccaccctataccaccgaactataccacccaagcacaccctgagcaagaaggagctgaaggagctgatccagaaggagctcaccattggctcgaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagtggtgggtaattgtacaataaattttttttggtcaaattt

SEQ ID NO: 355887 - DNA, 334 bp, Homo sapiens
gcggccgcctactactactaaattcgcggccgcgtcgaccaagcacaccctgagcaagaaggagctgaaggagctgatccagaaggagctcaccattggctcgaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagtggtgggtaattgtacaataaattttttttggtcaaattt

SEQ ID NO: 355888 - DNA, 941 bp, Homo sapiens
gcggccgcctactactactaaattcgcggccgcgtcgaccgcatttggccgcctccctaccgctccaagcccagccctcagccatggcatgccccctggatcaggccattggcctcctcgtggccatcttccacaagtactccggcagggagggtgacaagcacaccctgagcaagaaggagctgaaggagctgatccagaaggagctcaccattggctcgaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagtggtgggtaattgtacaataaattttttttggtcaaatttaaaaaaaaaaaagcgcctcggaggcgtcagctgttcaagatgaagtgaacatctccttcccagccactggtgcagaaatcattgaagtggacgatgaacgcaaattcgtacttctatgagaagcgtatggcacagaagttgtgctgagctctgggtgaagaatggcaggggttatgtggccgaatcagggtggaaacgacagacaggttcccatgaagcaggtgtcttgacccatggcgggtccggctgctaatgaagaaggggatctgtgacagaccagggacggcgaagaacggaacatcagtcgggtggcttgcggtgaaactgggggctcaactggttctgggacacaggcgagggatccgcgggaggaaacagggccgccggtgggcccaagattaggacccggaatcaaccccaaaaaggtcgcgatgtggaacgttaagggagaacggcaccaaaaggcgtccgtggaaggggttgagagca

SEQ ID NO: 355889 - DNA, 1035 bp, Homo sapiens
agaggtgcctggtgcatctgactcacatttacccacattctgaggccctggtccacatgtagaccctgagctgtagacccactctcccagcgggtaggggatgcttccagccggatatccatctctccaaatgaggaccagtaactgagaagtagctgaggagaagcaatgccaaagtgacatgggtccttggtgatgagggagcacagagccacttgcagagaggattgcctgggagggggaaggggaagaatccagggttgtcatcaccactgagtatggatttcacattctaacacattagaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagtggtgggtaattgtacaataaattttttttggtcaaatttaaaaaaaaaaaaaaaaaaaaaaaaaaaaaaaaaaaaaaaagaaaaaaaaaaaaggggggggggcataaaagttcctctctcggggggggggccaacagcttacgaatatgaaccccggtttttgtgataaaagggggtcccctataataggggaggctgattattatttaagacgcaacgcaaggggagcgcggtttttaaaaaacgctgggtcgtggggaaaacagggggcacaccgtggggggaaatcttctggtgggagaaacgaacccctcatccctcgtggggggggggggccacctaccggggggcgaaacaactacccctcatcgaaaggataatataatagccccctacgaaggggacaccttatactcaaacttccaccggctgatattgtgggcggttcaccacaatgggcgctatatcgcgcggcgcggctagggacattctggccttgcgggattttctctctgacacaattttactcgcggggccga

SEQ ID NO: 355890 - DNA, 252 bp, Homo sapiens
  misc_feature (49)..(49): n is a, c, g, or t
tcgagctccggtacaccctcccaaggaatagagaaattgcaaaggctgnatggaagacattggacccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagtggtgggtaattgtacaataaattttttttggtcaaattt

SEQ ID NO: 355891 - DNA, 234 bp, Homo sapiens
gtgctgtatcgccaacacatgtatatacatacagcaaggagtttcggagattaaaaggaccaggaggtgaacttccaggagtatgtcaccttcctgggggccttggctttgatctacaatgaagccctcaagggctgaaaataaatagggaagatggagacaccctctgggggtcctctctgagtcaaatccagtggtgggtaattgtacaataaattttttttggtcaaattt

SEQ ID NO: 355892 - DNA, 1000 bp, Homo sapiens
  misc_feature (955)..(955): n is a, c, g, or t
  misc_feature (981)..(981): n is a, c, g, or t
  misc_feature (999)..(999): n is a, c, g, or t
agcggaaactgagcaaactgagctgcgcagatgaggggagactcgtcaccaggcgtgcagtgggcactgctgggctcccccatcccgtcctaacccggaacagccccgggcaggaggcgtggaaagtcgagggggtaaaccgcgaatgtgcgttgtgtaagccacggcgcagggtggggcgcgggcgggacttgggcgggcggggtgggcttggccgagctggcctccggggcaccgaccgctataaggccagtcggactgcgacacagcccatcccctcgaccgctcgcgtcgcatttggccgcctccctaccgctccaagcccagccctcagccatggcatgccccctggatcaggccattggcctcctcgtggccatcttccacaagtactccggcagggagggtgacaagcacaccctgagcaagaaggagctgaaggagctgatccagaaggagctcaccattggctcgaagctgcaggatgctgaaattgcaaggctgatggaagacttggaccggaacaatacagccaatggcattgccctgctctgggccccgcggcccttcaacctacgctctggtcgcacccgtcgggccctggacataccccttgtcaagaactggtatcgggagcattgtcctgccgggcagcctgtgaaagtgagggtctcctaccagaagctgcttaagtactatgtgctgaatgccctgaagcatcggccccctaaggctcaaaagaagaggtatttgttccgctccttcaaagccaccaaattctttcagtccacaaagctggactgggtggaggttgggctccaggtttgccgccagggctacaacatgctcaaccttctcattcaccgcaaaaacctcaactacctgcacctggactacaacttcaacctcaacctgtgaaaacgctaccaccaaggaaagaaagaaatctcgtttnggaatgctttccactgtgtcgggaanttctgcgtttgactaaanc

SEQ ID NO: 355893 - DNA, 705 bp, Homo sapiens
agcggaaactgagcaaactgagctgcgcagatgaggggagactcgtcaccaggcgtgcagtgggcactgctgggctcccccatcccgtcctaacccggaacagccccgggcaggaggcgtggaaagtcgagggggtaaaccgcgaatgtgcgttgtgtaagccacggcgcagggtggggcgcgggcgggacttgggcgggcggggtgggcttggccgagctggcctccggggcaccgaccgctataaggccagtcggactgcgacacagcccatcccctcgaccgctcgcgtcgcatttggccgcctccctaccgctccaagcccagccctcagccatggcatgccccctggatcaggccattggcctcctcgtggccatcttccacaagtactccggcagggagggtgacaagcacaccctgagcaagaaggagctgaaggagctgatccagaaggagctcaccattggctcgaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagtggtgggtaattgtacaataaattttttttggtcaaattt

SEQ ID NO: 355894 - DNA, 446 bp, Homo sapiens
gcggccgcctactactactactactgctcgaattcagcttctaacgatgtacggggctccaagcccagccctcagccatggcatgccccctggatcaggccattggcctcctcgtggccatcttccacaagtactccggcagggagggtgacaagcacaccctgagcaagaaggagctgaaggagctgatccagaaggagctcaccattggctcgaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagtggtgggtaattgtacaataaattttttttggtcaaattt

SEQ ID NO: 355895 - DNA, 407 bp, Homo sapiens
  misc_feature (40)..(40): n is a, c, g, or t
  misc_feature (54)..(54): n is a, c, g, or t
ctggtttcaccgctaccaagacccgactctgcgacctggncatggccccctggntacaggccattggcctcctcgtggccatcttccacaagtactccggcagggagggtgacaagcacaccctgagcaagaaggagctgaaggagctgatccagaaggagctcaccattggctcgaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagtggtgggtaattgtacaataaattttttttggtcaaattt

SEQ ID NO: 355896 - DNA, 693 bp, Homo sapiens
ttcgcccacgcgtcgcccgcggcgtcggtcgcatttggccgcctccctaccgctccaagcccagccctcagccatggcatgccccctggatcaggccattggcctcctcgtggccatcttccacaagtactccggcagggagggtgacaagcacaccctgagcaagaaggagctgaaggagctgatccagaaggagctcaccattggctcgaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagtggtgggtaattgtacaataaattttttttggtcaaatttaaaaaaaaaaaaaaaaaaaaaaaaaaaaaaaaaaaaaaaaaaaaacataaaagaaaagcacgagaaaaagagagaaaacgacgaagagaagaaagagaaacaagaagagagagaaaaatggagaacaagcagaagagaaaaagagaggaaagaagaggagaaaagcaacggaaagagaaacaaaagaaagaaagaggaagaaagaaagaaagaagaagagcggagaaggaagaggaacaagagagagagag

SEQ ID NO: 355897 - DNA, 554 bp, Homo sapiens
cccaccacaacacacacaccaacccccacaataggctagtacaggctggtgtgctcgcgtcgcatttggccgcctccctaccgctccaagcccagccctcagccatggcatgccccctggatcaggccattggcctcctcgtggccatcttccacaagtactccggcagggagggtgacaagcacaccctgagcaagaaggagctgaaggagctgatccagaaggagctcaccattggctcgaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagtggtgggtaattgtacaataaattttttttggtcaaatttaaaaaaattcaaacatattactgatctcctcacacccatttggctcatctattaccctatagaggactaaagaaaaaactt

SEQ ID NO: 355898 - DNA, 598 bp, Homo sapiens
acatataccaactgtggtagtctgaattgtcctccaaagatatcaggccctgaaactggtgagttttacattatgaaaccaaaggtgtgattaagttgaggatcttgagatggaaggattatactggactgtccaggtgggagcggtcgacggacgcgtccgtcgaccgctcgcgtcgcatttggccgcctccctaccgctccaagcccagccctcagccatggcatgccccctggatcaggccattggcctcctcgtggccatcttccacaagtactccggcagggagggtgacaagcacaccctgagcaagaaggagctgaaggagctgatccagaaggagctcaccattggctcgaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagcggtcgacggacgggggatcctgctagagtcgacgcaacaaaaacgcaa

SEQ ID NO: 355899 - DNA, 663 bp, Homo sapiens
agcggaaactgagcaaactgagctgcgcagatgaggggagactcgtcaccaggcgtgcagtgggcactgctgggctcccccatcccgtcctaacccggaacagccccgggcaggaggcgtggaaagtcgagggggtaaaccgcgaatggccagctgccctcacgctgggggtccagccatcccctgcccagttcagccgctggatccagactggggccatctgtggcgctcccccgctggagggatagtcaggagcagcagtgctgtgccaggctccaagcccagccctcagccatggcatgccccctggatcaggccattggcctcctcgtggccatcttccacaagtactccggcagggagggtgacaagcacaccctgagcaagaaggagctgaaggagctgatccagaaggagctcaccattggctcgaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagtggtgggtaattgtacaataaattttttttggtcaaattt

SEQ ID NO: 355900 - DNA, 443 bp, Homo sapiens
ccatgtcagaatatactcgaccgctcgcgtcgcatttggccgcctccctaccgctccaagcccagccctcagccatggcatgccccctggatcaggccattggcctcctcgtggccatcttccacaagtactccggcagggagggtgacaagcacaccctgagcaagaaggagctgaaggagctgatccagaaggagctcaccattggctcgaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagtggtgggtaattgtacaataaattttttttggtcaaattt

SEQ ID NO: 355901 - DNA, 452 bp, Homo sapiens
gcggccgcctactactactaaattcgcggccgcgtcgaccgcatttggccgcctccctaccgctccaagcccagccctcagccatggcatgccccctggatcaggccattggcctcctcgtggccatcttccacaagtactccggcagggagggtgacaagcacaccctgagcaagaaggagctgaaggagctgatccagaaggagctcaccattggctcgaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagtggtgggtaattgtacaataaattttttttggtcaaattt

SEQ ID NO: 355902 - DNA, 1164 bp, Homo sapiens
agcggaaactgagcaaactgagctgcgcagatgaggggagactcgtcaccaggcgtgcagtgggcactgctgggctcccccatcccgtcctaacccggaacagccccgggcaggaggcgtggaaagtcgagggggtaaaccgcgaatgtgcgttgtgtaagccacggcgcagggtggggcgcgggcgggacttgggcgggcggggtgggcttggccgagctggcctccggggcaccgaccgctataaggccagtcggactgcgacacagcccatcccctcgaccgctcgcgtcgcatttggccgcctccctaccgctccaagcccagccctcagccatggcatgccccctggatcaggccattggcctcctcgtggccatcttccacaagtactccggcagggagggtgacaagcacaccctgagcaagaaggagctgaaggagctgatccagaaggagctcaccattggctcgaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagtggtgggtaattgtacaataaattttttttggtcaaatttaaaaaaaaaaaaaaaaaaacaaaaaaaaaaaaaaagaggggggggggctaaaaaatttcccgggggggccccagtttaggggttacccagtttttttggttcaaggggggcccccttggggggggggtataaaaaagagggggggccgggtttaaacaaggtgggggtggggaaacaccggctaggtggggactctgtggaaggggacccttacctcgcggcggcgggccactcgttgggcacctaccccaacagagattaaacggccgaggggaaacacaacctttcacgcggtgacgtgggggtaacccacgcgataatcttggcggtggaaagttcggtcccggtttggttttcgaattttcagcgtcgtcgctactatatcggcacaaccacacccagaccaacacacagggcagcactacacgcaacagaccccaccacacaacgtacaaaaca

SEQ ID NO: 355903 - DNA, 1117 bp, Homo sapiens
agcggaaactgagcaaactgagctgcgcagatgaggggagactcgtcaccaggcgtgcagtgggcactgctgggctcccccatcccgtcctaacccggaacagccccgggcaggaggcgtggaaagtcgagggggtaaaccgcgaatgtgcgttgtgtaagccacggcgcagggtggggcgcgggcgggacttgggcgggcggggtgggcttggccgagctggcctccggggcaccgaccgctataaggccagtcggactgcgacacagcccatcccctcgaccgctcgcgtcgcatttggccgcctccctaccgctccaagcccagccctcagccatggcatgccccctggatcaggccattggcctcctcgtggccatcttccacaagtactccggcagggagggtgacaagcacaccctgagcaagaaggagctgaaggagctgatccagaaggagctcaccattggctcgaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagtggtgggtaattgtacaataaattttttttggtcaaatttaaaaaaaaaaaaaaaaaaaaaaaaaaatctggtgtgcgcgcgcgcgcgcacctacggcgcccttcgagaaaaagcgtctttcagaaacacattccggtatgggcgcgcgcgcgggggccaaatataggggaacagtggagcacccgtgggccaaaagcgcgtggtctccacaaggagagaccccggggcacaagacaaaagggcggcgggggggaatcttctctcacccaatatataaaaaaaaggcccccggcggggggaacaaccgcgagaggcgtgtcttctggacacaaaaatctttcgcagagagcgggagagttcgtggagggggcaccatcaacagggggggaattctatattaaacccgggggagcgcttcccagaggacgaaagccctaaaattttcaaatgt

SEQ ID NO: 355904 - DNA, 1227 bp, Homo sapiens
agcggaaactgagcaaactgagctgcgcagatgaggggagactcgtcaccaggcgtgcagtgggcactgctgggctcccccatcccgtcctaacccggaacagccccgggcaggaggcgtggaaagtcgagggggtaaaccgcgaatgtgcgttgtgtaagccacggcgcagggtggggcgcgggcgggacttgggcgggcggggtgggcttggccgagctggcctccggggcaccgaccgctataaggccagtcggactgcgacacagcccatcccctcgaccgctcgcgtcgcatttggccgcctccctaccgctccaagcccagccctcagccatggcatgccccctggatcaggccattggcctcctcgtggccatcttccacaagtactccggcagggagggtgacaagcacaccctgagcaagaaggagctgaaggagctgatccagaaggagctcaccattggctcgaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagtggtgggtaattgtacaataaattttttttggtcaaatttaaaaaaaaaaaaaaaaaaaaaaaaaaacctgcgagaggattttatgttggggtgtggcgaaaaagagagaggttatgtgaaatgtgggccctgtggtccatagggtgttttccggaaccagagttttcttggtgacaagggggtaagaatctggcggagactaccctaataagtggagtcagtaatagaattgacaataaagccagggttaaaccggggcatacaaggaacgcgggagaaagagaaaaacagagaacagaagaagagaagagaaacgagacaagaagagagaagagagaagaagcaaaggaaagaaacaagaaagaacagaaaagcaagaaaaaaaaacagaacagacaaacaaaacaagagagaaaagagagaagagagaggaagaagaacgaaagaggaggaagaagcagaaggaagagaagagacgacagaaaaagagagagacagaaaagaacaagaagagagtgagagaggagaggagaagaaaagagcaagaagatagaaagaaga

SEQ ID NO: 355905 - DNA, 786 bp, Homo sapiens
agcggaaactgagcaaactgagctgcgcagatgaggggagactcgtcaccaggcgtgcagtgggcactgctgggctcccccatcccgtcctaacccggaacagccccgggcaggaggcgtggaaagtcgagggggtaaaccgcgaatgtgcgttgtgtaagccacggcgcagggtggggcgcgggcgggacttgggcgggcggggtgggcttggccgagctggcctccggggcaccgaccgctataaggccagtcggactgcgacacagcccatcccctcgaccgctcgcgtcgcatttggccgcctccctaccgctccaagcccagccctcagccatggcatgccccctggatcaggccattggcctcctcgtggccatcttccacaagtactccggcagggagggtgacaagcacaccctgagcaagaaggagctgaaggagctgatccagaaggagctcaccattggctcgaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagtggtgggtaattgtacaataaattttttttggtcaaatttttttttttttttttttttttttttttttttttttttttttttttttttttttttttttttttaaaataatagggagagaac

SEQ ID NO: 355906 - DNA, 714 bp, Homo sapiens
agcggaaactgagcaaactgagctgcgcagatgaggggagactcgtcaccaggcgtgcagtgggcactgctgggctcccccatcccgtcctaacccggaacagccccgggcaggaggcgtggaaagtcgagggggtaaaccgcgaatgtgcgttgtgtaagccacggcgcagggtggggcgcgggcgggacttgggcgggcggggtgggcttggccgagctggcctccggggcaccgaccgctataaggccagtcggactgcgacacagcccatcccctcgaccgctcgcgtcgcatttggccgcctccctaccgctccaagcccagccctcagccatggcatgccccctggatcaggccattggcctcctcgtggccatcttccacaagtactccggcagggagggtgacaagcacaccctgagcaagaaggagctgaaggagctgatccagaaggagctcaccattggctcgaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagcggtcgacggacgggggatcctgctagagtcgacgcaacaaaaacgcaa

SEQ ID NO: 355907 - DNA, 344 bp, Homo sapiens
ctagccgactctagcaggacccctccctgtactccggcagggagggtgacaagcacaccctgagcaagaaggagctgaaggagctgatccagaaggagctcaccattggctcgaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagtggtgggtaattgtacaataaattttttttggtcaaattt

SEQ ID NO: 355908 - DNA, 1185 bp, Homo sapiens
agcggaaactgagcaaactgagctgcgcagatgaggggagactcgtcaccaggcgtgcagtgggcactgctgggctcccccatcccgtcctaacccggaacagccccgggcaggaggcgtggaaagtcgagggggtaaaccgcgaatggccagctgccctcacgctgggggtccagccatcccctgcccagttcagccgctggatccagactggggccatctgtggcgctcccccgctggagggatagtcaggagcagcagtgctgtgccaggctccaagcccagccctcagccatggcatgccccctggatcaggccattggcctcctcgtggccatcttccacaagtactccggcagggagggtgacaagcacaccctgagcaagaaggagctgaaggagctgatccagaaggagctcaccattggctcgaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagtggtgggtaattgtacaataaattttttttggtcaaatttaaaaaaaaaaaaaaaaaaaaaaaaaaacctgcgagaggattttatgttggggtgtggcgaaaaagagagaggttatgtgaaatgtgggccctgtggtccatagggtgttttccggaaccagagttttcttggtgacaagggggtaagaatctggcggagactaccctaataagtggagtcagtaatagaattgacaataaagccagggttaaaccggggcatacaaggaacgcgggagaaagagaaaaacagagaacagaagaagagaagagaaacgagacaagaagagagaagagagaagaagcaaaggaaagaaacaagaaagaacagaaaagcaagaaaaaaaaacagaacagacaaacaaaacaagagagaaaagagagaagagagaggaagaagaacgaaagaggaggaagaagcagaaggaagagaagagacgacagaaaaagagagagacagaaaagaacaagaagagagtgagagaggagaggagaagaaaagagcaagaagatagaaagaaga

SEQ ID NO: 355909 - DNA, 1236 bp, Homo sapiens
  misc_feature (858)..(859): n is a, c, g, or t
agcggaaactgagcaaactgagctgcgcagatgaggggagactcgtcaccaggcgtgcagtgggcactgctgggctcccccatcccgtcctaacccggaacagccccgggcaggaggcgtggaaagtcgagggggtaaaccgcgaatgctccaagcccagccctcagccatggcatgccccctggatcaggccattggcctcctcgtggccatcttccacaagtactccggcagggagggtgacaagcacaccctgagcaagaaggagctgaaggagctgatccagaaggagctcaccattggctcgaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagtggtgggtaattgtacaataaattttttttggtcaaatttaaaaaaaaaaaaagaaaaaaaaaaaaaaaatttttgggcggccttgggccctagaaaaagtttttaaaacccttcggttgggggcggggccccggtgggtagggacctgggccaaaaggggtcccaaggaaaccgggggccatgagatcagcgggtcggggttcccccacccaaaaaaaaaacgcgcgggggcaccgcgggggggttctggaccaaaccccagaagggagctccgggagggccataaaggggtcctataccaaacagggggccccaagggaggcgctccgataatcaaattatccgcgcgcgcggggggnnaaacacacaccaaccacacaaagaaaaacacaacaaaatagaaaacaacacacgcacgagaaagagacacagaacagaggtgaaggagacaaacagaaaaagacagggagagaggcgaagaaggacagaggagagaggaaaaggagcgagggggagaggacaaaagatcgacgacggaaggacgacgagacagaaagcgacaggacacgcgagaacaagacaacacgcgagcaagggaaagccgcgagaaaggcaaaggagggagggaacagacagagaaagccaagaagaagacagagagaagcggcaaaggaggagaatgcgaaacagagcgaaaaagagagagactggagaaggacgaaaaaggagggagcaac

SEQ ID NO: 355910 - DNA, 1125 bp, Homo sapiens
agcggaaactgagcaaactgagctgcgcagatgaggggagactcgtcaccaggcgtgcagtgggcactgctgggctcccccatcccgtcctaacccggaacagccccgggcaggaggcgtggaaagtcgagggggtaaaccgcgaatgtgcgttgtgtaagccacggcgcagggtggggcgcgggcgggacttgggcgggcggggtgggcttggccgagctggcctccggggcaccgaccgctataaggccagtcggactgcgacacagcccatcccctcgaccgctcgcgtcgcatttggccgcctccctaccgtgagttctctccaggagccctgggtactttccagggccagctgccctcacgctgggggtccagccatcccctgcccagttcagccgctggatccagactggggccatctgtggcgctcccccgctggagggatagtcaggagcagcagtgctgtgccaggcaggccttgggctaagggatcgcaatggggtgtgctcttttggggtgcggaagggagtgccctgggtgtgtcattgccaccatgtgtggccctgtgaagctgtgtttaagctgcctttgcagcctccattcccctcccctgcccagccatactcctcaacttctggatcccctgaaggacagttctcagctgtgcccaaagctactgttcctatatgcttcttagaatccttaagccacctctcttgccttggccctagtgtgctctctccttccccttcaagccctgggctgtctcctgatgccattgtgtgtggcctgagactgggtggttccaaaggaggcggggctagtgcaggcagcattattggggtgtgtgggtgagaagtccttgctcccatggcactgactaggccctctgctgccagctccaagcccagccctcagccatggcatgccccctggatcaggccattggcctcctcgtggccatcttccacaagtactccggcagggagggtgacaagcacaccctgagcaagaaggagctgaaggagctgatccagaaggagctcaccattggctcggtgagtggcctcctccccaggaccccttttgccacccttgtcctttggaagcaggattagggga

SEQ ID NO: 355911 - DNA, 822 bp, Homo sapiens
caaagccaagtatatgatctttattatactgataaaagtgagacacaggcacaccacaattaatagcaaagccagaacaacaacccatatcttgtgaatcttagtttctctattttaccaagcttcctcccctcattagacacatctgttaacaggtaacatttaaccctaatgtgtcaagcattgtcctaggcactttacccacagaaactcatttaccctaatcctttcaacaaccctatgaaatagctgttattaacattttacagatgaggagactgaaccacagagaaattaagtaacttgcgcaaagtcacatagctggagtgtagtttgctgatattcacacccaggcaatctgtctttagagccagtgcccttaatcactctgccatattgctcctgtgaacccagaagacaacatgaaaggttgatgtactttactcatggtggccagtaagcagccaagtgtgatatttctccttacaggcctctcaactcaggccatctggcgccgactctgggatgaactgatgaagacaaggccttccagtttggaagtaagttaaggtatcaggtagaatgctagcctgattttgcatggtaaaagcaggaatagcacacaaacacaagctgggtactgataaagtgcagaggcaatgatggaatggatttgggaggagggctctgatggcttgtcacaaggttttggtccatttggcatttgtcactgaattgcttgctcactgtatttgcaggggacacaaaacagggaaagttagtgatcatggatggcagagccaggattcctagagttcttga

SEQ ID NO: 355912 - DNA, 703 bp, Homo sapiens
ccagctggtacgctcgggttcgggatgacaaccctggtgtgccagggaatgcagggccccctagccacataataggcgatgaggagataccagaaaactgcctggagcagttggagatgggatttccacggggagcccagccagccccactgctgtgctccgttctgaaggcctcgggttctctgcagcagctgtccctggatagtgccacctttgcctctccccaggattttgggcttgttttgcaaacactcaaagagtacaacctagccctgaaaagactgagcttccatgacatgaatctcgctgactgtcagagcgaggtgctctttttgctacagaatctgactctgcaagagattaccttctccttctgccgtctgtttgagaagcgcccagcccaatttctgcctgagatggttgctgctatgaagggcaactccacactgaagggcctccggctgccagggaaccgcctgggtgggggccagaccctggggagggagaggggaaaggagctaggcctttgacctaaaaactcactggataaaggcaaagacctctccactgggaacgtgggagttggaatacagatatttctgtgctggggcttcaggaaccagcagggctggttctgccagccatagttgggttgggatacccttgtcccctgttcttgggtggaggtgataggcgttctccc

SEQ ID NO: 355913 - DNA, 358 bp, Homo sapiens
ttttttttagttatttcactctctctgttaaatttatctgataggattctgcagagaacaaaattcaacagggccctgtggagcaaggagccccttttccctatctccttcctctaagagctacacccagaccagctggttatcagcggaggccccgctgctcctcatgagaacgctggtggaagacgaaggtgatggcagtggaggcagcatcccaggcagcctggagtacctcatcccggagcccccacttatcagtgcagtggttccaccctgccaggtctgaagtgcagtcagaaccatcagggggtggccggatctgacggctgttgacacaacgtcggcagtgcaacctagg

SEQ ID NO: 355914 - DNA, 3107 bp, Homo sapiens
caaagccaagtatatgatctttattatactgataaaagtgagacacaggcacaccacaattaatagcaaagccagaacaacaacccatatcttgtgaatcttagtttctctattttaccaagcttcctcccctcattagacacatctgttaacaggtaacatttaaccctaatgtgtcaagcattgtcctaggcactttacccacagaaactcatttaccctaatcctttcaacaaccctatgaaatagctgttattaacattttacagatgaggagactgaaccacagagaaattaagtaacttgcgcaaagtcacatagctggagtgtagtttgctgatattcacacccaggcaatctgtctttagagccagtgcccttaatcactctgccatattgctcctgtgaacccagaagacaacatgaaaggttgatgtactttactcatggtggccagtaagcagccaagtgtgatatttctccttacaggcctctcaactcaggccatctggcgccgactctgggatgaactgatgaagacaaggccttccagtttggaaagtgtgacatgttggcgagccaagtttatggaggcctttttttcccatgttctacgtgggaccattgatgtgtcttctgacaggcgtctttgtgatcagcggttctcacctcttctgcacagctcccgccatgtccgacagctcaccatctgtaacatgctgcagggtgcaaccgagctggtggctgagcccaaccgcagggttctggagaccctggccagctccctgcacactctcaagttccgccacctgctgttctctgatgtggctgctcagcagtcacttcggcagctgttgcatcagctcattcaccatggggctgtcagtcaagtgtcgctatactcctggcctgtgcctgagtcagcccttttcatccttattctcaccatgagtgctggcttctggcaaccagggcctggtggcccaccctgccgcctctgtggagaggcctcccgaggccgggccccatcccgagatgaagggtccctcttattgggctcacgtcggccccgccgggatgctgctgagcgatgtgctgcagccctgatggccagccggcgtaagagtgaagccaagcagatgcccagagctgcacctgccactcgggtaacacgccggagcacacaggagagcctgacagcaggcggaacagaccttaagagggagctgcaccccccagccacctcccatgaggctcctggcaccaagcggtcaccttctgctccagcagccacctcctctgcctcttcttctacatcctcatacaaacgggcaccagctagctcagccccacagcctaagcccctaaagcgtttcaagcgagctgcagggaagaagggtgctcgcacccgtcaggggcctggtgcagagtctgaagacctgtatgacttcgtttttattgtggctggcgagaaggaggatggcgaagagatggagattggggaagtggcttgtggagctttggatggatcagatcccagctgcctggggcttccagcactggaagcttcacaaagattccgcagcatctccaccttggagctattcacagttccactctccacagaggcagccctgacactatgccacctgctgagctcctgggtgtcactggagagcctcacactctcctacaatggcctgggctctaacatcttccgcctgctagacagcctgcgggccctgtcaggccaggctggatgtcgcctccgtgccctgcatctcagtgacctgttctcaccactgcccatcctggagctgacacgtgctatcgtgcgagcactgcccctgctacgggtcctctctattcgtgttgaccacccaagccagcgggacaaccctggtgtgccagggaatgcagggccccctagccacataataggcgatgaggagataccagaaaactgcctggagcagttggagatgggatttccacggggagcccagccagccccactgctgtgctccgttctgaaggcctcgggttctctgcagcagctgtccctggatagtgccacctttgcctctccccaggattttgggcttgttttgcaaacactcaaagagtacaacctagccctgaaaagactgagcttccatgacatgaatctcgctgactgtcagagcgaggtgctctttttgctacagaatctgactctgcaagagattaccttctccttctgccgtctgtttgagaagcgcccagcccaatttctgcctgagatggttgctgctatgaagggcaactccacactgaagggcctccggctgccagggaaccgcctggggaatgctggcctgctggccttggcagatgttttctcagaggattcatcctcctctctctgtcagctggacatcagttccaactgcatcaagccagatgggcttctggagttcgccaagcggctggagcgctggggccgtggagcctttggtcacctgcgcctcttccaaaactggctggaccaggatgcagtcacagccagggaagccatccggcggctccgggctacctgccatgtggttagcgactcatgggactcatcccaggccttcgcagattatgttagcaccatgtgatggggcccgtacctcacagtctcatgctcggtaccatcagcttgcaggggctgaagcatgggctgcccagaaccccaaccaccagttctatctttctctttctgtcaccttttttctcttttttccttcttcccttgcactgaggtcctggaggccttgatgaggcccagcaaacaggcattctcacagctgggtttatagtctttgggccccttactcagtatcctgggaaccctgggccaggaggttacagtggtcatcataattgctgaagagatcccctcccctgcccctgggttcctgccttccctcctcaagcaggcacccaggctttagagaagtatagggggcttcttccctgctgggcttaccacactgctctcaggcctcaaaccctttcatacctttattcttttttttaaccaaaaaagtttttcttataaaataaattttgggcaaacatca

SEQ ID NO: 355915 - DNA, 3289 bp, Homo sapiens
gcgcacctccccaagatggcggcgcccgaggcctggcgcgcccggagttgctggttctgtgaggtagcggcggcaacgaccatggaggccacgtcccgggaggcggcgccagcgaagagctcggcctcgggccccaacgctccccccgccctgttcgagctgtgcgggcgggcggtgagcgcccatatgggggttctggagagcggggtgtgggccctcccaggcccaatacttcaaagcatcctacctctgctcaatatatattacttggagaggattgaggaaactgccctcaagaaaggcctctcaactcaggccatctggcgccgactctgggatgaactgatgaagacaaggccttccagtttggaaagtgtgacatgttggcgagccaagtttatggaggcctttttttcccatgttctacgtgggaccattgatgtgtcttctgacaggcgtctttgtgatcagcggttctcacctcttctgcacagctcccgccatgtccgacagctcaccatctgtaacatgctgcagggtgcaaccgagctggtggctgagcccaaccgcagggttctggagaccctggccagctccctgcacactctcaagttccgccacctgctgttctctgatgtggctgctcagcagtcacttcggcagctgttgcatcagctcattcaccatggggctgtcagtcaagtgtcgctatactcctggcctgtgcctgagtcagcccttttcatccttattctcaccatgagtgctggcttctggcaaccagggcctggtggcccaccctgccgcctctgtggagaggcctcccgaggccgggccccatcccgagatgaagggtccctcttattgggctcacgtcggccccgccgggatgctgctgagcgatgtgctgcagccctgatggccagccggcgtaagagtgaagccaagcagatgcccagagctgcacctgccactcgggtaacacgccggagcacacaggagagcctgacagcaggcggaacagaccttaagagggagctgcaccccccagccacctcccatgaggctcctggcaccaagcggtcaccttctgctccagcagccacctcctctgcctcttcttctacatcctcatacaaacgggcaccagctagctcagccccacagcctaagcccctaaagcgtttcaagcgagctgcagggaagaagggtgctcgcacccgtcaggggcctggtgcagagtctgaagacctgtatgacttcgtttttattgtggctggcgagaaggaggatggcgaagagatggagattggggaagtggcttgtggagctttggatggatcagatcccagctgcctggggcttccagcactggaagcttcacaaagattccgcagcatctccaccttggagctattcacagttccactctccacagaggcagccctgacactatgccacctgctgagctcctgggtgtcactggagagcctcacactctcctacaatggcctgggctctaacatcttccgcctgctagacagcctgcgggccctgtcaggccaggctggatgtcgcctccgtgccctgcatctcagtgacctgttctcaccactgcccatcctggagctgacacgtgctatcgtgcgagcactgcccctgctacgggtcctctctattcgtgttgaccacccaagccagcgggacaaccctggtgtgccagggaatgcagggccccctagccacataataggcgatgaggagataccagaaaactgcctggagcagttggagatgggatttccacggggagcccagccagccccactgctgtgctccgttctgaaggcctcgggttctctgcagcagctgtccctggatagtgccacctttgcctctccccaggattttgggcttgttttgcaaacactcaaagagtacaacctagccctgaaaagactgagcttccatgacatgaatctcgctgactgtcagagcgaggtgctctttttgctacagaatctgactctgcaagagattaccttctccttctgccgtctgtttgagaagcgcccagcccaatttctgcctgagatggttgctgctatgaagggcaactccacactgaagggcctccggctgccagggaaccgcctggggaatgctggcctgctggccttggcagatgttttctcagaggattcatcctcctctctctgtcagctggacatcagttccaactgcatcaagccagatgggcttctggagttcgccaagcggctggagcgctggggccgtggagcctttggtcacctgcgcctcttccaaaactggctggaccaggatgcagtcacagccagggaagccatccggcggctccgggctacctgccatgtggttagcgactcatgggactcatcccaggccttcgcagattatgttagcaccatgtgatggggcccgtacctcacagtctcatgctcggtaccatcagcttgcaggggctgaagcatgggctgcccagaaccccaaccaccagttctatctttctctttctgtcaccttttttctcttttttccttcttcccttgcactgaggtcctggaggccttgatgaggcccagcaaacaggcattctcacagctgggtttatagtctttgggccccttactcagtatcctgggaaccctgggccaggaggttacagtggtcatcataattgctgaagagatcccctcccctgcccctgggttcctgccttccctcctcaagcaggcacccaggctttagagaagtatagggggcttcttccctgctgggcttaccacactgctctcaggcctcaaaccctttcatacctttattcttttttttaaccaaaaaagtttttcttataaaataaattttgggcaaacatcaaaaaaaaaaccacaacaccaccaccaacacaactccccaccacacccaaaaaattggcgggcgccggcagccacgagaagactaaacaccaaggtaggtgaggcccggagacccagaaagataaaacacaagggccaacagggcccaaaacaaacgtcgcatcgaacgagggatggtctacccaaaaaacggcgggaacgaggtgctgccaaccaagggatcgggcctctaggtacaacgggccaggccttaacaccgcgcagcaggaggggaagacaccaccacccacacgcggcactcagactagcgaatagcacagacgacacagcgatcaacatcacccagtgcaagtagagcaagactccgctca

SEQ ID NO: 355916 - DNA, 3856 bp, Homo sapiens
  misc_feature (3228)..(3228): n is a, c, g, or t
  misc_feature (3263)..(3263): n is a, c, g, or t
  misc_feature (3272)..(3272): n is a, c, g, or t
gcgcacctccccaagatggcggcgcccgaggcctggcgcgcccggagttgctggttctgtgaggtagcggcggcaacgaccatggaggccacgtcccgggaggcggcgccagcgaagagctcggcctcgggccccaacgctccccccgccctgttcgagctgtgcgggcgggcggtgagcgcccatatgggggttctggagagcggggtgtgggccctcccaggcccaatacttcaaagcatcctacctctgctcaatatatattacttggagaggattgaggaaactgccctcaagaaaggcctctcaactcaggccatctggcgccgactctgggatgaactgatgaagacaaggccttccagtttggaaagtgtgacatgttggcgagccaagtttatggaggcctttttttcccatgttctacgtgggaccattgatgtgtcttctgacaggcgtctttgtgatcagcggttctcacctcttctgcacagctcccgccatgtccgacagctcaccatctgtaacatgctgcagggtgcaaccgagctggtggctgagcccaaccgcagggttctggagaccctggccagctccctgcacactctcaagttccgccacctgctgttctctgatgtggctgctcagcagtcacttcggcagctgttgcatcagctcattcaccatggggctgtcagtcaagtgtcgctatactcctggcctgtgcctgagtcagcccttttcatccttattctcaccatgagtgctggcttctggcaaccagggcctggtggcccaccctgccgcctctgtggagaggcctcccgaggccgggccccatcccgagatgaagggtccctcttattgggctcacgtcggccccgccgggatgctgctgagcgatgtgctgcagccctgatggccagccggcgtaagagtgaagccaagcagatgcccagagctgcacctgccactcgggtaacacgccggagcacacaggagagcctgacagcaggcggaacagaccttaagagggagctgcaccccccagccacctcccatgaggctcctggcaccaagcggtcaccttctgctccagcagccacctcctctgcctcttcttctacatcctcatacaaacgggcaccagctagctcagccccacagcctaagcccctaaagcgtttcaagcgagctgcagggaagaagggtgctcgcacccgtcaggggcctggtgcagagtctgaagacctgtatgacttcgtttttattgtggctggcgagaaggaggatggcgaagagatggagattggggaagtggcttgtggagctttggatggatcagatcccagctgcctggggcttccagcactggaagcttcacaaagattccgcagcatctccaccttggagctattcacagttccactctccacagaggcagccctgacactatgccacctgctgagctcctgggtgtcactggagagcctcacactctcctacaatggcctgggctctaacatcttccgcctgctagacagcctgcgggccctgtcaggccaggctggatgtcgcctccgtgccctgcatctcagtgacctgttctcaccactgcccatcctggagctgacacgtgctatcgtgcgagcactgcccctgctacgggtcctctctattcgtgttgaccacccaagccagcgggacaaccctggtgtgccagggaatgcagggccccctagccacataataggcgatgaggagataccagaaaactgcctggagcagttggagatgggatttccacggggagcccagccagccccactgctgtgctccgttctgaaggcctcgggttctctgcagcagctgtccctggatagtgccacctttgcctctccccaggattttgggcttgttttgcaaacactcaaagagtacaacctagccctgaaaagactgagcttccatgacatgaatctcgctgactgtcagagcgaggtgctctttttgctacagaatctgactctgcaagagattaccttctccttctgccgtctgtttgagaagcgcccagcccaatttctgcctgagatggttgctgctatgaagggcaactccacactgaagggcctccggctgccagggaaccgcctggggaatgctggcctgctggccttggcagatgttttctcagaggattcatcctcctctctctgtcagctggacatcagttccaactgcatcaagccagatgggcttctggagttcgccaagcggctggagcgctggggccgtggagcctttggtcacctgcgcctcttccaaaactggctggaccaggatgcagtcacagccagggaagccatccggcggctccgggctacctgccatgtggttagcgactcatgggactcatcccaggccttcgcagattatgttagcaccatgtgatggggcccgtacctcacagtctcatgctcggtaccatcagcttgcaggggctgaagcatgggctgcccagaaccccaaccaccagttctatctttctctttctgtcaccttttttctcttttttccttcttcccttgcactgaggtcctggaggccttgatgaggcccagcaaacaggcattctcacagctgggtttatagtctttgggccccttactcagtatcctgggaaccctgggccaggaggttacagtggtcatcataattgctgaagagatcccctcccctgcccctgggttcctgccttccctcctcaagcaggcacccaggctttagagaagtatagggggcttcttccctgctgggcttaccacactgctctcaggcctcaaaccctttcatacctttattcttttttttaaccaaaaaagtttttcttataaaataaattttgggcaaacatcagaaaaaaaaacaaaaacacaaaaaaaaaaaaaaaatggttgtggggcccgcgccccggccccagggaagaaggttttcttaaccccaatcagtgttggggcggcggcggcgcccgcagtagggttaaacgtgcgaccattgcgccaacgctggtcccaaagggagatctctgggccatggactaggggtcggggttcccccacccaactaaaaaaacggccggggcggaccaccgagcgttcttggaaccactccaagagggggtttcgcggggccgtagcgggtgcctctataaaagaggagggtccnagggggaggcccggaattcaaattattcccgcgcnctgagtggnaaactagcacactataacaaacaaacacaacgagtatcaatactagacaagacgacacgagagacatactacacacaagaacactacacatagacgtaacacacaactaagacacacataacacgtactcatacaacatgactaagcaacaacacatacaaatacacaacaacatcactacacaccaactagtagtagcacagacaacacgagcacacgcaggcacgaacagaccgacagtagtcacacaagacgggagaacagagcagatacgcaacagacgacaaagagaagacacacacacaacaacacaagcacccaacagaacaacacacacccgagcagcaagacgaacaaaacagcaccgaacaagcagacaggcacccaacagaacgcatagagacagaacggcaccaaggagcaaaccaagcaaccaaacacacagagcgagacacacgcaccacaccaacagaacacaggaaacgccacgacagccaaacacgaaaaacgcacgagagaggccaacagcaagaagacgacgagagaaagacagaaccgacagggaaacaacacaccgaacgaca

SEQ ID NO: 355917 - DNA, 2901 bp, Homo sapiens
gcgcacctccccaagatggcggcgcccgaggcctggcgcgcccggagttgctggttctgtgaggtagcggcggcaacgaccatggaggccacgtcccgggaggcggcgccagcgaagagctcggcctcgggccccaacgctccccccgccctgttcgagctgtgcgggcgggcggtgagcgcccatatgggggttctggagagcggggtgtgggccctcccaggcccaatacttcaaagcatcctacctctgctcaatatatattacttggagaggattgaggaaactgccctcaagaaaggcctctcaactcaggccatctggcgccgactctgggatgaactgatgaagacaaggccttccagtttggaaagtgtgacatgttggcgagccaagtttatggaggcctttttttcccatgttctacgtgggaccattgatgtgtcttctgacaggcgtctttgtgatcagcggttctcacctcttctgcacagctcccgccatgtccgacagctcaccatctgtaacatgctgcagggtgcaaccgagctggtggctgagcccaaccgcagggttctggagaccctggccagctccctgcacactctcaagttccgccacctgctgttctctgatgtggctgctcagcagtcacttcggcagctgttgcatcagctcattcaccatggggctgtcagtcaagtgtcgctatactcctggcctgtgcctgagtcagcccttttcatccttattctcaccatgagtgctggcttctggcaaccagggcctggtggcccaccctgccgcctctgtggagaggcctcccgagatgaagggtccctcttattgggctcacgtcggccccgccgggatgctgctgagcgatgtgctgcagccctgatggccagccggcgtaagagtgaagccaagcagatgcccagagctgcacctgccactcgggtaacacgccggagcacacaggagagcctgacagcaggcggaacagaccttaagagggagctgcaccccccagccacctcccatgaggctcctggcaccaagcggtcaccttctgctccagcagccacctcctctgcctcttcttctacatcctcatacaaacgggcaccagctagctcagccccacagcctaagcccctaaagcgtttcaagcgagctgcagggaagaagggtgctcgcacccgtcaggggcctggtgcagagtctgaagacctgtatgacttcgtttttattgtggctggcgagaaggaggatggcgaagagatggagattggggaagtggcttgtggagctttggatggatcagatcccagctgcctggggcttccagcactggaagcttcacaaagattccgcagcatctccaccttggagctattcacagttccactctccacagaggcagccctgacactatgccacctgctgagctcctgggtgtcactggagagcctcacactctcctacaatggcctgggctctaacatcttccgcctgctagacagcctgcgggccctgtcaggccaggctggatgtcgcctccgtgccctgcatctcagtgacctgttctcaccactgcccatcctggagctgacacgtgctatcgtgcgagcactgcccctgctacgggtcctctctattcgtgttgaccacccaagccagcgggacaaccctggtgtgccagggaatgcagggccccctagccacataataggcgatgaggagataccagaaaactgcctggagcagttggagatgggatttccacggggagcccagccagccccactgctgtgctccgttctgaaggcctcgggttctctgcagcagctgtccctggatagtgccacctttgcctctccccaggattttgggcttgttttgcaaacactcaaagagtacaacctagccctgaaaagactgagcttccatgacatgaatctcgctgactgtcagagcgaggtgctctttttgctacagaatctgactctgcaagagattaccttctccttctgccgtctgtttgagaagcgcccagcccaatttctgcctgagatggttgctgctatgaagggcaactccacactgaagggcctccggctgccagggaaccgcctggggaatgctggcctgctggccttggcagatgttttctcagaggattcatcctcctctctctgtcagctggacatcagttccaactgcatcaagccagatgggcttctggagttcgccaagcggctggagcgctggggccgtggagcctttggtcacctgcgcctcttccaaaactggctggaccaggatgcagtcacagccagggaagccatccggcggctccgggctacctgccatgtggttagcgactcatgggactcatcccaggccttcgcagattatgttagcaccatgtgatggggcccgtacctcacagtctcatgctcggtaccatcagcttgcaggggctgaagcatgggctgcccagaaccccaaccaccagttctatctttctctttctgtcaccttttttctcttttttccttcttcccttgcactgaggtcctggaggccttgatgaggcccagcaaacaggcattctcacagctgggtttatagtctttgggccccttactcagtatcctgggaaccctgggccaggaggttacagtggtcatcataattgctgaagagatcccctcccctgcccctgggttcctgccttccctcctcaagcaggcacccaggctttagagaagtatagggggcttcttccctgctgggcttaccacactgctctcaggcctcaaaccctttcatacctttattcttttttttaaccaaaaaagtttttcttataaaataaattttgggcaaacatca

SEQ ID NO: 355918 - DNA, 2058 bp, Homo sapiens
cccacaaatgggccctttatttctgaactgccaccactgcacggataaggccacttgggttgcaggcacactgtggagtgtcaggggacagagaggagaggggctgcacaccaagactgccctgtcctcacggagaggaaaagcggccgcagaagagaatcccgttggtcttgctgtgctggatgaagaaaaggaaggggtggtcggcgcagaagcgggggacgaatctggcacaccgcatcatcatgatggcagctgtggcggctgcagcctccgtgccttcctcattgacctccacaaaagacttgtgcacgaccttggacagagacaggtctgtctgggacattccagagaagtctgccttgcccagctcgaaggcatcagtcatgcccaggttgcgcaggacactctccatgtcgtagctttcctctagtttaaaccgcgggagggacacttccacctcctcttcatccatcatgtccagcctcgtccattctacgaacttctcgtaagtgagttctttctccaccgttctcaagtcagtggtctcgtccggaagcatgatgatcatattcagttccttgccaacatatggaagcaccaagatttgggtaaatatttctcctatataggtcttcttaaaagtagattgcttaaacatcatttgcacaggtttctcctcattcttgctgactttaaacagtctctcctcggtgttctccttgtcaaactgttcatcccagtttcctctgaaatagacagcattcactgacacgtgctatcgtgcgagcactgcccctgctacgggtcctctctattcgtgttgaccacccaagccagcgggacaaccctggtgtgccagggaatgcagggccccctagccacataataggcgatgaggagataccagaaaactgcctggagcagttggagatgggatttccacggggagcccagccagccccactgctgtgctccgttctgaaggcctcgggttctctgcagcagctgtccctggatagtgccacctttgcctctccccaggattttgggcttgttttgcaaacactcaaagagtacaacctagccctgaaaagactgagcttccatgacatgaatctcgctgactgtcagagcgaggtgctctttttgctacagaatctgactctgcaagagattaccttctccttctgccgtctgtttgagaagcgcccagcccaatttctgcctgagatggttgctgctatgaagggcaactccacactgaagggcctccggctgccagggaaccgcctggggaatgctggcctgctggccttggcagatgttttctcagaggattcatcctcctctctctgtcagctggacatcagttccaactgcatcaagccagatgggcttctggagttcgccaagcggctggagcgctggggccgtggagcctttggtcacctgcgcctcttccaaaactggctggaccaggatgcagtcacagccagggaagccatccggcggctccgggctacctgccatgtggttagcgactcatgggactcatcccaggccttcgcagattatgttagcaccatgtgatggggcccgtacctcacagtctcatgctcggtaccatcagcttgcaggggctgaagcatgggctgcccagaaccccaaccaccagttctatctttctctttctgtcaccttttttctcttttttccttcttcccttgcactgaggtcctggaggccttgatgaggcccagcaaacaggcattctcacagctgggtttatagtctttgggccccttactcagtatcctgggaaccctgggccaggaggttacagtggtcatcataattgctgaagagatcccctcccctgcccctgggttcctgccttccctcctcaagcaggcacccaggctttagagaagtatagggggcttcttccctgctgggcttaccacactgctctcaggcctcaaaccctttcatacctttattcttttttttaaccaaaaaagtttttcttataaaataaattttgggcaaacatca

SEQ ID NO: 355919 - DNA, 2707 bp, Homo sapiens
gcgcacctccccaagatggcggcgcccgaggcctggcgcgcccggagttgctggttctgtgaggtagcggcggcaacgaccatggaggccacgtcccgggaggcggcgccagcgaagagctcggcctcgggccccaacgctccccccgccctgttcgagctgtgcgggcgggcggtgagcgcccatatgggggttctggagagcggggtgtgggccctcccaggcccaatacttcaaagcatcctacctctgctcaatatatattacttggagaggattgaggaaactgccctcaagaaaggcctctcaactcaggccatctggcgccgactctgggatgaactgatgaagacaaggccttccagtttggaaagtgtgacatgttggcgagccaagtttatggaggcctttttttcccatgttctacgtgggaccattgatgtgtcttctgacaggcgtctttgtgatcagcggttctcacctcttctgcacagctcccgccatgtccgacagctcaccatctgtaacatgctgcagggtgcaaccgagctggtggctgagcccaaccgcagggttctggagaccctggccagctccctgcacactctcaagttccgccacctgctgttctctgatgtggctgctcagcagtcacttcggcagctgttgcatcagctcattcaccatggggctgtcagtcaagtgtcgctatactcctggcctgtgcctgagtcagcccttttcatccttattctcaccatgagtgctggcttctggcaaccagggcctggtggcccaccctgccgcctctgtggagaggcctcccgaggccgggccccatcccgagatgaagggtccctcttattgggctcacgtcggccccgccgggatgctgctgagcgatgtgctgcagccctgatggccagccggcgtaagagtgaagccaagcagatgcccagagctgcacctgccactcgggtaacacgccggagcacacaggagagcctgacagcaggcggaacagaccttaagagggagctgcaccccccagccacctcccatgaggctcctggcaccaagcggtcaccttctgctccagcagccacctcctctgcctcttcttctacatcctcatacaaacgggcaccagctagctcagccccacagcctaagcccctaaagcgtttcaagcgagctgcagggaagaagggtgctcgcacccgtcaggggcctggtgcagagtctgaagacctgtatgacttcgtttttattgtggctggcgagaaggaggatggcgaagagatggagattggggaagtggcttgtggagctttggatggatcagatcccagctgcctggggcttccagcactggaagcttcacaaagattccgcagcatctccaccttggagctattcacagttccactctccacagaggcagccctgacactatgccacctgctgagctcctgggtgtcactggagagcctcacactctcctacaatggtgagcaccctggagtggcagggattgggcttagattgcctagcagcaccagctgtgtgcctaattctagggaggtgggaggggcaaattgggggtatgatcaggaggttagagaggaaggcttgtatgcctcatagcaggggagactgtcattgctagaagagaggaacataaagtctatacacttgattagttgttgaaagcaggggttcctgaggggcagtgagacaagccagctggaatctgaagaatgaatacattttagatatggaaggcagtccaagggcaggtgggagcagtatagtatatgcatgctcaggcagggctagagtttgacctcaccacctcaccagtcatatcagagtagctgtccagacaaggtgtgggacacaatttcttatcagaccaacaacctgcaaagcagtcctcagtcctcatttccctcctgcttgtgaccagctagcaaaacctcaactctggctaaatccagcaatccgcctaggttgctgagcactgctagagacaaatcatacaactatgcaaatcagtgttactatatgatcactaacctcgtatgaaccttcactgtgcttgcaacatcagctcccattcctaccacttccaaactctccttttcccttctcagggatgacctcacctacttcacagagaaaatagaagccatcacacatgagtttctttagcttgctaagcagcctataaactctccatctgcactcatccttctttaccagaatagaagagaccaccatcctttctaaggctaattctcccacctgtgctctagatgcatagagcttcacaacaaagtatataaaaattaccagtttgagaaacaagcattctaccttcttagggaagcttgtttctcaaactaatttttatatactgcttagtatgtgtctggcatattttaagtattcttgataatttgatctaacaatcctcacaaccctatgagggcaagtgacttcctcaggataacctagcaattatagagctaggattcaaaacccaggcaaccagactgcagattcatgctttcaaacaactatgctactctcctttccaccgtctctctcctatcagcattttaacaggtctccatcaaaaactgccaccaccacctccctctatgccatattaataaactgttatctcctgttcttcacaaac

SEQ ID NO: 355920 - DNA, 1078 bp, Homo sapiens
acaaatccaagctcgttacccttttgggggccttggctagaagagaggaacataaagtctatacacttgattagttgttgaaagcaggggttcctgaggggcagtgagacaagccagctggaatctgaagaatgaatacattttagatatggaaggcagtccaagggcaggtgggagcagtatagtatatgcatgctcaggcagggctagagtttgacctcaccacctcaccagtcatatcagagtagctgtccagacaaggtgtgggacacaatttcttatcagaccaacaacctgcaaagcagtcctcagtcctcatttccctcctgcttgtgaccagctagcaaaacctcaactctggctaaatccagcaatccgcctaggttgctgagcactgctagagacaaatcatacaactatgcaaatcagtgttactatatgatcactaacctcgtatgaaccttcactgtgcttgcaacatcagctcccattcctaccacttccaaactctccttttcccttctcagggatgacctcacctacttcacagagaaaatagaagccatcacacatgagtttctttagcttgctaagcagcctataaactctccatctgcactcatccttctttaccagaatagaagagaccaccatcctttctaaggctaattctcccacctgtgctctagatgcatagagcttcacaacaaagtatataaaaattaccagtttgagaaacaagcattctaccttcttagggaagcttgtttctcaaactaatttttatatactgcttagtatgtgtctggcatattttaagtattcttgataatttgatctaacaatcctcacaaccctatgagggcaagtgacttcctcaggataacctagcaattatagagctaggattcaaaacccaggcaaccagactgcagattcatgctttcaaacaactatgctactctcctttccaccgtctctctcctatcagcattttaacaggtctccatcaaaaactgccaccaccacctccctctatgccatattaataaactgttatctcctgttcttcacaaac

SEQ ID NO: 355921 - DNA, 314 bp, Homo sapiens
atccccggtgccaggtgaaatggagagtgcttagtatgtgtctggcatattttaagtattcttgataatttgatctaacaatcctcacaaccctatgagggcaagtgacttcctcaggataacctagcaattatagagctaggattcaaaacccaggcaaccagactgcagattcatgctttcaaacaactatgctactctcctttccaccgtctctctcctatcagcattttaacaggtctccatcaaaaactgccaccaccacctccctctatgccatattaataaactgttatctcctgttcttcacaaac

SEQ ID NO: 355922 - DNA, 407 bp, Homo sapiens
cagggaatgcagggccccctagccacataataggcgatgaggagataccaggtgaagcactgtgtgtgtgtttgtgtgtgtgcacgcacgtgtatccccacacaaaggtgcagatgcattcgtatggggaaaggggaaggacctcttctatcactcattcctggcttatctggaacctatcccccctttagagcctaccactaagatactcttgagctagacagggcctaaaccaccataagaccagcagagagtgaccaaggcagcttggtctccagaaaaggaaaagaactgatctttagactggattagttcccctgctgtatgttcccttagttcttgtatgtctcctatcccaccactctgcatactttatttgcttgtgtctgggtagcctgtcttcctgg

SEQ ID NO: 355923 - DNA, 2133 bp, Homo sapiens
gcgcacctccccaagatggcggcgcccgaggcctggcgcgcccggagttgctggttctgtgaggtagcggcggcaacgaccatggaggccacgtcccgggaggcggcgccagcgaagagctcggcctcgggccccaacgctccccccgccctgttcgagctgtgcgggcgggcggtgagcgcccatatgggggttctggagagcggggtgtgggccctcccaggcccaatacttcaaagcatcctacctctgctcaatatatattacttggagaggattgaggaaactgccctcaagaaaggcctctcaactcaggccatctggcgccgactctgggatgaactgatgaagacaaggccttccagtttggaaagtgtgacatgttggcgagccaagtttatggaggcctttttttcccatgttctacgtgggaccattgatgtgtcttctgacaggcgtctttgtgatcagcggttctcacctcttctgcacagctcccgccatgtccgacagctcaccatctgtaacatgctgcagggtgcaaccgagctggtggctgagcccaaccgcagggttctggagaccctggccagctccctgcacactctcaagttccgccacctgctgttctctgatgtggctgctcagcagtcacttcggcagctgttgcatcagctcattcaccatggggctgtcagtcaagtgtcgctatactcctggcctgtgcctgagtcagcccttttcatccttattctcaccatgagtgctggcttctggcaaccagggcctggtggcccaccctgccgcctctgtggagaggcctcccgaggccgggccccatcccgagatgaagggtccctcttattgggctcacgtcggccccgccgggatgctgctgagcgatgtgctgcagccctgatggccagccggcgtaagagtgaagccaagcagatgcccagagctgcacctgccactcgggtaacacgccggagcacacaggagagcctgacagcaggcggaacagaccttaagagggagctgcaccccccagccacctcccatgaggctcctggcaccaagcggtcaccttctgctccagcagccacctcctctgcctcttcttctacatcctcatacaaacgggcaccagctagctcagccccacagcctaagcccctaaagcgtttcaagcgagctgcagggaagaagggtgctcgcacccgtcaggggcctggtgcagagtctgaagacctgtatgacttcgtttttattgtggctggcgagaaggaggatggcgaagagatggagattggggaagtggcttgtggagctttggatggatcagatcccagctgcctggggcttccagcactggaagcttcacaaagattccgcagcatctccaccttggagctattcacagttccactctccacagaggcagccctgacactatgccacctgctgagctcctgggtgtcactggagagcctcacactctcctacaatggtgagcaccctggagtggcagggattgggcttagattgcctagcagcaccagctgtgtgcctaattctagggaggtgggaggggcaaattgggggtatgatcaggaggttagagaggaaggcttgtatgcctcatagcaggggagactgtcattgctagaagagaggaacataaagtctatacacttgattagttgttgaaagcaggggttcctgaggggcagtgagacaagccagctggaatctgaagaatgaatacattttagatatggaaggcagtccaagggcaggtgggagcagtatagtatatgcatgctcaggcagggctagagtttgacctcaccacctcaccagtcatattttaagtattcttgataatttgatctaacaatcctcacaaccctatgagggcaagtgacttcctcaggataacctagcaattatagagctaggattcaaaacccaggcaaccagactgcagattcatgctttcaaacaactatgctactctcctttccaccgtctctctcctatcagcattttaacaggtctccatcaaaaactgccaccaccacctccctctatgccatattaataaactgttatctcctgttcttcacaaac

SEQ ID NO: 355924 - DNA, 811 bp, Homo sapiens
  misc_feature (10)..(10): n is a, c, g, or t
  misc_feature (20)..(20): n is a, c, g, or t
  misc_feature (39)..(39): n is a, c, g, or t
  misc_feature (96)..(96): n is a, c, g, or t
  misc_feature (100)..(100): n is a, c, g, or t
  misc_feature (103)..(103): n is a, c, g, or t
tcccggattncaaagggaanccggctttggggaaaatgnttggccatggctgggcctttggaaaaatgtttttttcaaaaggaattcatccctccntctnctnatgtcaaggtgggaacatcaagtttccaactgcatcaagccagatgggcttctggagttcgccaagcggctggagcgctggggccgtggagcctttggtcacctgcgcctcttccaaaactggctggaccaggatgcagtcacagccagggaagccatccggcggctccgggctacctgccatgtggttagcgactcatgggactcatcccaggccttcgcagattatgttagcaccatgtgatggggcccgtacctcacagtctcatgctcggtaccatcagcttgcaggggctgaagcatgggctgcccagaaccccaaccaccagttctatctttctctttctgtcaccttttttctcttttttccttcttcccttgcactgaggtcctggaggccttgatgaggcccagcaaacaggcattctcacagctgggtttatagtctttgggccccttactcagtatcctgggaaccctgggccaggaggttacagtggtcatcataattgctgaagagatcccctcccctgcccctgggttcctgccttccctcctcaagcaggcacccaggctttagagaagtatagggggcttcttccctgctgggcttaccacactgctctcaggcctcaaaccctttcatacctttattcttttttttaaccaaaaaagtttttcttataaaataaattttgggcaaacatca

SEQ ID NO: 355925 - DNA, 2919 bp, Homo sapiens
gcgcacctccccaagatggcggcgcccgaggcctggcgcgcccggagttgctggttctgtgaggtagcggcggcaacgaccatggaggccacgtcccgggaggcggcgccagcgaagagctcggcctcgggccccaacgctccccccgccctgttcgagctgtgcgggcgggcggtgagcgcccatatgggggttctggagagcggggtgtgggccctcccaggcccaatacttcaaagcatcctacctctgctcaatatatattacttggagaggattgaggaaactgccctcaagaaaggcctctcaactcaggccatctggcgccgactctgggatgaactgatgaagacaaggccttccagtttggaaagtgtgacatgttggcgagccaagtttatggaggcctttttttcccatgttctacgtgggaccattgatgtgtcttctgacaggcgtctttgtgatcagcggttctcacctcttctgcacagctcccgccatgtccgacagctcaccatctgtaacatgctgcagggtgcaaccgagctggtggctgagcccaaccgcagggttctggagaccctggccagctccctgcacactctcaagttccgccacctgctgttctctgatgtggctgctcagcagtcacttcggcagctgttgcatcagctcattcaccatggggctgtcagtcaagtgtcgctatactcctggcctgtgcctgagtcagcccttttcatccttattctcaccatgagtgctggcttctggcaaccagggcctggtggcccaccctgccgcctctgtggagaggcctcccgaggccgggccccatcccgagatgaagggtccctcttattgggctcacgtcggccccgccgggatgctgctgagcgatgtgctgcagccctgatggccagccggcgtaagagtgaagccaagcagatgcccagagctgcacctgccactcgggtaacacgccggagcacacaggagagcctgacagcaggcggaacagaccttaagagggagctgcaccccccagccacctcccatgaggctcctggcaccaagcggtcaccttctgctccagcagccacctcctctgcctcttcttctacatcctcatacaaacgggcaccagctagctcagccccacagcctaagcccctaaagcgtttcaagcgagctgcagggaagaagggtgctcgcacccgtcaggggcctggtgcagagtctgaagacctgtatgacttcgtttttattgtggctggcgagaaggaggatggcgaagagatggagattggggaagtggcttgtggagctttggatggatcagatcccagctgcctggggcttccagcactggaagcttcacaaagattccgcagcatctccaccttggagctattcacagttccactctccacagaggcagccctgacactatgccacctgctgagctcctgggtgtcactggagagcctcacactctcctacaatggcctgggctctaacatcttccgcctgctagacagcctgcgggccctgtcaggccaggctggatgtcgcctccgtgccctgcatctcagtgacctgttctcaccactgcccatcctggagctgacacgtgctatcgtgcgagcactgcccctgctacgggtcctctctattcgtgttgaccacccaagccagcgggacaaccctggtgtgccagggaatgcagggccccctagccacataataggcgatgaggagataccagaaaactgcctggagcagttggagatgggatttccacggggagcccagccagccccactgctgtgctccgttctgaaggcctcgggttctctgcagcagctgtccctggatagtgccacctttgcctctccccaggattttgggcttgttttgcaaacactcaaagagtacaacctagccctgaaaagactgagcttccatgacatgaatctcgctgactgtcagagcgaggtgctctttttgctacagaatctgactctgcaagagattaccttctccttctgccgtctgtttgagaagcgcccagcccaatttctgcctgagatggttgctgctatgaagggcaactccacactgaagggcctccggctgccagggaaccgcctggggaatgctggcctgctggccttggcagatgttttctcagaggattcatcctcctctctctgtcagctggacatcagttccaactgcatcaagccagatgggcttctggagttcgccaagcggctggagcgctggggccgtggagcctttggtcacctgcgcctcttccaaaactggctggaccaggatgcagtcacagccagggaagccatccggcggctccgggctacctgccatgtggttagcgactcatgggactcatcccaggccttcgcagattatgttagcaccatgtgatggggcccgtacctcacagtctcatgctcggtaccatcagcttgcaggggctgaagcatgggctgcccagaaccccaaccaccagttctatctttctctttctgtcaccttttttctcttttttccttcttcccttgcactgaggtcctggaggccttgatgaggcccagcaaacaggcattctcacagctgggtttatagtctttgggccccttactcagtatcctgggaaccctgggccaggaggttacagtggtcatcataattgctgaagagatcccctcccctgcccctgggttcctgccttccctcctcaagcaggcacccaggctttagagaagtatagggggcttcttccctgctgggcttaccacactgctctcaggcctcaaaccctttcatacctttattcttttttttaaccaaaaaagtttttcttataaaataaattttgggcaaacatca

SEQ ID NO: 355926 - DNA, 2589 bp, Homo sapiens
atggatatatcatggctgtctggcatgttttctgcgtttcagagtgtgacatgttggcgagccaagtttatggaggcctttttttcccatgttctacgtgggaccattgatgtgtcttctgacaggcgtctttgtgatcagcggttctcacctcttctgcacagctcccgccatgtccgacagctcaccatctgtaacatgctgcagggtgcaaccgagctggtggctgagcccaaccgcagggttctggagaccctggccagctccctgcacactctcaagttccgccacctgctgttctctgatgtggctgctcagcagtcacttcggcagctgttgcatcagctcattcaccatggggctgtcagtcaagtgtcgctatactcctggcctgtgcctgagtcagcccttttcatccttattctcaccatgagtgctggcttctggcaaccagggcctggtggcccaccctgccgcctctgtggagaggcctcccgaggccgggccccatcccgagatgaagggtccctcttattgggctcacgtcggccccgccgggatgctgctgagcgatgtgctgcagccctgatggccagccggcgtaagagtgaagccaagcagatgcccagagctgcacctgccactcgggtaacacgccggagcacacaggagagcctgacagcaggcggaacagaccttaagagggagctgcaccccccagccacctcccatgaggctcctggcaccaagcggtcaccttctgctccagcagccacctcctctgcctcttcttctacatcctcatacaaacgggcaccagctagctcagccccacagcctaagcccctaaagcgtttcaagcgagctgcagggaagaagggtgctcgcacccgtcaggggcctggtgcagagtctgaagacctgtatgacttcgtttttattgtggctggcgagaaggaggatggcgaagagatggagattggggaagtggcttgtggagctttggatggatcagatcccagctgcctggggcttccagcactggaagcttcacaaagattccgcagcatctccaccttggagctattcacagttccactctccacagaggcagccctgacactatgccacctgctgagctcctgggtgtcactggagagcctcacactctcctacaatggcctgggctctaacatcttccgcctgctagacagcctgcgggccctgtcaggccaggctggatgtcgcctccgtgccctgcatctcagtgacctgttctcaccactgcccatcctggagctgacacgtgctatcgtgcgagcactgcccctgctacgggtcctctctattcgtgttgaccacccaagccagcgggacaaccctggtgtgccagggaatgcagggccccctagccacataataggcgatgaggagataccagaaaactgcctggagcagttggagatgggatttccacggggagcccagccagccccactgctgtgctccgttctgaaggcctcgggttctctgcagcagctgtccctggatagtgccacctttgcctctccccaggattttgggcttgttttgcaaacactcaaagagtacaacctagccctgaaaagactgagcttccatgacatgaatctcgctgactgtcagagcgaggtgctctttttgctacagaatctgactctgcaagagattaccttctccttctgccgtctgtttgagaagcgcccagcccaatttctgcctgagatggttgctgctatgaagggcaactccacactgaagggcctccggctgccagggaaccgcctggggaatgctggcctgctggccttggcagatgttttctcagaggattcatcctcctctctctgtcagctggacatcagttccaactgcatcaagccagatgggcttctggagttcgccaagcggctggagcgctggggccgtggagcctttggtcacctgcgcctcttccaaaactggctggaccaggatgcagtcacagccagggaagccatccggcggctccgggctacctgccatgtggttagcgactcatgggactcatcccaggccttcgcagattatgttagcaccatgtgatggggcccgtacctcacagtctcatgctcggtaccatcagcttgcaggggctgaagcatgggctgcccagaaccccaaccaccagttctatctttctctttctgtcaccttttttctcttttttccttcttcccttgcactgaggtcctggaggccttgatgaggcccagcaaacaggcattctcacagctgggtttatagtctttgggccccttactcagtatcctgggaaccctgggccaggaggttacagtggtcatcataattgctgaagagatcccctcccctgcccctgggttcctgccttccctcctcaagcaggcacccaggctttagagaagtatagggggcttcttccctgctgggcttaccacactgctctcaggcctcaaaccctttcatacctttattcttttttttaaccaaaaaagtttttcttataaaataaattttgggcaaacatca

SEQ ID NO: 355927 - DNA, 2571 bp, Homo sapiens
cgcgatctaagacccaggttggaaagtgtgacatgttggcgagccaagtttatggaggcctttttttcccatgttctacgtgggaccattgatgtgtcttctgacaggcgtctttgtgatcagcggttctcacctcttctgcacagctcccgccatgtccgacagctcaccatctgtaacatgctgcagggtgcaaccgagctggtggctgagcccaaccgcagggttctggagaccctggccagctccctgcacactctcaagttccgccacctgctgttctctgatgtggctgctcagcagtcacttcggcagctgttgcatcagctcattcaccatggggctgtcagtcaagtgtcgctatactcctggcctgtgcctgagtcagcccttttcatccttattctcaccatgagtgctggcttctggcaaccagggcctggtggcccaccctgccgcctctgtggagaggcctcccgaggccgggccccatcccgagatgaagggtccctcttattgggctcacgtcggccccgccgggatgctgctgagcgatgtgctgcagccctgatggccagccggcgtaagagtgaagccaagcagatgcccagagctgcacctgccactcgggtaacacgccggagcacacaggagagcctgacagcaggcggaacagaccttaagagggagctgcaccccccagccacctcccatgaggctcctggcaccaagcggtcaccttctgctccagcagccacctcctctgcctcttcttctacatcctcatacaaacgggcaccagctagctcagccccacagcctaagcccctaaagcgtttcaagcgagctgcagggaagaagggtgctcgcacccgtcaggggcctggtgcagagtctgaagacctgtatgacttcgtttttattgtggctggcgagaaggaggatggcgaagagatggagattggggaagtggcttgtggagctttggatggatcagatcccagctgcctggggcttccagcactggaagcttcacaaagattccgcagcatctccaccttggagctattcacagttccactctccacagaggcagccctgacactatgccacctgctgagctcctgggtgtcactggagagcctcacactctcctacaatggcctgggctctaacatcttccgcctgctagacagcctgcgggccctgtcaggccaggctggatgtcgcctccgtgccctgcatctcagtgacctgttctcaccactgcccatcctggagctgacacgtgctatcgtgcgagcactgcccctgctacgggtcctctctattcgtgttgaccacccaagccagcgggacaaccctggtgtgccagggaatgcagggccccctagccacataataggcgatgaggagataccagaaaactgcctggagcagttggagatgggatttccacggggagcccagccagccccactgctgtgctccgttctgaaggcctcgggttctctgcagcagctgtccctggatagtgccacctttgcctctccccaggattttgggcttgttttgcaaacactcaaagagtacaacctagccctgaaaagactgagcttccatgacatgaatctcgctgactgtcagagcgaggtgctctttttgctacagaatctgactctgcaagagattaccttctccttctgccgtctgtttgagaagcgcccagcccaatttctgcctgagatggttgctgctatgaagggcaactccacactgaagggcctccggctgccagggaaccgcctggggaatgctggcctgctggccttggcagatgttttctcagaggattcatcctcctctctctgtcagctggacatcagttccaactgcatcaagccagatgggcttctggagttcgccaagcggctggagcgctggggccgtggagcctttggtcacctgcgcctcttccaaaactggctggaccaggatgcagtcacagccagggaagccatccggcggctccgggctacctgccatgtggttagcgactcatgggactcatcccaggccttcgcagattatgttagcaccatgtgatggggcccgtacctcacagtctcatgctcggtaccatcagcttgcaggggctgaagcatgggctgcccagaaccccaaccaccagttctatctttctctttctgtcaccttttttctcttttttccttcttcccttgcactgaggtcctggaggccttgatgaggcccagcaaacaggcattctcacagctgggtttatagtctttgggccccttactcagtatcctgggaaccctgggccaggaggttacagtggtcatcataattgctgaagagatcccctcccctgcccctgggttcctgccttccctcctcaagcaggcacccaggctttagagaagtatagggggcttcttccctgctgggcttaccacactgctctcaggcctcaaaccctttcatacctttattcttttttttaaccaaaaaagtttttcttataaaataaattttgggcaaacatca

SEQ ID NO: 355928 - DNA, 3252 bp, Homo sapiens
gcgcacctccccaagatggcggcgcccgaggcctggcgcgcccggagttgctggttctgtgaggtagcggcggcaacgaccatggaggccacgtcccgggaggcggcgccagcgaagagctcggcctcgggccccaacgctccccccgccctgttcgagctgtgcgggcgggcggtgagcgcccatatgggggttctggagagcggggtgtgggccctcccaggcccaatacttcaaagcatcctacctctgctcaatatatattacttggagaggattgaggaaactgccctcaagaaaggcctctcaactcaggccatctggcgccgactctgggatgaactgatgaagacaaggccttccagtttggaaagtgtgacatgttggcgagccaagtttatggaggcctttttttcccatgttctacgtgggaccattgatgtgtcttctgacaggcgtctttgtgatcagcggttctcacctcttctgcacagctcccgccatgtccgacagctcaccatctgtaacatgctgcagggtgcaaccgagctggtggctgagcccaaccgcagggttctggagaccctggccagctccctgcacactctcaagttccgccacctgctgttctctgatgtggctgctcagcagtcacttcggcagctgttgcatcagctcattcaccatggggctgtcagtcaagtgtcgctatactcctggcctgtgcctgagtcagcccttttcatccttattctcaccatgagtgctggcttctggcaaccagggcctggtggcccaccctgccgcctctgtggagaggcctcccgaggccgggccccatcccgagatgaagggtccctcttattgggctcacgtcggccccgccgggatgctgctgagcgatgtgctgcagccctgatggccagccggcgtaagagtgaagccaagcagatgcccagagctgcacctgccactcgggtaacacgccggagcacacaggagagcctgacagcaggcggaacagaccttaagagggagctgcaccccccagccacctcccatgaggctcctggcaccaagcggtcaccttctgctccagcagccacctcctctgcctcttcttctacatcctcatacaaacgggcaccagctagctcagccccacagcctaagcccctaaagcgtttcaagcgagctgcagggaagaagggtgctcgcacccgtcaggggcctggtgcagagtctgaagacctgtatgacttcgtttttattgtggctggcgagaaggaggatggcgaagagatggagattggggaagtggcttgtggagctttggatggatcagatcccagctgcctggggcttccagcactggaagcttcacaaagattccgcagcatctccaccttggagctattcacagttccactctccacagaggcagccctgacactatgccacctgctgagctcctgggtgtcactggagagcctcacactctcctacaatggcctgggctctaacatcttccgcctgctagacagcctgcgggccctgtcaggccaggctggatgtcgcctccgtgccctgcatctcagtgacctgttctcaccactgcccatcctggagctgacacgtgctatcgtgcgagcactgcccctgctacgggtcctctctattcgtgttgaccacccaagccagcgggacaaccctggtgtgccagggaatgcagggccccctagccacataataggcgatgaggagataccagaaaactgcctggagcagttggagatgggatttccacggggagcccagccagccccactgctgtgctccgttctgaaggcctcgggttctctgcagcagctgtccctggatagtgccacctttgcctctccccaggattttgggcttgttttgcaaacactcaaagagtacaacctagccctgaaaagactgagcttccatgacatgaatctcgctgactgtcagagcgaggtgctctttttgctacagaatctgactctgcaagagattaccttctccttctgccgtctgtttgagaagcgcccagcccaatttctgcctgagatggttgctgctatgaagggcaactccacactgaagggcctccggctgccagggaaccgcctggggaatgctggcctgctggccttggcagatgttttctcagaggattcatcctcctctctctgtcagctggacatcagttccaactgcatcaagccagatgggcttctggagttcgccaagcggctggagcgctggggccgtggagcctttggtcacctgcgcctcttccaaaactggctggaccaggatgcagtcacagccagggaagccatccggcggctccgggctacctgccatgtggttagcgactcatgggactcatcccaggccttcgcagattatgttagcaccatgtgatggggcccgtacctcacagtctcatgctcggtaccatcagcttgcaggggctgaagcatgggctgcccagaaccccaaccaccagttctatctttctctttctgtcaccttttttctcttttttccttcttcccttgcactgaggtcctggaggccttgatgaggcccagcaaacaggcattctcacagctgggtttatagtctttgggccccttactcagtatcctgggaaccctgggccaggaggttacagtggtcatcataattgctgaagagatcccctcccctgcccctgggttcctgccttccctcctcaagcaggcacccaggctttagagaagtatagggggcttcttccctgctgggcttaccacactgctctcaggcctcaaaccctttcatacctttattcttttttttaaccaaaaaagtttttcttataaaataaattttgggcaaacatcatgcagcccttcttgatgattttctcccagagaacaaaattcaacagggccctgtggagcaaggagccccttttccctatctccttcctctaagagctacacccagaccagctggttatcagcggaggccccgctgctcctcatgagaacgctggtggaagacgaaggtgatggcagtggaggcagcatcccaggcagcctggagtacctcatcccggagcccccacttatcagtgcagtggttccaccctgccaggtctgaagtgcagtcagaaccatcagggggtggccggatctgacggctgttgacacaacgtcggcagtgcaacctagg

SEQ ID NO: 355929 - DNA, 3496 bp, Homo sapiens
gcgcacctccccaagatggcggcgcccgaggcctggcgcgcccggagttgctggttctgtgaggtagcggcggcaacgaccatggaggccacgtcccgggaggcggcgccagcgaagagctcggcctcgggccccaacgctccccccgccctgttcgagctgtgcgggcgggcggtgagcgcccatatgggggttctggagagcggggtgtgggccctcccaggcccaatacttcaaagcatcctacctctgctcaatatatattacttggagaggattgaggaaactgccctcaagaaaggcctctcaactcaggccatctggcgccgactctgggatgaactgatgaagacaaggccttccagtttggaaagtgtgacatgttggcgagccaagtttatggaggcctttttttcccatgttctacgtgggaccattgatgtgtcttctgacaggcgtctttgtgatcagcggttctcacctcttctgcacagctcccgccatgtccgacagctcaccatctgtaacatgctgcagggtgcaaccgagctggtggctgagcccaaccgcagggttctggagaccctggccagctccctgcacactctcaagttccgccacctgctgttctctgatgtggctgctcagcagtcacttcggcagctgttgcatcagctcattcaccatggggctgtcagtcaagtgtcgctatactcctggcctgtgcctgagtcagcccttttcatccttattctcaccatgagtgctggcttctggcaaccagggcctggtggcccaccctgccgcctctgtggagaggcctcccgaggccgggccccatcccgagatgaagggtccctcttattgggctcacgtcggccccgccgggatgctgctgagcgatgtgctgcagccctgatggccagccggcgtaagagtgaagccaagcagatgcccagagctgcacctgccactcgggtaacacgccggagcacacaggagagcctgacagcaggcggaacagaccttaagagggagctgcaccccccagccacctcccatgaggctcctggcaccaagcggtcaccttctgctccagcagccacctcctctgcctcttcttctacatcctcatacaaacgggcaccagctagctcagccccacagcctaagcccctaaagcgtttcaagcgagctgcagggaagaagggtgctcgcacccgtcaggggcctggtgcagagtctgaagacctgtatgacttcgtttttattgtggctggcgagaaggaggatggcgaagagatggagattggggaagtggcttgtggagctttggatggatcagatcccagctgcctggggcttccagcactggaagcttcacaaagattccgcagcatctccaccttggagctattcacagttccactctccacagaggcagccctgacactatgccacctgctgagctcctgggtgtcactggagagcctcacactctcctacaatggcctgggctctaacatcttccgcctgctagacagcctgcgggccctgtcaggccaggctggatgtcgcctccgtgccctgcatctcagtgacctgttctcaccactgcccatcctggagctgacacgtgctatcgtgcgagcactgcccctgctacgggtcctctctattcgtgttgaccacccaagccagcgggacaaccctggtgtgccagggaatgcagggccccctagccacataataggcgatgaggagataccagaaaactgcctggagcagttggagatgggatttccacggggagcccagccagccccactgctgtgctccgttctgaaggcctcgggttctctgcagcagctgtccctggatagtgccacctttgcctctccccaggattttgggcttgttttgcaaacactcaaagagtacaacctagccctgaaaagactgagcttccatgacatgaatctcgctgactgtcagagcgaggtgctctttttgctacagaatctgactctgcaaggtaagttccttattcagaacctggacatttcctgggtcttcactatggttctgccataatctgagtgagcaaaccactgttcctttcttggccttgtgtcctcagctataaaatggatatagaacctgcatgattttccttctaaaagccccaacctcaattcctcctctactaaacatgagaaatcgctcttttagagtgcttcacccaaaagttgctcttacctttcagaggtggacaaaatggtggtggtggggcaaaataaatgtactgtgccaggctcccctcatagacttttctctgatccccacccccgcatagagggtggccagtgttagggaaagaaggaagtgaatggagaattgtccatgcagagaaccttcttatagggaacatttaggttcagtctttagtttggattctgatttagttccagccttgcttggagtctagacaaattccttcctctttttgggcctctataatgttaataccccttgctagggccaactggggcaggaggggcagcaccagtcctaatgcagccatcagaatttactataatttttcttgacagagattaccttctccttctgccgtctgtttgagaagcgcccagcccaatttctgcctgagatggttgctgctatgaagggcaactccacactgaagggcctccggctgccagggaaccgcctggggaatgctggcctgctggccttggcagatgttttctcagaggattcatcctcctctctctgtcagctggacatcagttccaactgcatcaagccagatgggcttctggagttcgccaagcggctggagcgctggggccgtggagcctttggtcacctgcgcctcttccaaaactggctggaccaggatgcagtcacagccagggaagccatccggcggctccgggctacctgccatgtggttagcgactcatgggactcatcccaggccttcgcagattatgttagcaccatgtgatggggcccgtacctcacagtctcatgctcggtaccatcagcttgcaggggctgaagcatgggctgcccagaaccccaaccaccagttctatctttctctttctgtcaccttttttctcttttttccttcttcccttgcactgaggtcctggaggccttgatgaggcccagcaaacaggcattctcacagctgggtttatagtctttgggccccttactcagtatcctgggaaccctgggccaggaggttacagtggtcatcataattgctgaagagatcccctcccctgcccctgggttcctgccttccctcctcaagcaggcacccaggctttagagaagtatagggggcttcttccctgctgggcttaccacactgctctcaggcctcaaaccctttcatacctttattcttttttttaaccaaaaaagtttttcttataaaataaattttgggcaaacatca

SEQ ID NO: 355930 - DNA, 2865 bp, Homo sapiens
gcgcacctccccaagatggcggcgcccgaggcctggcgcgcccggagttgctggttctgtgaggtagcggcggcaacgaccatggaggccacgtcccgggaggcggcgccagcgaagagctcggcctcgggccccaacgctccccccgccctgttcgagctgtgcgggcgggcggtgagcgcccatatgggggttctggagagcggggtgtgggccctcccaggcccaatacttcaaagcatcctacctctgctcaatatatattacttggagaggattgaggaaactgccctcaagaaaggcctctcaactcaggccatctggcgccgactctgggatgaactgatgaagacaaggccttccagtttggaaagtgtgacatgttggcgagccaagtttatggaggcctttttttcccatgttctacgtgggaccattgatgtgtcttctgacaggcgtctttgtgatcagcggttctcacctcttctgcacagctcccgccatgtccgacagctcaccatctgtaacatgctgcagggtgcaaccgagctggtggctgagcccaaccgcagggttctggagaccctggccagctccctgcacactctcaagttccgccacctgctgttctctgatgtggctgctcagcagtcacttcggcagctgttgcatcagctcattcaccatggggctgtcagtcaagtgtcgctatactcctggcctgtgcctgagtcagcccttttcatccttattctcaccatgagtgctggcttctggcaaccagggcctggtggcccaccctgccgcctctgtggagaggcctcccgaggccgggccccatcccgagatgaagggtccctcttattgggctcacgtcggccccgccgggatgctgctgagcgatgtgctgcagccctgatggccagccggcgtaagagtgaagccaagcagatgcccagagctgcacctgccactcgggtaacacgccggagcacacaggagagcctgacagcaggcggaacagaccttaagagggagctgcaccccccagccacctcccatgaggctcctggcaccaagcggtcaccttctgctccagcagccacctcctctgcctcttcttctacatcctcatacaaacgggcaccagctagctcagccccacagcctaagcccctaaagcgtttcaagcgagctgcagggaagaagggtgctcgcacccgtcaggggcctggtgcagagtctgaagacctgtatgacttcgtttttattgtggctggcgagaaggaggatggcgaagagatggagattggggaagtggcttgtggagctttggatggatcagatcccagctgcctggggcttccagcactggaagcttcacaaagattccgcagcatctccaccttggagctattcacagttccactctccacagaggcagccctgacactatgccacctgctgagctcctgggtgtcactggagagcctcacactctcctacaatggcctgggctctaacatcttccgcctgctagacagcctgcgggccctgtcaggccaggctggatgtcgcctccgtgccctgcatctcagtgacctgttctcaccactgcccatcctggagctgacacgtgctatcgtgcgagcactgcccctgctacgggtcctctctattcgtgttgaccacccaagccagcgggacaaccctggtgtgccagggaatgcagggccccctagccacataataggcgatgaggagataccagaaaactgcctggagcagttggagatgggatttccacggggagcccagccagccccactgctgtgctccgttctgaaggcctcgggttctctgcagcagctgtccctggatagtgccacctttgcctctccccaggattttgggcttgttttgcaaacactcaaagagtacaacctagccctgaaaagactgagcttccatgacatgaatctcgctgactgtcagagcgaggtgctctttttgctacagaatctgactctgcaagagattaccttctccttctgccgtctgtttgagaagcgcccagcccaatttctgcctgagatggttgctgctatgaagggcaactccacactgaagggcctccggctgccagggaaccgcctggggaatgctggcctgctggccttggcagatgttttctcagaggattcatcctcctctctctgtcagctggacatcagttccaactgcatcaagccagatgggcttctggagttcgccaagcggctggagcgctggggccgtggagcctttggtcacctgcgcctcttccgggctacctgccatgtggttagcgactcatgggactcatcccaggccttcgcagattatgttagcaccatgtgatggggcccgtacctcacagtctcatgctcggtaccatcagcttgcaggggctgaagcatgggctgcccagaaccccaaccaccagttctatctttctctttctgtcaccttttttctcttttttccttcttcccttgcactgaggtcctggaggccttgatgaggcccagcaaacaggcattctcacagctgggtttatagtctttgggccccttactcagtatcctgggaaccctgggccaggaggttacagtggtcatcataattgctgaagagatcccctcccctgcccctgggttcctgccttccctcctcaagcaggcacccaggctttagagaagtatagggggcttcttccctgctgggcttaccacactgctctcaggcctcaaaccctttcatacctttattcttttttttaaccaaaaaagtttttcttataaaataaattttgggcaaacatca

SEQ ID NO: 355931 - DNA, 2664 bp, Homo sapiens
gcgcacctccccaagatggcggcgcccgaggcctggcgcgcccggagttgctggttctgtgaggtagcggcggcaacgaccatggaggccacgtcccgggaggcggcgccagcgaagagctcggcctcgggccccaacgctccccccgccctgttcgagctgtgcgggcgggcggtgagcgcccatatgggggttctggagagcggggtgtgggccctcccaggcccaatacttcaaagcatcctacctctgctcaatatatattacttggagaggattgaggaaactgccctcaagaaaggcctctcaactcaggccatctggcgccgactctgggatgaactgatgaagacaaggccttccagtttggaaagtgtgacatgttggcgagccaagtttatggaggcctttttttcccatgttctacgtgggaccattgatgtgtcttctgacaggcgtctttgtgatcagcggttctcacctcttctgcacagctcccgccatgtccgacagctcaccatctgtaacatgctgcagggtgcaaccgagctggtggctgagcccaaccgcagggttctggagaccctggccagctccctgcacactctcaagttccgccacctgctgttctctgatgtggctgctcagcagtcacttcggcagctgttgcatcagctcattcaccatggggctgtcagtcaagtgtcgctatactcctggcctgtgcctgagtcagcccttttcatccttattctcaccatgagtgctggcttctggcaaccagggcctggtggcccaccctgccgcctctgtggagaggcctcccgaggccgggccccatcccgagatgaagggtccctcttattgggctcacgtcggccccgccgggatgctgctgagcgatgtgctgcagccctgatggccagccggcgtaagagtgaagccaagcagatgcccagagctgcacctgccactcgggtaacacgccggagcacacaggagagcctgacagcaggcggaacagaccttaagagggagctgcaccccccagccacctcccatgaggctcctggcaccaagcggtcaccttctgctccagcagccacctcctctgcctcttcttctacatcctcatacaaacgggcaccagctagctcagccccacagcctaagcccctaaagcgtttcaagcgagctgcagggaagaagggtgctcgcacccgtcaggggcctggtgcagagtctgaagacctgtatgacttcgtttttattgtggctggcgagaaggaggatggcgaagagatggagattggggaagtggcttgtggagctttggatggatcagatcccagctgcctggggcttccagcactggaagcttcacaaagattccgcagcatctccaccttggagctattcacagttccactctccacagaggcagccctgacactatgccacctgctgagctcctgggtgtcactggagagcctcacactctcctacaatggcctgggctctaacatcttccgcctgctagacagcctgcgggccctgtcaggccaggctggatgtcgcctccgtgccctgcatctcagtgacctgttctcaccactgcccatcctggagctgacacgtgctatcgtgcgagcactgcccctgctacgggtcctctctattcgtgttgaccacccaagccagcgggacaaccctggtgtgccagggaatgcagggccccctagccacataataggcgatgaggagataccagaaaactgcctggagcagttggagatgggatttccacggggagcccagccagccccactgctgtgctccgttctgaaggcctcgggttctctgcagcagctgtccctggatagtgccacctttgcctctccccaggattttgggcttgttttgcaaacactcaaagagtacaacctagccctgaaaagactgagcttccatgacatgaatctcgctgactgtcagagcgaggtgctctttttgctacagaatctgactctgcaagagattaccttctccttctgccgtctgtttgagaagcgcccagcccaatttctgcctgagatggttgctgctatgaagggcaactccacactgaagggcctccggctgccagggaaccgcctggggaatgctggcctgctggccttggcagatgttttctcagaggattcatcctcctctctctgtcagctggacatcagttccaactgcatcaagccagatgggcttctggagttcgccaagcggctggagcgctggggccgtggagcctttggtcacctgcgcctcttccaaaactggctggaccaggatgcagtcacagccagggaagccatccggcggctccgggctacctgccatgtggttagcgactcatgggactcatcccaggccttcgcagattatgttagcaccatgtgatggggcccgtacctcacagtctcatgctcggtaccatcagcttgcaggggctgaagcatgggctgcccagaaccccaaccaccagttctatctttctctttctgtcaccttttttctctttttttttttttttttttttttttttttttttttttttttttttttttttttttttttttttttttttttttttttttttttttttttttt

SEQ ID NO: 355932 - DNA, 2169 bp, Homo sapiens
gcgcacctccccaagatggcggcgcccgaggcctggcgcgcccggagttgctggttctgtgaggtagcggcggcaacgaccatggaggccacgtcccgggaggcggcgccagcgaagagctcggcctcgggccccaacgctccccccgccctgttcgagctgtgcgggcgggcggtgagcgcccatatgggggttctggagagcggggtgtgggccctcccaggcccaatacttcaaagcatcctacctctgctcaatatatattacttggagaggattgaggaaactgccctcaagaaaggcctctcaactcaggccatctggcgccgactctgggatgaactgatgaagacaaggccttccagtttggaaagtgtgacatgttggcgagccaagtttatggaggcctttttttcccatgttctacgtgggaccattgatgtgtcttctgacaggcgtctttgtgatcagcggttctcacctcttctgcacagctcccgccatgtccgacagctcaccatctgtaacatgctgcagggtgcaaccgagctggtggctgagcccaaccgcagggttctggagaccctggccagctccctgcacactctcaagttccgccacctgctgttctctgatgtggctgctcagcagtcacttcggcagctgttgcatcagctcattcaccatggggctgtcagtcaagtgtcgctatactcctggcctgtgcctgagtcagcccttttcatccttattctcaccatgagtgctggcttctggcaaccagggcctggtggcccaccctgccgcctctgtggagaggcctcccgaggccgggccccatcccgagatgaagggtccctcttattgggctcacgtcggccccgccgggatgctgctgagcgatgtgctgcagccctgatggccagccggcgtaagagtgaagccaagcagatgcccagagctgcacctgccactcgggtaacacgccggagcacacaggagagcctgacagcaggcggaacagaccttaagagggagctgcaccccccagccacctcccatgaggctcctggcaccaagcggtcaccttctgctccagcagccacctcctctgcctcttcttctacatcctcatacaaacgggcaccagctagctcagccccacagcctaagcccctaaagcgtttcaagcgagctgcagggaagaagggtgctcgcacccgtcaggggcctggtgcagagtctgaagacctgtatgacttcgtttttattgtggctggcgagaaggaggatggcgaagagatggagattggggaagtggcttgtggagctttggatggatcagatcccagctgcctggggcttccagcactggaagcttcacaaagattccgcagcatctccaccttggagctattcacagttccactctccacagaggcagccctgacactatgccacctgctgagctcctgggtgtcactggagagcctcacactctcctacaatggcctgggctctaacatcttccgcctgctagacagcctgcgggccctgtcaggccaggctggatgtcgcctccgtgccctgcatctcagtgacctgttctcaccactgcccatcctggagctgacacgtgctatcgtgcgagcactgcccctgctacgggtcctctctattcgtgttgaccacccaagccagcgggacaaccctggtgtgccagggaatgcagggccccctagccacataataggcgatgaggagataccagaaaactgcctggagcagttggagatgggatttccacggggagcccagccagccccactgctgtgctccgttctgaaggcctcgggttctctgcagcagctgtccctggatagtgccacctttgcctctccccaggattttgggcccttactcagtatcctgggaaccctgggccaggaggttacagtggtcatcataattgctgaagagatcccctcccctgcccctgggttcctgccttccctcctcaagcaggcacccaggctttagagaagtatagggggcttcttccctgctgggcttaccacactgctctcaggcctcaaaccctttcatacctttattcttttttttaaccaaaaaagtttttcttataaaataaattttgggcaaacatca

SEQ ID NO: 355933 - DNA, 2216 bp, Homo sapiens
gcgcacctccccaagatggcggcgcccgaggcctggcgcgcccggagttgctggttctgtgaggtagcggcggcaacgaccatggaggccacgtcccgggaggcggcgccagcgaagagctcggcctcgggccccaacgctccccccgccctgttcgagctgtgcgggcgggcggtgagcgcccatatgggggttctggagagcggggtgtgggccctcccaggcccaatacttcaaagcatcctacctctgctcaatatatattacttggagaggattgaggaaactgccctcaagaaaggcctctcaactcaggccatctggcgccgactctgggatgaactgatgaagacaaggccttccagtttggaaagtgtgacatgttggcgagccaagtttatggaggcctttttttcccatgttctacgtgggaccattgatgtgtcttctgacaggcgtctttgtgatcagcggttctcacctcttctgcacagctcccgccatgtccgacagctcaccatctgtaacatgctgcagggtgcaaccgagctggtggctgagcccaaccgcagggttctggagaccctggccagctccctgcacactctcaagttccgccacctgctgttctctgatgtggctgctcagcagtcacttcggcagctgttgcatcagctcattcaccatggggctgtcagtcaagtgtcgctatactcctggcctgtgcctgagtcagcccttttcatccttattctcaccatgagtgctggcttctggcaaccagggcctggtggcccaccctgccgcctctgtggagaggcctcccgaggccgggccccatcccgagatgaagggtccctcttattgggctcacgtcggccccgccgggatgctgctgagcgatgtgctgcagccctgatggccagccggcgtaagagtgaagccaagcagatgcccagagctgcacctgccactcgggtaacacgccggagcacacaggagagcctgacagcaggcggaacagaccttaagagggagctgcaccccccagccacctcccatgaggctcctggcaccaagcggtcaccttctgctccagcagccacctcctctgcctcttcttctacatcctcatacaaacgggcaccagctagctcagccccacagcctaagcccctaaagcgtttcaagcgagctgcagggaagaagggtgctcgcacccgtcaggggcctggtgcagagtctgaagacctgtatgacttcgtttttattgtggctggcgagaaggaggatggcgaagagatggagattggggaagtggcttgtggagctttggatggatcagatcccagctgcctggggcttccagcactggaagcttcacaaagattccgcagcatctccaccttggagctattcacagttccactctccacagaggcagccctgacactatgccacctgctgagctcctgggtgtcactggagagcctcacactctcctacaatggcctgggctctaacatcttccgcctgctagacagcctgcgggccctgtcaggccaggctggatgtcgcctccgtgccctgcatctcagtgacctgttctcaccactgcccatcctggagctgacacgtgctatcgtgcgagcactgcccctgctacgggtcctctctattcgtgttgaccacccaagccagcgggacaaccctggtgtgccagggaatgcagggccccctagccacataataggcgatgaggagataccagagtacaacctagccctgaaaagactgagcttccatgacatgaatctcgctgactgtcagagcgaggtgctctttttgctacagaatctgactctgcaagagattaccttctccttctgccgtctgtttgagaagcgcccagcccaatttctgcctgagatggttgctgctatgaagggcaactccacactgaagggcctccggctgccagggaaccgcctgggtgggggccagaccctggggagggagaggggaaaggagctaggcctttgacctaaaaactcactggataaaggcaaagacctctccactgggaacgtgggagttggaatacagatatttctgtgctggggcttcaggaaccagcagggctggttctgccagccatagttgggttgggatacccttgtcccctgttcttgggtggaggtgataggcgttctccc

SEQ ID NO: 355934 - DNA, 810 bp, Homo sapiens
gcgcacctccccaagatggcggcgcccgaggcctggcgcgcccggagttgctggttctgtgaggtagcggcggcaacgaccatggaggccacgtcccgggaggcggcgccagcgaagagctcggcctcgggccccaacgctccccccgccctgttcgagctgtgcgggcgggcggtgagcgcccatatgggggttctggagagcggggtgtgggccctcccaggcccaatacttcaaagcatcctacctctgctcaatatatattacttggagaggattgaggaaactgccctcaagaaaggcctctcaactcaggccatctggcgccgactctgggatgaactgatgaagacaaggccttccagtttggaaagtgtgacatgttggcgagccaagtttatggaggcctttttttcccatgttctacgtgggaccattgatgtgtcttctgacaggcgtctttgtgatcagcggttctcacctcttctgcacagctcccgccatgtccgacagctcaccatctgtaacatgctgcagggtgcaaccgagctggtggctgagcccaaccgcagggttctggagaccctggccagctccctgcacactctcaagttccgccacctgctgttctctgatgtggctgctcagcagtcacttcggcagctgttgcatcagctcattcaccatggggctgtcagtcaagtgtcgctatactcctggcctgtgcctgagtcagcccttttcatccttattctcaccacctccctctatgccatattaataaactgttatctcctgttcttcacaaac

SEQ ID NO: 355935 - DNA, 679 bp, Homo sapiens
gcggccgccgcggctgcggccgtggcaaagaaacaggctgcgggcggcaggaagggctgctggggctgcggctggggctgctggccggcgccgccgctctccatcttggcagagctttccatgcgcagcggcggccaaggagtcgcggaatcagagcgatccgggacgcgaggtgcggggcccgcgagggggacacagagagaacttgggtgcaggaacagagagggaaagaaaaggaaatatgaagcgggagccctgacggaagttaaaaaatatatacaaaatccccgggagacttcttagagtgggagcaaaaaaagtgaaaatgctttttctcctccctgcacgccgcctcctcctccctcccctcctcccttcgcgggttggcttcgggagcctcgcgtggcgctcgcgtgtgaggctgccgctggcgccttcttgtttctaagaaaaaaaaaagcagaagcagcagcaaaagtcagtgctgaacgcgctctgccgcgtctcgcgttcctctcctactaaggctgcgctctcttgcgccgggtctcggtctctccagccgtggctcaggctgtttttattattttgttaactcccttcctttctgatttccttctttcactcgccctccctggccggatccctgtcggtgcgccttccacgttccctggccaga

SEQ ID NO: 355936 - DNA, 2685 bp, Homo sapiens
cagctgggggtaaggggggcggattattcatataattgttataccagacggtcgcaggcttagtccaattgcagagaactcgcttcccaggcttctgagagtcccggaagtgcctaaacctgtctaatcgacggggcttgggtggcccgtcgctccctggcttcttccctttacccagggcgggcagcgaagtggtgcctcctgcgtcccccacaccctccctcagcccctcccctccggcccgtcctgggcaggtgacctggagcatccggcaggctgccctggcctcctgcgtcaggacaagcccacgaggggcgttactgtgcggagatgcaccacgcaagagacaccctttgtaactctcttctcctccctagtgcgaggttaaaaccttcagccccacgtgctgtttgcaaacctgcctgtacctgaggccctaaaaagccagagacctcactcccggggagccagcatgtccactgcggtcctggaaaacccaggcttgggcaggaaactctctgactttggacaggaaacaagctatattgaagacaactgcaatcaaaatggtgccatatcactgatcttctcactcaaagaagaagttggtgcattggccaaagtattgcgcttatttgaggagaatgatgtaaacctgacccacattgaatctagaccttctcgtttaaagaaagatgagtatgaatttttcacccatttggataaacgtagcctgcctgctctgacaaacatcatcaagatcttgaggcatgacattggtgccactgtccatgagctttcacgagataagaagaaagacacagtgccctggttcccaagaaccattcaagagctggacagatttgccaatcagattctcagctatggagcggaactggatgctgaccaccctggttttaaagatcctgtgtaccgtgcaagacggaagcagtttgctgacattgcctacaactaccgccatgggcagcccatccctcgagtggaatacatggaggaagaaaagaaaacatggggcacagtgttcaagactctgaagtccttgtataaaacccatgcttgctatgagtacaatcacatttttccacttcttgaaaagtactgtggcttccatgaagataacattccccagctggaagacgtttctcagttcctgcagacttgcactggtttccgcctccgacctgtagctggcctgctttcctctcgggatttcttgggtggcctggccttccgagtcttccactgcacacagtacatcagacatggatccaagcccatgtatacccccgaacctgacatctgccatgagctgttgggacatgtgcccttgttttcagatcgcagctttgcccagttttcccaggaaattggccttgcctctctgggtgcacctgatgaatacattgaaaagctcgccacaatttactggtttactgtggagtttgggctctgcaaacaaggagactccataaaggcatatggtgctgggctcctgtcatcctttggtgaattacagtactgcttatcagagaagccaaagcttctccccctggagctggagaagacagccatccaaaattacactgtcacggagttccagcccctgtattacgtggcagagagttttaatgatgccaaggagaaagtaaggaactttgctgccacaatacctcggcccttctcagttcgctacgacccatacacccaaaggattgaggtcttggacaatacccagcagcttaagattttggctgattccattaacagtgaaattggaatcctttgcagtgccctccagaaaataaagtaaagccatggacagaatgtggtctgtcagctgtgaatctgttgatggagatccaactatttctttcatcagaaaaagtccgaaaagcaaaccttaatttgaaataacagccttaaatcctttacaagatggagaaacaacaaataagtcaaaataatctgaaatgacaggatatgagtacatactcaagagcataatggtaaatcttttggggtcatctttgatttagagatgataatcccatactctcaattgagttaaatcagtaatctgtcgcatttcatcaagattaattaaaatttgggacctgcttcattcaagcttcatatatgctttgcagagaactcataaaggagcatataaggctaaatgtaaaacacaagactgtcattagaattgaattattgggcttaatataaatcgtaacctatgaagtttattttctattttagttaactatgattccaattactactttgttattgtacctaagtaaattttctttaagtcagaagcccattaaaatagttacaagcattgaacttctttagtattatattaatataaaaacatttttgtatgttttattgtaatcataaatactgctgtataaggtaataaaactctgcacctaatccccataacttccagtatcattttccaattaattatcaagtctgttttgggaaacactttgaggacatttatgatgcagcagatgttgactaaaggcttggttggtagatattcaggaaatgttcactgaataaataagtaaatacattattgaaaagcaaatctgtataaatgtgaaatttttatttgtattagtaataaaacattagtagtttaaacaa

SEQ ID NO: 355937 - DNA, 421 bp, Homo sapiens
gcggccgccgcggctgcggccgtggcaaagaaacaggctgcgggcggcaggaagggctgctggggctgcggctggggctgctggccggcgccgccgctctccatcttggcagagctttccatgcgcagcggcggccaaggagtcgcggaatcagagcgatccgggacgcgaggtgcggggcccgcgagggggacacagagagaacttgggtgcaggaacagagagggaaagaaaaggaaatatgaagcgggagccctgacggaagttaaaaaatatatacaaaatccccgggagacttcttagagtgggagcaaaaaaagtgaaaatgctttttctcctcccttcctttctgatttccttctttcactcgccctccctggccggatccctgtcggtgcgccttccacgttccctggccaga

SEQ ID NO: 355938 - DNA, 509 bp, Homo sapiens
  misc_feature (1)..(1): n is a, c, g, or t
naagagaacctctggggtccccagggaccaaaagaagggagaaagaaaaaggagaaatactgaaccccgggaagcccctgacacggagaagttataaaaaaaatatatacaaaatccccgggagacttcttagagtgggagcaaaaaaagtgaaaatgctttttctcctccctgcacgccgcctcctcctccctcccctcctcccttcgcgggttggcttcgggagcctcgcgtggcgctcgcgtgtgaggctgccgctggcgccttcttgtttctaagaaaaaaaaaagcagaagcagcagcaaaagtcagtgctgaacgcgctctgccgcgtctcgcgttcctctcctactaaggctgcgctctcttgcgccgggtctcggtctctccagccgtggctcaggctgtttttattattttgttaactcccttcctttctgatttccttctttcactcgccctccctggccggatccctgtcggtgcgccttccacgttccctggccaga

SEQ ID NO: 355939 - DNA, 2619 bp, Homo sapiens
cagctgggggtaaggggggcggattattcatataattgttataccagacggtcgcaggcttagtccaattgcagagaactcgcttcccaggcttctgagagtcccggaagtgcctaaacctgtctaatcgacggggcttgggtggcccgtcgctccctggcttcttccctttacccagggcgggcagcgaagtggtgcctcctgcgtcccccacaccctccctcagcccctcccctccggcccgtcctgggcaggtgacctggagcatccggcaggctgccctggcctcctgcgtcaggacaagcccacgaggggcgttactgtgcggagatgcaccacgcaagagacaccctttgtaactctcttctcctccctagtgcgaggttaaaaccttcagccccacgtgctgtttgcaaacctgcctgtacctgaggccctaaaaagccagagacctcactcccggggagccagcatgtccactgcggtcctggaaaacccaggcttgggcaggaaactctctgactttggacaggaaacaagctatattgaagacaactgcaatcaaaatggtgccatatcactgatcttctcactcaaagaagaagttggtgcattggccaaagtattgcgcttatttgaggagaatgatgtaaacctgacccacattgaatctagaccttctcgtttaaagaaagatgagtatgaatttttcacccatttggataaacgtagcctgcctgctctgacaaacatcatcaagatcttgaggcatgacattggtgccactgtccatgagctttcacgagataagaagaaagacacagtgccctggttcccaagaaccattcaagagctggacagatttgccaatcagattctcagctatggagcggaactggatgctgaccaccctggttttaaagatcctgtgtaccgtgcaagacggaagcagtttgctgacattgcctacaactaccgccatgggcagcccatccctcgagtggaatacatggaggaagaaaagaaaacatggggcacagtgttcaagactctgaagtccttgtataaaacccatgcttgctatgagtacaatcacatttttccacttcttgcttgcactggtttccgcctccgacctgtagctggcctgctttcctctcgggatttcttgggtggcctggccttccgagtcttccactgcacacagtacatcagacatggatccaagcccatgtatacccccgaacctgacatctgccatgagctgttgggacatgtgcccttgttttcagatcgcagctttgcccagttttcccaggaaattggccttgcctctctgggtgcacctgatgaatacattgaaaagctcgccacaatttactggtttactgtggagtttgggctctgcaaacaaggagactccataaaggcatatggtgctgggctcctgtcatcctttggtgaattacagtactgcttatcagagaagccaaagcttctccccctggagctggagaagacagccatccaaaattacactgtcacggagttccagcccctgtattacgtggcagagagttttaatgatgccaaggagaaagtaaggaactttgctgccacaatacctcggcccttctcagttcgctacgacccatacacccaaaggattgaggtcttggacaatacccagcagcttaagattttggctgattccattaacagtgaaattggaatcctttgcagtgccctccagaaaataaagtaaagccatggacagaatgtggtctgtcagctgtgaatctgttgatggagatccaactatttctttcatcagaaaaagtccgaaaagcaaaccttaatttgaaataacagccttaaatcctttacaagatggagaaacaacaaataagtcaaaataatctgaaatgacaggatatgagtacatactcaagagcataatggtaaatcttttggggtcatctttgatttagagatgataatcccatactctcaattgagttaaatcagtaatctgtcgcatttcatcaagattaattaaaatttgggacctgcttcattcaagcttcatatatgctttgcagagaactcataaaggagcatataaggctaaatgtaaaacacaagactgtcattagaattgaattattgggcttaatataaatcgtaacctatgaagtttattttctattttagttaactatgattccaattactactttgttattgtacctaagtaaattttctttaagtcagaagcccattaaaatagttacaagcattgaacttctttagtattatattaatataaaaacatttttgtatgttttattgtaatcataaatactgctgtataaggtaataaaactctgcacctaatccccataacttccagtatcattttccaattaattatcaagtctgttttgggaaacactttgaggacatttatgatgcagcagatgttgactaaaggcttggttggtagatattcaggaaatgttcactgaataaataagtaaatacattattgaaaagcaaatctgtataaatgtgaaatttttatttgtattagtaataaaacattagtagtttaaacaa

SEQ ID NO: 355940 - DNA, 2646 bp, Homo sapiens
cagctgggggtaaggggggcggattattcatataattgttataccagacggtcgcaggcttagtccaattgcagagaactcgcttcccaggcttctgagagtcccggaagtgcctaaacctgtctaatcgacggggcttgggtggcccgtcgctccctggcttcttccctttacccagggcgggcagcgaagtggtgcctcctgcgtcccccacaccctccctcagcccctcccctccggcccgtcctgggcaggtgacctggagcatccggcaggctgccctggcctcctgcgtcaggacaagcccacgaggggcgttactgtgcggagatgcaccacgcaagagacaccctttgtaactctcttctcctccctagtgcgaggttaaaaccttcagccccacgtgctgtttgcaaacctgcctgtacctgaggccctaaaaagccagagacctcactcccggggagccagcatgtccactgcggtcctggaaaacccaggcttgggcaggaaactctctgactttggacaggaaacaagctatattgaagacaactgcaatcaaaatggtgccatatcactgatcttctcactcaaagaagaagttggtgcattggccaaagtattgcgcttatttgaggagaatgatgtaaacctgacccacattgaatctagaccttctcgtttaaagaaagatgagtatgaatttttcacccatttggataaacgtagcctgcctgctctgacaaacatcatcaagatcttgaggcatgacattggtgccactgtccatgagctttcacgagataagaagaaagacacagtgccctggttcccaagaaccattcaagagctggacagatttgccaatcagattctcagctatggagcggaactggatgctgaccaccctggttttaaagatcctgtgtaccgtgcaagacggaagcagtttgctgacattgcctacaactaccgccatgggcagcccatccctcgagtggaatacatggaggaagaaaagaaaacatggggcacagtgttcaagactctgaagtccttgtataaaacccatgcttgctatgagtacaatcacatttttccacttcttgaaaagtactgtggcttccatgaagataacattccccagctggaagacgtttctcagttcctgcagacttgcactggtttccgcctccgacctgtagctggcctgctttcctctcgggatttcttgggtggcctggccttccgagtcttccactgcacacagtacatcagacatggatccaagcccatgtatacccccgaacctgacatctgccatgagctgttgggacatgtgcccttgttttcagatcgcagctttgcccagttttcccaggaaattggccttgcctctctgggtgcacctgatgaatacattgaaaagctcgccacaggagactccataaaggcatatggtgctgggctcctgtcatcctttggtgaattacagtactgcttatcagagaagccaaagcttctccccctggagctggagaagacagccatccaaaattacactgtcacggagttccagcccctgtattacgtggcagagagttttaatgatgccaaggagaaagtaaggaactttgctgccacaatacctcggcccttctcagttcgctacgacccatacacccaaaggattgaggtcttggacaatacccagcagcttaagattttggctgattccattaacagtgaaattggaatcctttgcagtgccctccagaaaataaagtaaagccatggacagaatgtggtctgtcagctgtgaatctgttgatggagatccaactatttctttcatcagaaaaagtccgaaaagcaaaccttaatttgaaataacagccttaaatcctttacaagatggagaaacaacaaataagtcaaaataatctgaaatgacaggatatgagtacatactcaagagcataatggtaaatcttttggggtcatctttgatttagagatgataatcccatactctcaattgagttaaatcagtaatctgtcgcatttcatcaagattaattaaaatttgggacctgcttcattcaagcttcatatatgctttgcagagaactcataaaggagcatataaggctaaatgtaaaacacaagactgtcattagaattgaattattgggcttaatataaatcgtaacctatgaagtttattttctattttagttaactatgattccaattactactttgttattgtacctaagtaaattttctttaagtcagaagcccattaaaatagttacaagcattgaacttctttagtattatattaatataaaaacatttttgtatgttttattgtaatcataaatactgctgtataaggtaataaaactctgcacctaatccccataacttccagtatcattttccaattaattatcaagtctgttttgggaaacactttgaggacatttatgatgcagcagatgttgactaaaggcttggttggtagatattcaggaaatgttcactgaataaataagtaaatacattattgaaaagcaaatctgtataaatgtgaaatttttatttgtattagtaataaaacattagtagtttaaacaa

SEQ ID NO: 355941 - DNA, 2631 bp, Homo sapiens
cagctgggggtaaggggggcggattattcatataattgttataccagacggtcgcaggcttagtccaattgcagagaactcgcttcccaggcttctgagagtcccggaagtgcctaaacctgtctaatcgacggggcttgggtggcccgtcgctccctggcttcttccctttacccagggcgggcagcgaagtggtgcctcctgcgtcccccacaccctccctcagcccctcccctccggcccgtcctgggcaggtgacctggagcatccggcaggctgccctggcctcctgcgtcaggacaagcccacgaggggcgttactgtgcggagatgcaccacgcaagagacaccctttgtaactctcttctcctccctagtgcgaggttaaaaccttcagccccacgtgctgtttgcaaacctgcctgtacctgaggccctaaaaagccagagacctcactcccggggagccagcatgtccactgcggtcctggaaaacccaggcttgggcaggaaactctctgactttggacaggaaacaagctatattgaagacaactgcaatcccaaagtattgcgcttatttgaggagaatgatgtaaacctgacccacattgaatctagaccttctcgtttaaagaaagatgagtatgaatttttcacccatttggataaacgtagcctgcctgctctgacaaacatcatcaagatcttgaggcatgacattggtgccactgtccatgagctttcacgagataagaagaaagacacagtgccctggttcccaagaaccattcaagagctggacagatttgccaatcagattctcagctatggagcggaactggatgctgaccaccctggttttaaagatcctgtgtaccgtgcaagacggaagcagtttgctgacattgcctacaactaccgccatgggcagcccatccctcgagtggaatacatggaggaagaaaagaaaacatggggcacagtgttcaagactctgaagtccttgtataaaacccatgcttgctatgagtacaatcacatttttccacttcttgaaaagtactgtggcttccatgaagataacattccccagctggaagacgtttctcagttcctgcagacttgcactggtttccgcctccgacctgtagctggcctgctttcctctcgggatttcttgggtggcctggccttccgagtcttccactgcacacagtacatcagacatggatccaagcccatgtatacccccgaacctgacatctgccatgagctgttgggacatgtgcccttgttttcagatcgcagctttgcccagttttcccaggaaattggccttgcctctctgggtgcacctgatgaatacattgaaaagctcgccacaatttactggtttactgtggagtttgggctctgcaaacaaggagactccataaaggcatatggtgctgggctcctgtcatcctttggtgaattacagtactgcttatcagagaagccaaagcttctccccctggagctggagaagacagccatccaaaattacactgtcacggagttccagcccctgtattacgtggcagagagttttaatgatgccaaggagaaagtaaggaactttgctgccacaatacctcggcccttctcagttcgctacgacccatacacccaaaggattgaggtcttggacaatacccagcagcttaagattttggctgattccattaacagtgaaattggaatcctttgcagtgccctccagaaaataaagtaaagccatggacagaatgtggtctgtcagctgtgaatctgttgatggagatccaactatttctttcatcagaaaaagtccgaaaagcaaaccttaatttgaaataacagccttaaatcctttacaagatggagaaacaacaaataagtcaaaataatctgaaatgacaggatatgagtacatactcaagagcataatggtaaatcttttggggtcatctttgatttagagatgataatcccatactctcaattgagttaaatcagtaatctgtcgcatttcatcaagattaattaaaatttgggacctgcttcattcaagcttcatatatgctttgcagagaactcataaaggagcatataaggctaaatgtaaaacacaagactgtcattagaattgaattattgggcttaatataaatcgtaacctatgaagtttattttctattttagttaactatgattccaattactactttgttattgtacctaagtaaattttctttaagtcagaagcccattaaaatagttacaagcattgaacttctttagtattatattaatataaaaacatttttgtatgttttattgtaatcataaatactgctgtataaggtaataaaactctgcacctaatccccataacttccagtatcattttccaattaattatcaagtctgttttgggaaacactttgaggacatttatgatgcagcagatgttgactaaaggcttggttggtagatattcaggaaatgttcactgaataaataagtaaatacattattgaaaagcaaatctgtataaatgtgaaatttttatttgtattagtaataaaacattagtagtttaaacaa

SEQ ID NO: 355942 - DNA, 2639 bp, Homo sapiens
cagctgggggtaaggggggcggattattcatataattgttataccagacggtcgcaggcttagtccaattgcagagaactcgcttcccaggcttctgagagtcccggaagtgcctaaacctgtctaatcgacggggcttgggtggcccgtcgctccctggcttcttccctttacccagggcgggcagcgaagtggtgcctcctgcgtcccccacaccctccctcagcccctcccctccggcccgtcctgggcaggtgacctggagcatccggcaggctgccctggcctcctgcgtcaggacaagcccacgaggggcgttactgtgcggagatgcaccacgcaagagacaccctttgtaactctcttctcctccctagtgcgaggttaaaaccttcagccccacgtgctgtttgcaaacctgcctgtacctgaggccctaaaaagccagagacctcactcccggggagccagcatgtccactgcggtcctggaaaacccaggcttgggcaggaaactctctgactttggacaggaaacaagctatattgaagacaactgcaatcaaaatggtgccatatcactgatcttctcactcaaagaagaagttggtgcattggccaaagtattgcgcttatttgaggagaatgatgtaaacctgacccacattgaatctagaccttctcgtttaaagaaagatgagtatgaatttttcacccatttggataaacgtagcctgcctgctctgacaaacatcatcaagatcttgaggcatgacattggtgccactgtccatgagctttcacgagataagaagaaagacacagtgccctggttcccaagaaccattcaagagctggacagatttgccaatcagattctcagctatggagcggaactggatgctgaccaccctggttttaaagatcctgtgtaccgtgcaagacggaagcagtttgctgacattgcctacaactaccgccatgggcagcccatccctcgagtggaatacatggaggaagaaaagaaaacatggggcacagtgttcaagactctgaagtccttgtataaaagtactgtggcttccatgaagataacattccccagctggaagacgtttctcagttcctgcagacttgcactggtttccgcctccgacctgtagctggcctgctttcctctcgggatttcttgggtggcctggccttccgagtcttccactgcacacagtacatcagacatggatccaagcccatgtatacccccgaacctgacatctgccatgagctgttgggacatgtgcccttgttttcagatcgcagctttgcccagttttcccaggaaattggccttgcctctctgggtgcacctgatgaatacattgaaaagctcgccacaatttactggtttactgtggagtttgggctctgcaaacaaggagactccataaaggcatatggtgctgggctcctgtcatcctttggtgaattacagtactgcttatcagagaagccaaagcttctccccctggagctggagaagacagccatccaaaattacactgtcacggagttccagcccctgtattacgtggcagagagttttaatgatgccaaggagaaagtaaggaactttgctgccacaatacctcggcccttctcagttcgctacgacccatacacccaaaggattgaggtcttggacaatacccagcagcttaagattttggctgattccattaacagtgaaattggaatcctttgcagtgccctccagaaaataaagtaaagccatggacagaatgtggtctgtcagctgtgaatctgttgatggagatccaactatttctttcatcagaaaaagtccgaaaagcaaaccttaatttgaaataacagccttaaatcctttacaagatggagaaacaacaaataagtcaaaataatctgaaatgacaggatatgagtacatactcaagagcataatggtaaatcttttggggtcatctttgatttagagatgataatcccatactctcaattgagttaaatcagtaatctgtcgcatttcatcaagattaattaaaatttgggacctgcttcattcaagcttcatatatgctttgcagagaactcataaaggagcatataaggctaaatgtaaaacacaagactgtcattagaattgaattattgggcttaatataaatcgtaacctatgaagtttattttctattttagttaactatgattccaattactactttgttattgtacctaagtaaattttctttaagtcagaagcccattaaaatagttacaagcattgaacttctttagtattatattaatataaaaacatttttgtatgttttattgtaatcataaatactgctgtataaggtaataaaactctgcacctaatccccataacttccagtatcattttccaattaattatcaagtctgttttgggaaacactttgaggacatttatgatgcagcagatgttgactaaaggcttggttggtagatattcaggaaatgttcactgaataaataagtaaatacattattgaaaagcaaatctgtataaatgtgaaatttttatttgtattagtaataaaacattagtagtttaaacaa

SEQ ID NO: 355943 - DNA, 2926 bp, Homo sapiens
cagctgggggtaaggggggcggattattcatataattgttataccagacggtcgcaggcttagtccaattgcagagaactcgcttcccaggcttctgagagtcccggaagtgcctaaacctgtctaatcgacggggcttgggtggcccgtcgctccctggcttcttccctttacccagggcgggcagcgaagtggtgcctcctgcgtcccccacaccctccctcagcccctcccctccggcccgtcctgggcaggtgacctggagcatccggcaggctgccctggcctcctgcgtcaggacaagcccacgaggggcgttactgtgcggagatgcaccacgcaagagacaccctttgtaactctcttctcctccctagtgcgaggttaaaaccttcagccccacgtgctgtttgcaaacctgcctgtacctgaggccctaaaaagccagagacctcactcccggggagccagcatgtccactgcggtcctggaaaacccaggcttgggcaggaaactctctgactttggacaggaaacaagctatattgaagacaactgcaatcaaaatggtgccatatcactgatcttctcactcaaagaagaagttggtgcattggccaaagtattgcgcttatttgaggagaatgatgtaaacctgacccacattgaatctagaccttctcgtttaaagaaagatgagtatgaatttttcacccatttggataaacgtagcctgcctgctctgacaaacatcatcaagatcttgaggcatgacattggtgccactgtccatgagctttcacgagataagaagaaagacacagtgccctggttcccaagaaccattcaagagctggacagatttgccaatcagattctcagctatggagcggaactggatgctgaccaccctggttttaaagatcctgtgtaccgtgcaagacggaagcagtttgctgacattgcctacaactaccgccatgggcagcccatccctcgagtggaatacatggaggaagaaaagaaaacatggggcacagtgttcaagactctgaagtccttgtataaaacccatgcttgctatgagtacaatcacatttttccacttcttgaaaagtactgtggcttccatgaagataacattccccagctggaagacgtttctcagttcctgcagacttgcactggtttccgcctccgacctgtagctggcctgctttcctctcgggatttcttgggtggcctggccttccgagtcttccactgcacacagtacatcagacatggatccaagcccatgtatacccccgaacctgacatctgccatgagctgttgggacatgtgcccttgttttcagatcgcagctttgcccagttttcccaggaaattggccttgcctctctgggtgcacctgatgaatacattgaaaagctcgccacaatttactggtttactgtggagtttgggctctgcaaacaaggagactccataaaggcatatggtgctgggctcctgtcatcctttggtgaattacagtactgcttatcagagaagccaaagcttctccccctggagctggagaagacagccatccaaaattacactgtcacggagttccagcccctgtattacgtggcagagagttttaatgatgccaaggagaaagtaaggaactttgctgccacaatacctcggcccttctcagttcgctacgacccatacacccaaaggattgaggtcttggacaatacccagcagcttaagattttggctgattccattaacagtgaaattggaatcctttgcagtgccctccagaaaataaagtaaagccatggacagaatgtggtctgtcagctgtgaatctgttgatggagatccaactatttctttcatcagaaaaagtccgaaaagcaaaccttaatttgaaataacagccttaaatcctttacaagatggagaaacaacaaataagtcaaaataatctgaaatgacaggatatgagtacatactcaagagcataatggtaaatcttttggggtcatctttgatttagagatgataatcccatactctcaattgagttaaatcagtaatctgtcgcatttcatcaagattaattaaaatttgggacctgcttcattcaagcttcatatatgctttgcagagaactcataaaggagcatataaggctaaatgtaaaacacaagactgtcattagaattgaattattgggcttaatataaatcgtaacctatgaagtttattttctattttagttaactatgattccaattactactttgttattgtacctaagtaaattttctttaagtcagaagcccattaaaatagttacaagcattgaacttctttagtattatattaatataaaaacatttttgtatgttttattgtaatcataaatactgctgtataaggtaataaaactctgcacctaatccccataacttccagtatcattttccaattaattatcaagtctgttttgggaaacactttgaggacatttatgatgcagcagatgttgactaaaggcttggttggtagatattcaggaaatgttcactgaataaataagtaaatacattattgaaaagcaaatctgtataaatgtgaaatttttatttgtattagtaataaaacattagtagtttaaacaaaaaaaaaaaaaaaaaaaaaaaaaaaaaaaaagttaaagacaacacccgaaccaataacgcatgatactaacacctttagggggtccacgcgcctctaatttgacctacaatgatcaaaatatgcgggcgtggagcgggcttcccctggagagccgttataactcaggtggcccgctcaatgggtgcaggaaccaacggactctccttgagttcggattatgtatgcggacatctcttttgg

SEQ ID NO: 355944 - DNA, 2605 bp, Homo sapiens
cagctgggggtaaggggggcggattattcatataattgttataccagacggtcgcaggcttagtccaattgcagagaactcgcttcccaggcttctgagagtcccggaagtgcctaaacctgtctaatcgacggggcttgggtggcccgtcgctccctggcttcttccctttacccagggcgggcagcgaagtggtgcctcctgcgtcccccacaccctccctcagcccctcccctccggcccgtcctgggcaggtgacctggagcatccggcaggctgccctggcctcctgcgtcaggacaagcccacgaggggcgttactgtgcggagatgcaccacgcaagagacaccctttgtaactctcttctcctccctagtgcgaggttaaaaccttcagccccacgtgctgtttgcaaacctgcctgtacctgaggccctaaaaagccagagacctcactcccggggagccagcatgtccactgcggtcctggaaaacccaggcttgggcaggaaactctctgactttggacaggaaacaagctatattgaagacaactgcaatcccaaagtattgcgcttatttgaggagaatgatgtaaacctgacccacattgaatctagaccttctcgtttaaagaaagatgagtatgaatttttcacccatttggataaacgtagcctgcctgctctgacaaacatcatcaagatcttgaggcatgacattggtgccactgtccatgagctttcacgagataagaagaaccattcaagagctggacagatttgccaatcagattctcagctatggagcggaactggatgctgaccaccctggttttaaagatcctgtgtaccgtgcaagacggaagcagtttgctgacattgcctacaactaccgccatgggcagcccatccctcgagtggaatacatggaggaagaaaagaaaacatggggcacagtgttcaagactctgaagtccttgtataaaacccatgcttgctatgagtacaatcacatttttccacttcttgaaaagtactgtggcttccatgaagataacattccccagctggaagacgtttctcagttcctgcagacttgcactggtttccgcctccgacctgtagctggcctgctttcctctcgggatttcttgggtggcctggccttccgagtcttccactgcacacagtacatcagacatggatccaagcccatgtatacccccgaacctgacatctgccatgagctgttgggacatgtgcccttgttttcagatcgcagctttgcccagttttcccaggaaattggccttgcctctctgggtgcacctgatgaatacattgaaaagctcgccacaatttactggtttactgtggagtttgggctctgcaaacaaggagactccataaaggcatatggtgctgggctcctgtcatcctttggtgaattacagtactgcttatcagagaagccaaagcttctccccctggagctggagaagacagccatccaaaattacactgtcacggagttccagcccctgtattacgtggcagagagttttaatgatgccaaggagaaagtaaggaactttgctgccacaatacctcggcccttctcagttcgctacgacccatacacccaaaggattgaggtcttggacaatacccagcagcttaagattttggctgattccattaacagtgaaattggaatcctttgcagtgccctccagaaaataaagtaaagccatggacagaatgtggtctgtcagctgtgaatctgttgatggagatccaactatttctttcatcagaaaaagtccgaaaagcaaaccttaatttgaaataacagccttaaatcctttacaagatggagaaacaacaaataagtcaaaataatctgaaatgacaggatatgagtacatactcaagagcataatggtaaatcttttggggtcatctttgatttagagatgataatcccatactctcaattgagttaaatcagtaatctgtcgcatttcatcaagattaattaaaatttgggacctgcttcattcaagcttcatatatgctttgcagagaactcataaaggagcatataaggctaaatgtaaaacacaagactgtcattagaattgaattattgggcttaatataaatcgtaacctatgaagtttattttctattttagttaactatgattccaattactactttgttattgtacctaagtaaattttctttaagtcagaagcccattaaaatagttacaagcattgaacttctttagtattatattaatataaaaacatttttgtatgttttattgtaatcataaatactgctgtataaggtaataaaactctgcacctaatccccataacttccagtatcattttccaattaattatcaagtctgttttgggaaacactttgaggacatttatgatgcagcagatgttgactaaaggcttggttggtagatattcaggaaatgttcactgaataaataagtaaatacattattgaaaagcaaatctgtataaatgtgaaatttttatttgtattagtaataaaacattagtagtttaaacaa

SEQ ID NO: 355945 - DNA, 2775 bp, Homo sapiens
tgtgggggcaatgagccagggaaattacttggcaggaagggaagttgtagccaggacagtttgggggtgagttagatgaccttttgggtcccttccattagaaagtctttgcttcttagataaagaagggagtaagggtccaagcagagtgtgcttcagcctgaagacacagagaacatgggggcaagaggcaaggggatctcaaagacttctttagctaattacttccattgccatggccaataataagaataataaaacagtaatactagcagttgggaagctacataatagtaattaagagaacagactttgaagctagactgcctgtggctgtgaccttgaataaaacctttaacctatctctgtctcagctttcccatcggtaaagtgggcataataaaagtgtctacttcatagggctattgtggggattagtagcatatctaaagtagcttaaaacagtgtcttacatacagtaggtcaaatatagtgttagctattattaccattatcactgtcactatccttatcctccaaagtttgcaacaaactgagagacagatacaggaaccatagagatggtgatcagaggtcagctttaatattttaccccttaattaggtaaacttacctgccaattcatagagcatagtccattgcatggccaagagcagactggaatgaggtcctctgtgaacaatcaagagagaaagagcagtacagaaagagttaaattgacaatattcatattctcttcccaaatgctccagtcagacaggtcactgctacttatggggtagactgtgtgaggtgcagtacagaagctggaagcactctatccatactcttcccttctgggaaatgaggttcaaattccctcttcactctagaagcaggagaagtagggaatcattgttccaccctaacaaatggtaatgaaagctaaatttattgcatgtttccaatgtgctaggctctgtgctaagtactttgtattcattagctctttttattcttggaacatttctaagaagtatctatccacattatgcagatgaggaaactgaggctcagaaatgggaatttacttgatccagatcacctagctagaaagcagcgaggcagacatctgaagccaagtctgcctagcgtcaaagcctatgtccctgggcagttatgtgtactactccactacctaaaggtctcctagtgcctctgactcagtggtgatgagctttgagttttctttcttcttttcatcccagcttgcactggtttccgcctccgacctgtagctggcctgctttcctctcgggatttcttgggtggcctggccttccgagtcttccactgcacacagtacatcagacatggatccaagcccatgtatacccccgaacctgacatctgccatgagctgttgggacatgtgcccttgttttcagatcgcagctttgcccagttttcccaggaaattggccttgcctctctgggtgcacctgatgaatacattgaaaagctcgccacaatttactggtttactgtggagtttgggctctgcaaacaaggagactccataaaggcatatggtgctgggctcctgtcatcctttggtgaattacagtactgcttatcagagaagccaaagcttctccccctggagctggagaagacagccatccaaaattacactgtcacggagttccagcccctgtattacgtggcagagagttttaatgatgccaaggagaaagtaaggaactttgctgccacaatacctcggcccttctcagttcgctacgacccatacacccaaaggattgaggtcttggacaatacccagcagcttaagattttggctgattccattaacagtgaaattggaatcctttgcagtgccctccagaaaataaagtaaagccatggacagaatgtggtctgtcagctgtgaatctgttgatggagatccaactatttctttcatcagaaaaagtccgaaaagcaaaccttaatttgaaataacagccttaaatcctttacaagatggagaaacaacaaataagtcaaaataatctgaaatgacaggatatgagtacatactcaagagcataatggtaaatcttttggggtcatctttgatttagagatgataatcccatactctcaattgagttaaatcagtaatctgtcgcatttcatcaagattaattaaaatttgggacctgcttcattcaagcttcatatatgctttgcagagaactcataaaggagcatataaggctaaatgtaaaacacaagactgtcattagaattgaattattgggcttaatataaatcgtaacctatgaagtttattttctattttagttaactatgattccaattactactttgttattgtacctaagtaaattttctttaagtcagaagcccattaaaatagttacaagcattgaacttctttagtattatattaatataaaaacatttttgtatgttttattgtaatcataaatactgctgtataaggtaataaaactctgcacctaatccccataacttccagtatcattttccaattaattatcaagtctgttttgggaaacactttgaggacatttatgatgcagcagatgttgactaaaggcttggttggtagatattcaggaaatgttcactgaataaataagtaaatacattattgaaaagcaaatctgtataaatgtgaaatttttatttgtattagtaataaaacattagtagtttaaacaa

SEQ ID NO: 355946 - DNA, 2829 bp, Homo sapiens
tgtgggggcaatgagccagggaaattacttggcaggaagggaagttgtagccaggacagtttgggggtgagttagatgaccttttgggtcccttccattagaaagtctttgcttcttagataaagaagggagtaagggtccaagcagagtgtgcttcagcctgaagacacagagaacatgggggcaagaggcaaggggatctcaaagacttctttagctaattacttccattgccatggccaataataagaataataaaacagtaatactagcagttgggaagctacataatagtaattaagagaacagactttgaagctagactgcctgtggctgtgaccttgaataaaacctttaacctatctctgtctcagctttcccatcggtaaagtgggcataataaaagtgtctacttcatagggctattgtggggattagtagcatatctaaagtagcttaaaacagtgtcttacatacagtaggtcaaatatagtgttagctattattaccattatcactgtcactatccttatcctccaaagtttgcaacaaactgagagacagatacaggaaccatagagatggtgatcagaggtcagctttaaaattgagcgatttagagaatgtgatatagatatgcacacaaatggacttgctaatattttaccccttaattaggtaaacttacctgccaattcatagagcatagtccattgcatggccaagagcagactggaatgaggtcctctgtgaacaatcaagagagaaagagcagtacagaaagagttaaattgacaatattcatattctcttcccaaatgctccagtcagacaggtcactgctacttatggggtagactgtgtgaggtgcagtacagaagctggaagcactctatccatactcttcccttctgggaaatgaggttcaaattccctcttcactctagaagcaggagaagtagggaatcattgttccaccctaacaaatggtaatgaaagctaaatttattgcatgtttccaatgtgctaggctctgtgctaagtactttgtattcattagctctttttattcttggaacatttctaagaagtatctatccacattatgcagatgaggaaactgaggctcagaaatgggaatttacttgatccagatcacctagctagaaagcagcgaggcagacatctgaagccaagtctgcctagcgtcaaagcctatgtccctgggcagttatgtgtactactccactacctaaaggtctcctagtgcctctgactcagtggtgatgagctttgagttttctttcttcttttcatcccagcttgcactggtttccgcctccgacctgtagctggcctgctttcctctcgggatttcttgggtggcctggccttccgagtcttccactgcacacagtacatcagacatggatccaagcccatgtatacccccgaacctgacatctgccatgagctgttgggacatgtgcccttgttttcagatcgcagctttgcccagttttcccaggaaattggccttgcctctctgggtgcacctgatgaatacattgaaaagctcgccacaatttactggtttactgtggagtttgggctctgcaaacaaggagactccataaaggcatatggtgctgggctcctgtcatcctttggtgaattacagtactgcttatcagagaagccaaagcttctccccctggagctggagaagacagccatccaaaattacactgtcacggagttccagcccctgtattacgtggcagagagttttaatgatgccaaggagaaagtaaggaactttgctgccacaatacctcggcccttctcagttcgctacgacccatacacccaaaggattgaggtcttggacaatacccagcagcttaagattttggctgattccattaacagtgaaattggaatcctttgcagtgccctccagaaaataaagtaaagccatggacagaatgtggtctgtcagctgtgaatctgttgatggagatccaactatttctttcatcagaaaaagtccgaaaagcaaaccttaatttgaaataacagccttaaatcctttacaagatggagaaacaacaaataagtcaaaataatctgaaatgacaggatatgagtacatactcaagagcataatggtaaatcttttggggtcatctttgatttagagatgataatcccatactctcaattgagttaaatcagtaatctgtcgcatttcatcaagattaattaaaatttgggacctgcttcattcaagcttcatatatgctttgcagagaactcataaaggagcatataaggctaaatgtaaaacacaagactgtcattagaattgaattattgggcttaatataaatcgtaacctatgaagtttattttctattttagttaactatgattccaattactactttgttattgtacctaagtaaattttctttaagtcagaagcccattaaaatagttacaagcattgaacttctttagtattatattaatataaaaacatttttgtatgttttattgtaatcataaatactgctgtataaggtaataaaactctgcacctaatccccataacttccagtatcattttccaattaattatcaagtctgttttgggaaacactttgaggacatttatgatgcagcagatgttgactaaaggcttggttggtagatattcaggaaatgttcactgaataaataagtaaatacattattgaaaagcaaatctgtataaatgtgaaatttttatttgtattagtaataaaacattagtagtttaaacaa

SEQ ID NO: 355947 - DNA, 2551 bp, Homo sapiens
  misc_feature (2420)..(2420): n is a, c, g, or t
  misc_feature (2423)..(2424): n is a, c, g, or t
  misc_feature (2428)..(2429): n is a, c, g, or t
  misc_feature (2434)..(2434): n is a, c, g, or t
  misc_feature (2454)..(2454): n is a, c, g, or t
  misc_feature (2461)..(2461): n is a, c, g, or t
  misc_feature (2466)..(2466): n is a, c, g, or t
  misc_feature (2469)..(2469): n is a, c, g, or t
  misc_feature (2483)..(2483): n is a, c, g, or t
  misc_feature (2486)..(2486): n is a, c, g, or t
  misc_feature (2488)..(2488): n is a, c, g, or t
  misc_feature (2505)..(2505): n is a, c, g, or t
  misc_feature (2509)..(2509): n is a, c, g, or t
cagctgggggtaaggggggcggattattcatataattgttataccagacggtcgcaggcttagtccaattgcagagaactcgcttcccaggcttctgagagtcccggaagtgcctaaacctgtctaatcgacggggcttgggtggcccgtcgctccctggcttcttccctttacccagggcgggcagcgaagtggtgcctcctgcgtcccccacaccctccctcagcccctcccctccggcccgtcctgggcaggtgacctggagcatccggcaggctgccctggcctcctgcgtcaggacaagcccacgaggggcgttactgtgcggagatgcaccacgcaagagacaccctttgtaactctcttctcctccctagtgcgaggttaaaaccttcagccccacgtgctgtttgcaaacctgcctgtacctgaggccctaaaaagccagagacctcactcccggggagccagcatgtccactgcggtcctggaaaacccaggcttgggcaggaaactctctgactttggacaggaaacaagctatattgaagacaactgcaatcaaaatggtgccatatcactgatcttctcactcaaagaagaagttggtgcattggccaaagtattgcgcttatttgaggagaatgatgtaaacctgacccacattgaatctagaccttctcgtttaaagaaagatgagtatgaatttttcacccatttggataaacgtagcctgcctgctctgacaaacatcatcaagatcttgaggcatgacattggtgccactgtccatgagctttcacgagataagaagaaagacacagtgccctggttcccaagaaccattcaagagctggacagatttgccaatcagattctcagctatggagcggaactggatgctgaccaccctggttttaaagatcctgtgtaccgtgcaagacggaagcagtttgctgacattgcctacaactaccgccatgggcagcccatccctcgagtggaatacatggaggaagaaaagaaaacatggggcacagtgttcaagactctgaagtccttgtataaaacccatgcttgctatgagtacaatcacatttttccacttcttgaaaagtactgtggcttccatgaagataacattccccagctggaagacgtttctcagttcctgcagacttgcactggtttccgcctccgacctgtagctggcctgctttcctctcgggatttcttgggtggcctggccttccgagtcttccactgcacacagtacatcagacatggatccaagcccatgtatacccccgaacctgacatctgccatgagctgttgggacatgtgcccttgttttcagatcgcagctttgcccagttttcccaggaaattggccttgcctctctgggtgcacctgatgaatacattgaaaagctcgccacaatttactggtttactgtggagtttgggctctgcaaacaaggagactccataaaggcatatggtgctgggctcctgtcatcctttggtgaattacagtactgcttatcagagaagccaaagcttctccccctggagctggagaagacagccatccaaaattacactgtcacggagttccagcccctgtattacgtggcagagagttttaatgatgccaaggagaaagtaaggaactttgctgccacaatacctcggcccttctcagttcgctacgacccatacacccaaaggattgaggtcttggacaatacccagcagcttaagattttggctgattccattaacagtgaaattggaatcctttgcagtgccctccagaaaataaagtaaagccatggacagaatgtggtctgtcagctgtgaatctgttgatggagatccaactatttctttcatcagaaaaagtccgaaaagcaaaccttaatttgaaataacagccttaaatcctttacaagatggagaaacaacaaataagtcaaaataatctgaaatgacaggatatgagtacatactcaagagcataatggtaaatcttttggggtcatctttgatttagagatgataatcccatactctcaattgagttaaatcagtaatctgtcgcatttcatcaagattaattaaaatttgggacctgcttcattcaagcttcatatatgctttgcagagaactcataaaggagcatataaggctaaatgtaaaacacaagactgtcattagaattgaattattgggcttaatataaatcgtaacctatgaagtttattttctattttagttaactatgattccaattactactttgttattgtacctaagtaaattttctttaagtcagaagcccattaaaatagttacaagcattgaacttctttagtattatattaatatctattcaaaaccatttcgtatgtctantgnnatcnntaatnctggtgtataaggtataaantctgacntaatnccnataattcagtatcnttncnattaatatcaagtctgntggngaaaaccttgagggacttatgatggcggcgatttcgactaag

SEQ ID NO: 355948 - DNA, 2631 bp, Homo sapiens
cagctgggggtaaggggggcggattattcatataattgttataccagacggtcgcaggcttagtccaattgcagagaactcgcttcccaggcttctgagagtcccggaagtgcctaaacctgtctaatcgacggggcttgggtggcccgtcgctccctggcttcttccctttacccagggcgggcagcgaagtggtgcctcctgcgtcccccacaccctccctcagcccctcccctccggcccgtcctgggcaggtgacctggagcatccggcaggctgccctggcctcctgcgtcaggacaagcccacgaggggcgttactgtgcggagatgcaccacgcaagagacaccctttgtaactctcttctcctccctagtgcgaggttaaaaccttcagccccacgtgctgtttgcaaacctgcctgtacctgaggccctaaaaagccagagacctcactcccggggagccagcatgtccactgcggtcctggaaaacccaggcttgggcaggaaactctctgactttggacaggaaacaagctatattgaagacaactgcaatcaaaatggtgccatatcactgatcttctcactcaaagaagaagttggtgcattggccaaagtattgcgcttatttgaggagaatgatgtaaacctgacccacattgaatctagaccttctcgtttaaagaaagatgagtatgaatttttcacccatttggataaacgtagcctgcctgctctgacaaacatcatcaagatcttgaggcatgacattggtgccactgtccatgagctttcacgagataagaagaaagacacagtgccctggttcccaagaaccattcaagagctggacagatttgccaatcagattctcagctatggagcggaactggatgctgaccaccctggttttaaagatcctgtgtaccgtgcaagacggaagcagtttgctgacattgcctacaactaccgccatgggcagcccatccctcgagtggaatacatggaggaagaaaagaaaacatggggcacagtgttcaagactctgaagtccttgtataaaacccatgcttgctatgagtacaatcacatttttccacttcttgaaaagtactgtggcttccatgaagataacattccccagctggaagacgtttctcagttcctgcagacttgcactggtttccgcctccgacctgtagctggcctgctttcctctcgggatttcttgggtggcctggccttccgagtcttccactgcacacagtacatcagacatggatccaagcccatgtatacccccgaacctgacatctgccatgagctgttgggacatgtgcccttgttttcagatcgcagctttgcccagttttcccaggaaattggccttgcctctctgggtgcacctgatgaatacattgaaaagctcgccacaatttactggtttactgtggagtttgggctctgcaaacaaggagactccataaaggcatatggtgctgggctcctgtcatcctttggtgaattacagtactgcttatcagagaagccaaagcttctccccctggagctggagaagacagccatccaaaattacactgtcacggagttccagcccctgtattacgtggcagagagttttaatgatgccaaggagaaagtaaggaactttgctgccacaatacctcggcccttctcagttcgctacgacccatacacccaaaggattgaggtcttggacaatacccagcagcttaagattttggctgattccattaacagtgaaattggaatcctttgcagtgccctccagaaaataaagtaaagccatggacagaatgtggtctgtcagctgtgaatctgttgatggagatccaactatttctttcatcagaaaaagtccgaaaagcaaaccttaatttgaaataacagccttaaatcctttacaagatggagaaacaacaaataagtcaaaataatctgaaatgacaggatatgagtacatactcaagagcataatggtaaatcttttggggtcatctttgatttagagatgataatcccatactctcaattgagttaaatcagtaatctgtcgcatttcatcaagattaattaaaggagcatataaggctaaatgtaaaacacaagactgtcattagaattgaattattgggcttaatataaatcgtaacctatgaagtttattttctattttagttaactatgattccaattactactttgttattgtacctaagtaaattttctttaagtcagaagcccattaaaatagttacaagcattgaacttctttagtattatattaatataaaaacatttttgtatgttttattgtaatcataaatactgctgtataaggtaataaaactctgcacctaatccccataacttccagtatcattttccaattaattatcaagtctgttttgggaaacactttgaggacatttatgatgcagcagatgttgactaaaggcttggttggtagatattcaggaaatgttcactgaataaataagtaaatacattattgaaaagcaaatctgtataaatgtgaaatttttatttgtattagtaataaaacattagtagtttaaacaa

SEQ ID NO: 355949 - DNA, 1875 bp, Homo sapiens
ggacatagcacatacagtgttaaataaatgtaggttttcttccctcactgctgtccacctccagactaacagaagagcagcactgtttttgttttagttcccagtggaatagctgagcatattgtatctgcccagggaagtcaataccagggagaagacaggatgagaagtgttcatgactcatagctcacttaggtatatgggagcatgtccacaggaatattagctcttctgcctggtaccccactggggatactcttaagacccttggctgctgtgccctaccctgcacctgtctcttatttttccttccttttcttctttttaccttgtaccctgccttttatgatcccaacctctgcatatcacttattcctgggagagggatcataagcctaaaagagttatttccattctttctgcccattcctcatgtagaaagactgagtctggcttggcttaaacctcctcccctccgagctctctgtgctttctgtctttcagtgacatctgccatgagctgttgggacatgtgcccttgttttcagatcgcagctttgcccagttttcccaggaaattggccttgcctctctgggtgcacctgatgaatacattgaaaagctcgccacaatttactggtttactgtggagtttgggctctgcaaacaaggagactccataaaggcatatggtgctgggctcctgtcatcctttggtgaattacagtactgcttatcagagaagccaaagcttctccccctggagctggagaagacagccatccaaaattacactgtcacggagttccagcccctgtattacgtggcagagagttttaatgatgccaaggagaaagtaaggaactttgctgccacaatacctcggcccttctcagttcgctacgacccatacacccaaaggattgaggtcttggacaatacccagcagcttaagattttggctgattccattaacagtgaaattggaatcctttgcagtgccctccagaaaataaagtaaagccatggacagaatgtggtctgtcagctgtgaatctgttgatggagatccaactatttctttcatcagaaaaagtccgaaaagcaaaccttaatttgaaataacagccttaaatcctttacaagatggagaaacaacaaataagtcaaaataatctgaaatgacaggatatgagtacatactcaagagcataatggtaaatcttttggggtcatctttgatttagagatgataatcccatactctcaattgagttaaatcagtaatctgtcgcatttcatcaagattaattaaaatttgggacctgcttcattcaagcttcatatatgctttgcagagaactcataaaggagcatataaggctaaatgtaaaacacaagactgtcattagaattgaattattgggcttaatataaatcgtaacctatgaagtttattttctattttagttaactatgattccaattactactttgttattgtacctaagtaaattttctttaagtcagaagcccattaaaatagttacaagcattgaacttctttagtattatattaatataaaaacatttttgtatgttttattgtaatcataaatactgctgtataaggtaataaaactctgcacctaatccccataacttccagtatcattttccaattaattatcaagtctgttttgggaaacactttgaggacatttatgatgcagcagatgttgactaaaggcttggttggtagatattcaggaaatgttcactgaataaataagtaaatacattattgaaaagcaaatctgtataaatgtgaaatttttatttgtattagtaataaaacattagtagtttaaacaa

SEQ ID NO: 355950 - DNA, 2721 bp, Homo sapiens
tgtgggggcaatgagccagggaaattacttggcaggaagggaagttgtagccaggacagtttgggggtgagttagatgaccttttgggtcccttccattagaaagtctttgcttcttagataaagaagggagtaagggtccaagcagagtgtgcttcagcctgaagacacagagaacatgggggcaagaggcaaggggatctcaaagacttctttagctaattacttccattgccatggccaataataagaataataaaacagtaatactagcagttgggaagctacataatagtaattaagagaacagactttgaagctagactgcctgtggctgtgaccttgaataaaacctttaacctatctctgtctcagctttcccatcggtaaagtgggcataataaaagtgtctacttcatagggctattgtggggattagtagcatatctaaagtagcttaaaacagtgtcttacatacagtaggtcaaatatagtgttagctattattaccattatcactgtcactatccttatcctccaaagtttgcaacaaactgagagacagatacaggaaccatagagatggtgatcagaggtcagctttaatattttaccccttaattaggtaaacttacctgccaattcatagagcatagtccattgcatggccaagagcagactggaatgaggtcctctgtgaacaatcaagagagaaagagcagtacagaaagagttaaattgacaatattcatattctcttcccaaatgctccagtcagacaggtcactgctacttatggggtagactgtgtgaggtgcagtacagaagctggaagcactctatccatactcttcccttctgggaaatgaggttcaaattccctcttcactctagaagcaggagaagtagggaatcattgttccaccctaacaaatggtaatgaaagctaaatttattgcatgtttccaatgtgctaggctctgtgctaagtactttgtattcattagctctttttattcttggaacatttctaagaagtatctatccacattatgcagatgaggaaactgaggctcagaaatgggaatttacttgatccagatcacctagctagaaagcagcgaggcagacatctgaagccaagtctgcctagcgtcaaagcctatgtccctgggcagttatgtgtactactccactacctaaaggtctcctagtgcctctgactcagtggtgatgagctttgagttttctttcttcttttcatcccagcttgcactggtttccgcctccgacctgtagctggcctgctttcctctcgggatttcttgggtggcctggccttccgagtcttccactgcacacagtacatcagacatggatccaagcccatgtatacccccgaacctgacatctgccatgagctgttgggacatgtgcccttgttttcagatcgcagctttgcccagttttcccaggaaattggccttgcctctctgggtgcacctgatgaatacattgaaaagctcgccacaatttactggtttactgtggagtttgggctctgcaaacaaggagactccataaaggcatatggtgctgggctcctgtcatcctttggtgaattacagtactgcttatcagagaagccaaagcttctccccctggagctggagaagacagccatccatgatgccaaggagaaagtaaggaactttgctgccacaatacctcggcccttctcagttcgctacgacccatacacccaaaggattgaggtcttggacaatacccagcagcttaagattttggctgattccattaacagtgaaattggaatcctttgcagtgccctccagaaaataaagtaaagccatggacagaatgtggtctgtcagctgtgaatctgttgatggagatccaactatttctttcatcagaaaaagtccgaaaagcaaaccttaatttgaaataacagccttaaatcctttacaagatggagaaacaacaaataagtcaaaataatctgaaatgacaggatatgagtacatactcaagagcataatggtaaatcttttggggtcatctttgatttagagatgataatcccatactctcaattgagttaaatcagtaatctgtcgcatttcatcaagattaattaaaatttgggacctgcttcattcaagcttcatatatgctttgcagagaactcataaaggagcatataaggctaaatgtaaaacacaagactgtcattagaattgaattattgggcttaatataaatcgtaacctatgaagtttattttctattttagttaactatgattccaattactactttgttattgtacctaagtaaattttctttaagtcagaagcccattaaaatagttacaagcattgaacttctttagtattatattaatataaaaacatttttgtatgttttattgtaatcataaatactgctgtataaggtaataaaactctgcacctaatccccataacttccagtatcattttccaattaattatcaagtctgttttgggaaacactttgaggacatttatgatgcagcagatgttgactaaaggcttggttggtagatattcaggaaatgttcactgaataaataagtaaatacattattgaaaagcaaatctgtataaatgtgaaatttttatttgtattagtaataaaacattagtagtttaaacaa

SEQ ID NO: 355951 - DNA, 1903 bp, Homo sapiens
ctaaaactcacaagatgtctttactgattttatacactgcctggcacatcaaatgaacttaataaatattttgagagtgaattaatatatacagtaggaaagacacatacacacaaggcaggctgcagtaagtgctgttaatctatgatgtgttagactctccagctatatatatgcctggaccgatgtcaccacttatctgcagttctcctgtgatgtttccagggtacatgattaagactcatttaacattccaggaatattctgctgatgaataatcactgagctggagtcaagagaagaagctttagatactaaccgaccctgtgatcatgagcaagtcacttcccttctctgtgcctcaatttcctcacttataaagtgaaaacaaagggccaagtgagggtggaaggatccccctaccctggagatctgtgattctataacatatgggcaggaaagacttgataacacactcagggtctatgtgggctgttctgaaggcatctggccacccatcacctttttatggccaagtactaggttggttctgtggttccaattacaggaacagaacaggttctattttcccccaattacaggaaattggccttgcctctctgggtgcacctgatgaatacattgaaaagctcgccacaatttactggtttactgtggagtttgggctctgcaaacaaggagactccataaaggcatatggtgctgggctcctgtcatcctttggtgaattacagtactgcttatcagagaagccaaagcttctccccctggagctggagaagacagccatccaaaattacactgtcacggagttccagcccctgtattacgtggcagagagttttaatgatgccaaggagaaagtaaggaactttgctgccacaatacctcggcccttctcagttcgctacgacccatacacccaaaggattgaggtcttggacaatacccagcagcttaagattttggctgattccattaacagtgaaattggaatcctttgcagtgccctccagaaaataaagtaaagccatggacagaatgtggtctgtcagctgtgaatctgttgatggagatccaactatttctttcatcagaaaaagtccgaaaagcaaaccttaatttgaaataacagccttaaatcctttacaagatggagaaacaacaaataagtcaaaataatctgaaatgacaggatatgagtacatactcaagagcataatggtaaatcttttggggtcatctttgatttagagatgataatcccatactctcaattgagttaaatcagtaatctgtcgcatttcatcaagattaattaaaatttgggacctgcttcattcaagcttcatatatgctttgcagagaactcataaaggagcatataaggctaaatgtaaaacacaagactgtcattagaattgaattattgggcttaatataaatcgtaacctatgaagtttattttctattttagttaactatgattccaattactactttgttattgtacctaagtaaattttctttaagtcagaagcccattaaaatagttacaagcattgaacttctttagtattatattaatataaaaacatttttgtatgttttattgtaatcataaatactgctgtataaggtaataaaactctgcacctaatccccataacttccagtatcattttccaattaattatcaagtctgttttgggaaacactttgaggacatttatgatgcagcagatgttgactaaaggcttggttggtagatattcaggaaatgttcactgaataaataagtaaatacattattgaaaagcaaatctgtataaatgtgaaatttttatttgtattagtaataaaacattagtagtttaaacaa

SEQ ID NO: 355952 - DNA, 1903 bp, Homo sapiens
ctaaaactcacaagatgtctttactgattttatacactgcctggcacatcaaatgaacttaataaatattttgagagtgaattaatatatacagtaggaaagacacatacacacaaggcaggctgcagtaagtgctgtaaaagagacaatgagacagtagaggaattctgcaacagaagctgtggtgagaattaatctatgatgtgttagactctccagctatatatatgcctggaccgatgtcaccacttatctgcagttctcctgtgatgtttccagggtacatgattaagactcatttaacattccaggaatattctgctgatgaataatcactgagctggagtcaagagaagaagctttagatactaaccgaccctgtgatcatgagcaagtcacttcccttctctgtgcctcaatttcctcacttataaagtgttctataacatatgggcaggaaagacttgataacacactcagggtctatgtgggctgttctgaaggcatctggccacccatcacctttttatggccaagtactaggttggttctgtggttccaattacaggaacagaacaggttctattttcccccaattacaggaaattggccttgcctctctgggtgcacctgatgaatacattgaaaagctcgccacaatttactggtttactgtggagtttgggctctgcaaacaaggagactccataaaggcatatggtgctgggctcctgtcatcctttggtgaattacagtactgcttatcagagaagccaaagcttctccccctggagctggagaagacagccatccaaaattacactgtcacggagttccagcccctgtattacgtggcagagagttttaatgatgccaaggagaaagtaaggaactttgctgccacaatacctcggcccttctcagttcgctacgacccatacacccaaaggattgaggtcttggacaatacccagcagcttaagattttggctgattccattaacagtgaaattggaatcctttgcagtgccctccagaaaataaagtaaagccatggacagaatgtggtctgtcagctgtgaatctgttgatggagatccaactatttctttcatcagaaaaagtccgaaaagcaaaccttaatttgaaataacagccttaaatcctttacaagatggagaaacaacaaataagtcaaaataatctgaaatgacaggatatgagtacatactcaagagcataatggtaaatcttttggggtcatctttgatttagagatgataatcccatactctcaattgagttaaatcagtaatctgtcgcatttcatcaagattaattaaaatttgggacctgcttcattcaagcttcatatatgctttgcagagaactcataaaggagcatataaggctaaatgtaaaacacaagactgtcattagaattgaattattgggcttaatataaatcgtaacctatgaagtttattttctattttagttaactatgattccaattactactttgttattgtacctaagtaaattttctttaagtcagaagcccattaaaatagttacaagcattgaacttctttagtattatattaatataaaaacatttttgtatgttttattgtaatcataaatactgctgtataaggtaataaaactctgcacctaatccccataacttccagtatcattttccaattaattatcaagtctgttttgggaaacactttgaggacatttatgatgcagcagatgttgactaaaggcttggttggtagatattcaggaaatgttcactgaataaataagtaaatacattattgaaaagcaaatctgtataaatgtgaaatttttatttgtattagtaataaaacattagtagtttaaacaa

SEQ ID NO: 355953 - DNA, 1836 bp, Homo sapiens
ggacatagcacatacagtgttaaataaatgtaggttttcttccctcactgctgtccacctccagactaacagaagagcagcactgtttttgttttagttcccagtggaatagctgagcatattgtatctgcccagggaagtcaataccagggagaagacaggatgagaagtgttcatgactcatagctcacttaggtatatgggagcatgtccacaggaatattagctcttctgcctggtaccccactggggatactcttaagacccttggctgctgtgccctaccctgcacctgtctcttatttttccttccttttcttctttttaccttgtaccctgccttttatgatcccaacctctgcatatcacttattcctgggagagggatcataagcctaaaagagttatttccattctttctgcccattcctcatgtagaaagactgagtctggcttggcttaaacctcctcccctccgagctctctgtgctttctgtctttcagtgacatctgccatgagctgttgggacatgtgcccttgttttcagatcgcagctttgcccagttttcccaggaaattggccttgcctctctgggtgcacctgatgaatacattgaaaagctcgccacaggagactccataaaggcatatggtgctgggctcctgtcatcctttggtgaattacagtactgcttatcagagaagccaaagcttctccccctggagctggagaagacagccatccaaaattacactgtcacggagttccagcccctgtattacgtggcagagagttttaatgatgccaaggagaaagtaaggaactttgctgccacaatacctcggcccttctcagttcgctacgacccatacacccaaaggattgaggtcttggacaatacccagcagcttaagattttggctgattccattaacagtgaaattggaatcctttgcagtgccctccagaaaataaagtaaagccatggacagaatgtggtctgtcagctgtgaatctgttgatggagatccaactatttctttcatcagaaaaagtccgaaaagcaaaccttaatttgaaataacagccttaaatcctttacaagatggagaaacaacaaataagtcaaaataatctgaaatgacaggatatgagtacatactcaagagcataatggtaaatcttttggggtcatctttgatttagagatgataatcccatactctcaattgagttaaatcagtaatctgtcgcatttcatcaagattaattaaaatttgggacctgcttcattcaagcttcatatatgctttgcagagaactcataaaggagcatataaggctaaatgtaaaacacaagactgtcattagaattgaattattgggcttaatataaatcgtaacctatgaagtttattttctattttagttaactatgattccaattactactttgttattgtacctaagtaaattttctttaagtcagaagcccattaaaatagttacaagcattgaacttctttagtattatattaatataaaaacatttttgtatgttttattgtaatcataaatactgctgtataaggtaataaaactctgcacctaatccccataacttccagtatcattttccaattaattatcaagtctgttttgggaaacactttgaggacatttatgatgcagcagatgttgactaaaggcttggttggtagatattcaggaaatgttcactgaataaataagtaaatacattattgaaaagcaaatctgtataaatgtgaaatttttatttgtattagtaataaaacattagtagtttaaacaa

SEQ ID NO: 355954 - DNA, 2107 bp, Homo sapiens
gccatttgttcttcatgaaagatagcaactaacactcatagggcacttacaccatagtataacagcatttgctgcaaccccctgaggcaggtaccactaatgccccaattttacagaggaaattggggtacagaagagtggtcccctgtgcccatggtcacaagggccataatagacagaggcagggtttcagcccaggcagcttgacttggaacttggggagccactcttgccaaacttggaggtccctactgtctcccgtaacattgtattttcagtacagcagcttataggttcaccagaggccaacttagaaatctgtgattactttgcaacatcttgttaatggtattgcatgatgtccctcatagaggccctcatggtggatttctcccagatccaggagtaaggcactgggaaggcaggaaagcaaagggtccaggccagtgtcagactgcctgggttccttcccagctgcataacttactgacagtatggccttagtagtcacgcagccttcccaagcctgtttcctcatccataggaaggatatttgtaaagagcattggacagttagaacttaacatagttcttggaacatagaaggtactccatcaatgttaaatttcattattaacatagtgctttcttcaccacttgagagctatttccctctgcattgattgtcaaccatttcagagcttttttccctctatatagcattctttagctagattttacttactcttgattttatttaatgataggagtttgtggctttattgtattcagtagtttcattgtaagctatctctgtcttcttggagccaggggactaaataaacatgtgtatatatgtgtttgtacatacacaatacacacacacagaggcttccccaagaagactcattaaaactcccattccccccggcctcagcccctggctgttgaagaccctgctctagggaggtgtccgtgttcctaaaaaagaagtaaaatgcccactgagaactctcttaagactacctttctccaaatggtgcccttcactcaagcctgtggttttggtctttgatgccaaggagaaagtaaggaactttgctgccacaatacctcggcccttctcagttcgctacgacccatacacccaaaggattgaggtcttggacaatacccagcagcttaagattttggctgattccattaacagtgaaattggaatcctttgcagtgccctccagaaaataaagtaaagccatggacagaatgtggtctgtcagctgtgaatctgttgatggagatccaactatttctttcatcagaaaaagtccgaaaagcaaaccttaatttgaaataacagccttaaatcctttacaagatggagaaacaacaaataagtcaaaataatctgaaatgacaggatatgagtacatactcaagagcataatggtaaatcttttggggtcatctttgatttagagatgataatcccatactctcaattgagttaaatcagtaatctgtcgcatttcatcaagattaattaaaatttgggacctgcttcattcaagcttcatatatgctttgcagagaactcataaaggagcatataaggctaaatgtaaaacacaagactgtcattagaattgaattattgggcttaatataaatcgtaacctatgaagtttattttctattttagttaactatgattccaattactactttgttattgtacctaagtaaattttctttaagtcagaagcccattaaaatagttacaagcattgaacttctttagtattatattaatataaaaacatttttgtatgttttattgtaatcataaatactgctgtataaggtaataaaactctgcacctaatccccataacttccagtatcattttccaattaattatcaagtctgttttgggaaacactttgaggacatttatgatgcagcagatgttgactaaaggcttggttggtagatattcaggaaatgttcactgaataaataagtaaatacattattgaaaagcaaatctgtataaatgtgaaatttttatttgtattagtaataaaacattagtagtttaaacaa

SEQ ID NO: 355955 - DNA, 1562 bp, Homo sapiens
cagctgggggtaaggggggcggattattcatataattgttataccagacggtcgcaggcttagtccaattgcagagaactcgcttcccaggcttctgagagtcccggaagtgcctaaacctgtctaatcgacggggcttgggtggcccgtcgctccctggcttcttccctttacccagggcgggcagcgaagtggtgcctcctgcgtcccccacaccctccctcagcccctcccctccggcccgtcctgggcaggtgacctggagcatccggcaggctgccctggcctcctgcgtcaggacaagcccacgaggggcgttactgtgcggagatgcaccacgcaagagacaccctttgtaactctcttctcctccctagtgcgaggttaaaaccttcagccccacgtgctgtttgcaaacctgcctgtacctgaggccctaaaaagccagagacctcactcccggggagccagcatgtccactgcggtcctggaaaacccaggcttgggcaggaaactctctgactttggacaggaaacaagctatattgaagacaactgcaatcaaaatggtgccatatcactgatcttctcactcaaagaagaagttggtgcattggccaaagtattgcgcttatttgaggagaatgatgtaaacctgacccacattgaatctagaccttctcgtttaaagaaagatgagtatgaatttttcacccatttggataaacgtagcctgcctgctctgacaaacatcatcaagatcttgaggcatgacattggtgccactgtccatgagctttcacgagataagaagaaagacacagtgccctggttcccaagaaccattcaagagctggacagatttgccaatcagattctcagctatggagcggaactggatgctgaccaccctggttttaaagatcctgtgtaccgtgcaagacggaagcagtttgctgacattgcctacaactaccgccatgggcagcccatccctcgagtggaatacatggaggaagaaaagaaaacatggggcacagtgttcaagactctgaagtccttgtataaaacccatgcttgctatgagtacaatcacatttttccacttcttgaaaagtactgtggcttccatgaagataacattccccagctggaagacgtttctcagttcctgcagagtaagtccacatcagggtcaatggccctgcagaaagttgggggaggattgaggcagaggagagggaaggggaagacaagtatgtggaggcaagtatgaaagcatgtgcttgtaggaatgcatgcaggttgattcctccaggaagaactaaatttcactgtgctctgccttccctccagcccctactgtgtttatccactttcattcaatcaaacacctgaggctgtggattttgccgtgtacctgtccctgtgttttgttttgttttgtttgccctgtagttcctgctgtgttatgagttaggagtgtgtgtttgtgtaagaaatgtgctattttcggggatggtgccaagagccctgagctctgagtctgtgcatctggtatg

SEQ ID NO: 355956 - DNA, 1035 bp, Homo sapiens
cagctgggggtaaggggggcggattattcatataattgttataccagacggtcgcaggcttagtccaattgcagagaactcgcttcccaggcttctgagagtcccggaagtgcctaaacctgtctaatcgacggggcttgggtggcccgtcgctccctggcttcttccctttacccagggcgggcagcgaagtggtgcctcctgcgtcccccacaccctccctcagcccctcccctccggcccgtcctgggcaggtgacctggagcatccggcaggctgccctggcctcctgcgtcaggacaagcccacgaggggcgttactgtgcggagatgcaccacgcaagagacaccctttgtaactctcttctcctccctagtgcgaggttaaaaccttcagccccacgtgctgtttgcaaacctgcctgtacctgaggccctaaaaagccagagacctcactcccggggagccagcatgtccactgcggtcctggaaaacccaggcttgggcaggaaactctctgactttggacaggaaacaagctatattgaagacaactgcaatcccaaagtattgcgcttatttgaggagaatgatgtaaacctgacccacattgaatctagaccttctcgtttaaagaaagatgagtatgaatttttcacccatttggataaacgtagcctgcctgctctgacaaacatcatcaagatcttgaggcatgacattggtgccactgtccatgagctttcacgagataagaagaaagacacagtgccctggttcccaagaaccattcaagagctggacagatttgccaatcagattctcagctatggagcggaactggatgctgaccaccctgtgagtccatggcccgtaggatgagattttttcagtgcctctcctccactcccctcccttcctcttaccttctctacttggagcaatgtacttgttcacttgttcaacaaacacttattgtgttcctatttacacgagggctgggaaaaattagcaagactttattgtcatcatca

SEQ ID NO: 355957 - DNA, 1283 bp, Homo sapiens
gccatttgttcttcatgaaagatagcaactaacactcatagggcacttacaccatagtataacagcatttgctgcaaccccctgaggcaggtaccactaatgccccaattttacagaggaaattggggtacagaagagtggtcccctgtgcccatggtcacaagggccataatagacagaggcagggtttcagcccaggcagcttgacttggaacttggggagccactcttgccaaacttggaggtccctactgtctcccgtaacattgtattttcagtacagcagcttataggttcaccagaggccaacttagaaatctgtgattactttgcaacatcttgttaatggtattgcatgatgtccctcatagaggccctcatggtggatttctcccagatccaggagtaaggcactgggaaggcaggaaagcaaagggtccaggccagtgtcagactgcctgggttccttcccagctgcataacttactgacagtatggccttagtagtcacgcagccttcccaagcctgtttcctcatccataggaaggatatttgtaaagagcattggacagttagaacttaacatagttcttggaacatagaaggtactccatcaatgttaaatttcattattaacatagtgctttcttcaccacttgagagctatttccctctgcattgattgtcaaccatttcagagcttttttccctctatatagcattctttagctagattttacttactcttgattttatttaatgataggagtttgtggctttattgtattcagtagtttcattgtaagctatctctgtcttcttggagccaggggactaaataaacatgtgtatatatgtgtttgtacatacacaatacacacacacagaggcttccccaagaagactcattaaaactcccattccccccggcctcagcccctggctgttgaagaccctgctctagggaggtgtccgtgttcctaaaaaagaagtaaaatgcccactgagaactctcttaagactacctttctccaaatggtgcccttcactcaagcctgtggttttggtctttgatgccaaggagaaagtaaggaactttgctgccacaatacctcggcccttctcagttcgctacgacccatacacccaaaggattgaggtcttggacaatacccagcagcttaagattttggctgattccattaacagtaagtaatttacaccttacgaggccactcggtttctcagtaatcgaagactgtctttccctaccatcgccata

SEQ ID NO: 355958 - DNA, 498 bp, Homo sapiens
agccagcatgtccactgcggtcctggaaaacccaggcttgggcaggaaactctctgactttggacaggtgagccacggcagcctgagctgctcagttaggggaatttgggcctccagagaaagagatccgaagactgctggtgcttcctggtttcataagctcagtaagaagtctgaattcgttggaagctgatgagaatatccaggaagtcaacagacaaatgtcctcaacaattgtttctaagtaggagaacatctgtcctcggtggctttcacaggaatgaatgaccattgctttagggggttggggatctggcctccagaactgccaccaattagctgtgtgtctttggacaagttactgtccctctctgttgtctgtttactcttctgtacactgaaggggctggtccctaatgatctgggatgggatgtggaatccttctagatttcttttgtaatatttataaagtgctctcagcaaggtatcaaaatggc

SEQ ID NO: 355959 - DNA, 699 bp, Homo sapiens
gatttgaaattctcatactactttacattttattttggaaatagttaagtcttaaagaatttgcatagtgtttctttgagtttagttctcagaacagctgtagtatcatcaacagcaaattctgggtaccttcccagctccacccaatttgaatctctgaagataaggcccagagacctgtatttttaagtaccccatttttttaattattcatagccaaattctatcaggtacattcagtttgagaaaacctgatttgtggtggtcagtctgccactgccaatgatgtcaatgtggataagctgtttcccttctttagacctcagtgtcactctaacaatgagggagttaaactttataaaccaaggtccattgcagccttgaaatatgattcaagtgttcatatgtgtctttatatagctatgcctgatccactgatggggtgttacaatacctgcttatatatgccagctgggaggaaagaggaatttactgaatgtgtctgaagtttcattgttttgaagttggaattttatgcctgtatctatgtttatgcctttgtaaaacccactgattttaaaagtgaaaaaggacttttttctctgcttttactctaaacaccaaacaatccctgcaaagggattattctgatgtttcttcatttcacatgaaaagttaattattgactctggaacttaa

SEQ ID NO: 355960 - DNA, 766 bp, Homo sapiens
ggagagggaaggggaagacaagtatgtggaggcaagtatgaaagcatgtgcttgtaggaatgcatgcaggttgattcctccaggaagaactaaatttcactgtgctctgccttccctccagcccctactgtgtttatccactttcattcaatcaaacacctgaggctgtggattttgccgtgtacctgtccctgaaaagtattttctttcacacttaaagcccaaggtgcttcactgaggtttttttttgttttgttttgttttgtttgccctgtagttcctgctgtgttatgagttaggagtgtgtgtttgtgtaagaaatgtgctattttcggggatggtgccaagagccctgagctctgagtctgtgcatctggtatgaatcctgccttcaatcctctccagctgagtaaacctgcctcagttttgtcatctgtcaaatggacactgtatcaactctttagcttttcccatagggaaattatgagaatgaagtaaggtgctgcatatggaaacaaccagcacagtcttgcatatacagcaggtattcagtgaatttggactgaattgaaatctgagtagcttaataggtaagtacattgagtcgcaagcctctctgtacagtatatccaggtgaaatgggtgttactctttctgtcaagaggatgttaatttagcaaaaacaaaataatgaactagcacatattgaacacctactgtgtgccaggtagaataagcagaagtggggagacagactacaggttac

SEQ ID NO: 355961 - DNA, 2435 bp, Homo sapiens
cttcatcgtcgtccaactgaccttgagtgttagtttcgcggtaagtttgggtataagtgccaccaccagtgccggcagtgtagtcagtagtttgttgctggaagtcgttaccgccaaactgcgtgttaccgcctagattagactgtggctgctggcgttgagggaaacctgcctgtacctgaggccctaaaaagccagagacctcactcccggggagccagcatgtccactgcggtcctggaaaacccaggcttgggcaggaaactctctgactttggacaggaaacaagctatattgaagacaactgcaatcaaaatggtgccatatcactgatcttctcactcaaagaagaagttggtgcattggccaaagtattgcgcttatttgaggagaatgatgtaaacctgacccacattgaatctagaccttctcgtttaaagaaagatgagtatgaatttttcacccatttggataaacgtagcctgcctgctctgacaaacatcatcaagatcttgaggcatgacattggtgccactgtccatgagctttcacgagataagaagaaagacacagtgccctggttcccaagaaccattcaagagctggacagatttgccaatcagattctcagctatggagcggaactggatgctgaccaccctggttttaaagatcctgtgtaccgtgcaagacggaagcagtttgctgacattgcctacaactaccgccatgggcagcccatccctcgagtggaatacatggaggaagaaaagaaaacatggggcacagtgttcaagactctgaagtccttgtataaaacccatgcttgctatgagtacaatcacatttttccacttcttgaaaagtactgtggcttccatgaagataacattccccagctggaagacgtttctcagttcctgcagacttgcactggtttccgcctccgacctgtagctggcctgctttcctctcgggatttcttgggtggcctggccttccgagtcttccactgcacacagtacatcagacatggatccaagcccatgtatacccccgaacctgacatctgccatgagctgttgggacatgtgcccttgttttcagatcgcagctttgcccagttttcccaggaaattggccttgcctctctgggtgcacctgatgaatacattgaaaagctcgccacaatttactggtttactgtggagtttgggctctgcaaacaaggagactccataaaggcatatggtgctgggctcctgtcatcctttggtgaattacagtactgcttatcagagaagccaaagcttctccccctggagctggagaagacagccatccaaaattacactgtcacggagttccagcccctgtattacgtggcagagagttttaatgatgccaaggagaaagtaaggaactttgctgccacaatacctcggcccttctcagttcgctacgacccatacacccaaaggattgaggtcttggacaatacccagcagcttaagattttggctgattccattaacagtgaaattggaatcctttgcagtgccctccagaaaataaagtaaagccatggacagaatgtggtctgtcagctgtgaatctgttgatggagatccaactatttctttcatcagaaaaagtccgaaaagcaaaccttaatttgaaataacagccttaaatcctttacaagatggagaaacaacaaataagtcaaaataatctgaaatgacaggatatgagtacatactcaagagcataatggtaaatcttttggggtcatctttgatttagagatgataatcccatactctcaattgagttaaatcagtaatctgtcgcatttcatcaagattaattaaaatttgggacctgcttcattcaagcttcatatatgctttgcagagaactcataaaggagcatataaggctaaatgtaaaacacaagactgtcattagaattgaattattgggcttaatataaatcgtaacctatgaagtttattttctattttagttaactatgattccaattactactttgttattgtacctaagtaaattttctttaagtcagaagcccattaaaatagttacaagcattgaacttctttagtattatattaatataaaaacatttttgtatgttttattgtaatcataaatactgctgtataaggtaataaaactctgcacctaatccccataacttccagtatcattttccaattaattatcaagtctgttttgggaaacactttgaggacatttatgatgcagcagatgttgactaaaggcttggttggtagatattcaggaaatgttcactgaataaataagtaaatacattattgaaaagcaaatctgtataaatgtgaaatttttatttgtattagtaataaaacattagtagtttaaacaa

SEQ ID NO: 355962 - DNA, 1043 bp, Homo sapiens
  misc_feature (638)..(638): n is a, c, g, or t
agcgggagggcgtcctggcgagtctcagcccccaagcgggtggaacgcaccaagggtctcatccgcgaggaagggctttaacgctcagggtcaggaacctctgagagctcttggggacttgcgcgcccttggatgctcttgcgttcaacagggctaggagactaccggctggggcgaggaatgcaggcgcctagagccttggagctcctgaaacgttcctgccgcctccggaaagcaagggcagtttaccgaagtgactgaggccaagtatttgcagcacgggcagggaccagtaactgattttcaggccttttgagaggaagaggaagagagaggaagagaaggatttctaatagtagatattcactctcatggactctttaggaaacagcaacaaagacaagattaagaacaccaaattgtgtgactatccacacaaaaaagcatcttcataagaaccaaaaatcaggtaagccatcacagtacgctattttagttttatatcactgaaagggacacctaagaaggtagaaaagacagtcttgaattgctgatgcaactcctcccccatcaccccaacactccagcagcagtggacgcatggcatggacagagaatctgtgtgcttcggacacatnctgggcgcaagaagaagaaccccaataaccttgaagggagagcgcccccgccctgggaagaacacctggggcgcggaatgagtccggaacaagggacaaggtccaaagagcacccagagggtggagagccatcaccgggggggagcaggggtgcacacaccaacagcggccgggggcaccaaaagattttcggcgtgtcttcaccgcgccacaagggggctcgtgatttgtaaagccccatatttggtgggtggcccttcaggaaggcgcatggaacggggggacacatataaatagggcgtcgatcagtgccacgggtgatgaatatgcaccagcacacagtgatgaccagcacacacgtcaatatgagcataggcataacataaaataacgatacgagtgaga

SEQ ID NO: 355963 - DNA, 2480 bp, Homo sapiens
gcggccgccgcggctgcggccgtggcaaagaaacaggctgcgggcggcaggaagggctgctggggctgcggctggggctgctggccggcgccgccgctctccatcttggcagagctttccatgcgcagcggcggccaaggagtcgcggaatcagagcgatccgggacgcgagtgcgaggttaaaaccttcagccccacgtgctgtttgcaaacctgcctgtacctgaggccctaaaaagccagagacctcactcccggggagccagcatgtccactgcggtcctggaaaacccaggcttgggcaggaaactctctgactttggacaggaaacaagctatattgaagacaactgcaatcaaaatggtgccatatcactgatcttctcactcaaagaagaagttggtgcattggccaaagtattgcgcttatttgaggagaatgatgtaaacctgacccacattgaatctagaccttctcgtttaaagaaagatgagtatgaatttttcacccatttggataaacgtagcctgcctgctctgacaaacatcatcaagatcttgaggcatgacattggtgccactgtccatgagctttcacgagataagaagaaagacacagtgccctggttcccaagaaccattcaagagctggacagatttgccaatcagattctcagctatggagcggaactggatgctgaccaccctggttttaaagatcctgtgtaccgtgcaagacggaagcagtttgctgacattgcctacaactaccgccatgggcagcccatccctcgagtggaatacatggaggaagaaaagaaaacatggggcacagtgttcaagactctgaagtccttgtataaaacccatgcttgctatgagtacaatcacatttttccacttcttgaaaagtactgtggcttccatgaagataacattccccagctggaagacgtttctcagttcctgcagacttgcactggtttccgcctccgacctgtagctggcctgctttcctctcgggatttcttgggtggcctggccttccgagtcttccactgcacacagtacatcagacatggatccaagcccatgtatacccccgaacctgacatctgccatgagctgttgggacatgtgcccttgttttcagatcgcagctttgcccagttttcccaggaaattggccttgcctctctgggtgcacctgatgaatacattgaaaagctcgccacaatttactggtttactgtggagtttgggctctgcaaacaaggagactccataaaggcatatggtgctgggctcctgtcatcctttggtgaattacagtactgcttatcagagaagccaaagcttctccccctggagctggagaagacagccatccaaaattacactgtcacggagttccagcccctgtattacgtggcagagagttttaatgatgccaaggagaaagtaaggaactttgctgccacaatacctcggcccttctcagttcgctacgacccatacacccaaaggattgaggtcttggacaatacccagcagcttaagattttggctgattccattaacagtgaaattggaatcctttgcagtgccctccagaaaataaagtaaagccatggacagaatgtggtctgtcagctgtgaatctgttgatggagatccaactatttctttcatcagaaaaagtccgaaaagcaaaccttaatttgaaataacagccttaaatcctttacaagatggagaaacaacaaataagtcaaaataatctgaaatgacaggatatgagtacatactcaagagcataatggtaaatcttttggggtcatctttgatttagagatgataatcccatactctcaattgagttaaatcagtaatctgtcgcatttcatcaagattaattaaaatttgggacctgcttcattcaagcttcatatatgctttgcagagaactcataaaggagcatataaggctaaatgtaaaacacaagactgtcattagaattgaattattgggcttaatataaatcgtaacctatgaagtttattttctattttagttaactatgattccaattactactttgttattgtacctaagtaaattttctttaagtcagaagcccattaaaatagttacaagcattgaacttctttagtattatattaatataaaaacatttttgtatgttttattgtaatcataaatactgctgtataaggtaataaaactctgcacctaatccccataacttccagtatcattttccaattaattatcaagtctgttttgggaaacactttgaggacatttatgatgcagcagatgttgactaaaggcttggttggtagatattcaggaaatgttcactgaataaataagtaaatacattattgaaaagcaaatctgtataaatgtgaaatttttatttgtattagtaataaaacattagtagtttaaacaa

SEQ ID NO: 355964 - DNA, 2570 bp, Homo sapiens
agcgggagggcgtcctggcgagtctcagcccccaagcgggtggaacgcaccaagggtctcatccgcgaggaagggctttaacgctcagggtcaggaacctctgagagctcttggggacttgcgcgcccttggatgctcttgcgttcaacagggctaggagactaccggctggggcgaggaatgcaggcgcctagagccttggagctcctgaaacgttcctgccgcctccggaaagcaagggcagtttaccgaagtgactgagtgcgaggttaaaaccttcagccccacgtgctgtttgcaaacctgcctgtacctgaggccctaaaaagccagagacctcactcccggggagccagcatgtccactgcggtcctggaaaacccaggcttgggcaggaaactctctgactttggacaggaaacaagctatattgaagacaactgcaatcaaaatggtgccatatcactgatcttctcactcaaagaagaagttggtgcattggccaaagtattgcgcttatttgaggagaatgatgtaaacctgacccacattgaatctagaccttctcgtttaaagaaagatgagtatgaatttttcacccatttggataaacgtagcctgcctgctctgacaaacatcatcaagatcttgaggcatgacattggtgccactgtccatgagctttcacgagataagaagaaagacacagtgccctggttcccaagaaccattcaagagctggacagatttgccaatcagattctcagctatggagcggaactggatgctgaccaccctggttttaaagatcctgtgtaccgtgcaagacggaagcagtttgctgacattgcctacaactaccgccatgggcagcccatccctcgagtggaatacatggaggaagaaaagaaaacatggggcacagtgttcaagactctgaagtccttgtataaaacccatgcttgctatgagtacaatcacatttttccacttcttgaaaagtactgtggcttccatgaagataacattccccagctggaagacgtttctcagttcctgcagacttgcactggtttccgcctccgacctgtagctggcctgctttcctctcgggatttcttgggtggcctggccttccgagtcttccactgcacacagtacatcagacatggatccaagcccatgtatacccccgaacctgacatctgccatgagctgttgggacatgtgcccttgttttcagatcgcagctttgcccagttttcccaggaaattggccttgcctctctgggtgcacctgatgaatacattgaaaagctcgccacaatttactggtttactgtggagtttgggctctgcaaacaaggagactccataaaggcatatggtgctgggctcctgtcatcctttggtgaattacagtactgcttatcagagaagccaaagcttctccccctggagctggagaagacagccatccaaaattacactgtcacggagttccagcccctgtattacgtggcagagagttttaatgatgccaaggagaaagtaaggaactttgctgccacaatacctcggcccttctcagttcgctacgacccatacacccaaaggattgaggtcttggacaatacccagcagcttaagattttggctgattccattaacagtgaaattggaatcctttgcagtgccctccagaaaataaagtaaagccatggacagaatgtggtctgtcagctgtgaatctgttgatggagatccaactatttctttcatcagaaaaagtccgaaaagcaaaccttaatttgaaataacagccttaaatcctttacaagatggagaaacaacaaataagtcaaaataatctgaaatgacaggatatgagtacatactcaagagcataatggtaaatcttttggggtcatctttgatttagagatgataatcccatactctcaattgagttaaatcagtaatctgtcgcatttcatcaagattaattaaaatttgggacctgcttcattcaagcttcatatatgctttgcagagaactcataaaggagcatataaggctaaatgtaaaacacaagactgtcattagaattgaattattgggcttaatataaatcgtaacctatgaagtttattttctattttagttaactatgattccaattactactttgttattgtacctaagtaaattttctttaagtcagaagcccattaaaatagttacaagcattgaacttctttagtattatattaatataaaaacatttttgtatgttttattgtaatcataaatactgctgtataaggtaataaaactctgcacctaatccccataacttccagtatcattttccaattaattatcaagtctgttttgggaaacactttgaggacatttatgatgcagcagatgttgactaaaggcttggttggtagatattcaggaaatgttcactgaataaataagtaaatacattattgaaaagcaaatctgtataaatgtgaaatttttatttgtattagtaataaaacattagtagtttaaacaa

SEQ ID NO: 355965 - DNA, 2631 bp, Homo sapiens
cagctgggggtaaggggggcggattattcatataattgttataccagacggtcgcaggcttagtccaattgcagagaactcgcttcccaggcttctgagagtcccggaagtgcctaaacctgtctaatcgacggggcttgggtggcccgtcgctccctggcttcttccctttacccagggcgggcagcgaagtggtgcctcctgcgtcccccacaccctccctcagcccctcccctccggcccgtcctgggcaggtgacctggagcatccggcaggctgccctggcctcctgcgtcaggacaagcccacgaggggcgttactgtgcggagatgcaccacgcaagagacaccctttgtaactctcttctcctccctagtgcgaggttaaaaccttcagccccacgtgctgtttgcaaacctgcctgtacctgaggccctaaaaagccagagacctcactcccggggagccagcatgtccactgcggtcctggaaaacccaggcttgggcaggaaactctctgactttggacaggaaacaagctatattgaagacaactgcaatcaaaatggtgccatatcactgatcttctcactcaaagaagaagttggtgcattggccaaagtattgcgcttatttgaggagaatgatgtaaacctgacccacattgaatctagaccttctcgtttaaagaaagatgagtatgaatttttcacccatttggataaacgtagcctgcctgctctgacaaacatcatcaagatcttgaggcatgacattggtgccactgtccatgagctttcacgagataagaagaaagacacagtgccctggttcccaagaaccattcaagagctggacagatttgccaatcagattctcagctatggagcggaactggatgctgaccaccctggttttaaagatcctgtgtaccgtgcaagacggaagcagtttgctgacattgcctacaactaccgccatgggcagcccatccctcgagtggaatacatggaggaagaaaagaaaacatggggcacagtgttcaagactctgaagtccttgtataaaacccatgcttgctatgagtacaatcacatttttccacttcttgaaaagtactgtggcttccatgaagataacattccccagctggaagacgtttctcagttcctgcagacttgcactggtttccgcctccgacctgtagctggcctgctttcctctcgggatttcttgggtggcctggccttccgagtcttccactgcacacagtacatcagacatggatccaagcccatgtatacccccgaacctgacatctgccatgagctgttgggacatgtgcccttgttttcagatcgcagctttgcccagttttcccaggaaattggccttgcctctctgggtgcacctgatgaatacattgaaaagctcgccacaatttactggtttactgtggagtttgggctctgcaaacaaggagactccataaaggcatatggtgctgggctcctgtcatcctttggtgaattacagtactgcttatcagagaagccaaagcttctccccctggagctggagaagacagccatccatgatgccaaggagaaagtaaggaactttgctgccacaatacctcggcccttctcagttcgctacgacccatacacccaaaggattgaggtcttggacaatacccagcagcttaagattttggctgattccattaacagtgaaattggaatcctttgcagtgccctccagaaaataaagtaaagccatggacagaatgtggtctgtcagctgtgaatctgttgatggagatccaactatttctttcatcagaaaaagtccgaaaagcaaaccttaatttgaaataacagccttaaatcctttacaagatggagaaacaacaaataagtcaaaataatctgaaatgacaggatatgagtacatactcaagagcataatggtaaatcttttggggtcatctttgatttagagatgataatcccatactctcaattgagttaaatcagtaatctgtcgcatttcatcaagattaattaaaatttgggacctgcttcattcaagcttcatatatgctttgcagagaactcataaaggagcatataaggctaaatgtaaaacacaagactgtcattagaattgaattattgggcttaatataaatcgtaacctatgaagtttattttctattttagttaactatgattccaattactactttgttattgtacctaagtaaattttctttaagtcagaagcccattaaaatagttacaagcattgaacttctttagtattatattaatataaaaacatttttgtatgttttattgtaatcataaatactgctgtataaggtaataaaactctgcacctaatccccataacttccagtatcattttccaattaattatcaagtctgttttgggaaacactttgaggacatttatgatgcagcagatgttgactaaaggcttggttggtagatattcaggaaatgttcactgaataaataagtaaatacattattgaaaagcaaatctgtataaatgtgaaatttttatttgtattagtaataaaacattagtagtttaaacaa

SEQ ID NO: 355966 - DNA, 4066 bp, Homo sapiens
cagctgggggtaaggggggcggattattcatataattgttataccagacggtcgcaggcttagtccaattgcagagaactcgcttcccaggcttctgagagtcccggaagtgcctaaacctgtctaatcgacggggcttgggtggcccgtcgctccctggcttcttccctttacccagggcgggcagcgaagtggtgcctcctgcgtcccccacaccctccctcagcccctcccctccggcccgtcctgggcaggtgacctggagcatccggcaggctgccctggcctcctgcgtcaggacaagcccacgaggggcgttactgtgcggagatgcaccacgcaagagacaccctttgtaactctcttctcctccctagtgcgaggttaaaaccttcagccccacgtgctgtttgcaaacctgcctgtacctgaggccctaaaaagccagagacctcactcccggggagccagcatgtccactgcggtcctggaaaacccaggcttgggcaggaaactctctgactttggacaggaaacaagctatattgaagacaactgcaatcaaaatggtgccatatcactgatcttctcactcaaagaagaagttggtgcattggccaaagtattgcgcttatttgaggagaatgatgtaaacctgacccacattgaatctagaccttctcgtttaaagaaagatgagtatgaatttttcacccatttggataaacgtagcctgcctgctctgacaaacatcatcaagatcttgaggcatgacattggtgccactgtccatgagctttcacgagataagaagaaagacacagtgccctggttcccaagaaccattcaagagctggacagatttgccaatcagattctcagctatggagcggaactggatgctgaccaccctggttttaaagatcctgtgtaccgtgcaagacggaagcagtttgctgacattgcctacaactaccgccatgggcagcccatccctcgagtggaatacatggaggaagaaaagaaaacatggggcacagtgttcaagactctgaagtccttgtataaaacccatgcttgctatgagtacaatcacatttttccacttcttgaaaagtactgtggcttccatgaagataacattccccagctggaagacgtttctcagttcctgcagacttgcactggtttccgcctccgacctgtagctggcctgctttcctctcgggatttcttgggtggcctggccttccgagtcttccactgcacacagtacatcagacatggatccaagcccatgtatacccccgaacctgacatctgccatgagctgttgggacatgtgcccttgttttcagatcgcagctttgcccagttttcccaggaaattggccttgcctctctgggtgcacctgatgaatacattgaaaagctcgccacaatttactggtttactgtggagtttgggctctgcaaacaaggagactccataaaggcatatggtgctgggctcctgtcatcctttggtgaattacagtactgcttatcagagaagccaaagcttctccccctggagctggagaagacagccatccaaaattacactgtcacggagttccagcccctgtattacgtggcagagagttttaatgatgccaaggagaaagtaaggaactttgctgccacaatacctcggcccttctcagttcgctacgacccatacacccaaaggattgaggtcttggacaatacccagcagcttaagattttggctgattccattaacagtgaaattggaatcctttgcagtgccctccagaaaataaagtaaagccatggacagaatgtggtctgtcagctgtgaatctgttgatggagatccaactatttctttcatcagaaaaagtccgaaaagcaaaccttaatttgaaataacagccttaaatcctttacaagatggagaaacaacaaataagtcaaaataatctgaaatgacaggatatgagtacatactcaagagcataatggtaaatcttttggggtcatctttgatttagagatgataatcccatactctcaattgagttaaatcagtaatctgtcgcatttcatcaagattaattaaaatttgggacctgcttcattcaagcttcatatatgctttgcagagaactcataaaggagcatataaggctaaatgtaaaacacaagactgtcattagaattgaattattgggcttaatataaatcgtaacctatgaagtttattttctattttagttaactatgattccaattactactttgttattgtacctaagtaaattttctttaagtcagaagcccattaaaatagttacaagcattgaacttctttagtattatattaatataaaaacatttttgtatgttttattgtaatcataaatactgctgtataaggtaataaaactctgcacctaatccccataacttccagtatcattttccaattaattatcaagtctgttttgggaaacactttgaggacatttatgatgcagcagatgttgactaaaggcttggttggtagatattcaggaaatgttcactgaataaataagtaaatacattattgaaaagcaaatctgtataaatgtgaaatttttatttgtattagtaataaaacattagtagtttaaacaatttcactgtttcagttatttcctggaatgaaatattcctctcactgccttagaaatacattagctagatagttttgtaacatgagaaaatggccagaggctcatatctccaaccctttgcaggggctccttgtgacactcaaagtcatgcctggacagtcaacggactttgacttttgttgattgtgtgtttgccatgaaaacatgaatatctgagaagcagtggggagaaaaaattttggaaatagttaagtcttaaagaatttgcatagtgtttctttgagtttagttctcagaacagctgtagtatcatcaacagcaaattctgggtaccttcccagctccacccaatttgaatctctgaagataaggcccagagacctgtatttttaagtaccccatttttttaattattcatagccaaattctatcaggtacattcagtttgagaaaacctgatttgtggtggtcagtctgccactgccaatgatgtcaatgtggataagctgtttcccttctttagacctcagtgtcactctaacaatgagggagttaaactttataaaccaaggtccattgcagccttgaaatatgattcaagtgttcatatgtgtctttatatagctatgcctgatccactgatggggtgttacaatacctgcttatatatgccagctgggaggaaagaggaatttactgaatgtgtctgaagtttcattgttttgaagttggaattttatgcctgtatctatgtttatgcctttgtaaaacccactgattttaaaagtgaaaaaggacttttttctctgcttttactctaaacaccaaacaatccctgcaaagggattattctgatgtttcttcatttcacatgaaaagttaattattgactctggaacttaaatattagataatatttttgacaatattgaagagtgagttttagtccagtaaagatgttttaatgagcttgaaggtaaagtttcggttaagttatgattttcacaggaagttacatactgaatgaaagataatatttgtatttttggtaatgtgctactcagttcttagctcttttttatccagatataaaagcccagtctatagctatgggatttaataaatttccaatatgtaagtgtttttatttgtttaatttctagtaaatgagcaatattttagaaacagtatcagtctttactgacagatgatcttgctgagtacaatcaaaataaatacataaaaaattctaagcatgtggcattgatgtttaataagtttctgaaagtaggaatctgaattttaactgtaggtttctaagttatataatttagttgtgtttcaaaaaatccaccaataaaatgtcagctttataaaaacag

SEQ ID NO: 355967 - DNA, 2271 bp, Homo sapiens
gggctgcaggattcggcacgagctaaaaagccagagacctcactcccggggagccagcatgtccactgcggtcctggaaaacccaggcttgggcaggaaactctctgactttggacaggaaacaagctatattgaagacaactgcaatcaaaatggtgccatatcactgatcttctcactcaaagaagaagttggtgcattggccaaagtattgcgcttatttgaggagaatgatgtaaacctgacccacattgaatctagaccttctcgtttaaagaaagatgagtatgaatttttcacccatttggataaacgtagcctgcctgctctgacaaacatcatcaagatcttgaggcatgacattggtgccactgtccatgagctttcacgagataagaagaaagacacagtgccctggttcccaagaaccattcaagagctggacagatttgccaatcagattctcagctatggagcggaactggatgctgaccaccctggttttaaagatcctgtgtaccgtgcaagacggaagcagtttgctgacattgcctacaactaccgccatgggcagcccatccctcgagtggaatacatggaggaagaaaagaaaacatggggcacagtgttcaagactctgaagtccttgtataaaacccatgcttgctatgagtacaatcacatttttccacttcttgaaaagtactgtggcttccatgaagataacattccccagctggaagacgtttctcagttcctgcagacttgcactggtttccgcctccgacctgtagctggcctgctttcctctcgggatttcttgggtggcctggccttccgagtcttccactgcacacagtacatcagacatggatccaagcccatgtatacccccgaacctgacatctgccatgagctgttgggacatgtgcccttgttttcagatcgcagctttgcccagttttcccaggaaattggccttgcctctctgggtgcacctgatgaatacattgaaaagctcgccacaatttactggtttactgtggagtttgggctctgcaaacaaggagactccataaaggcatatggtgctgggctcctgtcatcctttggtgaattacagtactgcttatcagagaagccaaagcttctccccctggagctggagaagacagccatccaaaattacactgtcacggagttccagcccctgtattacgtggcagagagttttaatgatgccaaggagaaagtaaggaactttgctgccacaatacctcggcccttctcagttcgctacgacccatacacccaaaggattgaggtcttggacaatacccagcagcttaagattttggctgattccattaacagtgaaattggaatcctttgcagtgccctccagaaaataaagtaaagccatggacagaatgtggtctgtcagctgtgaatctgttgatggagatccaactatttctttcatcagaaaaagtccgaaaagcaaaccttaatttgaaataacagccttaaatcctttacaagatggagaaacaacaaataagtcaaaataatctgaaatgacaggatatgagtacatactcaagagcataatggtaaatcttttggggtcatctttgatttagagatgataatcccatactctcaattgagttaaatcagtaatctgtcgcatttcatcaagattaattaaaatttgggacctgcttcattcaagcttcatatatgctttgcagagaactcataaaggagcatataaggctaaatgtaaaacacaagactgtcattagaattgaattattgggcttaatataaatcgtaacctatgaagtttattttctattttagttaactatgattccaattactactttgttattgtacctaagtaaattttctttaagtcagaagcccattaaaatagttacaagcattgaacttctttagtattatattaatataaaaacatttttgtatgttttattgtaatcataaatactgctgtataaggtaataaaactctgcacctaatccccataacttccagtatcattttccaattaattatcaagtctgttttgggaaacactttgaggacatttatgatgcagcagatgttgactaaaggcttggttggtagatattcaggaaatgttcactgaataaataagtaaatacattattgaaaagcaaatctgtataaatgtgaaatttttatttgtattagtaataaaacattagtagtttaaacaa

SEQ ID NO: 355968 - DNA, 3251 bp, Homo sapiens
cagctgggggtaaggggggcggattattcatataattgttataccagacggtcgcaggcttagtccaattgcagagaactcgcttcccaggcttctgagagtcccggaagtgcctaaacctgtctaatcgacggggcttgggtggcccgtcgctccctggcttcttccctttacccagggcgggcagcgaagtggtgcctcctgcgtcccccacaccctccctcagcccctcccctccggcccgtcctgggcaggtgacctggagcatccggcaggctgccctggcctcctgcgtcaggacaagcccacgaggggcgttactgtgcggagatgcaccacgcaagagacaccctttgtaactctcttctcctccctagtgcgaggttaaaaccttcagccccacgtgctgtttgcaaacctgcctgtacctgaggccctaaaaagccagagacctcactcccggggagccagcatgtccactgcggtcctggaaaacccaggcttgggcaggaaactctctgactttggacaggaaacaagctatattgaagacaactgcaatcaaaatggtgccatatcactgatcttctcactcaaagaagaagttggtgcattggccaaagtattgcgcttatttgaggagaatgatgtaaacctgacccacattgaatctagaccttctcgtttaaagaaagatgagtatgaatttttcacccatttggataaacgtagcctgcctgctctgacaaacatcatcaagatcttgaggcatgacattggtgccactgtccatgagctttcacgagataagaagaaagacacagtgccctggttcccaagaaccattcaagagctggacagatttgccaatcagattctcagctatggagcggaactggatgctgaccaccctggttttaaagatcctgtgtaccgtgcaagacggaagcagtttgctgacattgcctacaactaccgccatgggcagcccatccctcgagtggaatacatggaggaagaaaagaaaacatggggcacagtgttcaagactctgaagtccttgtataaaacccatgcttgctatgagtacaatcacatttttccacttcttgaaaagtactgtggcttccatgaagataacattccccagctggaagacgtttctcagttcctgcagacttgcactggtttccgcctccgacctgtagctggcctgctttcctctcgggatttcttgggtggcctggccttccgagtcttccactgcacacagtacatcagacatggatccaagcccatgtatacccccgaacctgacatctgccatgagctgttgggacatgtgcccttgttttcagatcgcagctttgcccagttttcccaggaaattggccttgcctctctgggtgcacctgatgaatacattgaaaagctcgccacaatttactggtttactgtggagtttgggctctgcaaacaaggagactccataaaggcatatggtgctgggctcctgtcatcctttggtgaattacagtactgcttatcagagaagccaaagcttctccccctggagctggagaagacagccatccaaaattacactgtcacggagttccagcccctgtattacgtggcagagagttttaatgatgccaaggagaaagtaaggaactttgctgccacaatacctcggcccttctcagttcgctacgacccatacacccaaaggattgaggtcttggacaatacccagcagcttaagattttggctgattccattaacagtgaaattggaatcctttgcagtgccctccagaaaataaagtaaagccatggacagaatgtggtctgtcagctgtgaatctgttgatggagatccaactatttctttcatcagaaaaagtccgaaaagcaaaccttaatttgaaataacagccttaaatcctttacaagatggagaaacaacaaataagtcaaaataatctgaaatgacaggatatgagtacatactcaagagcataatggtaaatcttttggggtcatctttgatttagagatgataatcccatactctcaattgagttaaatcagtaatctgtcgcatttcatcaagattaattaaaatttgggacctgcttcattcaagcttcatatatgctttgcagagaactcataaaggagcatataaggctaaatgtaaaacacaagactgtcattagaattgaattattgggcttaatataaatcgtaacctatgaagtttattttctattttagttaactatgattccaattactactttgttattgtacctaagtaaattttctttaagtcagaagcccattaaaatagttacaagcattgaacttctttagtattatattaatataaaaacatttttgtatgttttattgtaatcataaatactgctgtataaggtaataaaactctgcacctaatccccataacttccagtatcattttccaattaattatcaagtctgttttgggaaacactttgaggacatttatgatgcagcagatgttgactaaaggcttggttggtagatattcaggaaatgttcactgaataaataagtaaatacattattgaaaagcaaatctgtataaatgtgaaatttttatttgtattagtaataaaacattagtagtttaaacaaaaaaaaaaaaaaaaaaaaaaaaaaaaaaaaaaaactaaagggggggccaagaacaacaaataaacctataaagagacgaataacaaataaactggccgccatttaacaacgaaataaactggttaaaggggggcccctgcccccttaatccccttgcgggccatccttcattcgccaggtggcgttttatacaaataggcccgtgggaaacccccttgctaaccaaagataaccctgattggcgaatggccaattgtacgcgtgggtgttttgccaaaaagcccgctaaatattcgtttattcaactaattctttacccaatgggccgaaggcaatctgaaccccttataattttgggcaaaacaccgataaatggttgaaaagtcgcccaattttgaacacaaaggcgctaatttggaacatggcctttaaagttaaaggggttaaaccccttttgtcttggcggatggcccactcgtgaaccaataacccttattaaaaaaccgggggcccaatcgccagagggcatcggtactccggggggaggcccccctttcctgtcccct

SEQ ID NO: 355969 - DNA, 2565 bp, Homo sapiens
cagctgggggtaaggggggcggattattcatataattgttataccagacggtcgcaggcttagtccaattgcagagaactcgcttcccaggcttctgagagtcccggaagtgcctaaacctgtctaatcgacggggcttgggtggcccgtcgctccctggcttcttccctttacccagggcgggcagcgaagtggtgcctcctgcgtcccccacaccctccctcagcccctcccctccggcccgtcctgggcaggtgacctggagcatccggcaggctgccctggcctcctgcgtcaggacaagcccacgaggggcgttactgtgcggagatgcaccacgcaagagacaccctttgtaactctcttctcctccctagtgcgaggttaaaaccttcagccccacgtgctgtttgcaaacctgcctgtacctgaggccctaaaaagccagagacctcactcccggggagccagcatgtccactgcggtcctggaaaacccaggcttgggcaggaaactctctgactttggacaggaaacaagctatattgaagacaactgcaatcaaaatggtgccatatcactgatcttctcactcaaagaagaagttggtgcattggccaaagtattgcgcttatttgaggagaatgatgtaaacctgacccacattgaatctagaccttctcgtttaaagaaagatgagtatgaatttttcacccatttggataaacgtagcctgcctgctctgacaaacatcatcaagatcttgaggcatgacattggtgccactgtccatgagctttcacgagataagaagaaagacacagtgccctggttcccaagaaccattcaagagctggacagatttgccaatcagattctcagctatggagcggaactggatgctgaccaccctggttttaaagatcctgtgtaccgtgcaagacggaagcagtttgctgacattgcctacaactaccgccatgggcagcccatccctcgagtggaatacatggaggaagaaaagaaaacatggggcacagtgttcaagactctgaagtccttgtataaaacccatgcttgctatgagtacaatcacatttttccacttcttgcttgcactggtttccgcctccgacctgtagctggcctgctttcctctcgggatttcttgggtggcctggccttccgagtcttccactgcacacagtacatcagacatggatccaagcccatgtatacccccgaacctgacatctgccatgagctgttgggacatgtgcccttgttttcagatcgcagctttgcccagttttcccaggaaattggccttgcctctctgggtgcacctgatgaatacattgaaaagctcgccacaatttactggtttactgtggagtttgggctctgcaaacaaggagactccataaaggcatatggtgctgggctcctgtcatcctttggtgaattacagtactgcttatcagagaagccaaagcttctccccctggagctggagaagacagccatccatgatgccaaggagaaagtaaggaactttgctgccacaatacctcggcccttctcagttcgctacgacccatacacccaaaggattgaggtcttggacaatacccagcagcttaagattttggctgattccattaacagtgaaattggaatcctttgcagtgccctccagaaaataaagtaaagccatggacagaatgtggtctgtcagctgtgaatctgttgatggagatccaactatttctttcatcagaaaaagtccgaaaagcaaaccttaatttgaaataacagccttaaatcctttacaagatggagaaacaacaaataagtcaaaataatctgaaatgacaggatatgagtacatactcaagagcataatggtaaatcttttggggtcatctttgatttagagatgataatcccatactctcaattgagttaaatcagtaatctgtcgcatttcatcaagattaattaaaatttgggacctgcttcattcaagcttcatatatgctttgcagagaactcataaaggagcatataaggctaaatgtaaaacacaagactgtcattagaattgaattattgggcttaatataaatcgtaacctatgaagtttattttctattttagttaactatgattccaattactactttgttattgtacctaagtaaattttctttaagtcagaagcccattaaaatagttacaagcattgaacttctttagtattatattaatataaaaacatttttgtatgttttattgtaatcataaatactgctgtataaggtaataaaactctgcacctaatccccataacttccagtatcattttccaattaattatcaagtctgttttgggaaacactttgaggacatttatgatgcagcagatgttgactaaaggcttggttggtagatattcaggaaatgttcactgaataaataagtaaatacattattgaaaagcaaatctgtataaatgtgaaatttttatttgtattagtaataaaacattagtagtttaaacaa

SEQ ID NO: 355970 - DNA, 4012 bp, Homo sapiens
cagctgggggtaaggggggcggattattcatataattgttataccagacggtcgcaggcttagtccaattgcagagaactcgcttcccaggcttctgagagtcccggaagtgcctaaacctgtctaatcgacggggcttgggtggcccgtcgctccctggcttcttccctttacccagggcgggcagcgaagtggtgcctcctgcgtcccccacaccctccctcagcccctcccctccggcccgtcctgggcaggtgacctggagcatccggcaggctgccctggcctcctgcgtcaggacaagcccacgaggggcgttactgtgcggagatgcaccacgcaagagacaccctttgtaactctcttctcctccctagtgcgaggttaaaaccttcagccccacgtgctgtttgcaaacctgcctgtacctgaggccctaaaaagccagagacctcactcccggggagccagcatgtccactgcggtcctggaaaacccaggcttgggcaggaaactctctgactttggacaggaaacaagctatattgaagacaactgcaatcaaaatggtgccatatcactgatcttctcactcaaagaagaagttggtgcattggccaaagtattgcgcttatttgaggagaatgatgtaaacctgacccacattgaatctagaccttctcgtttaaagaaagatgagtatgaatttttcacccatttggataaacgtagcctgcctgctctgacaaacatcatcaagatcttgaggcatgacattggtgccactgtccatgagctttcacgagataagaagaaagacacagtgccctggttcccaagaaccattcaagagctggacagatttgccaatcagattctcagctatggagcggaactggatgctgaccaccctggttttaaagatcctgtgtaccgtgcaagacggaagcagtttgctgacattgcctacaactaccgccatgggcagcccatccctcgagtggaatacatggaggaagaaaagaaaacatggggcacagtgttcaagactctgaagtccttgtataaaacccatgcttgctatgagtacaatcacatttttccacttcttgaaaagtactgtggcttccatgaagataacattccccagctggaagacgtttctcagttcctgcagacttgcactggtttccgcctccgacctgtagctggcctgctttcctctcgggatttcttgggtggcctggccttccgagtcttccactgcacacagtacatcagacatggatccaagcccatgtatacccccgaacctgacatctgccatgagctgttgggacatgtgcccttgttttcagatcgcagctttgcccagttttcccaggaaattggccttgcctctctgggtgcacctgatgaatacattgaaaagctcgccacaatttactggtttactgtggagtttgggctctgcaaacaaggagactccataaaggcatatggtgctgggctcctgtcatcctttggtgaattacagtactgcttatcagagaagccaaagcttctccccctggagctggagaagacagccatccaaaattacactgtcacggagttccagcccctgtattacgtggcagagagttttaatgatgccaaggagaaagtaaggaactttgctgccacaatacctcggcccttctcagttcgctacgacccatacacccaaaggattgaggtcttggacaatacccagcagcttaagattttggctgattccattaacagtgaaattggaatcctttgcagtgccctccagaaaataaagtaaagccatggacagaatgtggtctgtcagctgtgaatctgttgatggagatccaactatttctttcatcagaaaaagtccgaaaagcaaaccttaatttgaaataacagccttaaatcctttacaagatggagaaacaacaaataagtcaaaataatctgaaatgacaggatatgagtacatactcaagagcataatggtaaatcttttggggtcatctttgatttagagatgataatcccatactctcaattgagttaaatcagtaatctgtcgcatttcatcaagattaattaaaatttgggacctgcttcattcaagcttcatatatgctttgcagagaactcataaaggagcatataaggctaaatgtaaaacacaagactgtcctattttagttaactatgattccaattactactttgttattgtacctaagtaaattttctttaagtcagaagcccattaaaatagttacaagcattgaacttctttagtattatattaatataaaaacatttttgtatgttttattgtaatcataaatactgctgtataaggtaataaaactctgcacctaatccccataacttccagtatcattttccaattaattatcaagtctgttttgggaaacactttgaggacatttatgatgcagcagatgttgactaaaggcttggttggtagatattcaggaaatgttcactgaataaataagtaaatacattattgaaaagcaaatctgtataaatgtgaaatttttatttgtattagtaataaaacattagtagtttaaacaatttcactgtttcagttatttcctggaatgaaatattcctctcactgccttagaaatacattagctagatagttttgtaacatgagaaaatggccagaggctcatatctccaaccctttgcaggggctccttgtgacactcaaagtcatgcctggacagtcaacggactttgacttttgttgattgtgtgtttgccatgaaaacatgaatatctgagaagcagtggggagaaaaaattttggaaatagttaagtcttaaagaatttgcatagtgtttctttgagtttagttctcagaacagctgtagtatcatcaacagcaaattctgggtaccttcccagctccacccaatttgaatctctgaagataaggcccagagacctgtatttttaagtaccccatttttttaattattcatagccaaattctatcaggtacattcagtttgagaaaacctgatttgtggtggtcagtctgccactgccaatgatgtcaatgtggataagctgtttcccttctttagacctcagtgtcactctaacaatgagggagttaaactttataaaccaaggtccattgcagccttgaaatatgattcaagtgttcatatgtgtctttatatagctatgcctgatccactgatggggtgttacaatacctgcttatatatgccagctgggaggaaagaggaatttactgaatgtgtctgaagtttcattgttttgaagttggaattttatgcctgtatctatgtttatgcctttgtaaaacccactgattttaaaagtgaaaaaggacttttttctctgcttttactctaaacaccaaacaatccctgcaaagggattattctgatgtttcttcatttcacatgaaaagttaattattgactctggaacttaaatattagataatatttttgacaatattgaagagtgagttttagtccagtaaagatgttttaatgagcttgaaggtaaagtttcggttaagttatgattttcacaggaagttacatactgaatgaaagataatatttgtatttttggtaatgtgctactcagttcttagctcttttttatccagatataaaagcccagtctatagctatgggatttaataaatttccaatatgtaagtgtttttatttgtttaatttctagtaaatgagcaatattttagaaacagtatcagtctttactgacagatgatcttgctgagtacaatcaaaataaatacataaaaaattctaagcatgtggcattgatgtttaataagtttctgaaagtaggaatctgaattttaactgtaggtttctaagttatataatttagttgtgtttcaaaaaatccaccaataaaatgtcagctttataaaaacag

SEQ ID NO: 355971 - DNA, 1619 bp, Homo sapiens
cagctgggggtaaggggggcggattattcatataattgttataccagacggtcgcaggcttagtccaattgcagagaactcgcttcccaggcttctgagagtcccggaagtgcctaaacctgtctaatcgacggggcttgggtggcccgtcgctccctggcttcttccctttacccagggcgggcagcgaagtggtgcctcctgcgtcccccacaccctccctcagcccctcccctccggcccgtcctgggcaggtgacctggagcatccggcaggctgccctggcctcctgcgtcaggacaagcccacgaggggcgttactgtgcggagatgcaccacgcaagagacaccctttgtaactctcttctcctccctagtgcgaggttaaaaccttcagccccacgtgctgtttgcaaacctgcctgtacctgaggccctaaaaagccagagacctcactcccggggagccagcatgtccactgcggtcctggaaaacccaggcttgggcaggaaactctctgactttggacaggaaacaagctatattgaagacaactgcaatcaaaatggtgccatatcactgatcttctcactcaaagaagaagttggtgcattggccaaagtattgcgcttatttgaggagaatgatgtaaacctgacccacattgaatctagaccttctcgtttaaagaaagatgagtatgaatttttcacccatttggataaacgtagcctgcctgctctgacaaacatcatcaagatcttgaggcatgacattggtgccactgtccatgagctttcacgagataagaagaaagacacagtgccctggttcccaagaaccattcaagagctggacagatttgccaatcagattctcagctatggagcggaactggatgctgaccaccctggttttaaagatcctgtgtaccgtgcaagacggaagcagtttgctgacattgcctacaactaccgccatgggcagcccatccctcgagtggaatacatggaggaagaaaagaaaacatggggcacagtgttcaagactctgaagtccttgtataaaacccatgcttgctatgagtacaatcacatttttccacttcttgaaaagtactgtggcttccatgaagataacattccccagctggaagacgtttctcagttcctgcagacttgcactggtttccgcctccgacctgtagctggcctgctttcctctcgggatttcttgggtggcctggccttccgagtcttccactgcacacagtacatcagacatggatccaagcccatgtatacccccgaaccgtgagtactgtcctccagctaccagttgccaggcacaatgagcgccatcttttcctgctgcaagaatgaggtttgggttcattgctggctggtccacaggactagttgtctagactgtttgctggtagtactagattggagatttggtcatcctgtgatccaataactcagaactcccttggcagtgagaatgagagatcccaatcaagttccaaagtcaaagctacgaagttgcaaatgagaacaggaacaagtggcagccaagctatctcaatacttcctaagtatacatctagattactctt

SEQ ID NO: 355972 - DNA, 884 bp, Homo sapiens
gcggccgccgcggctgcggccgtggcaaagaaacaggctgcgggcggcaggaagggctgctggggctgcggctggggctgctggccggcgccgccgctctccatcttggcagagctttccatgcgcagcggcggccaaggagtcgcggaatcagagcgatccgggacgcgagtgcgaggttaaaaccttcagccccacgtgctgtttgcaaacctgcctgtacctgaggccctaaaaagccagagacctcactcccggggagccagcatgtccactgcggtcctggaaaacccaggcttgggcaggaaactctctgactttggacaggaaacaagctatattgaagacaactgcaatcaaaatggtgccatatcactgatcttctcactcaaagaagaagttggtgcattggccaaagtattgcgcttatttgaggagaatgatgtaaacctgacccacattgaatctagaccttctcgtttaaagaaagatgagtatgaatttttcacccatttggataaacgtagcctgcctgctctgacaaacatcatcaagatcttgaggcatgacattggtgccactgtccatgagctttcacgagataagaagaaagacacagtgccctggttcccaagaaccattcaagagctggacagatttgccaatcagattctcagctatggagcggaactggatgctgaccaccctgtgagtccatggcccgtaggatgagattttttcagtgcctctcctccactcccctcccttcctcttaccttctctacttggagcaatgtacttgttcacttgttcaacaaacacttattgtgttcctatttacacgagggctgggaaaaattagcaagactttattgtcatcatca

SEQ ID NO: 355973 - DNA, 1817 bp, Homo sapiens
cgctgccgagggcagggcagggcaggcaggcggggtggggcggggcggggatcaagcaggggcagggctggcgctgcggcgggagatgctgtcgggccgcggcggcgcttggcagccaggagctctgcattgaaggcactggggtaaagtgaatgccgaagacagaagatttggatgatacaccactgactttctttgtttggaatacacgttatgaaccctttctggagcatgtctacaagctctgtacgcaaacgatctgaaggtgaagagaagacattaacaggggacgtgaaaaccagtcctccacgaactgcaccaaagaaacagctgccttctattcccaaaaatgctttgcccataactaagcctacatctcctgccccagcagcacagtcaacaaatggcacgcatgcgtcctatggacccttctacctggaatactctcttcttgcagaatttaccttggttgtgaagcagaagctaccaggcgtctatgtgcagccatcttatcgctctgcattaatgtggtttggagtaatattcatacggcatggactttaccaagatggcgtatttaagtttacagtttacatccctgataactatccagatggtgactgtccacgcttggtgttcgatattcctgtctttcacccgctagttgatcccacctcaggtgagctggatgtgaagagagcatttgcaaaatggaggcggaaccataatcatatttggcaggtattaatgtatgcaaggagagttttctacaagattgatacagcaagccccctgaacccagaggctgcagtactgtatgaaaaagatattcagctttttaaaagtaaagttgttgacagtgttaaggtgtgcactgctcgtttgtttgaccaacctaaaatagaagacccctatgcaattagcttttctccatggaatccttctgtacatgatgaagccagagaaaagatgctgactcagaaaaagaagcctgaagaacagcacaataaaagtgttcatgttgctggcctgtcatgggtaaagcctggctcagtacagcctttcagtaaagaagagaaaacagtggcgacttaagagatggtgaatctggtgcaccatgcactttcctgctagactctggcctagttcaagctgaccaatggcagaggactgcctgaagagtaaaactgtgtgaacaatgactgactgccagtgttttccatgtatgcataggttctaacagcagggtttggaaacctgtctctaagtaatgcattacttctgtcagaagtgtcttagggtggttatctagttcagtactccaaattattggggaccttgaggcttaagtaagtatttttctgaatataatgctaaaggtaagttgcattcatttaaactaatagagcagacagaattcagcactacttaatagtttataaatcagtggtttcagttgtatatatgttaggaaatggagaggtatagagagagcaggttccatagctcagcacttttaagtggaagatcatttgaatctcagtcttcagcctgcactgatttgtagcctgcactgtcttactgatttacaaactgaaatcactgagaaatgtctttagttcagtgagaagaaaccagaacacttgttcctagtgttgtgttgttttttttaagcaaattacttactgtatttttatggcaggagggagaaaaagtgttacaacggtttctaatgaagtccggtatttaaatgataaatgactaatgtgtttagtagagacaaaataaaccaataaatgattgttctttgccattta

SEQ ID NO: 355974 - DNA, 1046 bp, Homo sapiens
  misc_feature (768)..(768): n is a, c, g, or t
  misc_feature (1046)..(1046): n is a, c, g, or t
cgctgccgagggcagggcagggcaggcaggcggggtggggcggggcggggatcaagcaggggcagggctggcgctgcggcgggagatgctgtcgggccgcggcggcgcttggcagccaggagctctgcattgaaggcactggggtgaggcttactgcccggcaggctggtgggtaaagtgaatgccgaagacagaagatttggatgatacaccactgactttctttgtttggaatacacgttatgaaccctttctggagcatgtctacaagctctgtacgcaaacgatctgaaggtgaagagaagacattaacaggggacgtgaaaaccagtcctccacgaactgcaccaaagaaacagctgccttctattcccaaaaatgctttgcccataactaagcctacatctcctgccccagcagcacagtcaacaaatggcacgcatgcgtcctatggacccttctacctggaatactctcttcttgcagaatttaccttggttgtgaagcagaagctaccaggcgtctatgtgcagccatcttatcgctctgcattaatgtggtttggagtaatattcatacggcatggactttaccaagatggcgtatttaagtttacagtttacatccctgataactatccagatggtgactgtccacgcttggtgttcgatattcctgtctttcacccgctagttgatcccacctcaggtgagctggatgtgaagagagcatttgcaaaatggagaggcggaaccatatcatattggngggtgttatgcttgccgcgaggttcttaccgagttcgttacgaagcccctgaacccaagctgagtctggttgaaagatttccgttttaggggaaggtggtggacgttaggggcggcctgttggcccttcataagaccctggagtagtctccgggatcctgtgttagggcgagatgtccaaccggaagacaaatattgtgggcgtggtgcaccccaaaaaggagaggagtgtgccctcctcagggaggagaagagagacacagcgagtagctcaggggn

SEQ ID NO: 355975 - DNA, 1846 bp, Homo sapiens
cgctgccgagggcagggcagggcaggcaggcggggtggggcggggcggggatcaagcaggggcagggctggcgctgcggcgggagatgctgtcgggccgcggcggcgcttggcagccaggagctctgcattgaaggcactggggtgaggcttactgcccggcaggctggtgggtaaagtgaatgccgaagacagaagatttggatgatacaccactgactttctttgtttggaatacacgttatgaaccctttctggagcatgtctacaagctctgtacgcaaacgatctgaaggtgaagagaagacattaacaggggacgtgaaaaccagtcctccacgaactgcaccaaagaaacagctgccttctattcccaaaaatgctttgcccataactaagcctacatctcctgccccagcagcacagtcaacaaatggcacgcatgcgtcctatggacccttctacctggaatactctcttcttgcagaatttaccttggttgtgaagcagaagctaccaggcgtctatgtgcagccatcttatcgctctgcattaatgtggtttggagtaatattcatacggcatggactttaccaagatggcgtatttaagtttacagtttacatccctgataactatccagatggtgactgtccacgcttggtgttcgatattcctgtctttcacccgctagttgatcccacctcaggtgagctggatgtgaagagagcatttgcaaaatggaggcggaaccataatcatatttggcaggtattaatgtatgcaaggagagttttctacaagattgatacagcaagccccctgaacccagaggctgcagtactgtatgaaaaagatattcagctttttaaaagtaaagttgttgacagtgttaaggtgtgcactgctcgtttgtttgaccaacctaaaatagaagacccctatgcaattagcttttctccatggaatccttctgtacatgatgaagccagagaaaagatgctgactcagaaaaagaagcctgaagaacagcacaataaaagtgttcatgttgctggcctgtcatgggtaaagcctggctcagtacagcctttcagtaaagaagagaaaacagtggcgacttaagagatggtgaatctggtgcaccatgcactttcctgctagactctggcctagttcaagctgaccaatggcagaggactgcctgaagagtaaaactgtgtgaacaatgactgactgccagtgttttccatgtatgcataggttctaacagcagggtttggaaacctgtctctaagtaatgcattacttctgtcagaagtgtcttagggtggttatctagttcagtactccaaattattggggaccttgaggcttaagtaagtatttttctgaatataatgctaaaggtaagttgcattcatttaaactaatagagcagacagaattcagcactacttaatagtttataaatcagtggtttcagttgtatatatgttaggaaatggagaggtatagagagagcaggttccatagctcagcacttttaagtggaagatcatttgaatctcagtcttcagcctgcactgatttgtagcctgcactgtcttactgatttacaaactgaaatcactgagaaatgtctttagttcagtgagaagaaaccagaacacttgttcctagtgttgtgttgttttttttaagcaaattacttactgtatttttatggcaggagggagaaaaagtgttacaacggtttctaatgaagtccggtatttaaatgataaatgactaatgtgtttagtagagacaaaataaaccaataaatgattgttctttgccattta

SEQ ID NO: 355976 - DNA, 2162 bp, Homo sapiens
cgctgccgagggcagggcagggcaggcaggcggggtggggcggggcggggatcaagcaggggcagggctggcgctgcggcgggagatgctgtcgggccgcggcggcgcttggcagccaggagctctgcattgaaggcactggggcgctcgcgactcggcgacggcggccgcagtgggacacggaggcggggccgggcacctgtgcgcgtttgcaggcacctgctgcgctggccgcctcgcagcccgggactgctgctggggactgcggctggagctgggctggcccggcccgagggagaggggggcccagctggctcgccccggcccgtgcccgccctccccggccgggtcccgaccccgagctctggttaagggggcgtcgccgggccccagagcccccccactggaggggcccgcggctcccgggccagcatcgagctagctgcgaggccaggacagggcccccgccttgcatcacctcgagacaggtaaagtgaatgccgaagacagaagatttggatgatacaccactgactttctttgtttggaatacacgttatgaaccctttctggagcatgtctacaagctctgtacgcaaacgatctgaaggtgaagagaagacattaacaggggacgtgaaaaccagtcctccacgaactgcaccaaagaaacagctgccttctattcccaaaaatgctttgcccataactaagcctacatctcctgccccagcagcacagtcaacaaatggcacgcatgcgtcctatggacccttctacctggaatactctcttcttgcagaatttaccttggttgtgaagcagaagctaccaggcgtctatgtgcagccatcttatcgctctgcattaatgtggtttggagtaatattcatacggcatggactttaccaagatggcgtatttaagtttacagtttacatccctgataactatccagatggtgactgtccacgcttggtgttcgatattcctgtctttcacccgctagttgatcccacctcaggtgagctggatgtgaagagagcatttgcaaaatggaggcggaaccataatcatatttggcaggtattaatgtatgcaaggagagttttctacaagattgatacagcaagccccctgaacccagaggctgcagtactgtatgaaaaagatattcagctttttaaaagtaaagttgttgacagtgttaaggtgtgcactgctcgtttgtttgaccaacctaaaatagaagacccctatgcaattagcttttctccatggaatccttctgtacatgatgaagccagagaaaagatgctgactcagaaaaagaagcctgaagaacagcacaataaaagtgttcatgttgctggcctgtcatgggtaaagcctggctcagtacagcctttcagtaaagaagagaaaacagtggcgacttaagagatggtgaatctggtgcaccatgcactttcctgctagactctggcctagttcaagctgaccaatggcagaggactgcctgaagagtaaaactgtgtgaacaatgactgactgccagtgttttccatgtatgcataggttctaacagcagggtttggaaacctgtctctaagtaatgcattacttctgtcagaagtgtcttagggtggttatctagttcagtactccaaattattggggaccttgaggcttaagtaagtatttttctgaatataatgctaaaggtaagttgcattcatttaaactaatagagcagacagaattcagcactacttaatagtttataaatcagtggtttcagttgtatatatgttaggaaatggagaggtatagagagagcaggttccatagctcagcacttttaagtggaagatcatttgaatctcagtcttcagcctgcactgatttgtagcctgcactgtcttactgatttacaaactgaaatcactgagaaatgtctttagttcagtgagaagaaaccagaacacttgttcctagtgttgtgttgttttttttaagcaaattacttactgtatttttatggcaggagggagaaaaagtgttacaacggtttctaatgaagtccggtatttaaatgataaatgactaatgtgtttagtagagacaaaataaaccaataaatgattgttctttgccattta

SEQ ID NO: 355977 - DNA, 1736 bp, Homo sapiens
aaacaacccggccagagaatgcggcttctgagtgtaagacactgaggcggtgtcacagacaggtaaagtgaatgccgaagacagaagatttggatgatacaccactgactttctttgtttggaatacacgttatgaaccctttctggagcatgtctacaagctctgtacgcaaacgatctgaaggtgaagagaagacattaacaggggacgtgaaaaccagtcctccacgaactgcaccaaagaaacagctgccttctattcccaaaaatgctttgcccataactaagcctacatctcctgccccagcagcacagtcaacaaatggcacgcatgcgtcctatggacccttctacctggaatactctcttcttgcagaatttaccttggttgtgaagcagaagctaccaggcgtctatgtgcagccatcttatcgctctgcattaatgtggtttggagtaatattcatacggcatggactttaccaagatggcgtatttaagtttacagtttacatccctgataactatccagatggtgactgtccacgcttggtgttcgatattcctgtctttcacccgctagttgatcccacctcaggtgagctggatgtgaagagagcatttgcaaaatggaggcggaaccataatcatatttggcaggtattaatgtatgcaaggagagttttctacaagattgatacagcaagccccctgaacccagaggctgcagtactgtatgaaaaagatattcagctttttaaaagtaaagttgttgacagtgttaaggtgtgcactgctcgtttgtttgaccaacctaaaatagaagacccctatgcaattagcttttctccatggaatccttctgtacatgatgaagccagagaaaagatgctgactcagaaaaagaagcctgaagaacagcacaataaaagtgttcatgttgctggcctgtcatgggtaaagcctggctcagtacagcctttcagtaaagaagagaaaacagtggcgacttaagagatggtgaatctggtgcaccatgcactttcctgctagactctggcctagttcaagctgaccaatggcagaggactgcctgaagagtaaaactgtgtgaacaatgactgactgccagtgttttccatgtatgcataggttctaacagcagggtttggaaacctgtctctaagtaatgcattacttctgtcagaagtgtcttagggtggttatctagttcagtactccaaattattggggaccttgaggcttaagtaagtatttttctgaatataatgctaaaggtaagttgcattcatttaaactaatagagcagacagaattcagcactacttaatagtttataaatcagtggtttcagttgtatatatgttaggaaatggagaggtatagagagagcaggttccatagctcagcacttttaagtggaagatcatttgaatctcagtcttcagcctgcactgatttgtagcctgcactgtcttactgatttacaaactgaaatcactgagaaatgtctttagttcagtgagaagaaaccagaacacttgttcctagtgttgtgttgttttttttaagcaaattacttactgtatttttatggcaggagggagaaaaagtgttacaacggtttctaatgaagtccggtatttaaatgataaatgactaatgtgtttagtagagacaaaataaaccaataaatgattgttctttgccattta

SEQ ID NO: 355978 - DNA, 2077 bp, Homo sapiens
cgctgccgagggcagggcagggcaggcaggcggggtggggcggggcggggatcaagcaggggcagggctggcgctgcggcgggagatgctgtcgggccgcggcggcgcttggcagccaggagctctgcattgaaggcactggggtaaagtgaatgccgaagacagaagatttggatgatacaccactgactttctttgtttggaatacacgttatgaaccctttctggagcatgtctacaagctctgtacgcaaacgatctgaaggtgaagagaagacattaacaggggacgtgaaaaccagtcctccacgaactgcaccaaagaaacagctgccttctattcccaaaaatgctttgcccataactaagcctacatctcctgccccagcagcacagtcaacaaatggcacgcatgcgtcctatggacccttctacctggaatactctcttcttgcagaatttaccttggttgtgaagcagaagctaccaggcgtctatgtgcagccatcttatcgctctgcattaatgtggtttggagtaatattcatacggcatggactttaccaagatggcgtatttaagtttacagtttacatccctgataactatccagatggtgactgtccacgcttggtgttcgatattcctgtctttcacccgctagttgatcccacctcaggtgagctggatgtgaagagagcatttgcaaaatggaggcggaaccataatcatatttggcaggtattaatgtatgcaaggagagttttctacaagattgatacagcaagccccctgaacccagaggctgcagtactgtatgaaaaagatattcagctttttaaaagtaaagttgttgacagtgttaaggtgtgcactgctcgtttgtttgaccaacctaaaatagaagacccctatgcaattagcttttctccatggaatccttctgtacatgatgaagccagagaaaagatgctgactcagaaaaagaagcctgaagaacagcacaataaaagtgttcatgttgctggcctgtcatgggtaaagcctggctcagtacagcctttcagtaaagaagagaaaacagtggcgacttaagagatggtgaatctggtgcaccatgcactttcctgctagactctggcctagttcaagctgaccaatggcagaggactgcctgaagagtaaaactgtgtgaacaatgactgactgccagtgttttccatgtatgcataggttctaacagcagggtttggaaacctgtctctaagtaatgcattacttctgtcagaagtgtcttagggtggttatctagttcagtactccaaattattggggaccttgaggcttaagtaagtatttttctgaatataatgctaaaggtaagttgcattcatttaaactaatagagcagacagaattcagcactacttaatagtttataaatcagtggtttcagttgtatatatgttaggaaatggagaggtatagagagagcaggttccatagctcagcacttttaagtggaagatcatttgaatctcagtcttcagcctgcactgatttgtagcctgcactgtcttactgatttacaaactgaaatcactgagaaatgtctttagttcagtgagaagaaaccagaacacttgttcctagtgttgtgttgttttttttaagcaaattacttactgtatttttatggcaggagggagaaaaagtgttacaacggtttctaatgaagtccggtatttaaatgataaatgactaatgtgtttagtagagacaaaataaaccaataaatgattgttctttgccatttatgcaggaaactacccttttctcaatataaccaaacaaaggctaatttataaatgctttattgaaaaatacacttatcttcatataaaattacagtagcagtatcttgagaagttttataaatatttttgcagaacactattctaattgaacaatgtaagttccatatttctctcagcaatatgaagttacctagtaactttgtttatactgattcaatttacaattgaattttctccctaataagattattaatttgact

SEQ ID NO: 355979 - DNA, 1934 bp, Homo sapiens
cgctgccgagggcagggcagggcaggcaggcggggtggggcggggcggggatcaagcaggggcagggctggcgctgcggcgggagatgctgtcgggccgcggcggcgcttggcagccaggagctctgcattgaaggcactggggtaaagtgaatgccgaagacagaagatttggatgatacaccactgactttctttgtttggaatacacgttatgaaccctttctggagcatgtctacaagctctgtacgcaaacgatctgaaggtgaagagaagacattaacaggggacgtgaaaaccagtcctccacgaactgcaccaaagaaacagctgccttctattcccaaaaatgctttgcccataactaagcctacatctcctgccccagcagcacagtcaacaaatggcacgcatgcgtcctatggacccttctacctggaatactctcttcttgcagaatttaccttggttgtgaagcagaagctaccaggcgtctatgtgcagccatcttatcgctctgcattaatgtggtttggagtaatattcatacggcatggactttaccaagatggcgtatttaagtttacagtttacatccctgataactatccagatggtgactgtccattgtccagggggacttctgtgctttgcagcagcttccggcatgccatcagagctttgtttctctgctcagggtctgcaagggaggctggctgcctgccatcctgcagcactcaccagcgcttggtgttcgatattcctgtctttcacccgctagttgatcccacctcaggtgagctggatgtgaagagagcatttgcaaaatggaggcggaaccataatcatatttggcaggtattaatgtatgcaaggagagttttctacaagattgatacagcaagccccctgaacccagaggctgcagtactgtatgaaaaagatattcagctttttaaaagtaaagttgttgacagtgttaaggtgtgcactgctcgtttgtttgaccaacctaaaatagaagacccctatgcaattagcttttctccatggaatccttctgtacatgatgaagccagagaaaagatgctgactcagaaaaagaagcctgaagaacagcacaataaaagtgttcatgttgctggcctgtcatgggtaaagcctggctcagtacagcctttcagtaaagaagagaaaacagtggcgacttaagagatggtgaatctggtgcaccatgcactttcctgctagactctggcctagttcaagctgaccaatggcagaggactgcctgaagagtaaaactgtgtgaacaatgactgactgccagtgttttccatgtatgcataggttctaacagcagggtttggaaacctgtctctaagtaatgcattacttctgtcagaagtgtcttagggtggttatctagttcagtactccaaattattggggaccttgaggcttaagtaagtatttttctgaatataatgctaaaggtaagttgcattcatttaaactaatagagcagacagaattcagcactacttaatagtttataaatcagtggtttcagttgtatatatgttaggaaatggagaggtatagagagagcaggttccatagctcagcacttttaagtggaagatcatttgaatctcagtcttcagcctgcactgatttgtagcctgcactgtcttactgatttacaaactgaaatcactgagaaatgtctttagttcagtgagaagaaaccagaacacttgttcctagtgttgtgttgttttttttaagcaaattacttactgtatttttatggcaggagggagaaaaagtgttacaacggtttctaatgaagtccggtatttaaatgataaatgactaatgtgtttagtagagacaaaataaaccaataaatgattgttctttgccattta

SEQ ID NO: 355980 - DNA, 1718 bp, Homo sapiens
cgctgccgagggcagggcagggcaggcaggcggggtggggcggggcggggatcaagcaggggcagggctggcgctgcggcgggagatgctgtcgggccgcggcggcgcttggcagccaggagctctgcattgaaggcactggggtaaagtgaatgccgaagacagaagatttggatgatacaccactgactttctttgtttggaatacacgttatgaaccctttctggagcatgtctacaagctctgtacgcaaacgatctgaaggtgaagagaagacattaacaggggacgtgaaaaccagtcctccacgaactgcaccaaagaaacagctgccttctattcccaaaaatgctttgcccataactaagcctacatctcctgccccagcagcacagtcaacaaatggcacgcatgcgtcctatggacccttctacctggaatactctcttcttgcagaatttaccttggttgtgaagcagaagctaccaggcgtctatgtgcagccatcttatcgctctgcattaatgtggtttggagtaatattcatacggcatggactttaccaagatggcgtatttaagtttacagtttacatccctgataactatccagatggtgactgtccacgcttggtgttcgatattcctgtctttcacccgctagttgatcccacctcaggtgagctggatgtgaagagagcatttgcaaaatggaggtatgaaaaagatattcagctttttaaaagtaaagttgttgacagtgttaaggtgtgcactgctcgtttgtttgaccaacctaaaatagaagacccctatgcaattagcttttctccatggaatccttctgtacatgatgaagccagagaaaagatgctgactcagaaaaagaagcctgaagaacagcacaataaaagtgttcatgttgctggcctgtcatgggtaaagcctggctcagtacagcctttcagtaaagaagagaaaacagtggcgacttaagagatggtgaatctggtgcaccatgcactttcctgctagactctggcctagttcaagctgaccaatggcagaggactgcctgaagagtaaaactgtgtgaacaatgactgactgccagtgttttccatgtatgcataggttctaacagcagggtttggaaacctgtctctaagtaatgcattacttctgtcagaagtgtcttagggtggttatctagttcagtactccaaattattggggaccttgaggcttaagtaagtatttttctgaatataatgctaaaggtaagttgcattcatttaaactaatagagcagacagaattcagcactacttaatagtttataaatcagtggtttcagttgtatatatgttaggaaatggagaggtatagagagagcaggttccatagctcagcacttttaagtggaagatcatttgaatctcagtcttcagcctgcactgatttgtagcctgcactgtcttactgatttacaaactgaaatcactgagaaatgtctttagttcagtgagaagaaaccagaacacttgttcctagtgttgtgttgttttttttaagcaaattacttactgtatttttatggcaggagggagaaaaagtgttacaacggtttctaatgaagtccggtatttaaatgataaatgactaatgtgtttagtagagacaaaataaaccaataaatgattgttctttgccattta

SEQ ID NO: 355981 - DNA, 1072 bp, Homo sapiens
tatgagggatagttatgtgagaaaattaattagataatgtctaaaacatacatgtcgacaacaataaaaaatactgtgctttattaagttaggggaattggcttaaaactgcaaaatgaatgttatagaaatttagtgagccaacaaatagtttttaaatacttttctcttccttaagcttttctccatggaatccttctgtacatgatgaagccagagaaaagatgctgactcagaaaaagaagcctgaagaacagcacaataaaagtgttcatgttgctggcctgtcatgggtaaagcctggctcagtacagcctttcagtaaagaagagaaaacagtggcgacttaagagatggtgaatctggtgcaccatgcactttcctgctagactctggcctagttcaagctgaccaatggcagaggactgcctgaagagtaaaactgtgtgaacaatgactgactgccagtgttttccatgtatgcataggttctaacagcagggtttggaaacctgtctctaagtaatgcattacttctgtcagaagtgtcttagggtggttatctagttcagtactccaaattattggggaccttgaggcttaagtaagtatttttctgaatataatgctaaaggtaagttgcattcatttaaactaatagagcagacagaattcagcactacttaatagtttataaatcagtggtttcagttgtatatatgttaggaaatggagaggtatagagagagcaggttccatagctcagcacttttaagtggaagatcatttgaatctcagtcttcagcctgcactgatttgtagcctgcactgtcttactgatttacaaactgaaatcactgagaaatgtctttagttcagtgagaagaaaccagaacacttgttcctagtgttgtgttgttttttttaagcaaattacttactgtatttttatggcaggagggagaaaaagtgttacaacggtttctaatgaagtccggtatttaaatgataaatgactaatgtgtttagtagagacaaaataaaccaataaatgattgttctttgccattta

SEQ ID NO: 355982 - DNA, 962 bp, Homo sapiens
tgggccgcgttacctgtacactggtgtttgtaagacgtctaaagatagaaggagcactatgcaattagcttttctccatggaatccttctgtacatgatgaagccagagaaaagatgctgactcagaaaaagaagcctgaagaacagcacaataaaagtgttcatgttgctggcctgtcatgggtaaagcctggctcagtacagcctttcagtaaagaagagaaaacagtggcgacttaagagatggtgaatctggtgcaccatgcactttcctgctagactctggcctagttcaagctgaccaatggcagaggactgcctgaagagtaaaactgtgtgaacaatgactgactgccagtgttttccatgtatgcataggttctaacagcagggtttggaaacctgtctctaagtaatgcattacttctgtcagaagtgtcttagggtggttatctagttcagtactccaaattattggggaccttgaggcttaagtaagtatttttctgaatataatgctaaaggtaagttgcattcatttaaactaatagagcagacagaattcagcactacttaatagtttataaatcagtggtttcagttgtatatatgttaggaaatggagaggtatagagagagcaggttccatagctcagcacttttaagtggaagatcatttgaatctcagtcttcagcctgcactgatttgtagcctgcactgtcttactgatttacaaactgaaatcactgagaaatgtctttagttcagtgagaagaaaccagaacacttgttcctagtgttgtgttgttttttttaagcaaattacttactgtatttttatggcaggagggagaaaaagtgttacaacggtttctaatgaagtccggtatttaaatgataaatgactaatgtgtttagtagagacaaaataaaccaataaatgattgttctttgccattta

SEQ ID NO: 355983 - DNA, 390 bp, Homo sapiens
ggggtgatttgatttgcaggaccgagtgtgttcttcccaacgcccccggaagaacgtctttgacgggcaggtgtgagagccagttggcgccgggaggccaggcggaagcctcgggccccaggatcgtgcagcagggggcggagcccgctgccgagggcagggcagggcaggcaggcggggtggggcggggcggggatcaagcaggggcagggctggcgctgcggcgggagatgctgtcgggccgcggcggcgcttggcagccaggagctctgcattgaaggcactggggtgaggcttactgcccggcaggctggtgggtacgcgagggctgaggtgtctgtaaatctggccgccagcctccacgggcccggcatttgtccatctttctag

SEQ ID NO: 355984 - DNA, 795 bp, Homo sapiens
cgctgccgagggcagggcagggcaggcaggcggggtggggcggggcggggatcaagcaggggcagggctggcgctgcggcgggagatgctgtcgggccgcggcggcgcttggcagccaggagctctgcattgaaggcactggggtaaagtgaatgccgaagacagaagatttggatgatacaccactgactttctttgtttggaatacacgttatgaaccctttctggagcatgtctacaagctctgtacgcaaacgatctgaaggtgaagagaagacattaacaggggacgtgaaaaccagtcctccacgaactgcaccaaagaaacagctgccttctattcccaaaaatgctttgcccataactaagcctacatctcctgccccagcagcacagtcaacaaatggcacgcatgcgtcctatggacccttctacctggaatactctcttcttgcagaatttaccttggttgtgaagcagaagctaccaggcgtctatgtgcagccatcttatcgctctgcattaatgtggtttggagtaatattcatacggcatggactttaccaagatggcgtatttaagtttacagtttacatccctgataactatccagatggtgactgtccacgcttggtgttcgatattcctgtctttcacccgctagttgatcccacctcaggtgagctggatgtgaagagagcatttgcaaaatggagggtaagtaaataaagtgtttcttttagtgacataatacagcaagaggacgcctcggtaatcacgccatgtttcccttta

SEQ ID NO: 355985 - DNA, 1765 bp, Homo sapiens
cgctgccgagggcagggcagggcaggcaggcggggtggggcggggcggggatcaagcaggggcagggctggcgctgcggcgggagatgctgtcgggccgcggcggcgcttggcagccaggagctctgcattgaaggcactggggtaaagtgaatgccgaagacagaagatttggatgatacaccactgactttctttgtttggaatacacgttatgaaccctttctggagcatgtctacaagctctgtacgcaaacgatctgaaggtgaagagaagacattaacaggggacgtgaaaaccagtcctccacgaactgcaccaaagaaacagctgccttctattcccaaaaatgctttgcccataactaagcctacatctcctgccccagcagcacagtcaacaaatggcacgcatgcgtcctatggacccttctacctggaatactctcttcttgcagaatttaccttggttgtgaagcagaagctaccaggcgtctatgtgcagccatcttatcgctctgcattaatgtggtttggagtaatattcatacggcatggactttaccaagatggcgtatttaagtttacagtttacatccctgataactatccagatggtgactgtccacgcttggtgttcgatattcctgtctttcacccgctagttgatcccacctcaggtgagctggatgtgaagagagcatttgcaaaatggaggcggaaccataatcatatttggcaggtattaatgtatgcaaggagagttttctacaagattgatacagcaagccccctgaacccagaggctgcagtactgtatgaaaaagatattcagctttttaaaagtaaagttgttgacagtgttaaggtgtgcactgctcgtttgtttgaccaacctaaaatagaagacccctatgcaattagcttttctccatggaatccttctgtacatgatgaagccagagaaaagatgctgactcagaaaaagaagcctgaagaacagcacaataaaagtgttcatgttgctggcctgtcatgggtaaagcctggctcagtacagcctttcagtaaagaagagaaaacagtggcgacttaagagatggtgaatctggtgcaccatgcactttcctgctagactctggcctagttcaagctgaccaatggcagaggactgcctgaagagttctaacagcagggtttggaaacctgtctctaagtaatgcattacttctgtcagaagtgtcttagggtggttatctagttcagtactccaaattattggggaccttgaggcttaagtaagtatttttctgaatataatgctaaaggtaagttgcattcatttaaactaatagagcagacagaattcagcactacttaatagtttataaatcagtggtttcagttgtatatatgttaggaaatggagaggtatagagagagcaggttccatagctcagcacttttaagtggaagatcatttgaatctcagtcttcagcctgcactgatttgtagcctgcactgtcttactgatttacaaactgaaatcactgagaaatgtctttagttcagtgagaagaaaccagaacacttgttcctagtgttgtgttgttttttttaagcaaattacttactgtatttttatggcaggagggagaaaaagtgttacaacggtttctaatgaagtccggtatttaaatgataaatgactaatgtgtttagtagagacaaaataaaccaataaatgattgttctttgccattta

SEQ ID NO: 355986 - DNA, 369 bp, Homo sapiens
gcggccgcagtgggacacggaggcggggccgggcacctgtgcgcgtttgcaggcacctgctgcgctggccgcctcgcagcccgggactgctgctggggactgcggctggagctgggctggcccggcccgagggagaggggggcccagctggctcgccccggcccgtgcccgccctccccggccgggtcccgaccccgagctctggttaagggggcgtcgccgggccccagagcccccccactggaggggcccgcggctcccgggccagcatcgagctagctgcgaggccaggacagggcccccgccttgcatcacctcgagacaggtttgtccagattccctgagtgctcagagacgggtttccgcccg

SEQ ID NO: 355987 - DNA, 626 bp, Homo sapiens
gtacactcctggcatgcgtgttaccctagcgtgtgctcggtaccgtgacatccatacgcgtgctgtcatgttgtgcatgttcgaaagtgtcgcgtctcacagagggtaggaagcccaccaacaatatcgcgtatgtactataagatctctagctaggcgattgcttagtcgcttgcgtcgtttaatcaacgtttctgggtgtgcctagattgatcggtataaggctcactctcccgccccccaaagtggttgatcgttggaacgagaaaagggccatgttcggagtgtatgacaacatcgggatcctgggaaactttgaaaagcaccccaaagaactgatcagggggcccatatggcttcgaggttggaaagggaatgaattgcaacgttgtatccgaaagaggaaaatggttggaagtagaatgttcgctgatgacctgcacaaccttaataaacgcatccgctatctctacaaacactttaaccgacatgggaagtttcgatagaagagaaagctgagaacttcggaaaaggctcatctgtcaccctggagaagggaaactgtacttttccctgtgaggaaacggctttgtattttctctgtaataaaatggggcttctttgga

SEQ ID NO: 355988 - DNA, 1155 bp, Homo sapiens
gggatctcacccgcggctctgattccggcagtcaggctgaaatgaaaaggaaaaaacacgcgtgcacaacacgcaccaattagcaaggcagttttcaagtcggcggagaatccggccaatccccggcaggcagaggcaaagggccgcctctgagtctggcaacgcgcgggcaaagccacaaataccgagttcaaatctcaacggctgcaggacggccaatcgcgacgcccgccggagcggccggccaatcacagcgccgcccgggggcgggccaaggctccggctccggcccccgctcccacccccggcccgcctgcgaatccctccttggccgcaaggtccccctttgcccagtcggcggggaggaggccgtatttctgctggccagagacgtcgcgtccctggctgggcattcagtcacccccaggaaaggaggcaagtccacgctgggagttagaaggcatcgcctctaatccaggtttcgccatctcctctgctaagtgacgtccagcaagtcacttcactttcaggacctcaaatctcctccccagtagtaaaataggggtaataaaaacagctacagcggaagactgttgtgaggcacagagaaagggcttggtcattggaagcgggttccaggttctcaaccttcatttccttcacggttgaaggacgccaaagaaagcggaaagggtgtgcctagattgatcggtataaggctcactctcccgccccccaaagtggttgatcgttggaacgagaaaagggccatgttcggagtgtatgacaacatcgggatcctgggaaactttgaaaagcaccccaaagaactgatcagggggcccatatggcttcgaggttggaaagggaatgaattgcaacgttgtatccgaaagaggaaaatggttggaagtagaatgttcgctgatgacctgcacaaccttaataaacgcatccgctatctctacaaacactttaaccgacatgggaagtttcgatagaagagaaagctgagaacttcggaaaaggctcatctgtcaccctggagaagggaaactgtacttttccctgtgaggaaacggctttgtattttctctgtaataaaatggggcttctttggaaaaaaaccaaaaaaaaaaaacaaaaaaggggggg

SEQ ID NO: 355989 - DNA, 657 bp, Homo sapiens
  misc_feature (12)..(12): n is a, c, g, or t
ttttttttcttncccccaaagaaaaaaaaacaccctcccttgttaaggcgttcaaagagaccattgtcccctcccggttcttgcgggtgtggatgacgacattagaaatataatttttatcctcaaggatgcctagcagatcgcagctagatgggaggcgacgtctgcttctggttttggctgtaggggaataaaagccaggacttatcgggcagagggctgggactgggcttgcggcaaactttctctgtggctagatgtcggataagccctctccccccccaaaggttgtcgttggacgaaaaagggcatgttggaggtatgcaacatcggattctgggaaactttgaaaagcaccccaaagaactgatcagggggcccatatggcttcgaggttggaaagggaatgaattgcaacgttgtatccgaaagaggaaaatggttggaagtagaatgttcgctgatgacctgcacaaccttaataaacgcatccgctatctctacaaacactttaaccgacatgggaagtttcgatagaagagaaagctgagaacttcggaaaaggctcatctgtcaccctggagaagggaaactgtacttttccctgtgaggaaacggctttgtattttctctgtaataaaatggggcttctttgga

SEQ ID NO: 355990 - DNA, 1522 bp, Homo sapiens
gggatctcacccgcggctctgattccggcagtcaggctgaaatgaaaaggaaaaaacacgcgtgcacaacacgcaccaattagcaaggcagttttcaagtcggcggagaatccggccaatccccggcaggcagaggcaaagggccgcctctgagtctggcaacgcgcgggcaaagccacaaataccgagttcaaatctcaacggctgcaggacggccaatcgcgacgcccgccggagcggccggccaatcacagcgccgcccgggggcgggccaaggctccggctccggcccccgctcccacccccggcccgcctgcgaatccctccttggccgcaaggtccccctttgcccagtcggcggggaggaggccgtatttctgctggccagagacgtcgcgtccctggctgggcattcagtcacccccaggaaaggaggcaagtccacgctgggagttagaaggcatcgcctctaatccaggtttcgccatctcctctgctaagtgacgtccagcaagtcacttcactttcaggacctcaaatctcctccccagtagtaaaataggggtaataaaaacagctacagcggaagactgttgtgaggcacagagaaagggcttggtcattggaagcgggttccaggttctcaaccttcatttccttcacggttgaaggacgccaaagaaagcggaaagggtgaattttcttgaaatctcagttttggggaatcttagcgacgagtcgcggacctcagcttgtccggcgctccaaaacttccggcaggcggaccggaagcactgaggcgggaagggtggtagaggcccctcctgccggaacccggggggcggggctcgtggctgttgcggatggggcgtaggtgggcggtgcgcccacagctgcctgggtaaggcccaagatggctgtcttcgccttagtactcgtgtgaagttggcggggacggttcctgtcatcttcttgggcttatttggtgtgctgttgaaggggggagactagagaaatggcagggaacctcttatccggggcaggtaggcgcctgtgggactgggtgcctctggcgtgcagaagcttctctcttggtgtgcctagattgatcggtataaggctcactctcccgccccccaaagtggttgatcgttggaacgagaaaagggccatgttcggagtgtatgacaacatcgggatcctgggaaactttgaaaagcaccccaaagaactgatcagggggcccatatggcttcgaggttggaaagggaatgaattgcaacgttgtatccgaaagaggaaaatggttggaagtagaatgttcgctgatgacctgcacaaccttaataaacgcatccgctatctctacaaacactttaaccgacatgggaagtttcgatagaagagaaagctgagaacttcggaaaaggctcatctgtcaccctggagaagggaaactgtacttttccctgtgaggaaacggctttgtattttctctgtaataaaatggggcttctttgga

SEQ ID NO: 355991 - DNA, 2183 bp, Homo sapiens
gggatctcacccgcggctctgattccggcagtcaggctgaaatgaaaaggaaaaaacacgcgtgcacaacacgcaccaattagcaaggcagttttcaagtcggcggagaatccggccaatccccggcaggcagaggcaaagggccgcctctgagtctggcaacgcgcgggcaaagccacaaataccgagttcaaatctcaacggctgcaggacggccaatcgcgacgcccgccggagcggccggccaatcacagcgccgcccgggggcgggccaaggctccggctccggcccccgctcccacccccggcccgcctgcgaatccctccttggccgcaaggtccccctttgcccagtcggcggggaggaggccgtatttctgctggccagagacgtcgcgtccctggctgggcattcagtcacccccaggaaaggaggcaagtccacgctgggagttagaaggcatcgcctctaatccaggtttcgccatctcctctgctaagtgacgtccagcaagtcacttcactttcaggacctcaaatctcctccccagtagtaaaataggggtaataaaaacagctacagcggaagactgttgtgaggcacagagaaagggcttggtcattggaagcgggttccaggttctcaaccttcatttccttcacggttgaaggacgccaaagaaagcggaaagggtgaattttcttgaaatctcagttttggggaatcttagcgacgagtcgcggacctcagcttgtccggcgctccaaaacttccggcaggcggaccggaagcactgaggcgggaagggtggtagaggcccctcctgccggaacccggggggcggggctcgtggctgttgcggatggggcgtaggtgggcggtgcgcccacagctgcctgggtaaggcccaagatggctgtcttcgccttagtactcgtgtgaagttggcggggacggttcctgtcatcttcttgggcttatttggtgtgctgttgaaggggggagactagagaaatggcagggaacctcttatccggggcaggtaggcgcctgtgggactgggtgcctctggcgtgcagaagcttctctcttggtgtgcctagattgatcggtataaggctcactctcccgccccccaaagtggttgatcgttggaacgagaaaagggccatgttcggagtgtatgacaacatcgggatcctgggaaactttgaaaagcaccccaaagaactgatcagggggcccatatggcttcgaggttggaaagggaatgaattgcaacgttgtatccgaaagaggaaaatggttggaagtagaatgttcgctgatgacctgcacaaccttaataaacgcatccgctatctctacaaacactttaaccgacatgggaagtttcgatagaagagaaagctgagaacttcggaaaaggctcatctgtcaccctggagaagggaaactgtacttttccctgtgaggaaacggctttgtattttctctgtaataaaatggggcttctttggaatttgatagccacatacttttgttttcctctagatgctgcctctactcatgtagactatgaagtcttgactcatcctagatcttaggatcttaggtttgggcttcacaccacttgccttttacagtctagctatacctaattcctttaaaaagaaaagttggtgagaatgttattggcgctttttgacataatgctgttatgttaatagtgtttctaaagagccttccacactgaaatgaaatataagagaaaaatggagtcatacttctgtactactctcataaaatatttattaggcatattctctgagtaggaactataggaaaaacaaaaaagtgtgaggtgtcctttccatttaaatatgaaacattaagtaccatatgaatggtagagatggcggatactaagcctgactggtcatcagttttctgggtgttttaacatttcaagcctagtcctaacccctaaagattgatcagtagagctgagttgagtctagggcatctatgtgttttgttcttttttaataataatttttaagaattacagctgggcagaatggtgcccacatgtaatcccagcattttgggaggctgaggtgggaggattgcttggagacaggaatttgagactggtctgggcgacatggtgaaactccgt

SEQ ID NO: 355992 - DNA, 1580 bp, Homo sapiens
gggatctcacccgcggctctgattccggcagtcaggctgaaatgaaaaggaaaaaacacgcgtgcacaacacgcaccaattagcaaggcagttttcaagtcggcggagaatccggccaatccccggcaggcagaggcaaagggccgcctctgagtctggcaacgcgcgggcaaagccacaaataccgagttcaaatctcaacggctgcaggacggccaatcgcgacgcccgccggagcggccggccaatcacagcgccgcccgggggcgggccaaggctccggctccggcccccgctcccacccccggcccgcctgcgaatccctccttggccgcaaggtccccctttgcccagtcggcggggaggaggccgtatttctgctggccagagacgtcgcgtccctggctgggcattcagtcacccccaggaaaggaggcaagtccacgctgggagttagaaggcatcgcctctaatccaggtttcgccatctcctctgctaagtgacgtccagcaagtcacttcactttcaggacctcaaatctcctccccagtagtaaaataggggtaataaaaacagctacagcggaagactgttgtgaggcacagagaaagggcttggtcattggaagcgggttccaggttctcaaccttcatttccttcacggttgaaggacgccaaagaaagcggaaagggtgaattttcttgaaatctcagttttggggaatcttagcgacgagtcgcggacctcagcttgtccggcgctccaaaacttccggcaggcggaccggaagcactgaggcgggaagggtggtagaggcccctcctgccggaacccggggggcggggctcgtggctgttgcggatggggcgtaggtgggcggtgcgcccacagctgcctgggtaaggcccaagatggctgtcttcgccttagtactcgtgtgaagttggcggggacggttcctgtcatcttcttgggcttatttggtgtgctgttgaaggggggagactagagaaatggcagggaacctcttatccggggcaggtaggcgcctgtgggactgggtgcctctggcgtgcagaagcttctctcttggtgtgcctagattgatcggtataaggctcactctcccgccccccaaagtggttgatcgttggaacgagaaaagggccatgttcggagtgtatgacaacatcgggatcctgggaaactttgaaaagcaccccaaagaactgatcagggggcccatatggcttcgaggttggaaagggaatgaattgcaacgttgtatccgaaagaggaaaatggttggaagtagaatgttcgctgatgacctgcacaaccttaataaacgcatccgctatctctacaaacactttaaccgacatgggaagtttcgatagaagagaaagctgagaacttcggaaaaggctcatctgtcaccctggagaagggaaactgtacttttccctgtgaggaaacggctttgtattttctctgtaataaaatggggcttctttggaaaaaaaaatcacttcttcctcaactttggcaccaaatcgggaattatttcttcctttc

SEQ ID NO: 355993 - DNA, 1646 bp, Homo sapiens
  misc_feature (1536)..(1536): n is a, c, g, or t
  misc_feature (1539)..(1539): n is a, c, g, or t
gggatctcacccgcggctctgattccggcagtcaggctgaaatgaaaaggaaaaaacacgcgtgcacaacacgcaccaattagcaaggcagttttcaagtcggcggagaatccggccaatccccggcaggcagaggcaaagggccgcctctgagtctggcaacgcgcgggcaaagccacaaataccgagttcaaatctcaacggctgcaggacggccaatcgcgacgcccgccggagcggccggccaatcacagcgccgcccgggggcgggccaaggctccggctccggcccccgctcccacccccggcccgcctgcgaatccctccttggccgcaaggtccccctttgcccagtcggcggggaggaggccgtatttctgctggccagagacgtcgcgtccctggctgggcattcagtcacccccaggaaaggaggcaagtccacgctgggagttagaaggcatcgcctctaatccaggtttcgccatctcctctgctaagtgacgtccagcaagtcacttcactttcaggacctcaaatctcctccccagtagtaaaataggggtaataaaaacagctacagcggaagactgttgtgaggcacagagaaagggcttggtcattggaagcgggttccaggttctcaaccttcatttccttcacggttgaaggacgccaaagaaagcggaaagggtgaattttcttgaaatctcagttttggggaatcttagcgacgagtcgcggacctcagcttgtccggcgctccaaaacttccggcaggcggaccggaagcactgaggcgggaagggtggtagaggcccctcctgccggaacccggggggcggggctcgtggctgttgcggatggggcgtaggtgggcggtgcgcccacagctgcctgggtaaggcccaagatggctgtcttcgccttagtactcgtgtgaagttggcggggacggttcctgtcatcttcttgggcttatttggtgtgctgttgaaggggggagactagagaaatggcagggaacctcttatccggggcaggtaggcgcctgtgggactgggtgcctctggcgtgcagaagcttctctcttggtgtgcctagattgatcggtataaggctcactctcccgccccccaaagtggttgatcgttggaacgagaaaagggccatgttcggagtgtatgacaacatcgggatcctgggaaactttgaaaagcaccccaaagaactgatcagggggcccatatggcttcgaggttggaaagggaatgaattgcaacgttgtatccgaaagaggaaaatggttggaagtagaatgttcgctgatgacctgcacaaccttaataaacgcatccgctatctctacaaacactttaaccgacatgggaagtttcgatagaagagaaagctgagaacttcggaaaaggctcatctgtcaccctggagaagggaaactgtacttttccctgtgaggaaacggctttgtattttctctgtaataaaatggggcttctttggaaaatataactcacncanaaaaaccaggcaacaaagtcaaggccagcatttcttaaacatcaaaactattggcgcggttttacaagtctggactggggaaaccctgccgttcccactttatcccc

SEQ ID NO: 355994 - DNA, 1589 bp, Homo sapiens
gggatctcacccgcggctctgattccggcagtcaggctgaaatgaaaaggaaaaaacacgcgtgcacaacacgcaccaattagcaaggcagttttcaagtcggcggagaatccggccaatccccggcaggcagaggcaaagggccgcctctgagtctggcaacgcgcgggcaaagccacaaataccgagttcaaatctcaacggctgcaggacggccaatcgcgacgcccgccggagcggccggccaatcacagcgccgcccgggggcgggccaaggctccggctccggcccccgctcccacccccggcccgcctgcgaatccctccttggccgcaaggtccccctttgcccagtcggcggggaggaggccgtatttctgctggccagagacgtcgcgtccctggctgggcattcagtcacccccaggaaaggaggcaagtccacgctgggagttagaaggcatcgcctctaatccaggtttcgccatctcctctgctaagtgacgtccagcaagtcacttcactttcaggacctcaaatctcctccccagtaaaacagctacagcggaagactgttgtgaggcacagagaaagggcttggtcattggaagcgggttccaggttctcaaccttcatttccttcacggttgaaggacgccaaagaaagcggaaagggtgaattttcttgaaatctcagttttggggaatcttagcgacgagtcgcggacctcagcttgtccggcgctccaaaacttccggcaggcggaccggaagcactgaggcgggaagggtggtagaggcccctcctgccggaacccggggggcggggctcgtggctgttgcggatggggcgtaggtgggcggtgcgcccacagctgcctgggtaaggcccaagatggctgtcttcgccttagtactcgtgtgaagttggcggggacggttcctgtcatcttcttgggcttatttggtgtgctgttgaaggggggagactagagaaatggcagggaacctcttatccggggcaggtaggcgcctgtgggactgggtgcctctggcgtgcagaagcttctctcttggtaagtggctgatgtaggcaccccgataactgcttcgtagtataataggcggctcagattaattccctcccttccccatccccaggtgtgcctagattgatcggtataaggctcactctcccgccccccaaagtggttgatcgttggaacgagaaaagggccatgttcggagtgtatgacaacatcgggatcctgggaaactttgaaaagcaccccaaagaactgatcagggggcccatatggcttcgaggttggaaagggaatgaattgcaacgttgtatccgaaagaggaaaatggttggaagtagaatgttcgctgatgacctgcacaaccttaataaacgcatccgctatctctacaaacactttaaccgacatgggaagtttcgatagaagagaaagctgagaacttcggaaaaggctcatctgtcaccctggagaagggaaactgtacttttccctgtgaggaaacggctttgtattttctctgtaataaaatggggcttctttgga

SEQ ID NO: 355995 - DNA, 1318 bp, Homo sapiens
  misc_feature (12)..(12): n is a, c, g, or t
ttttttttcttncccccaaagaaaaaaaaacaccctcccttgttaaggcgttcaaagagaccattgtcccctcccggttcttgcgggtgtggatgacgacattagaaatataatttttatcctcaaggatgcctagcagatcgcagctagatgggaggcgacgtctgcttctggttttggctgtaggggaataaaagccaggacttatcgggcagagggctgggactgggcttgcggcaaactttctctgtggctagatgtcggataagccctctccccccccaaaggttgtcgttggacgaaaaagggcatgttggaggtatgcaacatcggattctgggaaactttgaaaagcaccccaaagaactgatcagggggcccatatggcttcgaggttggaaagggaatgaattgcaacgttgtatccgaaagaggaaaatggttggaagtagaatgttcgctgatgacctgcacaaccttaataaacgcatccgctatctctacaaacactttaaccgacatgggaagtttcgatagaagagaaagctgagaacttcggaaaaggctcatctgtcaccctggagaagggaaactgtacttttccctgtgaggaaacggctttgtattttctctgtaataaaatggggcttctttggaatttgatagccacatacttttgttttcctctagatgctgcctctactcatgtagactatgaagtcttgactcatcctagatcttaggatcttaggtttgggcttcacaccacttgccttttacagtctagctatacctaattcctttaaaaagaaaagttggtgagaatgttattggcgctttttgacataatgctgttatgttaatagtgtttctaaagagccttccacactgaaatgaaatataagagaaaaatggagtcatacttctgtactactctcataaaatatttattaggcatattctctgagtaggaactataggaaaaacaaaaaagtgtgaggtgtcctttccatttaaatatgaaacattaagtaccatatgaatggtagagatggcggatactaagcctgactggtcatcagttttctgggtgttttaacatttcaagcctagtcctaacccctaaagattgatcagtagagctgagttgagtctagggcatctatgtgttttgttcttttttaataataatttttaagaattacagctgggcagaatggtgcccacatgtaatcccagcattttgggaggctgaggtgggaggattgcttggagacaggaatttgagactggtctgggcgacatggtgaaactccgt

SEQ ID NO: 355996 - DNA, 1265 bp, Homo sapiens
caaacacttatgtagctgtttacattgtgtttggcactgttctgagtcccctcgtataatttttacttcataagtaaaaataaacagtttttccaaagttaataaatggcagcatcagaattttaaccccaagcagtctggctccagagtctgtgctattgttctgtactgtaatgttccttgtctataggtgctgctcagcaagatgcaaccgtgggttgaaagcttagctggtgtaggatgagttctcttgtcttggatctaatgtgttctctcacattacacaggaaactttgaaaagcaccccaaagaactgatcagggggcccatatggcttcgaggttggaaagggaatgaattgcaacgttgtatccgaaagaggaaaatggttggaagtagaatgttcgctgatgacctgcacaaccttaataaacgcatccgctatctctacaaacactttaaccgacatgggaagtttcgatagaagagaaagctgagaacttcggaaaaggctcatctgtcaccctggagaagggaaactgtacttttccctgtgaggaaacggctttgtattttctctgtaataaaatggggcttctttggaatttgatagccacatacttttgttttcctctagatgctgcctctactcatgtagactatgaagtcttgactcatcctagatcttaggatcttaggtttgggcttcacaccacttgccttttacagtctagctatacctaattcctttaaaaagaaaagttggtgagaatgttattggcgctttttgacataatgctgttatgttaatagtgtttctaaagagccttccacactgaaatgaaatataagagaaaaatggagtcatacttctgtactactctcataaaatatttattaggcatattctctgagtaggaactataggaaaaacaaaaaagtgtgaggtgtcctttccatttaaatatgaaacattaagtaccatatgaatggtagagatggcggatactaagcctgactggtcatcagttttctgggtgttttaacatttcaagcctagtcctaacccctaaagattgatcagtagagctgagttgagtctagggcatctatgtgttttgttcttttttaataataatttttaagaattacagctgggcagaatggtgcccacatgtaatcccagcattttgggaggctgaggtgggaggattgcttggagacaggaatttgagactggtctgggcgacatggtgaaactccgt

SEQ ID NO: 355997 - DNA, 1310 bp, Homo sapiens
gggatctcacccgcggctctgattccggcagtcaggctgaaatgaaaaggaaaaaacacgcgtgcacaacacgcaccaattagcaaggcagttttcaagtcggcggagaatccggccaatccccggcaggcagaggcaaagggccgcctctgagtctggcaacgcgcgggcaaagccacaaataccgagttcaaatctcaacggctgcaggacggccaatcgcgacgcccgccggagcggccggccaatcacagcgccgcccgggggcgggccaaggctccggctccggcccccgctcccacccccggcccgcctgcgaatccctccttggccgcaaggtccccctttgcccagtcggcggggaggaggccgtatttctgctggccagagacgtcgcgtccctggctgggcattcagtcacccccaggaaaggaggcaagtccacgctgggagttagaaggcatcgcctctaatccaggtttcgccatctcctctgctaagtgacgtccagcaagtcacttcactttcaggacctcaaatctcctccccagtaaaacagctacagcggaagactgttgtgaggcacagagaaagggcttggtcattggaagcgggttccaggttctcaaccttcatttccttcacggttgaaggacgccaaagaaagcggaaagggtgaattttcttgaaatctcagttttggggaatcttagcgacgagtcgcggacctcagcttgtccggcgctccaaaacttccggcaggcggaccggaagcactgaggcgggaagggtggtagaggcccctcctgccggaacccggggggcggggctcgtggctgttgcggatggggcgtaggtgggcggtgcgcccacagctgcctgggtaaggcccaagatggctgtcttcgccttagtactcgtgtgaagttggcggggacggttcctgtcatcttcttgggcttatttggtgtgctgttgaaggggggagactagagaaatggcagggaacctcttatccggggcaggtaggcgcctgtgggactgggtgcctctggcgtgcagaagcttctctcttggtaagtggctgatgtaggcaccccgataactgcttcgtagtataataggcggctcagattaattccctcccttccccatccccaggtgtgcctagattgatcggtataaggctcactctcccgccccccaaagtggttgatcgttggaacgagaaaagggccatgttcggagtgtatgacaacatcgggatcctgggtaagacttgaccttcgacgtggtacacaatttcagaa

SEQ ID NO: 355998 - DNA, 1121 bp, Homo sapiens
gggatctcacccgcggctctgattccggcagtcaggctgaaatgaaaaggaaaaaacacgcgtgcacaacacgcaccaattagcaaggcagttttcaagtcggcggagaatccggccaatccccggcaggcagaggcaaagggccgcctctgagtctggcaacgcgcgggcaaagccacaaataccgagttcaaatctcaacggctgcaggacggccaatcgcgacgcccgccggagcggccggccaatcacagcgccgcccgggggcgggccaaggctccggctccggcccccgctcccacccccggcccgcctgcgaatccctccttggccgcaaggtccccctttgcccagtcggcggggaggaggccgtatttctgctggccagagacgtcgcgtccctggctgggcattcagtcacccccaggaaaggaggcaagtccacgctgggagttagaaggcatcgcctctaatccaggtttcgccatctcctctgctaagtgacgtccagcaagtcacttcactttcaggacctcaaatctcctccccagtagtaaaataggggtaataaaaacagctacagcggaagactgttgtgaggcacagagaaagggcttggtcattggaagcgggttccaggttctcaaccttcatttccttcacggttgaaggacgccaaagaaagcggaaagggtgtgcctagattgatcggtataaggctcactctcccgccccccaaagtggttgatcgttggaacgagaaaagggccatgttcggagtgtatgacaacatcgggatcctgggaaactttgaaaagcaccccaaagaactgatcagggggcccatatggcttcgaggttggaaagggaatgaattgcaacgttgtatccgaaagaggaaaatggttggaagtagaatgttcgctgatgacctgcacaaccttaataaacgcatccgctatctctacaaacactttaaccgacatgggaagtttcgatagaagagaaagctgagaacttcggaaaaggctcatctgtcaccctggagaagggaaactgtacttttccctgtgaggaaacggctttgtattttctctgtaataaaatggggcttctttgga

SEQ ID NO: 355999 - DNA, 1030 bp, Homo sapiens
  misc_feature (1030)..(1030): n is a, c, g, or t
gggatctcacccgcggctctgattccggcagtcaggctgaaatgaaaaggaaaaaacacgcgtgcacaacacgcaccaattagcaaggcagttttcaagtcggcggagaatccggccaatccccggcaggcagaggcaaagggccgcctctgagtctggcaacgcgcgggcaaagccacaaataccgagttcaaatctcaacggctgcaggacggccaatcgcgacgcccgccggagcggccggccaatcacagcgccgcccgggggcgggccaaggctccggctccggcccccgctcccacccccggcccgcctgcgaatccctccttggccgcaaggtccccctttgcccagtcggcggggaggaggccgtatttctgctggccagagacgtcgcgtccctggctgggcattcagtcacccccaggaaaggaggtgtgcctagattgatcggtataaggctcactctcccgccccccaaagtggttgatcgttggaacgagaaaagggccatgttcggagtgtatgacaacatcgggatcctgggaaactttgaaaagcaccccaaagaactgatcagggggcccatatggcttcgaggttggaaagggaatgaattgcaacgttgtatccgaaagaggaaaatggttggaagtagaatgttcgctgatgacctgcacaaccttaataaacgcatccgctatctctacaaacactttaaccgacatgggaagtttcgatagaagagaaagctgagaacttcggaaaaggctcatctgtcaccctggagaagggaaactgtacttttccctgtgaggaaacggctttgtattttctctgtaataaaatggggcttctttggaaaaaaaatcctttcccttcccttcccctctcctctctccttctactctaaactatctctcccccttggcctattcaccttttaactcgaacactcttttccttccggccgcatttggcgtcactggccctctcccctatggggactcctttcctccctggccgtccn

SEQ ID NO: 356000 - DNA, 1556 bp, Homo sapiens
gggatctcacccgcggctctgattccggcagtcaggctgaaatgaaaaggaaaaaacacgcgtgcacaacacgcaccaattagcaaggcagttttcaagtcggcggagaatccggccaatccccggcaggcagaggcaaagggccgcctctgagtctggcaacgcgcgggcaaagccacaaataccgagttcaaatctcaacggctgcaggacggccaatcgcgacgcccgccggagcggccggccaatcacagcgccgcccgggggcgggccaaggctccggctccggcccccgctcccacccccggcccgcctgcgaatccctccttggccgcaaggtccccctttgcccagtcggcggggaggaggccgtatttctgctggccagagacgtcgcgtccctggctgggcattcagtcacccccaggaaaggaggcaagtccacgctgggagttagaaggcatcgcctctaatccaggtttcgccatctcctctgctaagtgacgtccagcaagtcacttcactttcaggacctcaaatctcctccccagtagtaaaataggggtaataaaaacagctacagcggaagactgttgtgaggcacagagaaagggcttggtcattggaagcgggttccaggttctcaaccttcatttccttcacggttgaaggacgccaaagaaagcggaaagggtgaattttcttgaaatctcagttttggggaatcttagcgacgagtcgcggacctcagcttgtccggcgctccaaaacttccggcaggcggaccggaagcactgaggcgggaagggtggtagaggcccctcctgccggaacccggggggcggggctcgtggctgttgcggatggggcgtaggtgggcggtgcgcccacagctgcctgggtaaggcccaagatggctgtcttcgccttagtactcgtgtgaagttggcggggacggttcctgtcatcttcttgggcttatttggtgtgctgttgaaggggggagactagagaaatggcagggaacctcttatccggggcaggtaggcgcctgtgggactgggtgcctctggcgtgcagaagcttctctcttggtgtgcctagattgatcggtataaggctcactctcccgccccccaaagtggttgatcgttggaacgagaaaagggccatgttcggagtgtatgacaacatcgggatcctgggaaactttgaaaagcaccccaaagaactgatcagggggcccatatggcttcgaggttggaaagggaatgaattgcaacgttgtatccgaaagaggaaaatggttggaagtagaatgttcgctgatgacctgcacaaccttaataaacgcatccgctatctctacaaacactttaaccgacatgggaagtttcgatagaagagaaagctgagaacttcggaaaaggctcatctgtcaccctggagaagggaaactgtacttttccctgtgaggaaacggctttgtattttctctgtaataaaatggggcttctttggaaaaaaaccaaaaaaaaaaaacaaaaaaggggggg

SEQ ID NO: 356001 - DNA, 1842 bp, Homo sapiens
gggatctcacccgcggctctgattccggcagtcaggctgaaatgaaaaggaaaaaacacgcgtgcacaacacgcaccaattagcaaggcagttttcaagtcggcggagaatccggccaatccccggcaggcagaggcaaagggccgcctctgagtctggcaacgcgcgggcaaagccacaaataccgagttcaaatctcaacggctgcaggacggccaatcgcgacgcccgccggagcggccggccaatcacagcgccgcccgggggcgggccaaggctccggctccggcccccgctcccacccccggcccgcctgcgaatccctccttggccgcaaggtccccctttgcccagtcggcggggaggaggccgtatttctgctggccagagacgtcgcgtccctggctgggcattcagtcacccccaggaaaggaggcaagtccacgctgggagttagaaggcatcgcctctaatccaggtttcgccatctcctctgctaagtgacgtccagcaagtcacttcactttcaggacctcaaatctcctccccagtagtaaaataggggtaataaaaacagctacagcggaagactgttgtgaggcacagagaaagggcttggtcattggaagcgggttccaggttctcaaccttcatttccttcacggttgaaggacgccaaagaaagcggaaagggtgaattttcttgaaatctcagttttggggaatcttagcgacgagtcgcggacctcagcttgtccggcgctccaaaacttccggcaggcggaccggaagcactgaggcgggaagggtggtagaggcccctcctgccggaacccggggggcggggctcgtggctgttgcggatggggcgtaggtgggcggtgcgcccacagctgcctgggtaaggcccaagatggctgtcttcgccttagtactcgtgtgaagttggcggggacggttcctgtcatcttcttgggcttatttggtgtgctgttgaaggggggagactagagaaatggcagggaacctcttatccggggcaggtaggcgcctgtgggactgggtgcctctggcgtgcagaagcttctctcttggtgtgcctagattgatcggtataaggctcactctcccgccccccaaagtggttgatcgttggaacgagaaaagggccatgttcggagtgtatgacaacatcgggatcctgggaaactttgaaaagcaccccaaagaactgatcagggggcccatatggcttcgaggttggaaagggaatgaattgcaacgttgtatccgaaagaggaaaatggttggaagtagaatgttcgctgatgacctgcacaaccttaataaacgcatccgctatctctacaaacactttaaccgacatgggaagtttcgatagaagagaaagctgagaacttcggaaaaggctcatctgtcaccctggagaagggaaactgtacttttccctgtgaggaaacggctttgtattttctctgtaataaaatggggcttctttggaaaagaaaaaaaaaaaagaaaaaaaagaaaaagaaaaaaaagagagaaaagaaaaaaaaaaagaaaaaaaaaaaaaaaacacgtggcggcagcacgcggcgggcacggagaagaggtgaagacacgagcggtgagagagaggagacaacagaggaggagagaggggcaagggggcaacagaaaacagcgaggaaacagagaaggggagagaacacacagaaataaaacgccgcggagaaacagagggagtaaaaagacaacagaaagggagatagcggcagacagggagacacacgaggggcgcaaagagggagaaaaaga

SEQ ID NO: 356002 - DNA, 906 bp, Homo sapiens
gggatctcacccgcggctctgattccggcagtcaggctgaaatgaaaaggaaaaaacacgcgtgcacaacacgcaccaattagcaaggcagttttcaagtcggcggagaatccggccaatccccggcaggcagaggcaaagggccgcctctgagtctggcaacgcgcgggcaaagccacaaataccgagttcaaatctcaacggctgcaggacggccaatcgcgacgcccgccggagcggccggccaatcacagcgccgcccgggggcgggccaaggctccggctccggcccccgctcccacccccggcccgcctgcgaatccctccttggccgcaaggtccccctttgcccagtcggcggggaggaggccgtatttctgctggccagagacgtcgcgtccctggctgggcattcagtcacccccaggaaaggaggcaagtccacgctgggagttagaaggcatcgcctctaatccaggtgtgcctagattgatcggtataaggctcactctcccgccccccaaagtggttgatcgttggaacgagaaaagggccatgttcggagtgtatgacaacatcgggatcctgggaaactttgaaaagcaccccaaagaactgatcagggggcccatatggcttcgaggttggaaagggaatgaattgcaacgttgtatccgaaagaggaaaatggttggaagtagaatgttcgctgatgacctgcacaaccttaataaacgcatccgctatctctacaaacactttaaccgacatgggaagtttcgatagaagagaaagctgagaacttcggaaaaggctcatctgtcaccctggagaagggaaactgtacttttccctgtgaggaaacggctttgtattttctctgtaataaaatggggcttctttgga

SEQ ID NO: 356003 - DNA, 766 bp, Homo sapiens
caaaaacccatagaacgcacaacaccaagagtgagccctcatgtaaactatggactttgggtgagcattgcgtgtcaacataggctcatcagttgtaaccaatatgccactctggtgggagatgttggtaacaggggaggctgtacatacgtgggggcagggatatttgggaaatctctgtacctttgtctcaaattttctataaaaccaaaactactccaaaaaaagtctagtaaaaataaaaaattttggtttataaaggctatcatgttttcccctccaatttcccctctgtcacacttccttccccttgggtagtatgtgaaaagtaccagcagctctcagaatctggccaaagggaagtccaattggggctatactcagttggggtatagtgggatatattacgtgattcccagtcccttccatgtgtagttgttatctgtaaccattgtgatgaaggaatggcttggaggcacacctcagctgcccactgactcatccagagatgtgagaccagggattgtgttgcaatatgaacgtaccctgcagcacctggcactggaagtatggaagtagtggaggggagatgaagttctaaatatgcaatgccaaaagctagtcagtctgtggtacatcgggcagttaattaatagaaatactatattgtttttctgttttctgtgacatttgtggtatttgtcaactttgtaaaatttataaacaaaacttttttctcataataaatattgctttcagttccaat

SEQ ID NO: 356004 - DNA, 345 bp, Homo sapiens
tactactactaaattcgcggccgcgtcgacgacttttttaacccatgtaagaggatggtgttatttcaaatatctcgtggtttcccattcctgaattttgtgcacggcagatgcccatatttggggaaaaaatgcatagaatatgcatcattaatattgttttggcaaacaggcattgagtttcagaacagtgaactatttttagtacatatggcaatttttttcaccttattaaagtgagatgagaacagaccttaaaatagcttttacctcaccatccaaatacctattcagattagttggttgaatagccagcactttgaagtagagccttaggaaaaaaaa

SEQ ID NO: 356005 - DNA, 996 bp, Homo sapiens
aataggctaggtacgaggctgggtgttaatcggccgaggcagcaacctcagggcctccgagagatggcaggctggcacccgccctgcgggcactgcgcctgtcccaggtgtgggtggggcctggtggctgaatttccctttcactttaaactcacgggaaagtctcctgcttttctgcccttgggccagttctcacttatgtggccatgtgagcaaatggacattttttaaagggattcatagcaactcccagacatgtcctcatttcacaatgccgggggaaggtgattagatgagcttttgcatctttgactctactgtgacggaattatcctgcaattgtgcagaaacacccgcacgaattcacgggtgttacaaacagtgcaaacctaacgggacttcactacccacaaggggaggctggacagagccatcgggcccagaggctgtgaacgtgagcttggcctttgggcctgtgtctgggagccggtgttcacagaagccctttgtgcagcacagatggagatgtggggaggtgtttaccattcctgggcccagggcaggctcactttagggattcctgccattcctctaatccagagccttctctccacatccaggtccgggaggtgccgcaggccctaagggagaccagggtattgcaggttccgacggtcttcctggggataaaggagaactgggtcccagcggcctggtcggacccaaaggagaggtgagtgcccggcgactgttccgatgacaccatccatgggcgcctgctggcttcctgcccacctctgggcaaccaggcagccctgcagggcactgcccagatccgagatgtaaaaaagcttgctctggtcaaggctgggcaaaaggtcgcccggtggaaagccttggtgggtctgggctgtgccctggcccttttcgtttctggtggggtggggtggcccgagctcttccggcgcgtttttttgccccctattgggccgggga

SEQ ID NO: 356006 - DNA, 642 bp, Homo sapiens
  misc_feature (555)..(555): n is a, c, g, or t
ggtgggtaggggtggagggtgtcatgtggtggtcctccacccagaatgccggcactgagggagaagctggtcctccaggtctgcctgggcccccgggaccaaagggggccccaggaaagccggggaaaccaggagaggctgggctgccgggactgccgggtgtggatggtctgactggacgagatggaccccctggacccaagggtgcccctggggaacggggaagtctgggacccccggggccgcccgggctggggggcaaaggcctccctggaccccccggagaggcaggagtgagcggccccccaggtgggatcggcctccgcggccccccgggaccttctggactccccggcctccctggtcccccaggacctcccggaccccctggacacccaggagtcctccctgaaggcgctactgaccttcagtgcccaagtatctgcccgccaggtcccccagggccccctggaatgccagggttcaagggacccactggctacaaaggcgagcagggggaagtcggcaaggacggcgagaaggtgacctggcccncctgggccgcggctccgggcagagtggggctgcagggccccgggggattacagaggacggccaggccactcggggccctgggacagg

SEQ ID NO: 356007 - DNA, 2469 bp, Homo sapiens
aggctttgggtctcaccgaggagagcggcggtcgtcgcaggccccggagccgctcgggacccgggaggaggggacgccgggtcaggcccacgggggcacctgcgctccttaatgagttttctccgtttcagagagtgggactccccggcccccccggccccccagggccgcccgggaagcccggccaggacggcattgacggagaagctggtcctccaggtctgcctgggcccccgggaccaaagggggccccaggaaagccggggaaaccaggagaggctgggctgccgggactgccgggtgtggatggtctgactggacgagatggaccccctggacccaagggtgcccctggggaacggggaagtctgggacccccggggccgcccgggctggggggcaaaggcctccctggaccccccggagaggcaggagtgagcggccccccaggtgggatcggcctccgcggccccccgggaccttctggactccccggcctccctggtcccccaggacctcccggaccccctggacacccaggagtcctccctgaaggcgctactgaccttcagtgcccaagtatctgcccgccaggtcccccagggccccctggaatgccagggttcaagggacccactggctacaaaggcgagcagggggaagtcggcaaggacggcgagaagggtgaccctggcccccctgggcccgccggcctcccgggcagcgtggggctgcagggcccccggggattacgaggactgccagggccactcgggccccctggggaccggggtcccattgggttccgagggccgcctgggatcccaggagcgcctgggaaagcgggtgaccgaggcgagaggggcccagaagggttccgcggccccaagggtgacctcggcagacctggtcccaagggaacccccggagtggccgggccaagcggagagccgggcatgccgggcaaggacggccagaatggcgtgccaggactcgatggccagaagggagaggctggtcgcaacggtgctccgggagagaagggccccaacgggctgccgggcctccctggacgagcggggtccaaaggcgagaagggagaacggggcagagctggggagctgggtgaggccggcccctctggagagccaggcgtccctggagatgctggcatgcctggggagcgcggtgaggctggccaccggggctcagcgggggccctcggcccacaaggccctcccggagcccctggtgtccgaggcttccagggccagaagggcagcatgggagaccccggccttccaggcccccagggcctccgaggtgacgtgggcgaccggggtccgggaggtgccgcaggccctaagggagaccagggtattgcaggttccgacggtcttcctggggataaaggagaactgggtcccagcggcctggtcggacccaaaggagagtctggcagtcgaggggagctgggccccaaaggcacccagggtcccaacggcaccagcggtgttcagggtgtccccgggccccccggtcctctgggcctgcagggcgtcccgggtgttcctggcatcacggggaagccgggagttccggggaaggaggccagcgagcagcgcatcagggagctgtgtggggggatgatcagcgaacaaattgcacagttagccgcgcacctaaggaagcctttggcacccgggtccattggtcggcccggtccagctggcccccctgggcccccaggacccccaggctccattggtcaccctggcgctcgaggaccccccggataccgcggtcccactggggagctgggagaccccgggcccagaggaaaccagggtgacagaggagacaaaggcgcggcaggagcagggctggacgggcctgaaggagaccaggggccccaaggaccccaaggcgtgcccggcaccagcaaggacggccaggacggtgctcccggcgagcctgggcctcccggagatcctgggcttccaggtgccattggggcccaggggacaccggggatctgcgacacctcagcctgccaaggagccgtgttaggaggggtcggggagaaatcaggctctcgaagctcataaaattcaacgtgaggaagcaagtgacaaggacgcccgaagcacagtggacggtcatgaaggagcggaggtgtcgcaggcgggtgacgtccaggagagggagcgcccctggctgcccctcggccgccgactggacgcgcgggccttgccagcgagcaccctcatcgggctgtcgcctgacagcatacctcaaaaggccctagctaataaacctgtaagcccagcatttgagagaaggtagggtgtgtatatataaaaggttgtgtacaactccacgaggtgaaaaatattcagtaacttgtttacatagcatttgtgtaaagactatgatctcatcccaataaaatgatatattaaaccttca

SEQ ID NO: 356008 - DNA, 2105 bp, Homo sapiens
tccccctcgtctgagaccttacgctaggtacgggctgggtttgctcccttggacccccggagaggcaggagtgagcggccccccaggtgggatcggcctccgcggccccccgggaccttctggactccccggcctccctggtcccccaggacctcccggaccccctggacacccaggagtcctccctgaaggcgctactgaccttcagtgcccaagtatctgcccgccaggtcccccagggccccctggaatgccagggttcaagggacccactggctacaaaggcgagcagggggaagtcggcaaggacggcgagaagggtgaccctggcccccctgggcccgccggcctcccgggcagcgtggggctgcagggcccccggggattacgaggactgccagggccactcgggccccctggggaccggggtcccattgggttccgagggccgcctgggatcccaggagcgcctgggaaagcgggtgaccgaggcgagaggggcccagaagggttccgcggccccaagggtgacctcggcagacctggtcccaagggaacccccggagtggccgggccaagcggagagccgggcatgccgggcaaggacggccagaatggcgtgccaggactcgatggccagaagggagaggctggtcgcaacggtgctccgggagagaagggccccaacgggctgccgggcctccctggacgagcggggtccaaaggcgagaagggagaacggggcagagctggggagctgggtgaggccggcccctctggagagccaggcgtccctggagatgctggcatgcctggggagcgcggtgaggctggccaccggggctcagcgggggccctcggcccacaaggccctcccggagcccctggtgtccgaggcttccagggccagaagggcagcatgggagaccccggccttccaggcccccagggcctccgaggtgacgtgggcgaccggggtccgggaggtgccgcaggccctaagggagaccagggtattgcaggttccgacggtcttcctggggataaaggagaactgggtcccagcggcctggtcggacccaaaggagagtctggcagtcgaggggagctgggccccaaaggcacccagggtcccaacggcaccagcggtgttcagggtgtccccgggccccccggtcctctgggcctgcagggcgtcccgggtgttcctggcatcacggggaagccgggagttccggggaaggaggccagcgagcagcgcatcagggagctgtgtggggggatgatcagcgaacaaattgcacagttagccgcgcacctaaggaagcctttggcacccgggtccattggtcggcccggtccagctggcccccctgggcccccaggacccccaggctccattggtcaccctggcgctcgaggaccccccggataccgcggtcccactggggagctgggagaccccgggcccagaggaaaccagggtgacagaggagacaaaggcgcggcaggagcagggctggacgggcctgaaggagaccaggggccccaaggaccccaaggcgtgcccggcaccagcaaggacggccaggacggtgctcccggcgagcctgggcctcccggagatcctgggcttccaggtgccattggggcccaggggacaccggggatctgcgacacctcagcctgccaaggagccgtgttaggaggggtcggggagaaatcaggctctcgaagctcataaaattcaacgtgaggaagcaagtgacaaggacgcccgaagcacagtggacggtcatgaaggagcggaggtgtcgcaggcgggtgacgtccaggagagggagcgcccctggctgcccctcggccgccgactggacgcgcgggccttgccagcgagcaccctcatcgggctgtcgcctgacagcatacctcaaaaggccctagctaataaacctgtaagcccagcatttgagagaaggtagggtgtgtatatataaaaggttgtgtacaactccacgaggtgaaaaatattcagtaacttgtttacatagcatttgtgtaaagactatgatctcatcccaataaaatgatatattaaaccttca

SEQ ID NO: 356009 - DNA, 1986 bp, Homo sapiens
gaagtattacgagtcgagtcctgggtgtaatttcatacggggcccgggtacccagtagtctccgctgactggcgctacatgaccttcagtgcccaagtatctgcccgccaggtcccccagggccccctggaatgccagggttcaagggacccactggctacaaaggcgagcagggggaagtcggcaaggacggcgagaagggtgaccctggcccccctgggcccgccggcctcccgggcagcgtggggctgcagggcccccggggattacgaggactgccagggccactcgggccccctggggaccggggtcccattgggttccgagggccgcctgggatcccaggagcgcctgggaaagcgggtgaccgaggcgagaggggcccagaagggttccgcggccccaagggtgacctcggcagacctggtcccaagggaacccccggagtggccgggccaagcggagagccgggcatgccgggcaaggacggccagaatggcgtgccaggactcgatggccagaagggagaggctggtcgcaacggtgctccgggagagaagggccccaacgggctgccgggcctccctggacgagcggggtccaaaggcgagaagggagaacggggcagagctggggagctgggtgaggccggcccctctggagagccaggcgtccctggagatgctggcatgcctggggagcgcggtgaggctggccaccggggctcagcgggggccctcggcccacaaggccctcccggagcccctggtgtccgaggcttccagggccagaagggcagcatgggagaccccggccttccaggcccccagggcctccgaggtgacgtgggcgaccggggtccgggaggtgccgcaggccctaagggagaccagggtattgcaggttccgacggtcttcctggggataaaggagaactgggtcccagcggcctggtcggacccaaaggagagtctggcagtcgaggggagctgggccccaaaggcacccagggtcccaacggcaccagcggtgttcagggtgtccccgggccccccggtcctctgggcctgcagggcgtcccgggtgttcctggcatcacggggaagccgggagttccggggaaggaggccagcgagcagcgcatcagggagctgtgtggggggatgatcagcgaacaaattgcacagttagccgcgcacctaaggaagcctttggcacccgggtccattggtcggcccggtccagctggcccccctgggcccccaggacccccaggctccattggtcaccctggcgctcgaggaccccccggataccgcggtcccactggggagctgggagaccccgggcccagaggaaaccagggtgacagaggagacaaaggcgcggcaggagcagggctggacgggcctgaaggagaccaggggccccaaggaccccaaggcgtgcccggcaccagcaaggacggccaggacggtgctcccggcgagcctgggcctcccggagatcctgggcttccaggtgccattggggcccaggggacaccggggatctgcgacacctcagcctgccaaggagccgtgttaggaggggtcggggagaaatcaggctctcgaagctcataaaattcaacgtgaggaagcaagtgacaaggacgcccgaagcacagtggacggtcatgaaggagcggaggtgtcgcaggcgggtgacgtccaggagagggagcgcccctggctgcccctcggccgccgactggacgcgcgggccttgccagcgagcaccctcatcgggctgtcgcctgacagcatacctcaaaaggccctagctaataaacctgtaagcccagcatttgagagaaggtagggtgtgtatatataaaaggttgtgtacaactccacgaggtgaaaaatattcagtaacttgtttacatagcatttgtgtaaagactatgatctcatcccaataaaatgatatattaaaccttca

SEQ ID NO: 356010 - DNA, 2660 bp, Homo sapiens
aataggctaggtacgaggctgggtgttaatcggccgaggccatggccgggccgcgcgcgtgcgcgccgctcctgctcctgctcctgctcggggagcttctggcggccgccggggcgcagagagtgggactccccggcccccccggccccccagggccgcccgggaagcccggccaggacggcattgacggagaagctggtcctccaggtctgcctgggcccccgggaccaaagggggccccaggaaagccggggaaaccaggagaggctgggctgccgggactgccgggtgtggatggtctgactggacgagatggaccccctggacccaagggtgcccctggggaacggggaagtctgggacccccggggccgcccgggctggggggcaaaggcctccctggaccccccggagaggcaggagtgagcggccccccaggtgggatcggcctccgcggccccccgggaccttctggactccccggcctccctggtcccccaggacctcccggaccccctggacacccaggagtcctccctgaaggcgctactgaccttcagtgcccaagtatctgcccgccaggtcccccagggccccctggaatgccagggttcaagggacccactggctacaaaggcgagcagggggaagtcggcaaggacggcgagaaggccgggggaccaggtctgggatgccctttagcgtggctggagtgatcagatgaggagaccccaggtgcacatcagaggggtccctgcttggccacgaggaggggcctggacagggctgaagggccttgtgggaacagtgaccacggaccccggcccggcagggcgaggccaccgagactcgcgggactgctctggaactgtggggtgaccctggcccccctgggcccgccggcctcccgggcagcgtggggctgcagggcccccggggattacgaggactgccagggccactcgggccccctggggaccggggtcccattgggttccgagggccgcctgggatcccaggagcgcctgggaaagcgggtgaccgaggcgagaggggcccagaagggttccgcggccccaagggtgacctcggcagacctggtcccaagggaacccccggagtggccgggccaagcggagagccgggcatgccgggcaaggacggccagaatggcgtgccaggactcgatggccagaagggagaggctggtcgcaacggtgctccgggagagaagggccccaacgggctgccgggcctccctggacgagcggggtccaaaggcgagaagggagaacggggcagagctggggagctgggtgaggccggcccctctggagagccaggcgtccctggagatgctggcatgcctggggagcgcggtgaggctggccaccggggctcagcgggggccctcggcccacaaggccctcccggagcccctggtgtccgaggcttccagggccagaagggcagcatgggagaccccggccttccaggcccccagggcctccgaggtgacgtgggcgaccggggtccgggaggtgccgcaggccctaagggagaccagggtattgcaggttccgacggtcttcctggggataaaggagaactgggtcccagcggcctggtcggacccaaaggagagtctggcagtcgaggggagctgggccccaaaggcacccagggtcccaacggcaccagcggtgttcagggtgtccccgggccccccggtcctctgggcctgcagggcgtcccgggtgttcctggcatcacggggaagccgggagttccggggaaggaggccagcgagcagcgcatcagggagctgtgtggggggatgatcagcgaacaaattgcacagttagccgcgcacctaaggaagcctttggcacccgggtccattggtcggcccggtccagctggcccccctgggcccccaggacccccaggctccattggtcaccctggcgctcgaggaccccccggataccgcggtcccactggggagctgggagaccccgggcccagaggaaaccagggtgacagaggagacaaaggcgcggcaggagcagggctggacgggcctgaaggagaccaggggccccaaggaccccaaggcgtgcccggcaccagcaaggacggccaggacggtgctcccggcgagcctgggcctcccggagatcctgggcttccaggtgccattggggcccaggggacaccggggatctgcgacacctcagcctgccaaggagccgtgttaggaggggtcggggagaaatcaggctctcgaagctcataaaattcaacgtgaggaagcaagtgacaaggacgcccgaagcacagtggacggtcatgaaggagcggaggtgtcgcaggcgggtgacgtccaggagagggagcgcccctggctgcccctcggccgccgactggacgcgcgggccttgccagcgagcaccctcatcgggctgtcgcctgacagcatacctcaaaaggccctagctaataaacctgtaagcccagcatttgagagaaggtagggtgtgtatatataaaaggttgtgtacaactccacgaggtgaaaaatattcagtaacttgtttacatagcatttgtgtaaagactatgatctcatcccaataaaatgatatattaaaccttca

SEQ ID NO: 356011 - DNA, 3007 bp, Homo sapiens
aataggctaggtacgaggctgggtgttaatcggccgaggccatggccgggccgcgcgcgtgcgcgccgctcctgctcctgctcctgctcggggagcttctggcggccgccggggcgcagagagtgggactccccggcccccccggccccccagggccgcccgggaagcccggccaggacggcattgacggagaagctggtcctccaggtctgcctgggcccccgggaccaaagggggccccaggaaagccggggaaaccaggagaggctgggctgccgggactgccgggtgtggatggtctgactggacgagatggaccccctggacccaagggtgcccctggggaacggggaagtctgggacccccggggccgcccgggctggggggcaaaggcctccctggaccccccggagaggcaggagtgagcggccccccaggtgggatcggcctccgcggccccccgggaccttctggactccccggcctccctggtcccccaggacctcccggaccccctggacacccaggagtcctccctgaaggcgctactgaccttcagtgcccaagtatctgcccgccaggtcccccagggccccctggaatgccagggttcaagggacccactggctacaaaggcgagcagggggaagtcggcaaggacggcgagaagggtgaccctggcccccctgggcccgccggcctcccgggcagcgtggggctgcagggcccccggggattacgaggactgccagggccactcgggccccctggggaccggggtcccattgggttccgagggccgcctgggatcccaggagcgcctgggaaagcgggtgaccgaggcgagaggggcccagaagggttccgcggccccaagggtgacctcggcagacctggtcccaagggaacccccggagtggccgggccaagcggagagccgggcatgccgggcaaggacggccagaatggcgtgccaggactcgatggccagaagggagaggctggtcgcaacggtgctccgggagagaagggccccaacgggctgccgggcctccctggacgagcggggtccaaaggcgagaagggagaacggggcagagctggggagctgggtgaggccggcccctctggagagccaggcgtccctggagatgctggcatgcctggggagcgcggtgaggctggccaccggggctcagcgggggccctcggcccacaaggccctcccggagcccctggtgtccgaggcttccagggccagaagggcagcatgggagaccccggccttccaggcccccagggcctccgaggtgacgtgggcgaccggggtccgggaggtgccgcaggccctaagggagaccagggtattgcaggttccgacggtcttcctggggataaaggagaactgggtcccagcggcctggtcggacccaaaggagagtctggcagtcgaggggagctgggccccaaaggcacccagggtcccaacggcaccagcggtgttcagggtgtccccgggccccccggtcctctgggcctgcagggcgtcccgggtgttcctggcatcacggggaagccgggagttccggggaaggaggccagcgagcagcgcatcagggagctgtgtggggggatgatcagcggtaagtcagccacgtgcaccggctgcagcggggcccatccccgcctgggggtcccgtgcctggggctacacagaaagccttcgtgccactgctttccagccaaagtgagcccctagcactcaccccgcctgttagcccttgggggtccacgtccgccttggcgtctgcctgtcctctgcgctagaggatggcccacgctcccgccccggattcaaccagattcccagcacgcagcagacgccctaaagcctgctgaatgcaatgggtacaagaacagcggagtgtgcccctgtggctggcagggcaggtccctaaacacccccaagggcacttccttcaccttcccactcaggcttctcaggctccaaggggttgggggtcctttctagctccagcattcatcaccccaaagcagttaaaccattttccatcaatcagaaggaaaacttgcttctggaagacagcaccgtgtagatattttatgctttacgtaacaatacttctgatgatcctctctcgagtaaacgcctgcacccttgttttcccaaagaacaaattgcacagttagccgcgcacctaaggaagcctttggcacccgggtccattggtcggcccggtccagctggcccccctgggcccccaggacccccaggctccattggtcaccctggcgctcgaggaccccccggataccgcggtcccactggggagctgggagaccccgggcccagaggaaaccagggtgacagaggagacaaaggcgcggcaggagcagggctggacgggcctgaaggagaccaggggccccaaggaccccaaggcgtgcccggcaccagcaaggacggccaggacggtgctcccggcgagcctgggcctcccggagatcctgggcttccaggtgccattggggcccaggggacaccggggatctgcgacacctcagcctgccaaggagccgtgttaggaggggtcggggagaaatcaggctctcgaagctcataaaattcaacgtgaggaagcaagtgacaaggacgcccgaagcacagtggacggtcatgaaggagcggaggtgtcgcaggcgggtgacgtccaggagagggagcgcccctggctgcccctcggccgccgactggacgcgcgggccttgccagcgagcaccctcatcgggctgtcgcctgacagcatacctcaaaaggccctagctaataaacctgtaagcccagcatttgagagaaggtagggtgtgtatatataaaaggttgtgtacaactccacgaggtgaaaaatattcagtaacttgtttacatagcatttgtgtaaagactatgatctcatcccaataaaatgatatattaaaccttca

SEQ ID NO: 356012 - DNA, 2163 bp, Homo sapiens
aataggctaggtacgaggctgggtgttaatcggccgaggccatggccgggccgcgcgcgtgcgcgccgctcctgctcctgctcctgctcggggagcttctggcggccgccggggcgcagagagtgggactccccggcccccccggccccccagggccgcccgggaagcccggccaggacggcattgacggagaagctggtcctccaggtctgcctgggcccccgggaccaaagggggccccaggaaagccggggaaaccaggagaggctgggctgccgggactgccgggtgtggatggtctgactggacgagatggaccccctggacccaagggtgcccctggggaacggggaagtctgggacccccggggccgcccgggctggggggcaaaggcctccctggaccccccggagaggcaggagtgagcggccccccaggtgggatcggcctccgcggccccccgggaccttctggactccccggcctccctggtcccccaggacctcccggaccccctggacacccaggagtcctccctgaaggcgctactgaccttcagtgcccaagtatctgcccgccaggtcccccagggccccctggaatgccagggttcaagggacccactggctacaaaggcgagcagggggaagtcggcaaggacggcgagaagggtgaccctggcccccctgggcccgccggcctcccgggcagcgtggggctgcagggcccccggggattacgaggactgccagggccactcgggccccctggggaccggggtcccattgggttccgagggccgcctgggatcccaggagcgcctgggaaagcgggtgaccgaggcgagaggggcccagaagggttccgcggccccaagggtgacctcggcagacctggtcccaagggaacccccggagtggccgggccaagcggagagccgggcatgccgggcaaggacggccagaatggcgtgccaggactcgatggccagaagggagaggctggtcgcaacggtgctccgggagagaagggccccaacgggctgccgggcctccctggacgagcggggtccaaaggcgagaagggagaacggggcagagctggggagctgggtgaggccggcccctctggagagccaggcgtccctggagatgctggcatgcctggggagcgcggtgaggctggccaccggggctcagcgggggccctcggcccacaaggccctcccggagcccctggtgtccgaggcttccagggccagaagggcagcatgggagaccccggccttccaggcccccagggcctccgaggtgacgtgggcgaccggggtccgggaggtgccgcaggccctaagggagaccagggtattgcaggttccgacggtcttcctggggataaaggagaactgggtcccagcggcctggtcggacccaaaggagagtctggcagtcgaggggagctgggccccaaaggcacccagggtcccaacggcaccagcggtgttcagggtgtccccgggccccccggtcctctgggcctgcagggcgtcccgggtgttcctggcatcacggggaagccgggagttccggggaaggaggccagcgagcagcgcatcagggagctgtgtggggggatgatcagcgaacaaattgcacagttagccgcgcacctaaggaagcctttggcacccgggtccattggtcggcccggtccagggacaccggggatctgcgacacctcagcctgccaaggagccgtgttaggaggggtcggggagaaatcaggctctcgaagctcataaaattcaacgtgaggaagcaagtgacaaggacgcccgaagcacagtggacggtcatgaaggagcggaggtgtcgcaggcgggtgacgtccaggagagggagcgcccctggctgcccctcggccgccgactggacgcgcgggccttgccagcgagcaccctcatcgggctgtcgcctgacagcatacctcaaaaggccctagctaataaacctgtaagcccagcatttgagagaaggtagggtgtgtatatataaaaggttgtgtacaactccacgaggtgaaaaatattcagtaacttgtttacatagcatttgtgtaaagactatgatctcatcccaataaaatgatatattaaaccttca

SEQ ID NO: 356013 - DNA, 3099 bp, Homo sapiens
aataggctaggtacgaggctgggtgttaatcggccgaggccatggccgggccgcgcgcgtgcgcgccgctcctgctcctgctcctgctcggggagcttctggcggccgccggggcgcagagagtgggactccccggcccccccggccccccagggccgcccgggaagcccggccaggacggcattgacggagaagctggtcctccaggtctgcctgggcccccgggaccaaagggggccccaggaaagccggggaaaccaggagaggctgggctgccgggactgccgggtgtggatggtctgactggacgagatggaccccctggacccaagggtgcccctggggaacggggaagtctgggacccccggggccgcccgggctggggggcaaaggcctccctggaccccccggagaggcaggagtgagcggccccccaggtgggatcggcctccgcggccccccgggaccttctggactccccggcctccctggtcccccaggacctcccggaccccctggacacccaggagtcctccctgaaggcgctactgaccttcagtgcccaagtatctgcccgccaggtcccccagggccccctggaatgccagggttcaagggacccactggctacaaaggcgagcagggggaagtcggcaaggacggcgagaagggtgaccctggcccccctgggcccgccggcctcccgggcagcgtggggctgcagggcccccggggattacgaggactgccagggccactcgggccccctggggaccggggtcccattgggttccgagggccgcctgggatcccaggagcgcctgggaaagcgggtgaccgaggcgagaggggcccagaagggttccgcggccccaagggtgacctcggcagacctggtcccaagggaacccccggagtggccgggccaagcggagagccgggcatgccgggcaaggacggccagaatggcgtgccaggactcgatggccagaagggagaggctggtcgcaacggtgctccgggagagaagggccccaacgggctgccgggcctccctggacgagcggggtccaaaggcgagaagggagaacggggcagagctggggagctgggtgaggccggcccctctggagagccaggcgtccctggagatgctggcatgcctggggagcgcggtgaggctggccaccggggctcagcgggggccctcggcccacaaggccctcccggagcccctggtgtccgaggcttccagggccagaagggcagcatgggagaccccggccttccaggcccccagggcctccgaggtgacgtgggcgaccggggtccgggaggtgccgcaggccctaagggagaccagggtattgcaggttccgacggtcttcctggggataaaggagaactgggtcccagcggcctggtcggacccaaaggagagtctggcagtcgaggggagctgggccccaaaggcacccagggtcccaacggcaccagcggtgttcagggtgtccccgggccccccggtcctctgggcctgcagggcgtcccgggtgttcctggcatcacggggaagccgggagttccggggaaggaggccagcgagcagcgcatcagggagctgtgtggggggatgatcagcggtaagtcagccacgtgcaccggctgcagcggggcccatccccgcctgggggtcccgtgcctggggctacacagaaagccttcgtgccactgctttccagccaaagtgagcccctagcactcaccccgcctgttagcccttgggggtccacgtccgccttggcgtctgcctgtcctctgcgctagaggatggcccacgctcccgccccggattcaaccagattcccagcacgcagcagacgccctaaagcctgctgaatgcaatgggtacaagaacagcggagtgtgcccctgtggctggcagggcaggtccctaaacacccccaagggcacttccttcaccttcccactcaggcttctcaggctccaaggggttgggggtcctttctagctccagcattcatcaccccaaagcagttaaaccattttccatcaatcagaaggaaaacttgcttctggaagacagcaccgtgtagatattttatgctttacgtaacaatacttctgatgatcctctctcgagtaaacgcctgcacccttgttttcccaaagaacaaattgcacagttagccgcgcacctaaggaagcctttggcacccgggtccattggtcggcccggtccagctggcccccctgggcccccaggacccccaggctccattggtcaccctggcgctcgaggaccccccggataccgcggtcccactggggagctgggagaccccgggcccagaggaaaccagggtgacagaggagacaaaggcgcggcaggagcagggctggacgggcctgaaggagaccaggggccccaaggaccccaaggcgtgcccggcaccagcaaggacggccaggacggtgctcccggcgagcctgggcctcccggagatcctgggcttccaggtgccattggggcccaggggacaccggggatctgcgacacctcagcctgccaaggagccgtgttaggaggggtcggggagaaatcaggctctcgaagctcataaaattcaacgtgaggaagcaagtgacaaggacgcccgaagcacagtggacggtcatgaaggagcggaggtgtcgcaggcgggtgacgtccaggagagggagcgcccctggctgcccctcggccgccgactggacgcgcgggccttgccagcgagcaccctcatcgggctgtcgcctgacagcatacctcaaaaggccctagctaataaacctgtaagcccagcatttgagagaaggtagggtgtgtatatataaaaggttgtgtacaactccacgaggtgaaaaatattcagtaacttgtttacatagcatttgtgtaaagactatgatctcatcccaataaaatgatatattaaaccttcagattaatgactggctacagagtaacaaaaaataaagaatttaatgtacagtaaattctctccatacaaaggtctagtctgatgttttgtgta

SEQ ID NO: 356014 - DNA, 1091 bp, Homo sapiens
ctagcgggttatcgtggtctgaactggggataaaggagaactgggtcccagcggcctggtcggacccaaaggagagtctggcagtcgaggggagctgggccccaaaggcacccagggtcccaacggcaccagcggtgttcagggtgtccccgggccccccggtcctctgggcctgcagggcgtcccgggtgttcctggcatcacggggaagccgggagttccggggaaggaggccagcgagcagcgcatcagggagctgtgtggggggatgatcagcgaacaaattgcacagttagccgcgcacctaaggaagcctttggcacccgggtccattggtcggcccggtccagctggcccccctgggcccccaggacccccaggctccattggtcaccctggcgctcgaggaccccccggataccgcggtcccactggggagctgggagaccccgggcccagaggaaaccagggtgacagaggagacaaaggcgcggcaggagcagggctggacgggcctgaaggagaccaggggccccaaggaccccaaggcgtgcccggcaccagcaaggacggccaggacggtgctcccggcgagcctgggcctcccggagatcctgggcttccaggtgccattggggcccaggggacaccggggatctgcgacacctcagcctgccaaggagccgtgttaggaggggtcggggagaaatcaggctctcgaagctcataaaattcaacgtgaggaagcaagtgacaaggacgcccgaagcacagtggacggtcatgaaggagcggaggtgtcgcaggcgggtgacgtccaggagagggagcgcccctggctgcccctcggccgccgactggacgcgcgggccttgccagcgagcaccctcatcgggctgtcgcctgacagcatacctcaaaaggccctagctaataaacctgtaagcccagcatttgagagaaggtagggtgtgtatatataaaaggttgtgtacaactccacgaggtgaaaaatattcagtaacttgtttacatagcatttgtgtaaagactatgatctcatcccaataaaatgatatattaaaccttca

SEQ ID NO: 356015 - DNA, 1981 bp, Homo sapiens
aataggctaggtacgaggctgggtgttaatcggccgaggcagcaacctcagggcctccgagagatggcaggctggcacccgccctgcgggcactgcgcctgtcccaggtgtgggtggggcctggtggctgaatttccctttcactttaaactcacgggaaagtctcctgcttttctgcccttgggccagttctcacttatgtggccatgtgagcaaatggacattttttaaagggattcatagcaactcccagacatgtcctcatttcacaatgccgggggaaggtgattagatgagcttttgcatctttgactctactgtgacggaattatcctgcaattgtgcagaaacacccgcacgaattcacgggtgttacaaacagtgcaaacctaacgggacttcactacccacaaggggaggctggacagagccatcgggcccagaggctgtgaacgtgagcttggcctttgggcctgtgtctgggagccggtgttcacagaagccctttgtgcagcacagatggagatgtggggaggtgtttaccattcctgggcccagggcaggctcactttagggattcctgccattcctctaatccagagccttctctccacatccaggtccgggaggtgccgcaggccctaagggagaccagggtattgcaggttccgacggtcttcctggggataaaggagaactgggtcccagcggcctggtcggacccaaaggagaggtgagtgcccggcgactgttccgatgacaccatccatgggcgcctgctggcttcctgcccacctctgggcaaccaggcagccctgcagggcactgcccagatccgagatgtaaaaaagcttgctctggtcaaggctgggcaagacggctccgtgccggctgggaaagagcacgtcggggtggctctgggctcctgggctcgcccctgacccaccttcctctgttcctctgcagtctggcagtcgaggggagctgggccccaaaggcacccagggtcccaacggcaccagcggtgttcagggtgtccccgggccccccggtcctctgggcctgcagggcgtcccgggtgttcctggcatcacggggaagccgggagttccggggaaggaggccagcgagcagcgcatcagggagctgtgtggggggatgatcagcgaacaaattgcacagttagccgcgcacctaaggaagcctttggcacccgggtccattggtcggcccggtccagctggcccccctgggcccccaggacccccaggctccattggtcaccctggcgctcgaggaccccccggataccgcggtcccactggggagctgggagaccccgggcccagaggaaaccagggtgacagaggagacaaaggcgcggcaggagcagggctggacgggcctgaaggagaccaggggccccaaggaccccaaggcgtgcccggcaccagcaaggacggccaggacggtgctcccggcgagcctgggcctcccggagatcctgggcttccaggtgccattggggcccaggggacaccggggatctgcgacacctcagcctgccaaggagccgtgttaggaggggtcggggagaaatcaggctctcgaagctcataaaattcaacgtgaggaagcaagtgacaaggacgcccgaagcacagtggacggtcatgaaggagcggaggtgtcgcaggcgggtgacgtccaggagagggagcgcccctggctgcccctcggccgccgactggacgcgcgggccttgccagcgagcaccctcatcgggctgtcgcctgacagcatacctcaaaaggccctagctaataaacctgtaagcccagcatttgagagaaggtagggtgtgtatatataaaaggttgtgtacaactccacgaggtgaaaaatattcagtaacttgtttacatagcatttgtgtaaagactatgatctcatcccaataaaatgatatattaaaccttca

SEQ ID NO: 356016 - DNA, 1008 bp, Homo sapiens
  misc_feature (26)..(27): n is a, c, g, or t
aaacataggctaggtactgggccaanntaccaggtcccaacggcaccagcggtgttcagggtgtccccgggccccccggtcctctgggcctgcagggcgtcccgggtgttcctggcatcacggggaagccgggagttccggggaaggaggccagcgagcagcgcatcagggagctgtgtggggggatgatcagcgaacaaattgcacagttagccgcgcacctaaggaagcctttggcacccgggtccattggtcggcccggtccagctggcccccctgggcccccaggacccccaggctccattggtcaccctggcgctcgaggaccccccggataccgcggtcccactggggagctgggagaccccgggcccagaggaaaccagggtgacagaggagacaaaggcgcggcaggagcagggctggacgggcctgaaggagaccaggggccccaaggaccccaaggcgtgcccggcaccagcaaggacggccaggacggtgctcccggcgagcctgggcctcccggagatcctgggcttccaggtgccattggggcccaggggacaccggggatctgcgacacctcagcctgccaaggagccgtgttaggaggggtcggggagaaatcaggctctcgaagctcataaaattcaacgtgaggaagcaagtgacaaggacgcccgaagcacagtggacggtcatgaaggagcggaggtgtcgcaggcgggtgacgtccaggagagggagcgcccctggctgcccctcggccgccgactggacgcgcgggccttgccagcgagcaccctcatcgggctgtcgcctgacagcatacctcaaaaggccctagctaataaacctgtaagcccagcatttgagagaaggtagggtgtgtatatataaaaggttgtgtacaactccacgaggtgaaaaatattcagtaacttgtttacatagcatttgtgtaaagactatgatctcatcccaataaaatgatatattaaaccttca

SEQ ID NO: 356017 - DNA, 981 bp, Homo sapiens
  misc_feature (85)..(85): n is a, c, g, or t
aaaaaatacgggctaagagtacgaaggccccccgttggtttaaattcgtgcacgaatggggtggatgctcacgatgtgcgccccntgctgacgaatgtgtggggtgaattccagggaaggaggccagcgagcagcgcatcagggagctgtgtggggggatgatcagcgaacaaattgcacagttagccgcgcacctaaggaagcctttggcacccgggtccattggtcggcccggtccagctggcccccctgggcccccaggacccccaggctccattggtcaccctggcgctcgaggaccccccggataccgcggtcccactggggagctgggagaccccgggcccagaggaaaccagggtgacagaggagacaaaggcgcggcaggagcagggctggacgggcctgaaggagaccaggggccccaaggaccccaaggcgtgcccggcaccagcaaggacggccaggacggtgctcccggcgagcctgggcctcccggagatcctgggcttccaggtgccattggggcccaggggacaccggggatctgcgacacctcagcctgccaaggagccgtgttaggaggggtcggggagaaatcaggctctcgaagctcataaaattcaacgtgaggaagcaagtgacaaggacgcccgaagcacagtggacggtcatgaaggagcggaggtgtcgcaggcgggtgacgtccaggagagggagcgcccctggctgcccctcggccgccgactggacgcgcgggccttgccagcgagcaccctcatcgggctgtcgcctgacagcatacctcaaaaggccctagctaataaacctgtaagcccagcatttgagagaaggtagggtgtgtatatataaaaggttgtgtacaactccacgaggtgaaaaatattcagtaacttgtttacatagcatttgtgtaaagactatgatctcatcccaataaaatgatatattaaaccttca

SEQ ID NO: 356018 - DNA, 1209 bp, Homo sapiens
ccaagggctgtgtttggagcgggttaaaaggcagccctggggcctgggcttttggcctcgaccttaagatgaacattacacctacggaggcttgagagcagggactttaaggcatgaagtccctactcatgcatgaacagctcttttaactttggggtgtatcgttttcagggtattgcaggttccgacggtcttcctggggataaaggagaactgggtcccagcggcctggtcggacccaaaggagagtctggcagtcgaggggagctgggccccaaaggcacccagggtcccaacggcaccagcggtgttcagggtgtccccgggccccccggtcctctgggcctgcagggcgtcccgggtgttcctggcatcacggggaagccgggagttccgaacaaattgcacagttagccgcgcacctaaggaagcctttggcacccgggtccattggtcggcccggtccagctggcccccctgggcccccaggacccccaggctccattggtcaccctggcgctcgaggaccccccggataccgcggtcccactggggagctgggagaccccgggcccagaggaaaccagggtgacagaggagacaaaggcgcggcaggagcagggctggacgggcctgaaggagaccaggggccccaaggaccccaaggcgtgcccggcaccagcaaggacggccaggacggtgctcccggcgagcctgggcctcccggagatcctgggcttccaggtgccattggggcccaggggacaccggggatctgcgacacctcagcctgccaaggagccgtgttaggaggggtcggggagaaatcaggctctcgaagctcataaaattcaacgtgaggaagcaagtgacaaggacgcccgaagcacagtggacggtcatgaaggagcggaggtgtcgcaggcgggtgacgtccaggagagggagcgcccctggctgcccctcggccgccgactggacgcgcgggccttgccagcgagcaccctcatcgggctgtcgcctgacagcatacctcaaaaggccctagctaataaacctgtaagcccagcatttgagagaaggtagggtgtgtatatataaaaggttgtgtacaactccacgaggtgaaaaatattcagtaacttgtttacatagcatttgtgtaaagactatgatctcatcccaataaaatgatatattaaaccttca

SEQ ID NO: 356019 - DNA, 904 bp, Homo sapiens
aataggctaggtacgaggctgggtgttaatcggccgaggccatggccgggccgcgcgcgtgcgcgccgctcctgctcctgctcctgctcggggagcttctggcggccgccggggcgcagagagtgggactccccggcccccccggccccccagggccgcccgggaagcccggccaggacggcattgacggagctgtgtggggggatgatcagcgaacaaattgcacagttagccgcgcacctaaggaagcctttggcacccgggtccattggtcggcccggtccagctggcccccctgggcccccaggacccccagggctggacgggcctgaaggagaccaggggccccaaggaccccaaggcgtgcccggcaccagcaaggacggccaggacggtgctcccggcgagcctgggcctcccggagatcctgggcttccaggtgccattggggcccaggggacaccggggatctgcgacacctcagcctgccaaggagccgtgttaggaggggtcggggagaaatcaggctctcgaagctcataaaattcaacgtgaggaagcaagtgacaaggacgcccgaagcacagtggacggtcatgaaggagcggaggtgtcgcaggcgggtgacgtccaggagagggagcgcccctggctgcccctcggccgccgactggacgcgcgggccttgccagcgagcaccctcatcgggctgtcgcctgacagcatacctcaaaaggccctagctaataaacctgtaagcccagcatttgagagaaggtagggtgtgtatatataaaaggttgtgtacaactccacgaggtgaaaaatattcagtaacttgtttacatagcatttgtgtaaagactatgatctcatcccaataaaatgatatattaaaccttca

SEQ ID NO: 356020 - DNA, 2074 bp, Homo sapiens
aataggctaggtacgaggctgggtgttaatcggccgaggccatggccgggccgcgcgcgtgcgcgccgctcctgctcctgctcctgctcggggagcttctggcggccgccggggcgcagagagtgggactccccggcccccccggccccccagggccgcccgggaagcccggccaggacggcattgacggagaagctggtcctccaggtctgcctgggcccccgggaccaaagggggccccaggaaagccggggaaaccaggagaggctgggctgccgggactgccgggtgtggatggtctgactggacgagatggaccccctggacccaagggtgcccctggggaacggggaagtctgggacccccggggccgcccgggctggggggcaaaggcctccctggaccccccggagaggcaggagtgagcggccccccaggtgggatcggcctccgcggccccccgggaccttctggactccccggcctccctggtcccccaggacctcccggaccccctggacacccaggagtcctccctgaaggcgctactgaccttcagtgcccaagtatctgcccgccaggtcccccagggccccctggaatgccagggttcaagggacccactggctacaaaggcgagcagggggaagtcggcaaggacggcgagaagggtgaccctggcccccctgggcccgccggcctcccgggcagcgtggggctgcagggcccccggggattacgaggactgccagggccactcgggccccctggggaccggggtcccattgggttccgagggccgcctgggatcccaggagcgcctgggaaagcgggtgaccgaggcgagaggggcccagaagggttccgcggccccaagggtgacctcggcagacctggtcccaagggaacccccggagtggccgggccaagcggagagccgggcatgccgggcaaggacggccagaatggcgtgccaggactcgatggccagaagggagaggctggtcgcaacggtgctccgggagagaagggccccaacgggctgccgggcctccctggacgagcggggtccaaaggcgagaagggagaacggggcagagctggggagctgggtgaggccggcccctctggagagccaggcgtccctggagatgctggcatgcctggggagcgcggtgaggctggccaccggggctcagcgggggccctcggcccacaaggccctcccggagcccctggtgtccgaggcttccagggccagaagggcagcatgggagaccccggccttccaggcccccagggcctccgaggtgacgtgggcgaccggggtccgggaggtgccgcaggccctaagggagaccagggtattgcaggttccgacggtcttcctggggataaaggagaactgggtcccagcggcctggtcggacccaaaggagagtctggcagtcgaggggagctgggccccaaaggcacccagggtcccaacggcaccagcggtgttcagggtgtccccgggccccccggtcctctgggcctgcagggcgtcccgggtgttcctggcatcacggggaagccgggagttccggggaaggaggccagcgagcagcgcatcagggagctgtgtggggggatgatcagcgaacaaattgcacagttagccgcgcacctaaggaagcctttggcacccgggtccattggtcggcccggtccagctggcccccctgggcccccaggacccccaggctccattggtcaccctggcgctcgaggaccccccggataccgcggtcccactggggagctgggagaccccgggcccagaggaaaccagggtgacagaggagacaaaggcgcggcaggagcagggctggacgggcctgaaggagaccaggggccccaaggaccccaaggcgtgcccggcaccagcaaggacggccaggacggtgctcccggcgagcctgggcctcccggagatcctgggcttccaggtgccattggggcccagggggaaccaaccgggggaatcttggcgaaaaccttcaagcccttggcccaaaggggaacggccag

SEQ ID NO: 356021 - DNA, 189 bp, Homo sapiens
tttgtgtctgtggccggggcgaggggcatctgtgaggatggctggctttagcctgtagcctcccctcacctgtggtcgctgtccgtggagggtgtctgtccatggtcacctgcaggccgggggaccaggtctgggatgccctttagcgtggctggagtgatcagatgaggagaccccaggtgcacatca

SEQ ID NO: 356022 - DNA, 795 bp, Homo sapiens
tgggcttagtagagcatgggtgttaaataaggcagaggggaagctggaaggtaagggagaagggtgaccctggcccccctgggcccgccggcctcccgggcagcgtggggctgcagggcccccggggattacgaggactgccagggccactcgggccccctggggaccggggtcccattgggttccgagggccgcctgggatcccaggagcgcctgggaaagcgggtgaccgaggcgagaggggcccagaagggttccgcggccccaagggtgacctcggcagacctggtcccaagggaacccccggagtggccgggccaagcggagagccgggcatgccgggcaaggacggccagaatggcgtgccaggactcgatggccagaagggagaggctggtcgcaacggtgctccgggagagaagggccccaacgggctgccgggcctccctggacgagcggggtccaaaggcgagaagggagaacggggcagagctggggagctgggtgaggccggcccctctggagagccaggcgtccctggagatgctggcatgcctggggagcgcggtgaggctggccaccggggctcagcgggggccctcggcccacaaggccctcccggagcccctggtgtccgaggcttccaggccagaagggcagcatgggagacccggcttccaggcccagcctcgaggtgcgtgggacgggtcgggaggcgcggcctaggaacaggttgagtcgaggtctggaaaaggactggcccggcgtcgcaggaggaggcgaagccgcgtggga

SEQ ID NO: 356023 - DNA, 2457 bp, Homo sapiens
aataggctaggtacgaggctgggtgttaatcggccgaggccatggccgggccgcgcgcgtgcgcgccgctcctgctcctgctcctgctcggggagcttctggcggccgccggggcgcagagagtgggactccccggcccccccggccccccagggccgcccgggaagcccggccaggacggcattgacggagaagctggtcctccaggtctgcctgggcccccgggaccaaagggggccccaggaaagccggggaaaccaggagaggctgggctgccgggactgccgggtgtggatggtctgactggacgagatggaccccctggacccaagggtgcccctggggaacggggaagtctgggacccccggggccgcccgggctggggggcaaaggcctccctggaccccccggagaggcaggagtgagcggccccccaggtgggatcggcctccgcggccccccgggaccttctggactccccggcctccctggtcccccaggacctcccggaccccctggacacccaggagtcctccctgaaggcgctactgaccttcagtgcccaagtatctgcccgccaggtcccccagggccccctggaatgccagggttcaagggacccactggctacaaaggcgagcagggggaagtcggcaaggacggcgagaagggtgaccctggcccccctgggcccgccggcctcccgggcagcgtggggctgcagggcccccggggattacgaggactgccagggccactcgggccccctggggaccggggtcccattgggttccgagggccgcctgggatcccaggagcgcctgggaaagcgggtgaccgaggcgagaggggcccagaagggttccgcggccccaagggtgacctcggcagacctggtcccaagggaacccccggagtggccgggccaagcggagagccgggcatgccgggcaaggacggccagaatggcgtgccaggactcgatggccagaagggagaggctggtcgcaacggtgctccgggagagaagggccccaacgggctgccgggcctccctggacgagcggggtccaaaggcgagaagggagaacggggcagagctggggagctgggtgaggccggcccctctggagagccaggcgtccctggagatgctggcatgcctggggagcgcggtgaggctggccaccggggctcagcgggggccctcggcccacaaggccctcccggagcccctggtgtccgaggcttccagggccagaagggcagcatgggagaccccggccttccaggcccccagggcctccgaggtgacgtgggcgaccggggtccgggaggtgccgcaggccctaagggagaccagggtattgcaggttccgacggtcttcctggggataaaggagaactgggtcccagcggcctggtcggacccaaaggagagtctggcagtcgaggggagctgggccccaaaggcacccagggtcccaacggcaccagcggtgttcagggtgtccccgggccccccggtcctctgggcctgcagggcgtcccgggtgttcctggcatcacggggaagccgggagttccggggaaggaggccagcgagcagcgcatcagggagctgtgtggggggatgatcagcgaacaaattgcacagttagccgcgcacctaaggaagcctttggcacccgggtccattggtcggcccggtccagctggcccccctgggcccccaggacccccaggctccattggtcaccctggcgctcgaggaccccccggataccgcggtcccactggggagctgggagaccccgggcccagaggaaaccagggtgacagaggagacaaaggcgcggcaggagcagggctggacgggcctgaaggagaccaggggccccaaggaccccaaggcgtgcccggcaccagcaaggacggccaggacggtgctcccggcgagcctgggcctcccggagatcctgggcttccaggtgccattggggcccaggggacaccggggatctgcgacacctcagcctgccaaggagccgtgttaggaggggtcggggagaaatcaggctctcgaagctcataaaattcaacgtgaggaagcaagtgacaaggacgcccgaagcacagtggacggtcatgaaggagcggaggtgtcgcaggcgggtgacgtccaggagagggagcgcccctggctgcccctcggccgccgactggacgcgcgggccttgccagcgagcaccctcatcgggctgtcgcctgacagcatacctcaaaaggccctagctaataaacctgtaagcccagcatttgagagaaggtagggtgtgtatatataaaaggttgtgtacaactccacgaggtgaaaaatattcagtaacttgtttacatagcatttgtgtaaagactatgatctcatcccaataaaatgatatattaaaccttca

SEQ ID NO: 356024 - DNA, 2549 bp, Homo sapiens
aataggctaggtacgaggctgggtgttaatcggccgaggccatggccgggccgcgcgcgtgcgcgccgctcctgctcctgctcctgctcggggagcttctggcggccgccggggcgcagagagtgggactccccggcccccccggccccccagggccgcccgggaagcccggccaggacggcattgacggagaagctggtcctccaggtctgcctgggcccccgggaccaaagggggccccaggaaagccggggaaaccaggagaggctgggctgccgggactgccgggtgtggatggtctgactggacgagatggaccccctggacccaagggtgcccctggggaacggggaagtctgggacccccggggccgcccgggctggggggcaaaggcctccctggaccccccggagaggcaggagtgagcggccccccaggtgggatcggcctccgcggccccccgggaccttctggactccccggcctccctggtcccccaggacctcccggaccccctggacacccaggagtcctccctgaaggcgctactgaccttcagtgcccaagtatctgcccgccaggtcccccagggccccctggaatgccagggttcaagggacccactggctacaaaggcgagcagggggaagtcggcaaggacggcgagaagggtgaccctggcccccctgggcccgccggcctcccgggcagcgtggggctgcagggcccccggggattacgaggactgccagggccactcgggccccctggggaccggggtcccattgggttccgagggccgcctgggatcccaggagcgcctgggaaagcgggtgaccgaggcgagaggggcccagaagggttccgcggccccaagggtgacctcggcagacctggtcccaagggaacccccggagtggccgggccaagcggagagccgggcatgccgggcaaggacggccagaatggcgtgccaggactcgatggccagaagggagaggctggtcgcaacggtgctccgggagagaagggccccaacgggctgccgggcctccctggacgagcggggtccaaaggcgagaagggagaacggggcagagctggggagctgggtgaggccggcccctctggagagccaggcgtccctggagatgctggcatgcctggggagcgcggtgaggctggccaccggggctcagcgggggccctcggcccacaaggccctcccggagcccctggtgtccgaggcttccagggccagaagggcagcatgggagaccccggccttccaggcccccagggcctccgaggtgacgtgggcgaccggggtccgggaggtgccgcaggccctaagggagaccagggtattgcaggttccgacggtcttcctggggataaaggagaactgggtcccagcggcctggtcggacccaaaggagagtctggcagtcgaggggagctgggccccaaaggcacccagggtcccaacggcaccagcggtgttcagggtgtccccgggccccccggtcctctgggcctgcagggcgtcccgggtgttcctggcatcacggggaagccgggagttccggggaaggaggccagcgagcagcgcatcagggagctgtgtggggggatgatcagcgaacaaattgcacagttagccgcgcacctaaggaagcctttggcacccgggtccattggtcggcccggtccagctggcccccctgggcccccaggacccccaggctccattggtcaccctggcgctcgaggaccccccggataccgcggtcccactggggagctgggagaccccgggcccagaggaaaccagggtgacagaggagacaaaggcgcggcaggagcagggctggacgggcctgaaggagaccaggggccccaaggaccccaaggcgtgcccggcaccagcaaggacggccaggacggtgctcccggcgagcctgggcctcccggagatcctgggcttccaggtgccattggggcccaggggacaccggggatctgcgacacctcagcctgccaaggagccgtgttaggaggggtcggggagaaatcaggctctcgaagctcataaaattcaacgtgaggaagcaagtgacaaggacgcccgaagcacagtggacggtcatgaaggagcggaggtgtcgcaggcgggtgacgtccaggagagggagcgcccctggctgcccctcggccgccgactggacgcgcgggccttgccagcgagcaccctcatcgggctgtcgcctgacagcatacctcaaaaggccctagctaataaacctgtaagcccagcatttgagagaaggtagggtgtgtatatataaaaggttgtgtacaactccacgaggtgaaaaatattcagtaacttgtttacatagcatttgtgtaaagactatgatctcatcccaataaaatgatatattaaaccttcagattaatgactggctacagagtaacaaaaaataaagaatttaatgtacagtaaattctctccatacaaaggtctagtctgatgttttgtgta

SEQ ID NO: 356025 - DNA, 2052 bp, Homo sapiens
aataggctaggtacgaggctgggtgttaatcggccgagggatcggctccgcggcccccgggaccttctggactccccggcctccctggtcccccaggacctcccggaccccctggacacccaggagtcctccctgaaggcgctactgaccttcagtgcccaagtatctgcccgccaggtcccccagggccccctggaatgccagggttcaagggacccactggctacaaaggcgagcagggggaagtcggcaaggacggcgagaagggtgaccctggcccccctgggcccgccggcctcccgggcagcgtggggctgcagggcccccggggattacgaggactgccagggccactcgggccccctggggaccggggtcccattgggttccgagggccgcctgggatcccaggagcgcctgggaaagcgggtgaccgaggcgagaggggcccagaagggttccgcggccccaagggtgacctcggcagacctggtcccaagggaacccccggagtggccgggccaagcggagagccgggcatgccgggcaaggacggccagaatggcgtgccaggactcgatggccagaagggagaggctggtcgcaacggtgctccgggagagaagggccccaacgggctgccgggcctccctggacgagcggggtccaaaggcgagaagggagaacggggcagagctggggagctgggtgaggccggcccctctggagagccaggcgtccctggagatgctggcatgcctggggagcgcggtgaggctggccaccggggctcagcgggggccctcggcccacaaggccctcccggagcccctggtgtccgaggcttccagggccagaagggcagcatgggagaccccggccttccaggcccccagggcctccgaggtgacgtgggcgaccggggtccgggaggtgccgcaggccctaagggagaccagggtattgcaggttccgacggtcttcctggggataaaggagaactgggtcccagcggcctggtcggacccaaaggagagtctggcagtcgaggggagctgggccccaaaggcacccagggtcccaacggcaccagcggtgttcagggtgtccccgggccccccggtcctctgggcctgcagggcgtcccgggtgttcctggcatcacggggaagccgggagttccggggaaggaggccagcgagcagcgcatcagggagctgtgtggggggatgatcagcgaacaaattgcacagttagccgcgcacctaaggaagcctttggcacccgggtccattggtcggcccggtccagctggcccccctgggcccccaggacccccaggctccattggtcaccctggcgctcgaggaccccccggataccgcggtcccactggggagctgggagaccccgggcccagaggaaaccagggtgacagaggagacaaaggcgcggcaggagcagggctggacgggcctgaaggagaccaggggccccaaggaccccaaggcgtgcccggcaccagcaaggacggccaggacggtgctcccggcgagcctgggcctcccggagatcctgggcttccaggtgccattggggcccaggggacaccggggatctgcgacacctcagcctgccaaggagccgtgttaggaggggtcggggagaaatcaggctctcgaagctcataaaattcaacgtgaggaagcaagtgacaaggacgcccgaagcacagtggacggtcatgaaggagcggaggtgtcgcaggcgggtgacgtccaggagagggagcgcccctggctgcccctcggccgccgactggacgcgcgggccttgccagcgagcaccctcatcgggctgtcgcctgacagcatacctcaaaaggccctagctaataaacctgtaagcccagcatttgagagaaggtagggtgtgtatatataaaaggttgtgtacaactccacgaggtgaaaaatattcagtaacttgtttacatagcatttgtgtaaagactatgatctcatcccaataaaatgatatattaaaccttca

SEQ ID NO: 356026 - DNA, 2223 bp, Homo sapiens
aataggctaggtacgaggctgggtgttaatcggccgaggccatggccgggccgcgcgcgtgcgcgccgctcctgctcctgctcctgctcggggagcttctggcggccgccggggcgcagagagtgggactccccggcccccccggccccccagggccgcccgggaagcccggccaggacggcattgacggagaagctggtcctccaggtctgcctgggcccccgggaccaaagggggccccaggaaagccggggaaaccaggagaggctgggctgccgggactgccgggtgtggatggtctgactggacgagatggaccccctggacccaagggtgcccctggggaacggggaagtctgggacccccggggccgcccgggctggggggcaaaggcctccctggaccccccggagaggcaggagtgagcggccccccaggtgggatcggcctccgcggccccccgggaccttctggactccccggcctccctggtcccccaggacctcccggaccccctggacacccaggagtcctccctgaaggcgctactgaccttcagtgcccaagtatctgcccgccaggtcccccagggccccctggaatgccagggttcaagggacccactggctacaaaggcgagcagggggaagtcggcaaggacggcgagaagggtgaccctggcccccctgggcccgccggcctcccgggcagcgtggggctgcagggcccccggggattacgaggactgccagggccactcgggccccctggggaccggggtcccattgggttccgagggccgcctgggatcccaggagcgcctgggaaagcgggtgaccgaggcgagaggggcccagaagggttccgcggccccaagggtgacctcggcagacctggtcccaagggaacccccggagtggccgggccaagcggagagccgggcatgccgggcaaggacggccagaatggcgtgccaggactcgatggccagaagggagaggctggtcgcaacggtgctccgggagagaagggccccaacgggctgccgggcctccctggacgagcggggtccaaaggcgagaagggagaacggggcagagctggggagctgggtgaggccggcccctctggagagccaggcgtccctggagatgctggcatgcctggggagcgcggtgaggctggccaccggggctcagcgggggccctcggcccacaaggccctcccggagcccctggtgtccgaggcttccagggccagaagggcagcatgggagaccccggccttccaggcccccagggcctccgaggtgacgtgggcgaccggggtccgggaggtgccgcaggccctaagggagaccagggtattgcaggttccgacggtcttcctggggataaaggagaactgggtcccagcggcctggtcggacccaaaggagagtctggcagtcgaggggagctgggccccaaaggcacccagggtcccaacggcaccagcggtgttcagggtgtccccgggccccccggtcctctgggcctgcagggcgtcccgggtgttcctggcatcacggggaagccgggagttccggggaaggaggccagcgagcagcgcatcagggagctgtgtggggggatgatcagcgaacaaattgcacagttagccgcgcacctaaggaagcctttggcacccgggtccattggtcggcccggtccagctggcccccctgggcccccaggacccccaggctccattggtcaccctggcgctcgaggaccccccggataccgcggtcccactggggagctgggagaccccgggcccagaggaaaccagggtgacagaggagacaaaggcgcggcaggagcagggctggacgggcctgaaggagaccaggggccccaaggaccccaaggcgtgcccggcaccagcaaggacggccaggacggtgctcccggcgagcctgggcctcccggagatcctgggcttccaggtgccattggggcccaggggacaccggggatctgcgacacctcagcctgccaaggagccgtgttaggaggggtcggggagaaatcaggctctcgaagctcataaaattcaacgtgaggaagcaagtgacaaggacgcccgaagcacagtggacggtcatgaaggagcggaggtgtcgcagacaatccttgcaggggtaccgagcctcgaattcggttaatcatggttcttg

SEQ ID NO: 356027 - DNA, 2124 bp, Homo sapiens
tctgactgctctgttttccgacagtgcccaagtatctgcccgccaggtcccccagggccccctggaatgccagggttcaagggacccactggctacaaaggcgagcagggggaagtcggcaaggacggcgagaaggccgggggaccaggtctgggatgccctttagcgtggctggagtgatcagatgaggagaccccaggtgcacatcagaggggtccctgcttggccacgaggaggggcctggacagggctgaagggccttgtgggaacagtgaccacggaccccggcccggcagggcgaggccaccgagactcgcgggactgctctggaactgtggggtgaccctggcccccctgggcccgccggcctcccgggcagcgtggggctgcagggcccccggggattacgaggactgccagggccactcgggccccctggggaccggggtcccattgggttccgagggccgcctgggatcccaggagcgcctgggaaagcgggtgaccgaggcgagaggggcccagaagggttccgcggccccaagggtgacctcggcagacctggtcccaagggaacccccggagtggccgggccaagcggagagccgggcatgccgggcaaggacggccagaatggcgtgccaggactcgatggccagaagggagaggctggtcgcaacggtgctccgggagagaagggccccaacgggctgccgggcctccctggacgagcggggtccaaaggcgagaagggagaacggggcagagctggggagctgggtgaggccggcccctctggagagccaggcgtccctggagatgctggcatgcctggggagcgcggtgaggctggccaccggggctcagcgggggccctcggcccacaaggccctcccggagcccctggtgtccgaggcttccagggccagaagggcagcatgggagaccccggccttccaggcccccagggcctccgaggtgacgtgggcgaccggggtccgggaggtgccgcaggccctaagggagaccagggtattgcaggttccgacggtcttcctggggataaaggagaactgggtcccagcggcctggtcggacccaaaggagagtctggcagtcgaggggagctgggccccaaaggcacccagggtcccaacggcaccagcggtgttcagggtgtccccgggccccccggtcctctgggcctgcagggcgtcccgggtgttcctggcatcacggggaagccgggagttccggggaaggaggccagcgagcagcgcatcagggagctgtgtggggggatgatcagcgaacaaattgcacagttagccgcgcacctaaggaagcctttggcacccgggtccattggtcggcccggtccagctggcccccctgggcccccaggacccccaggctccattggtcaccctggcgctcgaggaccccccggataccgcggtcccactggggagctgggagaccccgggcccagaggaaaccagggtgacagaggagacaaaggcgcggcaggagcagggctggacgggcctgaaggagaccaggggccccaaggaccccaaggcgtgcccggcaccagcaaggacggccaggacggtgctcccggcgagcctgggcctcccggagatcctgggcttccaggtgccattggggcccaggggacaccggggatctgcgacacctcagcctgccaaggagccgtgttaggaggggtcggggagaaatcaggctctcgaagctcataaaattcaacgtgaggaagcaagtgacaaggacgcccgaagcacagtggacggtcatgaaggagcggaggtgtcgcaggcgggtgacgtccaggagagggagcgcccctggctgcccctcggccgccgactggacgcgcgggccttgccagcgagcaccctcatcgggctgtcgcctgacagcatacctcaaaaggccctagctaataaacctgtaagcccagcatttgagagaaggtagggtgtgtatatataaaaggttgtgtacaactccacgaggtgaaaaatattcagtaacttgtttacatagcatttgtgtaaagactatgatctcatcccaataaaatgatatattaaaccttca

SEQ ID NO: 356028 - DNA, 2692 bp, Homo sapiens
  misc_feature (1704)..(1704): n is a, c, g, or t
aataggctaggtacgaggctgggtgttaatcggccgaggccatggccgggccgcgcgcgtgcgcgccgctcctgctcctgctcctgctcggggagcttctggcggccgccggggcgcagagagtgggactccccggcccccccggccccccagggccgcccgggaagcccggccaggacggcattgacggagaagctggtcctccaggtctgcctgggcccccgggaccaaagggggccccaggaaagccggggaaaccaggagaggctgggctgccgggactgccgggtgtggatggtctgactggacgagatggaccccctggacccaagggtgcccctggggaacggggaagtctgggacccccggggccgcccgggctggggggcaaaggcctccctggaccccccggagaggcaggagtgagcggccccccaggtgggatcggcctccgcggccccccgggaccttctggactccccggcctccctggtcccccaggacctcccggaccccctggacacccaggagtcctccctgaaggcgctactgaccttcagtgcccaagtatctgcccgccaggtcccccagggccccctggaatgccagggttcaagggacccactggctacaaaggcgagcagggggaagtcggcaaggacggcgagaagggtgaccctggcccccctgggcccgccggcctcccgggcagcgtggggctgcagggcccccggggattacgaggactgccagggccactcgggccccctggggaccggggtcccattgggttccgagggccgcctgggatcccaggagcgcctgggaaagcgggtgaccgaggcgagaggggcccagaagggttccgcggccccaagggtgacctcggcagacctggtcccaagggaacccccggagtggccgggccaagcggagagccgggcatgccgggcaaggacggccagaatggcgtgccaggactcgatggccagaagggagaggctggtcgcaacggtgctccgggagagaagggccccaacgggctgccgggcctccctggacgagcggggtccaaaggcgagaagggagaacggggcagagctggggagctgggtgaggccggcccctctggagagccaggcgtccctggagatgctggcatgcctggggagcgcggtgaggctggccaccggggctcagcgggggccctcggcccacaaggccctcccggagcccctggtgtccgaggcttccagggccagaagggcagcatgggagaccccggccttccaggcccccagggcctccgaggtgacgtgggcgaccggggtccgggaggtgccgcaggccctaagggagaccagggtattgcaggttccgacggtcttcctggggataaaggagaactgggtcccagcggcctggtcggacccaaaggagagtctggcagtcgaggggagctgggccccaaaggcacccagggtcccaacggcaccagcggtgttcagggtgtccccgggccccccggtcctctgggcctgcagggcgtcccgggtgttcctggcatcacggggaagccgggagttccggtacgtcgcttttccggcttttccagctttcacagggttgagatcgtgttttttccggaaggaagttactttgcggggtgacggtgggaatgcctcaccgaggctgccgcccccntgctgacgaatgtgtggggtgaattccagggaaggaggccagcgagcagcgcatcagggagctgtgtggggggatgatcagcgaacaaattgcacagttagccgcgcacctaaggaagcctttggcacccgggtccattggtcggcccggtccagctggcccccctgggcccccaggacccccaggctccattggtcaccctggcgctcgaggaccccccggataccgcggtcccactggggagctgggagaccccgggcccagaggaaaccagggtgacagaggagacaaaggcgcggcaggagcagggctggacgggcctgaaggagaccaggggccccaaggaccccaaggcgtgcccggcaccagcaaggacggccaggacggtgctcccggcgagcctgggcctcccggagatcctgggcttccaggtgccattggggcccaggggacaccggggatctgcgacacctcagcctgccaaggagccgtgttaggaggggtcggggagaaatcaggctctcgaagctcataaaattcaacgtgaggaagcaagtgacaaggacgcccgaagcacagtggacggtcatgaaggagcggaggtgtcgcaggcgggtgacgtccaggagagggagcgcccctggctgcccctcggccgccgactggacgcgcgggccttgccagcgagcaccctcatcgggctgtcgcctgacagcatacctcaaaaggccctagctaataaacctgtaagcccagcatttgagagaaggtagggtgtgtatatataaaaggttgtgtacaactccacgaggtgaaaaatattcagtaacttgtttacatagcatttgtgtaaagactatgatctcatcccaataaaatgatatattaaaccttcagattaatgactggctacagagtaacaaaaaataaagaatttaatgtacagtaaattctctccatacaaaggtctagtctgatgttttgtgta

SEQ ID NO: 356029 - DNA, 1459 bp, Homo sapiens
ggcacgagggtacaccggtgcttaggagagaagggccccaacgggctgccgggcctccctggacgagcggggtccaaaggcgagaagggagaacggggcagagctggggagctgggtgaggccggcccctctggagagccaggcgtccctggagatgctggcatgcctggggagcgcggtgaggctggccaccggggctcagcgggggccctcggcccacaaggccctcccggagcccctggtgtccgaggcttccagggccagaagggcagcatgggagaccccggccttccaggcccccagggcctccgaggtgacgtgggcgaccggggtccgggaggtgccgcaggccctaagggagaccagggtattgcaggttccgacggtcttcctggggataaaggagaactgggtcccagcggcctggtcggacccaaaggagagtctggcagtcgaggggagctgggccccaaaggcacccagggtcccaacggcaccagcggtgttcagggtgtccccgggccccccggtcctctgggcctgcagggcgtcccgggtgttcctggcatcacggggaagccgggagttccggggaaggaggccagcgagcagcgcatcagggagctgtgtggggggatgatcagcgaacaaattgcacagttagccgcgcacctaaggaagcctttggcacccgggtccattggtcggcccggtccagctggcccccctgggcccccaggacccccaggctccattggtcaccctggcgctcgaggaccccccggataccgcggtcccactggggagctgggagaccccgggcccagaggaaaccagggtgacagaggagacaaaggcgcggcaggagcagggctggacgggcctgaaggagaccaggggccccaaggaccccaaggcgtgcccggcaccagcaaggacggccaggacggtgctcccggcgagcctgggcctcccggagatcctgggcttccaggtgccattggggcccaggggacaccggggatctgcgacacctcagcctgccaaggagccgtgttaggaggggtcggggagaaatcaggctctcgaagctcataaaattcaacgtgaggaagcaagtgacaaggacgcccgaagcacagtggacggtcatgaaggagcggaggtgtcgcaggcgggtgacgtccaggagagggagcgcccctggctgcccctcggccgccgactggacgcgcgggccttgccagcgagcaccctcatcgggctgtcgcctgacagcatacctcaaaaggccctagctaataaacctgtaagcccagcatttgagagaaggtagggtgtgtatatataaaaggttgtgtacaactccacgaggtgaaaaatattcagtaacttgtttacatagcatttgtgtaaagactatgatctcatcccaataaaatgatatattaaaccttca

SEQ ID NO: 356030 - DNA, 1392 bp, Homo sapiens
gtagtctaatagcaggtgtgtggatgatttgatttattttatcctcaactggctacttcccacccacccaacaatacacttagttcaaacacacaacttttctcttcacagggtcccagcggcctggtcggacccaaaggagaggtgagtgcccggcgactgttccgatgacaccatccatgggcgcctgctggcttcctgcccacctctgggcaaccaggcagccctgcagggcactgcccagatccgagatgtaaaaaagcttgctctggtcaaggctgggcaagacggctccgtgccggctgggaaagagcacgtcggggtggctctgggctcctgggctcgcccctgacccaccttcctctgttcctctgcagtctggcagtcgaggggagctgggccccaaaggcacccagggtcccaacggcaccagcggtgttcagggtgtccccgggccccccggtcctctgggcctgcagggcgtcccgggtgttcctggcatcacggggaagccgggagttccggggaaggaggccagcgagcagcgcatcagggagctgtgtggggggatgatcagcgaacaaattgcacagttagccgcgcacctaaggaagcctttggcacccgggtccattggtcggcccggtccagctggcccccctgggcccccaggacccccaggctccattggtcaccctggcgctcgaggaccccccggataccgcggtcccactggggagctgggagaccccgggcccagaggaaaccagggtgacagaggagacaaaggcgcggcaggagcagggctggacgggcctgaaggagaccaggggccccaaggaccccaaggcgtgcccggcaccagcaaggacggccaggacggtgctcccggcgagcctgggcctcccggagatcctgggcttccaggtgccattggggcccaggggacaccggggatctgcgacacctcagcctgccaaggagccgtgttaggaggggtcggggagaaatcaggctctcgaagctcataaaattcaacgtgaggaagcaagtgacaaggacgcccgaagcacagtggacggtcatgaaggagcggaggtgtcgcaggcgggtgacgtccaggagagggagcgcccctggctgcccctcggccgccgactggacgcgcgggccttgccagcgagcaccctcatcgggctgtcgcctgacagcatacctcaaaaggccctagctaataaacctgtaagcccagcatttgagagaaggtagggtgtgtatatataaaaggttgtgtacaactccacgaggtgaaaaatattcagtaacttgtttacatagcatttgtgtaaagactatgatctcatcccaataaaatgatatattaaaccttca

SEQ ID NO: 356031 - DNA, 1407 bp, Homo sapiens
  misc_feature (511)..(511): n is a, c, g, or t
ccaagggctgtgtttggagcgggttaaaaggcagccctggggcctgggcttttggcctcgaccttaagatgaacattacacctacggaggcttgagagcagggactttaaggcatgaagtccctactcatgcatgaacagctcttttaactttggggtgtatcgttttcagggtattgcaggttccgacggtcttcctggggataaaggagaactgggtcccagcggcctggtcggacccaaaggagagtctggcagtcgaggggagctgggccccaaaggcacccagggtcccaacggcaccagcggtgttcagggtgtccccgggccccccggtcctctgggcctgcagggcgtcccgggtgttcctggcatcacggggaagccgggagttccggtacgtcgcttttccggcttttccagctttcacagggttgagatcgtgttttttccggaaggaagttactttgcggggtgacggtgggaatgcctcaccgaggctgccgcccccntgctgacgaatgtgtggggtgaattccagggaaggaggccagcgagcagcgcatcagggagctgtgtggggggatgatcagcgaacaaattgcacagttagccgcgcacctaaggaagcctttggcacccgggtccattggtcggcccggtccagctggcccccctgggcccccaggacccccaggctccattggtcaccctggcgctcgaggaccccccggataccgcggtcccactggggagctgggagaccccgggcccagaggaaaccagggtgacagaggagacaaaggcgcggcaggagcagggctggacgggcctgaaggagaccaggggccccaaggaccccaaggcgtgcccggcaccagcaaggacggccaggacggtgctcccggcgagcctgggcctcccggagatcctgggcttccaggtgccattggggcccaggggacaccggggatctgcgacacctcagcctgccaaggagccgtgttaggaggggtcggggagaaatcaggctctcgaagctcataaaattcaacgtgaggaagcaagtgacaaggacgcccgaagcacagtggacggtcatgaaggagcggaggtgtcgcaggcgggtgacgtccaggagagggagcgcccctggctgcccctcggccgccgactggacgcgcgggccttgccagcgagcaccctcatcgggctgtcgcctgacagcatacctcaaaaggccctagctaataaacctgtaagcccagcatttgagagaaggtagggtgtgtatatataaaaggttgtgtacaactccacgaggtgaaaaatattcagtaacttgtttacatagcatttgtgtaaagactatgatctcatcccaataaaatgatatattaaaccttca

SEQ ID NO: 356032 - DNA, 2190 bp, Homo sapiens
  misc_feature (744)..(744): n is a, c, g, or t
ccaagggctgtgtttggagcgggttaaaaggcagccctggggcctgggcttttggcctcgaccttaagatgaacattacacctacggaggcttgagagcagggactttaaggcatgaagtccctactcatgcatgaacagctcttttaactttggggtgtatcgttttcagggtattgcaggttccgacggtcttcctggggataaaggagaactgggtcccagcggcctggtcggacccaaaggagaggtgagtgcccggcgactgttccgatgacaccatccatgggcgcctgctggcttcctgcccacctctgggcaaccaggcagccctgcagggcactgcccagatccgagatgtaaaaaagcttgctctggtcaaggctgggcaagacggctccgtgccggctgggaaagagcacgtcggggtggctctgggctcctgggctcgcccctgacccaccttcctctgttcctctgcagtctggcagtcgaggggagctgggccccaaaggcacccagggtcccaacggcaccagcggtgttcagggtgtccccgggccccccggtcctctgggcctgcagggcgtcccgggtgttcctggcatcacggggaagccgggagttccggtacgtcgcttttccggcttttccagctttcacagggttgagatcgtgttttttccggaaggaagttactttgcggggtgacggtgggaatgcctcaccgaggctgccgcccccntgctgacgaatgtgtggggtgaattccagggaaggaggccagcgagcagcgcatcagggagctgtgtggggggatgatcagcggtaagtcagccacgtgcaccggctgcagcggggcccatccccgcctgggggtcccgtgcctggggctacacagaaagccttcgtgccactgctttccagccaaagtgagcccctagcactcaccccgcctgttagcccttgggggtccacgtccgccttggcgtctgcctgtcctctgcgctagaggatggcccacgctcccgccccggattcaaccagattcccagcacgcagcagacgccctaaagcctgctgaatgcaatgggtacaagaacagcggagtgtgcccctgtggctggcagggcaggtccctaaacacccccaagggcacttccttcaccttcccactcaggcttctcaggctccaaggggttgggggtcctttctagctccagcattcatcaccccaaagcagttaaaccattttccatcaatcagaaggaaaacttgcttctggaagacagcaccgtgtagatattttatgctttacgtaacaatacttctgatgatcctctctcgagtaaacgcctgcacccttgttttcccaaagaacaaattgcacagttagccgcgcacctaaggaagcctttggcacccgggtccattggtcggcccggtccagctggcccccctgggcccccaggacccccaggctccattggtcaccctggcgctcgaggaccccccggataccgcggtcccactggggagctgggagaccccgggcccagaggaaaccagggtgacagaggagacaaaggcgcggcaggagcagggctggacgggcctgaaggagaccaggggccccaaggaccccaaggcgtgcccggcaccagcaaggacggccaggacggtgctcccggcgagcctgggcctcccggagatcctgggcttccaggtgccattggggcccaggggacaccggggatctgcgacacctcagcctgccaaggagccgtgttaggaggggtcggggagaaatcaggctctcgaagctcataaaattcaacgtgaggaagcaagtgacaaggacgcccgaagcacagtggacggtcatgaaggagcggaggtgtcgcaggcgggtgacgtccaggagagggagcgcccctggctgcccctcggccgccgactggacgcgcgggccttgccagcgagcaccctcatcgggctgtcgcctgacagcatacctcaaaaggccctagctaataaacctgtaagcccagcatttgagagaaggtagggtgtgtatatataaaaggttgtgtacaactccacgaggtgaaaaatattcagtaacttgtttacatagcatttgtgtaaagactatgatctcatcccaataaaatgatatattaaaccttca

SEQ ID NO: 356033 - DNA, 571 bp, Homo sapiens
  misc_feature (49)..(49): n is a, c, g, or t
  misc_feature (51)..(51): n is a, c, g, or t
  misc_feature (53)..(53): n is a, c, g, or t
  misc_feature (67)..(67): n is a, c, g, or t
acgcgtccggtgcccgcacatgcaaggacggccaggacggtgctcctcngngntcgggtaaaggggncccccccccctgggcctcccggagatcctgggcttccaggtgccattggggcccaggggacaccggggatctgcgacacctcagcctgccaaggagccgtgttaggaggggtcggggagaaatcaggctctcgaagctcataaaattcaacgtgaggaagcaagtgacaaggacgcccgaagcacagtggacggtcatgaaggagcggaggtgtcgcaggcgggtgacgtccaggagagggagcgcccctggctgcccctcggccgccgactggacgcgcgggccttgccagcgagcaccctcatcgggctgtcgcctgacagcatacctcaaaaggccctagctaataaacctgtaagcccagcatttgagagaaggtagggtgtgtatatataaaaggttgtgtacaactccacgaggtgaaaaatattcagtaacttgtttacatagcatttgtgtaaagactatgatctcatcccaataaaatgatatattaaaccttca

SEQ ID NO: 356034 - DNA, 1364 bp, Homo sapiens
aataggctaggtacgaggctgggtgttaatcggccgaggccatggccgggccgcgcgcgtgcgcgccgctcctgctcctgctcctgctcggggagcttctggcggccgccggggcgcagagagtgggactccccggcccccccggccccccagggccgcccgggaagcccggccaggacggcattgacggagaagctggtcctccaggtctgcctgggcccccgggaccaaagggggccccaggaaagccggggaaaccaggagaggctgggctgccgggactgccgggtgtggatggtctgactggacgagatggaccccctggacccaagggtgcccctggggaacggggaagtctgggacccccggggccgcccgggctggggggcaaaggcctccctggaccccccggagaggcaggagtgagcggccccccaggtgggatcggcctccgcggccccccgggaccttctggactccccggcctccctggtcccccaggacctcccggaccccctggacacccaggagtcctccctgaaggcgctactgaccttcagtgcccaagtatctgcccgccaggtcccccagggccccctggaatgccagggttcaagggacccactggctacaaaggcgagcagggggaagtcggcaaggacggcgagaagggtgaccctggcccccctgggcccgccggcctcccgggcagcgtggggctgcagggcccccggggattacgaggactgccagggccactcgggccccctggggaccggggtcccattgggttccgagggccgcctgggatcccaggagcgcctgggaaagcgggtgaccgaggcgagaggggcccagaagggttccgcggccccaagggtgacctcggcagacctggtcccaagggaacccccggagtggccgggccaagcggagagccgggcatgccgggcaaggacggccagaatggcgtgccaggactcgatggccagaagggagaggctggtcgcaacggtgctccgggagagaagggccccaacgggctgccgggcctccctggacgagcggggtccaaaggcgagaagggagaacgggggcagagctgggtgagctgggtgaggccggaccctctggagaaccaagagcgtcacacatggagaaatgcgatgggacaatgcccatgggagagaagacggacgggatgaacggacatgggtacccacaaccgtgtggacaatcaaaaaggagagagaagcaccaaacagggaacaccaacaaaaggagcccataccgccgagaaaaccacccatggattggtcaccagaaaggataccaggggtgcaagaaagtgcgacaagacaatg

SEQ ID NO: 356035 - DNA, 952 bp, Homo sapiens
gccggagacgccaggagccctgctccccacccctctccattaatgacggggaagagccaccgcctctgccgggaacgccaaggaatacgcgggcctggagcctgaaaagctggatggggctcaagtggaggcccaaaggatcactagcagcctagccagggtccagagcgaggcagggactggaggagcgcttatccgactgcctcgccctgccgcgggatcccccaaccccgacagggtctcagtcccgaactacaactcccggggtgcaccgcgccggccctcgccgccatgcccctccttcccgcaccatccccattcccatcccccttctctagtccccgaccgccctactatcccccagagtatacctgcagctcagaaacagatgcacagagcatcacgtacaatggctccatggacagcccagtgcccttgtaccctaccgattgccccccttcttatgaggcagtcatgggactacgaggagacagccaggccactctctttgaccctcagcttcacgatggctcgtgcatctgtgaacgagtggcctccattgtagacgtgtccatggacagcgggtctctggtgctgtcagccattggtgacctccctgggggctctagcccgtcggaggactcgtgcctgctggagctgcagggctccgtgcgctccgtggactacgttctctttcgctccatccagcgcagccgtgccggctactgcctcagcctggactgtggcctgcggggcctcggggaagcctgcgaagggcccaagggtgggcgtcctttctggttgcctttagtcacccatgtggccacagtggccttcggccggttggggtgccctggtggctgtcccatggcggggctcttttcggcccgtcctgacggtgtgaaatagcagcgggatcttccgcgaccgaaagacgggagaggatttacaa

SEQ ID NO: 356036 - DNA, 3890 bp, Homo sapiens
gccggagacgccaggagccctgctccccacccctctccattaatgacggggaagagccaccgcctctgccgggaacgccaaggaatacgcgggcctggagcctgaaaagctggatggggctcaagtggaggcccaaaggatcactagcagcctagccagggtccagagcgaggcagggactggaggagcgcttatccgactgcctcgccctgccgcgggatcccccaaccccgacagggtctcagtcccgaactacaactcccggggtgcaccgcgccggccctcgccgccatgcccctccttcccgcaccatccccattcccatcccccttctctagtccccgacctgcggcagccggagctcggggagcggagcgtggtggggaggggagcgggacaggcgacacaggagacagcggcgccgcggcctctccccaccaggcggccccggatcctactggacgccctgagggcacaccgaccgcgcctctagagtcaccccacgccgacccctcccctcttctctagacttatttccattccttcccgcttttaccctccccacccctccctgggctccaggccgccgccccctcctcactcctggaccggcccttctcggtgcccctcttccctagggagatgcgatgagccggtgcccccgcgtcctcatcgtcgccccgggcacggtgcccgtccagtgcccgtggtggggagggagcactccgcggtccctccgtgacgcccctcgcttggccccccccacagctggcgtccctcggccatgccccaggggacccagccagggggtgggctctagagcgagtggggtggagaggagaaaggacggggccttgggggcctctgagatgctcccaagtgccagggagggccgagcgaggcgcaggcaaccgggcagcaggcatgatgccctcgcctagtgactccagccgctcgctgaccagccggcccagcaccaggggccttacccacctccgcctccaccgaccctggctgcaggccctgcttacgctggggctggtccaagtgctcctgggcatcctggtggtcaccttcagcatggtggcctcttccgtcaccaccaccgagagcatcaagaggtcctgcccgtcttgggctgggttctcgctggcgttctccggggtggttggcattgtgtcctggaagcggccattcactctagtgatctccttcttctccttgctttcggtgctctgtgtcatgcttagcatggctggctctgttctctcctgtaagaatgctcaactggcccgagacttccaacagtgctctctggaaggaaaggtctgtgtgtgctgtccctctgttcccctcctccggccctgtccagagtcggggcaggaactgaaagttgcccctaactccacctgtgatgaagcccgaggggccctcaagaacctgctcttcagcgtctgtgggctcaccatttgtgccgctataatctgtacactctctgctattgtctgctgcatccaaatcttctccctggacctcgtgcatacgctggcccctgagcggtcagtctcaggcccactgggacctctgggctgcacgtccccgcccccagcccctctcctacacaccatgctggacctggaggaatttgtcccgcctgtgcccccaccgccctactatcccccagagtatacctgcagctcagaaacagatgcacagagcatcacgtacaatggctccatggacagcccagtgcccttgtaccctaccgattgccccccttcttatgaggcagtcatgggactacgaggagacagccaggccactctctttgaccctcagcttcacgatggctcgtgcatctgtgaacgagtggcctccattgtagacgtgtccatggacagcgggtctctggtgctgtcagccattggtgacctccctgggggctctagcccgtcggaggactcgtgcctgctggagctgcagggctccgtgcgctccgtggactacgttctctttcgctccatccagcgcagccgtgccggctactgcctcagcctggactgtggcctgcggggccccttcgaggaaagccccctgccacggcgccccccacgggctgcccgctcctattcctgctctgcccctgaagctccacccccactgggtgcccccacagctgcccgcagctgccaccggttggagggctggccgccctgggtgggaccctgcttccccgagctgaggcggcgggtcccccggggagggggccgcccagccgcagccccgcccacccgagccccgactcgtcgcttcagcgatagctcaggttccctcaccccaccggggcaccggcctcctcatccggcatccccaccaccgctgctgctgccacggtcccacagcgacccaggcatcacgacctccagtgacactgctgacttcagggacctttataccaaagtgcttgaggaagaagctgcttctgtttcctctgcagatacagggctctgctctgaagcctgcctcttccgcctagcccgctgcccttcccccaagttgctacgtgcccggtcagccgagaaacggcgccctgtgcccaccttccaaaaagttcccctgccctcgggccctgcacctgcccactccctgggggacctaaagggcagctggccaggtcggggcctggtcactcgtttcctccagatatccaggaaagccccagaccccagtgggactggagctcatggacataagcaggtgccccggagcctgtggggccggcctggccgagagagcctccaccttcgcagctgcggagatctgagctctagctcttccctgcggcgtctcctgtctggccgcaggctggagcgtggtacccgcccccacagcctcagcctcaacgggggcagccgggagactgggctctgacctaggcttcttgtcacactgaacacatccagccacaggcaccagctggttgggaccagcagcccccagcatcctcttgcactggctggcacaaaaagaaacctgctgtataccccccaaagtgtccctttccctcctacctctggggtctcttgctgcttgcctctgctgctctggtctgggagagcttctgtcctgtgctgcatgggtatttagactgtgggggagatgccccttcttatagcactggaggaggaaaacaaattcttgtccccctcagaatgagagtggctctttctgatttgcaagggcactatggtcagggcaaaggcatggcccaggtgtttaagtacagggtgacgtgtgcctatgcaatggggtggtaaggcaggcacgaagagtccaaaaaatctaggtggcctctcagctctgccacctctagctgcatgaccttgggcaagctatgtaaccccaattgcctgctccattaaagactgtgaaggtagaatgtttgtaaagctcttaacagtatgtaagccttcaataaatttcagttttccccttgttttcttggaaaaaaaaaaaaaaaaaaaaaaaaaaaaaaaaaaaagaaaaaaaaaaaaaaaaaaaaaaaagaaaaaaaagggggggggggggcacaagaggatcccgcggggggggcccagggggcacaccacacgattactaggacaaaagagggggcccccaattatggccgagctctcttataaatcaatacgacgggacagcggcgcggctagtacaaaaaaccccgatcacggcggcgtgggagaacccactcggccacacgggggaacatctgggaggagaaagaacccccaaatcggagggggcgacgaacacactgggcgcgccaacacacccacagagagactaacgaccctgggagaatcacaaacattcagcagtcatagcag

SEQ ID NO: 356037 - DNA, 2848 bp, Homo sapiens
gccggagacgccaggagccctgctccccacccctctccattaatgacggggaagagccaccgcctctgccgggaacgccaaggaatacgcgggcctggagcctgaaaagctggatggggctcaagtggaggcccaaaggatcactagcagcctagccagggtccagagcgaggcagggactggaggagcgcttatccgactgcctcgccctgccgcgggatcccccaaccccgacagggtctcagtcccgaactacaactcccggggtgcaccgcgccggccctcgccgccatgcccctccttcccgcaccatccccattcccatcccccttctctagtccccgacctgcggcagccggagctcggggagcggagcgtggtggggaggggagcgggacaggcgacacaggagacagcggcgccgcggcctctccccaccaggcggccccggatcctactggacgccctgagggcacaccgaccgcgcctctagagtcaccccacgccgacccctcccctcttctctagacttatttccattccttcccgcttttaccctccccacccctccctgggctccaggccgccgccccctcctcactcctggaccggcccttctcggtgcccctcttccctagggagatgcgatgagccggtgcccccgcgtcctcatcgtcgccccgggcacggtgcccgtccagtgcccgtggtggggagggagcactccgcggtccctccgtgacgcccctcgcttggccccccccacagctggcgtccctcggccatgccccaggggacccagccagggggtgggctctagagcgagtggggtggagaggagaaaggacggggccttgggggcctctgagatgctcccaagtgccagggagggccgagcgaggcgcaggcaaccgggcagcaggcatgatgccctcgcctagtgactccagccgctcgctgaccagccggcccagcaccaggggccttacccacctccgcctccaccgaccctggctgcaggccctgcttacgctggggctggtccaagtgctcctgggcatcctggtggtcaccttcagcatggtggcctcttccgtcaccaccaccgagagcatcaagaggtcctgcccgtcttgggctgggttctcgctggcgttctccggggtggttggcattgtgtcctggaagcggccattcactctagtgatctccttcttctccttgctttcggtgctctgtgtcatgcttagcatggctggctctgttctctcctgtaagaatgctcaactggcccgagacttccaacagtgctctctggaaggaaaggtctgtgtgtgctgtccctctgttcccctcctccggccctgtccagagtcggggcaggaactgaaagttgcccctaactccacctgtgatgaagcccgaggggccctcaagaacctgctcttcagcgtctgtgggctcaccatttgtgccgctataatctgtacactctctgctattgtctgctgcatccaaatcttctccctggacctcgtgcatacgctggcccctgagcggtcagtctcaggcccactgggacctctgggctgcacgtccccgcccccagcccctctcctacacaccatgctggacctggaggaatttgtcccgcctgtgcccccaccgccctactatcccccagagtatacctgcagctcagaaacagatgcacagagcatcacgtacaatggctccatggacagcccagtgcccttgtaccctaccgattgccccccttcttatgaggcagtcatgggactacgaggagacagccaggccactctctttgaccctcagcttcacgatggctcgtgcatctgtgaacgagtggcctccattgtagacgtgtccatggacagcgggtctctggtgctgtcagccattggtgacctccctgggggctctagcccgtcggaggactcgtgcctgctggagctgcagggctccgtgcgctccgtggactacgttctctttcgctccatccagcgcagccgtgccggctactgcctcagcctggactgtggcctgcggggccccttcgaggaaagccccctgccacggcgccccccacgggctgcccgctcctattcctgctctgcccctgaagctccacccccactgggtgcccccacagctgcccgcagctgccaccggttggagggctggccgccctgggtgggaccctgcttccccgagctgaggcggcgggtcccccggggagggggccgcccagccgcagccccgcccacccgagccccgactcgtcgcttcagcgatagctcaggttccctcaccccaccggggcaccggcctcctcatccggcatccccaccaccgctgctgctgccacggtcccacagcgacccaggcatcacgacctccagtgacactgctgacttcagggacctttataccaaagtgcttgaggaagaagctgcttctgtttcctctgcagatacagggctctgctctgaagcctgcctcttccgcctagcccgctgcccttcccccaaaatgagagtggctctttctgatttgcaagggcactatggtcagggcaaaggcatggcccaggtgtttaagtacagggtgacgtgtgcctatgcaatggggtggtaaggcaggcacgaagagtccaaaaaatctaggtggcctctcagctctgccacctctagctgcatgaccttgggcaagctatgtaaccccaattgcctgctccattaaagactgtgaaggtagaatgtttgtaaagctcttaacagtatgtaagccttcaataaatttcagttttccccttgttttcttg

SEQ ID NO: 356038 - DNA, 1821 bp, Homo sapiens
cctggtggcgaattcggcacgagggatgcacagagcatcacgtacaatggctccatggacagcccagtgcccttgtaccctaccgattgccccccttcttatgaggcagtcatgggactacgaggagacagccaggccactctctttgaccctcagcttcacgatggctcgtgcatctgtgaacgagtggcctccattgtagacgtgtccatggacagcgggtctctggtgctgtcagccattggtgacctccctgggggctctagcccgtcggaggactcgtgcctgctggagctgcagggctccgtgcgctccgtggactacgttctctttcgctccatccagcgcagccgtgccggctactgcctcagcctggactgtggcctgcggggccccttcgaggaaagccccctgccacggcgccccccacgggctgcccgctcctattcctgctctgcccctgaagctccacccccactgggtgcccccacagctgcccgcagctgccaccggttggagggctggccgccctgggtgggaccctgcttccccgagctgaggcggcgggtcccccggggagggggccgcccagccgcagccccgcccacccgagccccgactcgtcgcttcagcgatagctcaggttccctcaccccaccggggcaccggcctcctcatccggcatccccaccaccgctgctgctgccacggtcccacagcgacccaggcatcacgacctccagtgacactgctgacttcagggacctttataccaaagtgcttgaggaagaagctgcttctgtttcctctgcagatacagggctctgctctgaagcctgcctcttccgcctagcccgctgcccttcccccaagttgctacgtgcccggtcagccgagaaacggcgccctgtgcccaccttccaaaaagttcccctgccctcgggccctgcacctgcccactccctgggggacctaaagggcagctggccaggtcggggcctggtcactcgtttcctccagatatccaggaaagccccagaccccagtgggactggagctcatggacataagcaggtgccccggagcctgtggggccggcctggccgagagagcctccaccttcgcagctgcggagatctgagctctagctcttccctgcggcgtctcctgtctggccgcaggctggagcgtggtacccgcccccacagcctcagcctcaacgggggcagccgggagactgggctctgacctaggcttcttgtcacactgaacacatccagccacaggcaccagctggttgggaccagcagcccccagcatcctcttgcactggctggcacaaaaagaaacctgctgtataccccccaaagtgtccctttccctcctacctctggggtctcttgctgcttgcctctgctgctctggtctgggagagcttctgtcctgtgctgcatgggtatttagactgtgggggagatgccccttcttatagcactggaggaggaaaacaaattcttgtccccctcagaatgagagtggctctttctgatttgcaagggcactatggtcagggcaaaggcatggcccaggtgtttaagtacagggtgacgtgtgcctatgcaatggggtggtaaggcaggcacgaagagtccaaaaaatctaggtggcctctcagctctgccacctctagctgcatgaccttgggcaagctatgtaaccccaattgcctgctccattaaagactgtgaaggtagaatgtttgtaaagctcttaacagtatgtaagccttcaataaatttcagttttccccttgttttcttg

SEQ ID NO: 356039 - DNA, 532 bp, Homo sapiens
agcgccccctgccgcccacagtgtccatggacagcgggtctctggtgctgtcagccattggtgacctccctgggggctctagcccgtcggaggactcgtgcctgctggagctgcagggctccgtgcgctccgtggactacgttctctttcgctccatccagcgcagccgtgccggctactgcctcagcctggactgtggcctgcggggccccttcgaggaaagccccctgccacggcgccccccacgggctgcccgctcctattcctgctctgcccctgaagctccacccccactgggtgcccccacagctgcccgcagctgccaccggttggagggctggccgccctgggtgggaccctgcttccccgagctgaggcggcgggtcccccggggagggggccgcccagccgcagccccgcccacccgagccccgactcgtcgcttcagcgatagctcaggttccctcaccccaccggggcaccggcctcctcatccggcatccccaccaccgctgctgctgccacggtccca

SEQ ID NO: 356040 - DNA, 3504 bp, Homo sapiens
gccggagacgccaggagccctgctccccacccctctccattaatgacggggaagagccaccgcctctgccgggaacgccaaggaatacgcgggcctggagcctgaaaagctggatggggctcaagtggaggcccaaaggatcactagcagcctagccagggtccagagcgaggcagggactggaggagcgcttatccgactgcctcgccctgccgcgggatcccccaaccccgacagggtctcagtcccgaactacaactcccggggtgcaccgcgccggccctcgccgccatgcccctccttcccgcaccatccccattcccatcccccttctctagtccccgacctgcggcagccggagctcggggagcggagcgtggtggggaggggagcgggacaggcgacacaggagacagcggcgccgcggcctctccccaccaggcggccccggatcctactggacgccctgagggcacaccgaccgcgcctctagagtcaccccacgccgacccctcccctcttctctagacttatttccattccttcccgcttttaccctccccacccctccctgggctccaggccgccgccccctcctcactcctggaccggcccttctcggtgcccctcttccctagggagatgcgatgagccggtgcccccgcgtcctcatcgtcgccccgggcacggtgcccgtccagtgcccgtggtggggagggagcactccgcggtccctccgtgacgcccctcgcttggccccccccacagctggcgtccctcggccatgccccaggggacccagccagggggtgggctctagagcgagtggggtggagaggagaaaggacggggccttgggggcctctgagatgctcccaagtgccagggagggccgagcgaggcgcaggcaaccgggcagcaggcatgatgccctcgcctagtgactccagccgctcgctgaccagccggcccagcaccaggggccttacccacctccgcctccaccgaccctggctgcaggccctgcttacgctggggctggtccaagtgctcctgggcatcctggtggtcaccttcagcatggtggcctcttccgtcaccaccaccgagagcatcaagaggtcctgcccgtcttgggctgggttctcgctggcgttctccggggtggttggcattgtgtcctggaagcggccattcactctagtgatctccttcttctccttgctttcggtgctctgtgtcatgcttagcatggctggctctgttctctcctgtaagaatgctcaactggcccgagacttccaacagtgctctctggaaggaaaggtctgtgtgtgctgtccctctgttcccctcctccggccctgtccagagtcggggcaggaactgaaagttgcccctaactccacctgtgatgaagcccgaggggccctcaagaacctgctcttcagcgtctgtgggctcaccatttgtgccgctataatctgtacactctctgctattgtctgctgcatccaaatcttctccctggacctcgtgcatacgctggcccctgagcggtcagtctcaggcccactgggacctctgggctgcacgtccccgcccccagcccctctcctacacaccatgctggacctggaggaatttgtcccgcctgtgcccccaccgccctactatcccccagagtatacctgcagctcagaaacagatgcacagagcatcacgtacaatggctccatggacagcccagtgcccttgtaccctaccgattgccccccttcttatgaggcagtcatgggactacgaggagacagccaggccactctctttgaccctcagcttcacgatggctcgtgcatctgtgaacgagtggcctccattgtagacgtgtccatggacagcgggtctctggtgctgtcagccattggtgacctccctgggggctctagcccgtcggaggactcgtgcctgctggagctgcagggctccgtgcgctccgtggactacgttctctttcgctccatccagcgcagccgtgccggctactgcctcagcctggactgtggcctgcggggccccttcgaggaaagccccctgccacggcgccccccacgggctgcccgctcctattcctgctctgcccctgaagctccacccccactgggtgcccccacagctgcccgcagctgccaccggttggagggctggccgccctgggtgggaccctgcttccccgagctgaggcggcgggtcccccggggagggggccgcccagccgcagccccgcccacccgagccccgactcgtcgcttcagcgatagctcaggttccctcaccccaccggggcaccggcctcctcatccggcatccccaccaccgctgctgctgccacggtcccacagcgacccaggcatcacgacctccagtgacactgctgacttcagggacctttataccaaagtgcttgaggaagaagctgcttctgtttcctctgcagatacagggctctgctctgaagcctgcctcttccgcctagcccgctgcccttcccccaagttgctacgtgcccggtcagccgagaaacggcgccctgtgcccaccttccaaaaagttcccctgccctcgggccctgcacctgcccactccctgggggacctaaagggcagctggccaggtcggggcctggtcactcgtttcctccagatatccaggaaagccccagaccccagtgggactggagctcatggacataagcaggtgccccggagcctgtggggccggcctggccgagagagcctccaccttcgcagctgcggagatctgagctctagctcttccctgcggcgtctcctgtctggccgcaggctggagcgtggtacccgcccccacagcctcagcctcaacgggggcagccgggagactgggctctgacctaggcttcttgtcacactgaacacatccagccacaggcaccagctggttgggaccagcagcccccagcatcctcttgcactggctggcacaaaaagaaacctgctgtataccccccaaagtgtccctttccctcctacctctggggtctcttgctgcttgcctctgctgctctggtctgggagagcttctgtcctgtgctgcatgggtatttagactgtgggggagatgccccttcttatagcactggaggaggaaaacaaattcttgtccccctcagaatgagagtggctctttctgatttgcaagggcactatggtcagggcaaaggcatggcccaggtgtttaagtacagggtgacgtgtgcctatgcaatggggtggtaaggcaggcacgaagagtccaaaaaatctaggtggcctctcagctctgccacctctagctgcatgaccttgggcaagctatgtaaccccaattgcctgctccattaaagactgtgaaggtagaatgtttgtaaagctcttaacagtatgtaagccttcaataaatttcagttttccccttgttttcttg

SEQ ID NO: 356041 - DNA, 2184 bp, Homo sapiens
gccggagacgccaggagccctgctccccacccctctccattaatgacggggaagagccaccgcctctgccgggaacgccaaggaatacgcgggcctggagcctgaaaagctggatggggctcaagtggaggcccaaaggatcactagcagcctagccagggtccagagcgaggcagggactggaggagcgcttatccgactgcctcgccctgccgcgggatcccccaaccccgacagggtctcagtcccgaactacaactcccggggtgcaccgcgccggccctcgccgccatgcccctccttcccgcaccatccccattcccatcccccttctctagtccccgaccgccctactatcccccagagtatacctgcagctcagaaacagatgcacagagcatcacgtacaatggctccatggacagcccagtgcccttgtaccctaccgattgccccccttcttatgaggcagtcatgggactacgaggagacagccaggccactctctttgaccctcagcttcacgatggctcgtgcatctgtgaacgagtggcctccattgtagacgtgtccatggacagcgggtctctggtgctgtcagccattggtgacctccctgggggctctagcccgtcggaggactcgtgcctgctggagctgcagggctccgtgcgctccgtggactacgttctctttcgctccatccagcgcagccgtgccggctactgcctcagcctggactgtggcctgcggggccccttcgaggaaagccccctgccacggcgccccccacgggctgcccgctcctattcctgctctgcccctgaagctccacccccactgggtgcccccacagctgcccgcagctgccaccggttggagggctggccgccctgggtgggaccctgcttccccgagctgaggcggcgggtcccccggggagggggccgcccagccgcagccccgcccacccgagccccgactcgtcgcttcagcgatagctcaggttccctcaccccaccggggcaccggcctcctcatccggcatccccaccaccgctgctgctgccacggtcccacagcgacccaggcatcacgacctccagtgacactgctgacttcagggacctttataccaaagtgcttgaggaagaagctgcttctgtttcctctgcagatacagggctctgctctgaagcctgcctcttccgcctagcccgctgcccttcccccaagttgctacgtgcccggtcagccgagaaacggcgccctgtgcccaccttccaaaaagttcccctgccctcgggccctgcacctgcccactccctgggggacctaaagggcagctggccaggtcggggcctggtcactcgtttcctccagatatccaggaaagccccagaccccagtgggactggagctcatggacataagcaggtgccccggagcctgtggggccggcctggccgagagagcctccaccttcgcagctgcggagatctgagctctagctcttccctgcggcgtctcctgtctggccgcaggctggagcgtggtacccgcccccacagcctcagcctcaacgggggcagccgggagactgggctctgacctaggcttcttgtcacactgaacacatccagccacaggcaccagctggttgggaccagcagcccccagcatcctcttgcactggctggcacaaaaagaaacctgctgtataccccccaaagtgtccctttccctcctacctctggggtctcttgctgcttgcctctgctgctctggtctgggagagcttctgtcctgtgctgcatgggtatttagactgtgggggagatgccccttcttatagcactggaggaggaaaacaaattcttgtccccctcagaatgagagtggctctttctgatttgcaagggcactatggtcagggcaaaggcatggcccaggtgtttaagtacagggtgacgtgtgcctatgcaatggggtggtaaggcaggcacgaagagtccaaaaaatctaggtggcctctcagctctgccacctctagctgcatgaccttgggcaagctatgtaaccccaattgcctgctccattaaagactgtgaaggtagaatgtttgtaaagctcttaacagtatgtaagccttcaataaatttcagttttccccttgttttcttg

SEQ ID NO: 356042 - DNA, 1373 bp, Homo sapiens
aaagattgcaggtcgaggctgggtttaatcgggccgaggccacagctgcccgcagctgccaccggttggagggctggccgccctgggtgggaccctgcttccccgagctgaggcggcgggtcccccggggagggggccgcccagccgcagccccgcccacccgagccccgactcgtcgcttcagcgatagctcaggttccctcaccccaccggggcaccggcctcctcatccggcatccccaccaccgctgctgctgccacggtcccacagcgacccaggcatcacgacctccagtgacactgctgacttcagggacctttataccaaagtgcttgaggaagaagctgcttctgtttcctctgcagatacagggctctgctctgaagcctgcctcttccgcctagcccgctgcccttcccccaagttgctacgtgcccggtcagccgagaaacggcgccctgtgcccaccttccaaaaagttcccctgccctcgggccctgcacctgcccactccctgggggacctaaagggcagctggccaggtcggggcctggtcactcgtttcctccagatatccaggaaagccccagaccccagtgggactggagctcatggacataagcaggtgccccggagcctgtggggccggcctggccgagagagcctccaccttcgcagctgcggagatctgagctctagctcttccctgcggcgtctcctgtctggccgcaggctggagcgtggtacccgcccccacagcctcagcctcaacgggggcagccgggagactgggctctgacctaggcttcttgtcacactgaacacatccagccacaggcaccagctggttgggaccagcagcccccagcatcctcttgcactggctggcacaaaaagaaacctgctgtataccccccaaagtgtccctttccctcctacctctggggtctcttgctgcttgcctctgctgctctggtctgggagagcttctgtcctgtgctgcatgggtatttagactgtgggggagatgccccttcttatagcactggaggaggaaaacaaattcttgtccccctcagaatgagagtggctctttctgatttgcaagggcactatggtcagggcaaaggcatggcccaggtgtttaagtacagggtgacgtgtgcctatgcaatggggtggtaaggcaggcacgaagagtccaaaaaatctaggtggcctctcagctctgccacctctagctgcatgaccttgggcaagctatgtaaccccaattgcctgctccattaaagactgtgaaggtagaatgtttgtaaagctcttaacagtatgtaagccttcaataaatttcagttttccccttgttttcttg

SEQ ID NO: 356043 - DNA, 574 bp, Homo sapiens
tctttaccccatccaagatggctttggtgttgaagaactggaaaacagttatctttaacacaattccaagacagaactcagaggcccaatatagtgcaaagttctagaaagacagctgaaggctggtcatctcttccaggtgcacctggctcatcctactaggaggtcttgtcccggctctgtcctaccttgaggcagcctggggatgctaccaaacttcagtgggccttagcttccttatctacaaagcagagataggtccagggtctcttatctggaaccaaggaggtcagatatgttcagagtcagatgcaaatatcccacaaagcatcttacccagtgggcttcgggcagcgccccttcgttaaacacttgaatattcggcagtgggatgaaggcatccatagtctcaggatagttcaagccacattgttctgtcaaatttgtgtgtgccaactttagggaaaaactaaggtttcagattttttgcatttcagggattttggagaagtgattgtgaacctgtagcttctcacatgattaataaaaaggttggtggaacagaaaaaaaaaa

SEQ ID NO: 356044 - DNA, 1554 bp, Homo sapiens
gggaggtgcctgaatagggtttgagggtctgtttgagttgggtgaagaaggcgggaagttaatcctcttccaatcagctccccatctcgccctctggcggctccggaccacaggccgagttactctgattaccgccatgctccaagacccgcactgacagtccccacgtgagggaccgcggtgggagtcctaaatgggggaggaggggacgggcggcactgtgcatctgctgtgcctcgcggcctccagcggggtccccctattctgcaggagcagtcgcggcggcgcccccgcccgtcagcagctcccgttctctgtcatcggttccctcaatggagtccacatgtttgggcagaatctggaggtgcagctgagctctgcgaggaccgagaacacgactgtggtgtggaaaagcttccatgacagcatcaccctcattgttctgtcatctgaggtgggcatctctgagctgaggctggagagactactccaaatggtgtttggagccatggtccttcttgtgggacttgaagaactgaccaatatccgcaacgtggagagactgaagaaggacttgagggccagttattgcctcatcgacagcttcctgggggactcggagctcatcggggacctgacccagtgtgtggactgcgtgattcctccagaggggtccctcttgcaggaagccctctccgggttcgctgaggccgcgggcacgaccttcgtcagtctggtggtgtccggccgggtggtggcagcaacagagggttggtggcggctggggacgcccgaggccgtgctgctcccctggctggtggggtccctgccgccgcagaccgctcgcgactacccggtgtacctgccgcacgggagccccacggtcccacaccggctcctgaccctgactctgctgccgagcctggagctgtgtctactctgcgggccgagcccacccctcagccagttgtatccacagcttctggagcgctggtggcagccactgctggacccgttgcgggcctgtctgccgttgggaccccgggcgctgcccagtggcttcccccttcacacagacatcctcgggctgctgctcctccacctggaactgaagcgctgcctcttcaccgtggagcccttgggggataaagagccttcaccagaacagcgccggcgcctcctccgaaacttctataccctggtcacctccacgcacttcccaccagagccagggccaccagagaagacagaagatgaggtctaccaggcccagctgcccagagcttgctacctagcagtgggtgatggacacagacatggggctgttagcgtctctctgtttattcgctcacaataatacacagcccctggatggggagggggtaggaggggctacaacagggtggggtgggaggggaggagacatccacttccctggcccctctcccctctgtgcttgggggggaaagggagggagggggactccccctaaccccccagaatgtaaacagcagcagatgaacaaaaataaaaatacaaaaggccggaggaaag

SEQ ID NO: 356045 - DNA, 927 bp, Homo sapiens
  misc_feature (23)..(23): n is a, c, g, or t
  misc_feature (41)..(41): n is a, c, g, or t
  misc_feature (911)..(911): n is a, c, g, or t
aagaataggctagtacgaggctngtgttaatcggccgaggngccgagttactctgattaccgccatgctccaagacccgcactgacagtccccacgtgagggaccgcggtgggagtcctaaatgggggaggaggggacgggcggcactgtgcatctgctgtgcctcgcggcctccagcggggtccccctattctgcaggagcagtcgcggcggcgcccccgcccgtcagcagctcccgttctctgtcatcggttccctcaatggagtccacatgtttgggcagaatctggaggtgcagctgagctctgcgaggaccgagaacacgactgtggtccttcttgtgggacttgaagaactgaccaatatccgcaacgtggagagactgaagaaggacttgagggccagttattgcctcatcgacagcttcctgggggactcggagctcatcggggacctgacccagtgtgtggactgcgtgattcctccagaggggtccctcttgcagtctggtggtgtccggccgggtggtggcagcaacagagggttggtggcggctggggacgcccgaggccgtgctgctcccctggctggtggggtccctgccgccgcagaccgctcgcgactacccggtgtacctgccgcacgggagccccacggtcccacaccggctcctgaccctgactctgctgccgagcctggagctgtgtctactctgcgggccgagcccacccctcagccagttgtatccacagcttctggagcgctggtggcagccactgctggacccgttgcgggcctgtctgccgttgggaccccgggcgctgcccagtggcttcccccttcacacagacatcctcggggtgctgtgcctccactgaatgaaggccgcccttcaccggggcctggggtanaagcttccaaaaagcg

SEQ ID NO: 356046 - DNA, 1717 bp, Homo sapiens
gggaggtgcctgaatagggtttgagggtctgtttgagttgggtgaagaaggcgggaagttaatcctcttccaatcagctccccatctcgccctctggcggctccggaccacaggccgagttactctgattaccgccatgctccaagacccgcactgacagtccccacgtgagggaccgcggtgggagtcctaaatgggggaggaggggacgggcggcactgtgcatctgctgtgcctcgcggcctccagcggggtccccctattctgcaggagcagtcgcggcggcgcccccgcccgtcagcagctcccgttctctgtcatcggttccctcaatggagtccacatgtttgggcagaatctggaggtgcagctgagctctgcgaggaccgagaacacgactgtggtgtggaaaagcttccatgacagcatcaccctcattgttctgtcatctgaggtgggcatctctgagctgaggctggagagactactccaaatggtgtttggagccatggtccttcttgtgggacttgaagaactgaccaatatccgcaacgtggagagactgaagaaggacttgagggccagttattgcctcatcgacagcttcctgggggactcggagctcatcggggacctgacccagtgtgtggactgcgtgattcctccagaggggtccctcttgcaggaagccctctccgggttcgctgaggccgcgggcacgaccttcgtcagtctggtggtgtccggccgggtggtggcagcaacagagggttggtggcggctggggacgcccgaggccgtgctgctcccctggctggtggggtccctgccgccgcagaccgctcgcgactacccggtgtacctgccgcacgggagccccacggtcccacaccggctcctgaccctgactctgctgccgagcctggagctgtgtctactctgcgggccgagcccacccctcagccagttgtatccacagcttctggagcgctggtggcagccactgctggacccgttgcgggcctgtctgccgttgggaccccgggcgctgcccagtggcttcccccttcacacagacatcctcgggctgctgctcctccacctggaactgaagcgctgcctcttcaccgtggagcccttgggggataaagagccttcaccagaacagcgccggcgcctcctccgaaacttctataccctggtcacctccacgcacttcccaccagagccagggccaccagagaagacagaagatgaggtctaccaggcccagctgcccagagcttgctacctggtgttggggactgaggaaccaggcacaggagtgcgtctggtggccttgcagctggggcttcggcggctgctgctgctgctgtctccccagagtcccacccatgggctgcgaagcctggccacccacactctgcatgccctcaccccacttctttgactacctagcagtgggtgatggacacagacatggggctgttagcgtctctctgtttattcgctcacaataatacacagcccctggatggggagggggtaggaggggctacaacagggtggggtgggaggggaggagacatccacttccctggcccctctcccctctgtgcttgggggggaaagggagggagggggactccccctaaccccccagaatgtaaacagcagcagatgaacaaaaataaaaatacaaaaggccggaggaaag

SEQ ID NO: 356047 - DNA, 1694 bp, Homo sapiens
gggaggtgcctgaatagggtttgagggtctgtttgagttgggtgaagaaggcgggaagttaatcctcttccaatcagctccccatctcgccctctggcggctccggaccacaggccgagttactctgattaccgccatgctccaagacccgcactgacagtccccacgtgagggaccgcggtgggagtcctaaatgggggaggaggggacgggcggcactgtgcatctgctgtgcctcgcggcctccagcggggtccccctattctgcaggagcagtcgcggcggcgcccccgcccgtcagcagctcccgttctctgtcatcggttccctcaatggagtccacatgtttgggcagaatctggaggtgcagctgagctctgcgaggaccgagaacacgactgtgcatcaccctcattgttctgtcatctgaggtgggcatctctgagctgaggctggagagactactccaaatggtgtttggagccatggtccttcttgtgggacttgaagaactgaccaatatccgcaacgtggagagactgaagaaggacttgagggccagttattgcctcatcgacagcttcctgggggactcggagctcatcggggacctgacccagtgtgtggactgcgtgattcctccagaggggtccctcttgcaggaagccctctccgggttcgctgaggccgcgggcacgaccttcgtcagtctggtggtgtccggccgggtggtggcagcaacagagggttggtggcggctggggacgcccgaggccgtgctgctcccctggctggtggggtccctgccgccgcagaccgctcgcgactacccggtgtacctgccgcacgggagccccacggtcccacaccggctcctgaccctgactctgctgccgagcctggagctgtgtctactctgcgggccgagcccacccctcagccagttgtatccacagcttctggagcgctggtggcagccactgctggacccgttgcgggcctgtctgccgttgggaccccgggcgctgcccagtggcttcccccttcacacagacatcctcgggctgctgctcctccacctggaactgaagcgctgcctcttcaccgtggagcccttgggggataaagagccttcaccagaacagcgccggcgcctcctccgaaacttctataccctggtcacctccacgcacttcccaccagagccagggccaccagagaagacagaagatgaggtctaccaggcccagctgcccagagcttgctacctggtgttggggactgaggaaccaggcacaggagtgcgtctggtggccttgcagctggggcttcggcggctgctgctgctgctgtctccccagagtcccacccatgggctgcgaagcctggccacccacactctgcatgccctcaccccacttctttgactacctagcagtgggtgatggacacagacatggggctgttagcgtctctctgtttattcgctcacaataatacacagcccctggatggggagggggtaggaggggctacaacagggtggggtgggaggggaggagacatccacttccctggcccctctcccctctgtgcttgggggggaaagggagggagggggactccccctaaccccccagaatgtaaacagcagcagatgaacaaaaataaaaatacaaaaggccggaggaaag

SEQ ID NO: 356048 - DNA, 1741 bp, Homo sapiens
gggaggtgcctgaatagggtttgagggtctgtttgagttgggtgaagaaggcgggaagttaatcctcttccaatcagctccccatctcgccctctggcggctccggaccacaggccgagttactctgattaccgccatgctccaagacccgcactgacagtccccacgtgagggaccgcggtgggagtcctaaatgggggaggaggggacgggcggcactgtgcatctgctgtgcctcgcggcctccagcggggtccccctattctgcaggagcagtcgcggcggcgcccccgcccgtcagcagctcccgttctctgtcatcggttccctcaatggagtccacatgtttgggcagaatctggaggtgcagctgagctctgcgaggaccgagaacacgactgtggtgtggaaaagcttccatgacagcatcaccctcattgttctgtcatctgaggtgggcatctctgagctgaggctggagagactactccaaatggtgtttggagccatggtccttcttgtgggacttgaagaactgaccaatatccgcaacgtggagagactgaagaaggacttgagggctggtcccttcttcctctcctaggccagttattgcctcatcgacagcttcctgggggactcggagctcatcggggacctgacccagtgtgtggactgcgtgattcctccagaggggtccctcttgcaggaagccctctccgggttcgctgaggccgcgggcacgaccttcgtcagtctggtggtgtccggccgggtggtggcagcaacagagggttggtggcggctggggacgcccgaggccgtgctgctcccctggctggtggggtccctgccgccgcagaccgctcgcgactacccggtgtacctgccgcacgggagccccacggtcccacaccggctcctgaccctgactctgctgccgagcctggagctgtgtctactctgcgggccgagcccacccctcagccagttgtatccacagcttctggagcgctggtggcagccactgctggacccgttgcgggcctgtctgccgttgggaccccgggcgctgcccagtggcttcccccttcacacagacatcctcgggctgctgctcctccacctggaactgaagcgctgcctcttcaccgtggagcccttgggggataaagagccttcaccagaacagcgccggcgcctcctccgaaacttctataccctggtcacctccacgcacttcccaccagagccagggccaccagagaagacagaagatgaggtctaccaggcccagctgcccagagcttgctacctggtgttggggactgaggaaccaggcacaggagtgcgtctggtggccttgcagctggggcttcggcggctgctgctgctgctgtctccccagagtcccacccatgggctgcgaagcctggccacccacactctgcatgccctcaccccacttctttgactacctagcagtgggtgatggacacagacatggggctgttagcgtctctctgtttattcgctcacaataatacacagcccctggatggggagggggtaggaggggctacaacagggtggggtgggaggggaggagacatccacttccctggcccctctcccctctgtgcttgggggggaaagggagggagggggactccccctaaccccccagaatgtaaacagcagcagatgaacaaaaataaaaatacaaaaggccggaggaaag

SEQ ID NO: 356049 - DNA, 1834 bp, Homo sapiens
gggaggtgcctgaatagggtttgagggtctgtttgagttgggtgaagaaggcgggaagttaatcctcttccaatcagctccccatctcgccctctggcggctccggaccacaggccgagttactctgattaccgccatgctccaagacccgcactgacagtccccacgtgagggaccgcggtgggagtcctaaatgggggaggaggggacgggcggcactgtgcatctgctgtgcctcgcggcctccagcggggtccccctattctgcaggagcagtcgcggcggcgcccccgcccgtcagcagaatctggaggtgcagctgagctctgcgaggaccgagaacacgactgtggtgtggaaaagcttccatgacaggtccccaggagggaacgtgggacagggacagggcctgggtgatagtccctgttgaagatgaccccggaggccttccagctctctaaaagcagctgttaatttggctatgggatctttagcaagccagttaccctctttgatccctgatgttctctataagaaaggcagcatcaccctcattgttctgtcatctgaggtgggcatctctgagctgaggctggagagactactccaaatggtgtttggagccatggtccttcttgtgggacttgaagaactgaccaatatccgcaacgtggagagactgaagaaggacttgagggccagttattgcctcatcgacagcttcctgggggactcggagctcatcggggacctgacccagtgtgtggactgcgtgattcctccagaggggtccctcttgcaggaagccctctccgggttcgctgaggccgcgggcacgaccttcgtcagtctggtggtgtccggccgggtggtggcagcaacagagggttggtggcggctggggacgcccgaggccgtgctgctcccctggctggtggggtccctgccgccgcagaccgctcgcgactacccggtgtacctgccgcacgggagccccacggtcccacaccggctcctgaccctgactctgctgccgagcctggagctgtgtctactctgcgggccgagcccacccctcagccagttgtatccacagcttctggagcgctggtggcagccactgctggacccgttgcgggcctgtctgccgttgggaccccgggcgctgcccagtggcttcccccttcacacagacatcctcgggctgctgctcctccacctggaactgaagcgctgcctcttcaccgtggagcccttgggggataaagagccttcaccagaacagcgccggcgcctcctccgaaacttctataccctggtcacctccacgcacttcccaccagagccagggccaccagagaagacagaagatgaggtctaccaggcccagctgcccagagcttgctacctggtgttggggactgaggaaccaggcacaggagtgcgtctggtggccttgcagctggggcttcggcggctgctgctgctgctgtctccccagagtcccacccatgggctgcgaagcctggccacccacactctgcatgccctcaccccacttctttgactacctagcagtgggtgatggacacagacatggggctgttagcgtctctctgtttattcgctcacaataatacacagcccctggatggggagggggtaggaggggctacaacagggtggggtgggaggggaggagacatccacttccctggcccctctcccctctgtgcttgggggggaaagggagggagggggactccccctaaccccccagaatgtaaacagcagcagatgaacaaaaataaaaatacaaaaggccggaggaaag

SEQ ID NO: 356050 - DNA, 1604 bp, Homo sapiens
gggaggtgcctgaatagggtttgagggtctgtttgagttgggtgaagaaggcgggaagttaatcctcttccaatcagctccccatctcgccctctggcggctccggaccacaggccgagttactctgattaccgccatgctccaagacccgcactgacagtccccacctcccgttctctgtcatcggttccctcaatggagtccacatgtttgggcagaatctggaggtgcagctgagctctgcgaggaccgagaacacgactgtggtgtggaaaagcttccatgacagcatcaccctcattgttctgtcatctgaggtgggcatctctgagctgaggctggagagactactccaaatggtgtttggagccatggtccttcttgtgggacttgaagaactgaccaatatccgcaacgtggagagactgaagaaggacttgagggctggtcccttcttcctctcctaggccagttattgcctcatcgacagcttcctgggggactcggagctcatcggggacctgacccagtgtgtggactgcgtgattcctccagaggggtccctcttgcaggaagccctctccgggttcgctgaggccgcgggcacgaccttcgtcagtctggtggtgtccggccgggtggtggcagcaacagagggttggtggcggctggggacgcccgaggccgtgctgctcccctggctggtggggtccctgccgccgcagaccgctcgcgactacccggtgtacctgccgcacgggagccccacggtcccacaccggctcctgaccctgactctgctgccgagcctggagctgtgtctactctgcgggccgagcccacccctcagccagttgtatccacagcttctggagcgctggtggcagccactgctggacccgttgcgggcctgtctgccgttgggaccccgggcgctgcccagtggcttcccccttcacacagacatcctcgggctgctgctcctccacctggaactgaagcgctgcctcttcaccgtggagcccttgggggataaagagccttcaccagaacagcgccggcgcctcctccgaaacttctataccctggtcacctccacgcacttcccaccagagccagggccaccagagaagacagaagatgaggtctaccaggcccagctgcccagagcttgctacctggtgttggggactgaggaaccaggcacaggagtgcgtctggtggccttgcagctggggcttcggcggctgctgctgctgctgtctccccagagtcccacccatgggctgcgaagcctggccacccacactctgcatgccctcaccccacttctttgactacctagcagtgggtgatggacacagacatggggctgttagcgtctctctgtttattcgctcacaataatacacagcccctggatggggagggggtaggaggggctacaacagggtggggtgggaggggaggagacatccacttccctggcccctctcccctctgtgcttgggggggaaagggagggagggggactccccctaaccccccagaatgtaaacagcagcagatgaacaaaaataaaaatacaaaaggccggaggaaag

SEQ ID NO: 356051 - DNA, 267 bp, Homo sapiens
gtgtggaaaagcttccatgacaggtccccaggagggaacgtgggacagggacagggcctgggtgatagtccctgttgaagatgaccccggaggccttccagctctctaaaagcagctgttaatttggctatgggatctttagcaagccagttaccctctttgatccctgatgttctctataagaaaggcaggttggtctgagagaggatgtatctggtgttctaggatcaatgggcggactccaacataccccttcctgattcccca

SEQ ID NO: 356052 - DNA, 1004 bp, Homo sapiens
  misc_feature (885)..(885): n is a, c, g, or t
  misc_feature (892)..(892): n is a, c, g, or t
gggaggtgcctgaatagggtttgagggtctgtttgagttgggtgaagaaggcgggaagttaatcctcttccaatcagctccccatctcgccctctggcggctccggaccacaggccgagttactctgattaccgccatgctccaagacccgcactgacagtccccacctcccgttctctgtcatcggttccctcaatggagtccacatgtttgggcagaatctggaggtgcagctgagctctgcgaggaccgagaacacgactgtggtgtggaaaagcttccatgacagcatcaccctcattgttctgtcatctgaggtgggcatctctgagctgaggctggagagactactccaaatggtgtttggagccatggtccttcttgtgggacttgaagaactgaccaatatccgcaacgtggagagactgaagaaggacttgagggccagttattgcctcatcgacagcttcctgggggactcggagctcatcggggacctgacccagtgtgtggactgcgtgattcctccagaggggtccctcttgcaggaagccctctccgggttcgctgaggccgcgggcacgaccttcgtcagtctggtggtgtccggccgggtggtggcagcaacagagggttggtggcggctggggacgcccgaggccgtgctgctcccctggctggtggggtccctgccgccgcagaccgctcgcgactacccggtgtacctgccgcacgggagccccacggtcccacaccggctcctgaccctgactctgctgccgagcctggagctgtgtctactctgcgggccgagcccacccctcagccagttgtatccacagttctggagcgctggggagcatgtggaccgttggggcctgttgncgtgggnccggctgccaggttcccttacagaattcggggggctccggagggggcttccggcttgggaaggccacagcggcccaatacggctcccaccgccgaaagttcgctttggggaa

SEQ ID NO: 356053 - DNA, 1609 bp, Homo sapiens
gggaggtgcctgaatagggtttgagggtctgtttgagttgggtgaagaaggcgggaagttaatcctcttccaatcagctccccatctcgccctctggcggctccggaccacaggccgagttactctgattaccgccatgctccaagacccgcactgacagtccccacgtgagggaccgcggtgggagtcctaaatgggggaggaggggacgggcggcactgtgcatctgctgtgcctcgcggcctccagcggggtccccctattctgcaggagcagtcgcggcggcgcccccgcccgtcagcagctcccgttctctgtcatcggttccctcaatggagtccacatgtttgggcagaatctggaggtgcagctgagctctgcgaggaccgagaacacgactgtggtccttcttgtgggacttgaagaactgaccaatatccgcaacgtggagagactgaagaaggacttgagggccagttattgcctcatcgacagcttcctgggggactcggagctcatcggggacctgacccagtgtgtggactgcgtgattcctccagaggggtccctcttgcaggaagccctctccgggttcgctgaggccgcgggcacgaccttcgtcagtctggtggtgtccggccgggtggtggcagcaacagagggttggtggcggctggggacgcccgaggccgtgctgctcccctggctggtggggtccctgccgccgcagaccgctcgcgactacccggtgtacctgccgcacgggagccccacggtcccacaccggctcctgaccctgactctgctgccgagcctggagctgtgtctactctgcgggccgagcccacccctcagccagttgtatccacagcttctggagcgctggtggcagccactgctggacccgttgcgggcctgtctgccgttgggaccccgggcgctgcccagtggcttcccccttcacacagacatcctcgggctgctgctcctccacctggaactgaagcgctgcctcttcaccgtggagcccttgggggataaagagccttcaccagaacagcgccggcgcctcctccgaaacttctataccctggtcacctccacgcacttcccaccagagccagggccaccagagaagacagaagatgaggtctaccaggcccagctgcccagagcttgctacctggtgttggggactgaggaaccaggcacaggagtgcgtctggtggccttgcagctggggcttcggcggctgctgctgctgctgtctccccagagtcccacccatgggctgcgaagcctggccacccacactctgcatgccctcaccccacttctttgactacctagcagtgggtgatggacacagacatggggctgttagcgtctctctgtttattcgctcacaataatacacagcccctggatggggagggggtaggaggggctacaacagggtggggtgggaggggaggagacatccacttccctggcccctctcccctctgtgcttgggggggaaagggagggagggggactccccctaaccccccagaatgtaaacagcagcagatgaacaaaaataaaaatacaaaaggccggaggaaag

SEQ ID NO: 356054 - DNA, 1580 bp, Homo sapiens
gggaggtgcctgaatagggtttgagggtctgtttgagttgggtgaagaaggcgggaagttaatcctcttccaatcagctccccatctcgccctctggcggctccggaccacaggccgagttactctgattaccgccatgctccaagacccgcactgacagtccccacctcccgttctctgtcatcggttccctcaatggagtccacatgtttgggcagaatctggaggtgcagctgagctctgcgaggaccgagaacacgactgtggtgtggaaaagcttccatgacagcatcaccctcattgttctgtcatctgaggtgggcatctctgagctgaggctggagagactactccaaatggtgtttggagccatggtccttcttgtgggacttgaagaactgaccaatatccgcaacgtggagagactgaagaaggacttgagggccagttattgcctcatcgacagcttcctgggggactcggagctcatcggggacctgacccagtgtgtggactgcgtgattcctccagaggggtccctcttgcaggaagccctctccgggttcgctgaggccgcgggcacgaccttcgtcagtctggtggtgtccggccgggtggtggcagcaacagagggttggtggcggctggggacgcccgaggccgtgctgctcccctggctggtggggtccctgccgccgcagaccgctcgcgactacccggtgtacctgccgcacgggagccccacggtcccacaccggctcctgaccctgactctgctgccgagcctggagctgtgtctactctgcgggccgagcccacccctcagccagttgtatccacagcttctggagcgctggtggcagccactgctggacccgttgcgggcctgtctgccgttgggaccccgggcgctgcccagtggcttcccccttcacacagacatcctcgggctgctgctcctccacctggaactgaagcgctgcctcttcaccgtggagcccttgggggataaagagccttcaccagaacagcgccggcgcctcctccgaaacttctataccctggtcacctccacgcacttcccaccagagccagggccaccagagaagacagaagatgaggtctaccaggcccagctgcccagagcttgctacctggtgttggggactgaggaaccaggcacaggagtgcgtctggtggccttgcagctggggcttcggcggctgctgctgctgctgtctccccagagtcccacccatgggctgcgaagcctggccacccacactctgcatgccctcaccccacttctttgactacctagcagtgggtgatggacacagacatggggctgttagcgtctctctgtttattcgctcacaataatacacagcccctggatggggagggggtaggaggggctacaacagggtggggtgggaggggaggagacatccacttccctggcccctctcccctctgtgcttgggggggaaagggagggagggggactccccctaaccccccagaatgtaaacagcagcagatgaacaaaaataaaaatacaaaaggccggaggaaag

SEQ ID NO: 356055 - DNA, 1885 bp, Homo sapiens
gggaggtgcctgaatagggtttgagggtctgtttgagttgggtgaagaaggcgggaagttaatcctcttccaatcagctccccatctcgccctctggcggctccggaccacaggccgagttactctgattaccgccatgctccaagacccgcactgacagtccccacgtgagggaccgcggtgggagtcctaaatgggggaggaggggacgggcggcactgtgcatctgctgtgcctcgcggcctccagcggggtccccctattctgcaggagcagtcgcggcggcgcccccgcccgtcagcagctcccgttctctgtcatcggttccctcaatggagtccacatgtttgggcagaatctggaggtgcagctgagctctgcgaggaccgagaacacgactgtggtgtggaaaagcttccatgacaggtccccaggagggaacgtgggacagggacagggcctgggtgatagtccctgttgaagatgaccccggaggccttccagctctctaaaagcagctgttaatttggctatgggatctttagcaagccagttaccctctttgatccctgatgttctctataagaaaggcagcatcaccctcattgttctgtcatctgaggtgggcatctctgagctgaggctggagagactactccaaatggtgtttggagccatggtccttcttgtgggacttgaagaactgaccaatatccgcaacgtggagagactgaagaaggacttgagggccagttattgcctcatcgacagcttcctgggggactcggagctcatcggggacctgacccagtgtgtggactgcgtgattcctccagaggggtccctcttgcaggaagccctctccgggttcgctgaggccgcgggcacgaccttcgtcagtctggtggtgtccggccgggtggtggcagcaacagagggttggtggcggctggggacgcccgaggccgtgctgctcccctggctggtggggtccctgccgccgcagaccgctcgcgactacccggtgtacctgccgcacgggagccccacggtcccacaccggctcctgaccctgactctgctgccgagcctggagctgtgtctactctgcgggccgagcccacccctcagccagttgtatccacagcttctggagcgctggtggcagccactgctggacccgttgcgggcctgtctgccgttgggaccccgggcgctgcccagtggcttcccccttcacacagacatcctcgggctgctgctcctccacctggaactgaagcgctgcctcttcaccgtggagcccttgggggataaagagccttcaccagaacagcgccggcgcctcctccgaaacttctataccctggtcacctccacgcacttcccaccagagccagggccaccagagaagacagaagatgaggtctaccaggcccagctgcccagagcttgctacctggtgttggggactgaggaaccaggcacaggagtgcgtctggtggccttgcagctggggcttcggcggctgctgctgctgctgtctccccagagtcccacccatgggctgcgaagcctggccacccacactctgcatgccctcaccccacttctttgactacctagcagtgggtgatggacacagacatggggctgttagcgtctctctgtttattcgctcacaataatacacagcccctggatggggagggggtaggaggggctacaacagggtggggtgggaggggaggagacatccacttccctggcccctctcccctctgtgcttgggggggaaagggagggagggggactccccctaaccccccagaatgtaaacagcagcagatgaacaaaaataaaaatacaaaaggccggaggaaag

SEQ ID NO: 356056 - DNA, 1098 bp, Homo sapiens
  misc_feature (19)..(19): n is a, c, g, or t
tacggctaggtacgaggcngggtgtgtgtggactgcgtgattcctccagaggggtccctcttgcaggaagccctctccgggttcgctgaggccgcgggcacgaccttcgtcagtctggtggtgtccggccgggtggtggcagcaacagagggttggtggcggctggggacgcccgaggccgtgctgctcccctggctggtggggtccctgccgccgcagaccgctcgcgactacccggtgtacctgccgcacgggagccccacggtcccacaccggctcctgaccctgactctgctgccgagcctggagctgtgtctactctgcgggccgagcccacccctcagccagttgtatccacagcttctggagcgctggtggcagccactgctggacccgttgcgggcctgtctgccgttgggaccccgggcgctgcccagtggcttcccccttcacacagacatcctcgggctgctgctcctccacctggaactgaagcgctgcctcttcaccgtggagcccttgggggataaagagccttcaccagaacagcgccggcgcctcctccgaaacttctataccctggtcacctccacgcacttcccaccagagccagggccaccagagaagacagaagatgaggtctaccaggcccagctgcccagagcttgctacctggtgttggggactgaggaaccaggcacaggagtgcgtctggtggccttgcagctggggcttcggcggctgctgctgctgctgtctccccagagtcccacccatgggctgcgaagcctggccacccacactctgcatgccctcaccccacttctttgactacctagcagtgggtgatggacacagacatggggctgttagcgtctctctgtttattcgctcacaataatacacagcccctggatggggagggggtaggaggggctacaacagggtggggtgggaggggaggagacatccacttccctggcccctctcccctctgtgcttgggggggaaagggagggagggggactccccctaaccccccagaatgtaaacagcagcagatgaacaaaaataaaaatacaaaaggccggaggaaag

SEQ ID NO: 356057 - DNA, 1053 bp, Homo sapiens
  misc_feature (23)..(23): n is a, c, g, or t
  misc_feature (41)..(41): n is a, c, g, or t
aagaataggctagtacgaggctngtgttaatcggccgaggntgaggccgcgggcacgaccttcgtcagtctggtggtgtccggccgggtggtggcagcaacagagggttggtggcggctggggacgcccgaggccgtgctgctcccctggctggtggggtccctgccgccgcagaccgctcgcgactacccggtgtacctgccgcacgggagccccacggtcccacaccggctcctgaccctgactctgctgccgagcctggagctgtgtctactctgcgggccgagcccacccctcagccagttgtatccacagcttctggagcgctggtggcagccactgctggacccgttgcgggcctgtctgccgttgggaccccgggcgctgcccagtggcttcccccttcacacagacatcctcgggctgctgctcctccacctggaactgaagcgctgcctcttcaccgtggagcccttgggggataaagagccttcaccagaacagcgccggcgcctcctccgaaacttctataccctggtcacctccacgcacttcccaccagagccagggccaccagagaagacagaagatgaggtctaccaggcccagctgcccagagcttgctacctggtgttggggactgaggaaccaggcacaggagtgcgtctggtggccttgcagctggggcttcggcggctgctgctgctgctgtctccccagagtcccacccatgggctgcgaagcctggccacccacactctgcatgccctcaccccacttctttgactacctagcagtgggtgatggacacagacatggggctgttagcgtctctctgtttattcgctcacaataatacacagcccctggatggggagggggtaggaggggctacaacagggtggggtgggaggggaggagacatccacttccctggcccctctcccctctgtgcttgggggggaaagggagggagggggactccccctaaccccccagaatgtaaacagcagcagatgaacaaaaataaaaatacaaaaggccggaggaaag

SEQ ID NO: 356058 - DNA, 9654 bp, Homo sapiens
ccaagaattcggcacgagggcctgctgcactcggccttcttcggggaccagacgctgcaggagctgaagatggcgagctccgtggcgccctacgagcagctggtgaggcaggtggaggccttgaaggctgagaacagccacctgaggcaggagctaagggacaactccagccacctgtccaagctggagacagagacgtcgggcatgaaggaggtcctgaagcacctacagggaaaactggagcaggaggcccgagtgctggtgtcctcggggcagacggaggtgctggagcagctgaaggccctacagatggacatcaccagcctgtacaacctcaagttccagccgcccaccctgggcccggagcctgccgcccggacccccgagggcagcccagtacacggctccgggccctccaaggacagctttggggagctgagccgggccaccatccggctgctggaggaactggaccgggaacggtgtttcctgctgaatgagattgagaaggaggagaaggagaagctctggtactactctcagctgcagggcctgtccaagcgcctggacgaagctgctgcaggttgactatgagatgcacaagatgacccgggacccgctgaacctggcgctgcgccgctacgcgggcatgaccctcaccaacctcacctttggggacgttgccaacaaggccaccctgtgtgcgcgccgcggctgcatggaggccatcgtggcccagctggcctccgacagtgaggagctccaccaggtggtgtccagcatccttcggaacttgtcctggagggccgacatcaacagcaagaaggtgctgagggaggcgggcagcgtgactgccctggtgcagtgtgtcctgcgggccaccaaggagtccaccctgaagagcgtgctgagcgccctgtggaatctgtctgcacacagcacagagaacaaggcggccatctgccaggtggatggcgccctgggcttcctggtgagcaccctgacctacaagtgtcagagcaactcgctggccatcatcgagagcggcggcggcatcctccgcaatgtgtccagcctcgtcgccacccgtgaggactacaggcaggtgctccgggatcacaactgtctgcagacgctgctgcagcatctgacttcgcacagcctgaccatcgtgagcaacgcgtgcggcacgctctggaacctgtcggcccgcagcgcccgtgaccaggagctgctgtgggacctgggcgccgtgggcatgctgcgtaatctggtgcactccaagcacaagatgatcgccatgggcagcgccgccgccctgcgcaacctgctggcccatcggcccgccaagcaccaggcggccgccaccgccgtgtccccaggcagctgcgtgcccagcctgtacgtgcgcaagcagcgggcgctggaggccgagctggacgcacggcacctcgcgcaggcgctggagcacctggagaagcagggcccgccggcagccgaggccgccactaagaagccgctgccgcccctgcgacacctggacggcctggcccaagactatgcttccgattcgggctgctttgacgacgacgatgcaccgtcatccctggctgcggccgcggccaccggggagccagccagccctgccgcgctgtccctcttcctgggcagccccttcctgcaggggcaggcgctggctcgcaccccgcccacccgccgaggcggcaaggaggcagagaaggacaccagtggggaggcagccgtggcggccaaggccaaggccaagctggcgcttgcagtggcgcgcatcgaccagctggtggaggacatctccgccctgcacacctcgtccgacgatagcttcagcctcagctctggagacccgggacaggaggcgccacgggagggccgcgcccagtcctgctcgccatgccgcggcccggagggcgggcggcgagaggcaggaagccgggcgcacccgctgctgcggctcaaggcggcccacgccagcctctccaacgacagcctcaacagcggcagtgccagcgacgggtactgcccacgcgaacatatgctgccctgcccgctggccgcactggcttcgcgccgcgaggaccccaggtgtgggcagcctcggcccagccggcttgaccttgacctgcccggctgccaggccgagcccccggcccgcgaggccacctccgccgacgcccgcgtgcgcaccatcaagctgtcgcctacctatcagcacgtgccactgcttgagggtgcctcaagggcgggtgcagagcccctcgcggggcctggaatctctccaggggcccggaagcaggcctggctgccggcagaccacctgagcaaggttcccgagaagctggcggctgccccgctgtctgtggccagcaaggcactgcagaaactggcggcgcaagaggggccactctcgctgtcccgatgcagctccctttcctcgctgtcctcggccggccgcccaggccccagcgagggtggtgacctggatgacagtgactcctccctggaggggctggaggaggccggccccagcgaggctgagctggacagcacgtggcgggcgcccggggccacctcgctgcccgtagccattccggctccccggcgtaaccgaggccggggcctgggggtggaagacgccacgccgtccagctcgtcggagaactacgtgcaggagacaccgcttgtgctgagccgctgcagctctgtgagctcgctgggcagcttcgagagcccgtccatcgccagctccatccccagtgaaccttgcagcgggcagggcagcggcaccatcagccctagcgagctgcccgacagccccggacagaccatgcctcccagccggagcaagacgccaccgctggcgcccgcgccacagggtccccccgaggccacccagttcagcctgcagtgggagagctacgtgaagcgcttcctggacatcgccgactgccgggagcgctgccggctgccatctgagctggacgcaggcagcgtgcgctttaccgtggagaagccagacgagaacttctcgtgcgcctccagcctcagcgcgctggccttgcacgagcactacgtgcagcaggacgtggagctgcggctgctgccctcggcctgccccgagcgcggcgggggcgccgggggcgccggcctccactttgcagggcaccggcggcgggaggaggggccggcgcccacgggttctcgccctcgcggcgccgcggaccaggagctggaactgctgcgggagtgcctgggagccgccgtgcctgcccggctgcgcaaggtggcctccgcgctggtgccaggtcgccgcgcactccccgtgcccgtctacatgttggtgcccgccccggccccggcccaggaggacgactcctgcactgactccgcggagggcacgccggtcaacttctctagcgccgcctcgctcagcgacgagacgctgcagggaccccccagggaccagcccgggggaccagcgggcaggcaaagacccaccggccgccccacctctgccagacaggccatggggcaccggcacaaggcgggaggcgccggccgcagcgcggagcagtctcggggcgcgggcaagaaccgagcagggctggagctgcccctgggccggcccccgagcgcccccgcagacaaggacggctcaaagcccggccggacccgcggggacggggcgctccagtcgctgtgcctcacgacgcccactgaggaggccgtgtactgcttctacggcaacgactcggacgaggagcccccggcggccgcgcccacgccaacccaccggcgcacatcggccatccctcgcgcttttacgcgggagcgtccgcagggccggaaggaggcccctgccccgtccaaggctgcaccagctgccccgccgcccgcccggacccagcccagcctcattgctgacgagaccccgccctgctactccctgagctcctccgccagctccctcagcgagcccgagccctcggagccgccggccgtccatccacgaggccgggagcccgcggtcaccaaggacccgggcccaggaggcggacgcgacagctcgcccagcccgcgggccgcggaggagcttctgcagcggtgcatcagctcggccctgcccaggcgccggccccccgtgtctggcctgcggcgccgcaagccccgagccacccggctggatgagcggcccgcagaggggtcccgggaacgcggcgaggaggcagcgggctcggaccgggcctccgacctggatagcgtggagtggcgcgccatccaggagggcgccaattcaattgtcacgtggctgcaccaggcagcagctgccacgcgggaggcctcgtccgagtccgactccatcctgtccttcgtatccgggctgtcagtgggatccaccctacagccccccaagcacaggaagggacgacaggcggagggagaaatgggcagtgcccggcggccagagaaaaggggcgcagcctcagtcaagaccagcgggagcccccgttcccctgcaggccccgagaagccacgtggcacacagaagaccacgcccggggtgccagctgtgctccggggacgaacagtgatctacgtccccagcccggcaccccgtgcccagcccaaagggacccccggcccccgcgccacaccgcggaaggtggcgcccccttgcctggcacagcccgcggctccagccaaagtcccgagccccgggcagcagcggtcgcggagcctacaccggcctgccaagacctcggagctggcgacgctgagccagccccccagaagcgccacaccgcccgcccgcctcgccaagaccccctcctccagctcctcccagacctcgcccgcctcccagcccctgcccagaaagcgccccccggtcacccaggctgctggggccctgcccggccccggagcctccccggtgcccaaaacgccggcgcgcacccttctggcgaagcagcacaagacgcagagatcgcccgtgcggatcccgttcatgcagaggccggcccggcgtgggccgccaccgctggctcgggcagtcccggagccgggccccaggggccgggcggggaccgaggcgggcccgggggcgcgcgggggccgcctgggcctggtgcgtgtggcctcagccctctccagcggcagcgagtcctccgaccgctcgggcttccggcgacagctaaccttcatcaaggagtcgccgggcttgcggcgccgccgctccgagctgtcctcggccgagtccgcggcctctgccccccagggcgcctcgccccgccgcggccggcccgcgctgcccgccgtcttcctctgctcctcgcgctgcgaagagctccgagcggcaccccggcagggcccggccccggcccggcagcggccccccgcggcccgacccagccctggcgagcgccctgcccggcgcaccacctccgagagcccgtcccgcctgcctgtgcgcgcgcccgccgcccggccggagactgtcaagcgctacgcgtcgctgccgcacatcagcgtggcccgcaggcccgacggcgccgtccccgcggcccctgcctcagccgacgccgcgcgccgcagcagcgacggggagccccggccgctccccagggtggccgcgccgggcacgacctggcggcgcatccgagatgaggacgtgccccacatcctgcgcagcacgcttcccgccacggccctgccactgcggggctccacgcccgaggacgccccggccgggcccccgccgcgcaagaccagcgacgccgtggtccagaccgaggaggtcgccgcccccaagaccaactccagcacgtccccgagcctggagaccagggagccccccggggcccccgccggcggccagctctccctcctcggcagcgacgtggacggtcccagcctcgccaaggctcccatctccgcacccttcgtgcacgagggcctgggggtcgccgtggggggcttccccgccagccggcacggctcccccagccgctcggcccgagtaccccccttcaactatgtgcccagccccatggtggtcgcagccaccaccgactcggccgcggagaaagccccggccactgcctccgccaccctcctggaatagtggcctaggccggccttctggaacgttctctcccggccctgcggcgcggtctggctgccccatgggcctgcgctgtagacgtcccccataggtcgccccagggcctctgcccacccgagccccaccactctcagaacccccgcccagcgcacggcgacctcgcgcctcaccggaagaccttgcctctgtgccgcggaggtccaggaggaaacggggcggccgctaggcctcaagtcccgaccgtggagcgctggcaagggcgtcctggcccagccctgagcgcgcggcccttcccctgtcggaagccgttgcttgaccccgggcgagggaggcggtagcctccgggtccgggtctgggtctgggtccgctgcttcgcagggacagcgctggggaggtgacggcgcccgccgcaggtggggcgaggctgggggagggcggcgccgcggcgggcctgccagctgggggcctttgcggcgcgcaggggcgaagcctgtaatcactgcagccgccggtaattcgctaatgagggctttgcagggattgttttcattctcagccccagctgtgggagtgcgggtgggggtgtggccgagccccggcaggaagccccgcccagacggtgttcagggaacccggagcccaagcgctccggcggagcccaaaagggtgggggtgggaggggcagaggccaacggatccccctgcctgtcgcaccccttggcgggagacgggaaggcagcgggctgcgtacgatgggaccctggtgcagacgccgggccggctgacatttggaccccatcccagaggagatgctggctaccagctggggcgaccccaagggtcgctggagtcagtatcggcccggcgcagccgcggcgggcgaggccaatggaaaggagactgaggggagtcccggcagtgagcccgaggccctgggacctggagcccgcgctggcctctccccagcggagcctgcacgttacggagaccatcacatgtgggcgtggtcagtgcccaggaccgcaccgctgctcatcttgtcccttttcaattcccttctggttcatgatgcataaagcgctaggccctagaactccagaaacagcacagctggggcggggacccagccttgccctccacccgaggctctgggacaaggcgggaggttcgggggccttccggcaggtgaacgcagggctggagagtatttggtgccagatgaggtgaaagcttatagaagggcctgaggggctcggctgcctcatcccctggcgggggaggctgggagctgggcctcctgcgtggggtgggactcgcaggggccgggtctccgtgactggggcaacgcctcgtcctgcagagggagccgacgacctcttttctgcagaaaagctccagcaggcgctgccttcacccacggatctgcccaggctgaaggcacacgctcaatgccccacgtgccttctccaggaggaacgaagcagggtttgagggttgggtggatggagctcagaaggaaaccccagccccaccacggatgacaccatccctcccgtcccatccccagcatgggcaaggccagcctttctggcagaaggagctgtcctcaactcagggccgctgtgagcaaagctgaccccagcccccacccccagttaacactgctgcttctctgaatgcatgtcacgctgcaccccatgctccgggcccacaccctgcaggacaaggagctccagacaggacgtccataagtcaccgaggtgtgccacccagcaggtgctggaggtgcccaatgctccctcctaggacctcgcagccaggcaaggctgtcaggttgttttgggggaagagggggtcatggatggctgagcagagagcggggaaaatgcaggctgagtggggcgacctcctgcctgccaggagccccctttcaggacacagcgggggtctcacacttgctgtccccatccatggcccgagggggaacctggtggtctcttctgagcttttggacttggggatgccaaacacgtgctcaccctcacactcgccccggcccgctgcgcccctaattgccaaagggtagggaaatggcgaagccagccaccaggtcgctggtgacagggccagggttatgcaggaaggtggtgcggcattgccttccacatatgtaagtctctgggcggcgccctcccagctccctgcctctgtttccccatgtgggccgtggggaactcccagagctacctcttgggggagcgtggtggcagcgatgatggggagacgcctggaagctcacagaacttgggtctggctggctcctgcccgtgacgccttgcccagcagcaaggtgcgcaacatggctgccagccccgcctcccacccccaccccgagtcctgagctcactttcgccttctccatcccctgccgtgggggccacagccacacctcaccgcccagtccagctgtctccagaaggggacaggcagtccgcggtctctggacaatcaactcaaggtacgcccactgcaaggcctccctcccaccgcggcccctgcctggccacctggcctctctgcaccagggtgacaaggggtcctcgtctgccccccaatgctccagggccagtcctaaggagctgagggtctgaggacgcagggagggtggaggtgtcctgaggctgatggacagtgaccgccactggcccccaacatgaccacacgtgggtgctgaactcggggcgccgtgcccaccggcatggtcctcccgagctccgacagcattacctcacccggccccatctgttgccccggtccagccctgatggcgcgcgcctggtctgtctgattcccctagccgccaccccacgtttctgtaccgggtctctgcagtgttaaacggacgtgtaaatagtggtaaatagtgaaagcctgtccttccctaaatgtaaagccatctgtccggcgtaaggacgacaccgtcagctgtccgactcgcacacatttaataaactgagctcttgcattgaaaaaaaaaaaaaaaaaaacaaaaaaaacacaaaaacaaaaaaagaaaaacaaaatacacagagagacacaaacacaaacaataaaacaaacaaaaaaaaaaccaggagggagcggcaggaaagacaacaaaacacgccaggagaagagaaaaaacaaaagaaagacgaaaaagaagaaggagaacaaagacaagaaacgcaccacacaaaaaagaaagaacactaaacacaaagaaaacaagaacagacgaagaacaggagagaaaaaaaaagagcagagcagagggaaagagaaacaacaaagacactcaggaacgaacggagagaaaccacggggaggagagaagacacgaagacaaaaacaccaggagccgggggaggacagaaaacaacaaaagaagcaaacagaacatacaccagcagaagcaagaggaaacacaagcaagagcagagggaaaaagaaa

SEQ ID NO: 356059 - DNA, 9278 bp, Homo sapiens
ccaagaattcggcacgagggcctgctgcactcggccttcttcggggaccagacgctgcaggagctgaagatggcgagctccgtggcgccctacgagcagctggtgaggcaggtggaggccttgaaggctgagaacagccacctgaggcaggagctaagggacaactccagccacctgtccaagctggagacagagacgtcgggcatgaaggaggtcctgaagcacctacagggaaaactggagcaggaggcccgagtgctggtgtcctcggggcagacggaggtgctggagcagctgaaggccctacagatggacatcaccagcctgtacaacctcaagttccagccgcccaccctgggcccggagcctgccgcccggacccccgagggcagcccagtacacggctccgggccctccaaggacagctttggggagctgagccgggccaccatccggctgctggaggaactggaccgggaacggtgtttcctgctgaatgagattgagaaggaggagaaggagaagctctggtactactctcagctgcagggcctgtccaagcgcctggacgaagctgctgcaggttgactatgagatgcacaagatgacccgggacccgctgaacctggcgctgcgccgctacgcgggcatgaccctcaccaacctcacctttggggacgttgccaacaaggccaccctgtgtgcgcgccgcggctgcatggaggccatcgtggcccagctggcctccgacagtgaggagctccaccaggtggtgtccagcatccttcggaacttgtcctggagggccgacatcaacagcaagaaggtgctgagggaggcgggcagcgtgactgccctggtgcagtgtgtcctgcgggccaccaaggagtccaccctgaagagcgtgctgagcgccctgtggaatctgtctgcacacagcacagagaacaaggcggccatctgccaggtggatggcgccctgggcttcctggtgagcaccctgacctacaagtgtcagagcaactcgctggccatcatcgagagcggcggcggcatcctccgcaatgtgtccagcctcgtcgccacccgtgaggactacaggcaggtgctccgggatcacaactgtctgcagacgctgctgcagcatctgacttcgcacagcctgaccatcgtgagcaacgcgtgcggcacgctctggaacctgtcggcccgcagcgcccgtgaccaggagctgctgtgggacctgggcgccgtgggcatgctgcgtaatctggtgcactccaagcacaagatgatcgccatgggcagcgccgccgccctgcgcaacctgctggcccatcggcccgccaagcaccaggcggccgccaccgccgtgtccccaggcagctgcgtgcccagcctgtacgtgcgcaagcagcgggcgctggaggccgagctggacgcacggcacctcgcgcaggcgctggagcacctggagaagcagggcccgccggcagccgaggccgccactaagaagccgctgccgcccctgcgacacctggacggcctggcccaagactatgcttccgattcgggctgctttgacgacgacgatgcaccgtcatccctggctgcggccgcggccaccggggagccagccagccctgccgcgctgtccctcttcctgggcagccccttcctgcaggggcaggcgctggctcgcaccccgcccacccgccgaggcggcaaggaggcagagaaggacaccagtggggaggcagccgtggcggccaaggccaaggccaagctggcgcttgcagtggcgcgcatcgaccagctggtggaggacatctccgccctgcacacctcgtccgacgatagcttcagcctcagctctggagacccgggacaggaggcgccacgggagggccgcgcccagtcctgctcgccatgccgcggcccggagggcgggcggcgagaggcaggaagccgggcgcacccgctgctgcggctcaaggcggcccacgccagcctctccaacgacagcctcaacagcggcagtgccagcgacgggtactgcccacgcgaacatatgctgccctgcccgctggccgcactggcttcgcgccgcgaggaccccaggtgtgggcagcctcggcccagccggcttgaccttgacctgcccggctgccaggccgagcccccggcccgcgaggccacctccgccgacgcccgcgtgcgcaccatcaagctgtcgcctacctatcagcacgtgccactgcttgagggtgcctcaagggcgggtgcagagcccctcgcggggcctggaatctctccaggggcccggaagcaggcctggctgccggcagaccacctgagcaaggttcccgagaagctggcggctgccccgctgtctgtggccagcaaggcactgcagaaactggcggcgcaagaggggccactctcgctgtcccgatgcagctccctttcctcgctgtcctcggccggccgcccaggccccagcgagggtggtgacctggatgacagtgactcctccctggaggggctggaggaggccggccccagcgaggctgagctggacagcacgtggcgggcgcccggggccacctcgctgcccgtagccattccggctccccggcgtaaccgaggccggggcctgggggtggaagacgccacgccgtccagctcgtcggagaactacgtgcaggagacaccgcttgtgctgagccgctgcagctctgtgagctcgctgggcagcttcgagagcccgtccatcgccagctccatccccagtgaaccttgcagcgggcagggcagcggcaccatcagccctagcgagctgcccgacagccccggacagaccatgcctcccagccggagcaagacgccaccgctggcgcccgcgccacagggtccccccgaggccacccagttcagcctgcagtgggagagctacgtgaagcgcttcctggacatcgccgactgccgggagcgctgccggctgccatctgagctggacgcaggcagcgtgcgctttaccgtggagaagccagacgagaacttctcgtgcgcctccagcctcagcgcgctggccttgcacgagcactacgtgcagcaggacgtggagctgcggctgctgccctcggcctgccccgagcgcggcgggggcgccgggggcgccggcctccactttgcagggcaccggcggcgggaggaggggccggcgcccacgggttctcgccctcgcggcgccgcggaccaggagctggaactgctgcgggagtgcctgggagccgccgtgcctgcccggctgcgcaaggtggcctccgcgctggtgccaggtcgccgcgcactccccgtgcccgtctacatgttggtgcccgccccggccccggcccaggaggacgactcctgcactgactccgcggagggcacgccggtcaacttctctagcgccgcctcgctcagcgacgagacgctgcagggaccccccagggaccagcccgggggaccagcgggcaggcaaagacccaccggccgccccacctctgccagacaggccatggggcaccggcacaaggcgggaggcgccggccgcagcgcggagcagtctcggggcgcgggcaagaaccgagcagggctggagctgcccctgggccggcccccgagcgcccccgcagacaaggacggctcaaagcccggccggacccgcggggacggggcgctccagtcgctgtgcctcacgacgcccactgaggaggccgtgtactgcttctacggcaacgactcggacgaggagcccccggcggccgcgcccacgccaacccaccggcgcacatcggccatccctcgcgcttttacgcgggagcgtccgcagggccggaaggaggcccctgccccgtccaaggctgcaccagctgccccgccgcccgcccggacccagcccagcctcattgctgacgagaccccgccctgctactccctgagctcctccgccagctccctcagcgagcccgagccctcggagccgccggccgtccatccacgaggccgggagcccgcggtcaccaaggacccgggcccaggaggcggacgcgacagctcgcccagcccgcgggccgcggaggagcttctgcagcggtgcatcagctcggccctgcccaggcgccggccccccgtgtctggcctgcggcgccgcaagccccgagccacccggctggatgagcggcccgcagaggggtcccgggaacgcggcgaggaggcagcgggctcggaccgggcctccgacctggatagcgtggagtggcgcgccatccaggagggcgccaattcaattgtcacgtggctgcaccaggcagcagctgccacgcgggaggcctcgtccgagtccgactccatcctgtccttcgtatccgggctgtcagtgggatccaccctacagccccccaagcacaggaagggacgacaggcggagggagaaatgggcagtgcccggcggccagagaaaaggggcgcagcctcagtcaagaccagcgggagcccccgttcccctgcaggccccgagaagccacgtggcacacagaagaccacgcccggggtgccagctgtgctccggggacgaacagtgatctacgtccccagcccggcaccccgtgcccagcccaaagggacccccggcccccgcgccacaccgcggaaggtggcgcccccttgcctggcacagcccgcggctccagccaaagtcccgagccccgggcagcagcggtcgcggagcctacaccggcctgccaagacctcggagctggcgacgctgagccagccccccagaagcgccacaccgcccgcccgcctcgccaagaccccctcctccagctcctcccagacctcgcccgcctcccagcccctgcccagaaagcgccccccggtcacccaggctgctggggccctgcccggccccggagcctccccggtgcccaaaacgccggcgcgcacccttctggcgaagcagcacaagacgcagagatcgcccgtgcggatcccgttcatgcagaggccggcccggcgtgggccgccaccgctggctcgggcagtcccggagccgggccccaggggccgggcggggaccgaggcgggcccgggggcgcgcgggggccgcctgggcctggtgcgtgtggcctcagccctctccagcggcagcgagtcctccgaccgctcgggcttccggcgacagctaaccttcatcaaggagtcgccgggcttgcggcgccgccgctccgagctgtcctcggccgagtccgcggcctctgccccccagggcgcctcgccccgccgcggccggcccgcgctgcccgccgtcttcctctgctcctcgcgctgcgaagagctccgagcggcaccccggcagggcccggccccggcccggcagcggccccccgcggcccgacccagccctggcgagcgccctgcccggcgcaccacctccgagagcccgtcccgcctgcctgtgcgcgcgcccgccgcccggccggagactgtcaagcgctacgcgtcgctgccgcacatcagcgtggcccgcaggcccgacggcgccgtccccgcggcccctgcctcagccgacgccgcgcgccgcagcagcgacggggagccccggccgctccccagggtggccgcgccgggcacgacctggcggcgcatccgagatgaggacgtgccccacatcctgcgcagcacgcttcccgccacggccctgccactgcggggctccacgcccgaggacgccccggccgggcccccgccgcgcaagaccagcgacgccgtggtccagaccgaggaggtcgccgcccccaagaccaactccagcacgtccccgagcctggagaccagggagccccccggggcccccgccggcggccagctctccctcctcggcagcgacgtggacggtcccagcctcgccaaggctcccatctccgcacccttcgtgcacgagggcctgggggtcgccgtggggggcttccccgccagccggcacggctcccccagccgctcggcccgagtaccccccttcaactatgtgcccagccccatggtggtcgcagccaccaccgactcggccgcggagaaagccccggccactgcctccgccaccctcctggaatagtggcctaggccggccttctggaacgttctctcccggccctgcggcgcggtctggctgccccatgggcctgcgctgtagacgtcccccataggtcgccccagggcctctgcccacccgagccccaccactctcagaacccccgcccagcgcacggcgacctcgcgcctcaccggaagaccttgcctctgtgccgcggaggtccaggaggaaacggggcggccgctaggcctcaagtcccgaccgtggagcgctggcaagggcgtcctggcccagccctgagcgcgcggcccttcccctgtcggaagccgttgcttgaccccgggcgagggaggcggtagcctccgggtccgggtctgggtctgggtccgctgcttcgcagggacagcgctggggaggtgacggcgcccgccgcaggtggggcgaggctgggggagggcggcgccgcggcgggcctgccagctgggggcctttgcggcgcgcaggggcgaagcctgtaatcactgcagccgccggtaattcgctaatgagggctttgcagggattgttttcattctcagccccagctgtgggagtgcgggtgggggtgtggccgagccccggcaggaagccccgcccagacggtgttcagggaacccggagcccaagcgctccggcggagcccaaaagggtgggggtgggaggggcagaggccaacggatccccctgcctgtcgcaccccttggcgggagacgggaaggcagcgggctgcgtacgatgggaccctggtgcagacgccgggccggctgacatttggaccccatcccagaggagatgctggctaccagctggggcgaccccaagggtcgctggagtcagtatcggcccggcgcagccgcggcgggcgaggccaatggaaaggagactgaggggagtcccggcagtgagcccgaggccctgggacctggagcccgcgctggcctctccccagcggagcctgcacgttacggagaccatcacatgtgggcgtggtcagtgcccaggaccgcaccgctgctcatcttgtcccttttcaattcccttctggttcatgatgcataaagcgctaggccctagaactccagaaacagcacagctggggcggggacccagccttgccctccacccgaggctctgggacaaggcgggaggttcgggggccttccggcaggtgaacgcagggctggagagtatttggtgccagatgaggtgaaagcttatagaagggcctgaggggctcggctgcctcatcccctggcgggggaggctgggagctgggcctcctgcgtggggtgggactcgcaggggccgggtctccgtgactggggcaacgcctcgtcctgcagagggagccgacgacctcttttctgcagaaaagctccagcaggcgctgccttcacccacggatctgcccaggctgaaggcacacgctcaatgccccacgtgccttctccaggaggaacgaagcagggtttgagggttgggtggatggagctcagaaggaaaccccagccccaccacggatgacaccatccctcccgtcccatccccagcatgggcaaggccagcctttctggcagaaggagctgtcctcaactcagggccgctgtgagcaaagctgaccccagcccccacccccagttaacactgctgcttctctgaatgcatgtcacgctgcaccccatgctccgggcccacaccctgcaggacaaggagctccagacaggacgtccataagtcaccgaggtgtgccacccagcaggtgctggaggtgcccaatgctccctcctaggacctcgcagccaggcaaggctgtcaggttgttttgggggaagagggggtcatggatggctgagcagagagcggggaaaatgcaggctgagtggggcgacctcctgcctgccaggagccccctttcaggacacagcgggggtctcacacttgctgtccccatccatggcccgagggggaacctggtggtctcttctgagcttttggacttggggatgccaaacacgtgctcaccctcacactcgccccggcccgctgcgcccctaattgccaaagggtagggaaatggcgaagccagccaccaggtcgctggtgacagggccagggttatgcaggaaggtggtgcggcattgccttccacatatgtaagtctctgggcggcgccctcccagctccctgcctctgtttccccatgtgggccgtggggaactcccagagctacctcttgggggagcgtggtggcagcgatgatggggagacgcctggaagctcacagaacttgggtctggctggctcctgcccgtgacgccttgcccagcagcaaggtgcgcaacatggctgccagccccgcctcccacccccaccccgagtcctgagctcactttcgccttctccatcccctgccgtgggggccacagccacacctcaccgcccagtccagctgtctccagaaggggacaggcagtccgcggtctctggacaatcaactcaaggtacgcccactgcaaggcctccctcccaccgcggcccctgcctggccacctggcctctctgcaccagggtgacaaggggtcctcgtctgccccccaatgctccagggccagtcctaaggagctgagggtctgaggacgcagggagggtggaggtgtcctgaggctgatggacagtgaccgccactggcccccaacatgaccacacgtgggtgctgaactcggggcgccgtgcccaccggcatggtcctcccgagctccgacagcattacctcacccggccccatctgttgccccggtccagccctgatggcgcgcgcctggtctgtctgattcccctagccgccaccccacgtttctgtaccgggtctctgcagtgttaaacggacgtgtaaatagtggtaaatagtgaaagcctgtcgggctagtcggggccccgactagcccgacagctcctgggctcaggctccccgttgggaagcctccgtctcgttcagccctggaactgtaggaagaattgggttgcatggggtctgtgatctgtgcagacgcggggggtgattctcatccatgcgtgtcgtgctagtcgggggggtaccgag

SEQ ID NO: 356060 - DNA, 8771 bp, Homo sapiens
ttttttttttttttaactccatctcaaaaaaataaaaataaaataatttagtctctgtcatgcaatctttgggatatacttataccaaaaattagtctttccaagatccaaacctaaccagatgcgtttacttttacctgccacatctggcccccccatccttcggtgggcaggggagggtggggggtggcccaggctaacccgccctgtgcctacaggcaggtgctccgggatcacaactgtctgcagacgctgctgcagcatctgacttcgcacagcctgaccatcgtgagcaacgcgtgcggcacgctctggaacctgtcggcccgcagcgcccgtgaccaggagctgctgtgggacctgggcgccgtgggcatgctgcgtaatctggtgcactccaagcacaagatgatcgccatgggcagcgccgccgccctgcgcaacctgctggcccatcggcccgccaagcaccaggcggccgccaccgccgtgtccccaggcagctgcgtgcccagcctgtacgtgcgcaagcagcgggcgctggaggccgagctggacgcacggcacctcgcgcaggcgctggagcacctggagaagcagggcccgccggcagccgaggccgccactaagaagccgctgccgcccctgcgacacctggacggcctggcccaagactatgcttccgattcgggctgctttgacgacgacgatgcaccgtcatccctggctgcggccgcggccaccggggagccagccagccctgccgcgctgtccctcttcctgggcagccccttcctgcaggggcaggcgctggctcgcaccccgcccacccgccgaggcggcaaggaggcagagaaggacaccagtggggaggcagccgtggcggccaaggccaaggccaagctggcgcttgcagtggcgcgcatcgaccagctggtggaggacatctccgccctgcacacctcgtccgacgatagcttcagcctcagctctggagacccgggacaggaggcgccacgggagggccgcgcccagtcctgctcgccatgccgcggcccggagggcgggcggcgagaggcaggaagccgggcgcacccgctgctgcggctcaaggcggcccacgccagcctctccaacgacagcctcaacagcggcagtgccagcgacgggtactgcccacgcgaacatatgctgccctgcccgctggccgcactggcttcgcgccgcgaggaccccaggtgtgggcagcctcggcccagccggcttgaccttgacctgcccggctgccaggccgagcccccggcccgcgaggccacctccgccgacgcccgcgtgcgcaccatcaagctgtcgcctacctatcagcacgtgccactgcttgagggtgcctcaagggcgggtgcagagcccctcgcggggcctggaatctctccaggggcccggaagcaggcctggctgccggcagaccacctgagcaaggttcccgagaagctggcggctgccccgctgtctgtggccagcaaggcactgcagaaactggcggcgcaagaggggccactctcgctgtcccgatgcagctccctttcctcgctgtcctcggccggccgcccaggccccagcgagggtggtgacctggatgacagtgactcctccctggaggggctggaggaggccggccccagcgaggctgagctggacagcacgtggcgggcgcccggggccacctcgctgcccgtagccattccggctccccggcgtaaccgaggccggggcctgggggtggaagacgccacgccgtccagctcgtcggagaactacgtgcaggagacaccgcttgtgctgagccgctgcagctctgtgagctcgctgggcagcttcgagagcccgtccatcgccagctccatccccagtgaaccttgcagcgggcagggcagcggcaccatcagccctagcgagctgcccgacagccccggacagaccatgcctcccagccggagcaagacgccaccgctggcgcccgcgccacagggtccccccgaggccacccagttcagcctgcagtgggagagctacgtgaagcgcttcctggacatcgccgactgccgggagcgctgccggctgccatctgagctggacgcaggcagcgtgcgctttaccgtggagaagccagacgagaacttctcgtgcgcctccagcctcagcgcgctggccttgcacgagcactacgtgcagcaggacgtggagctgcggctgctgccctcggcctgccccgagcgcggcgggggcgccgggggcgccggcctccactttgcagggcaccggcggcgggaggaggggccggcgcccacgggttctcgccctcgcggcgccgcggaccaggagctggaactgctgcgggagtgcctgggagccgccgtgcctgcccggctgcgcaaggtggcctccgcgctggtgccaggtcgccgcgcactccccgtgcccgtctacatgttggtgcccgccccggccccggcccaggaggacgactcctgcactgactccgcggagggcacgccggtcaacttctctagcgccgcctcgctcagcgacgagacgctgcagggaccccccagggaccagcccgggggaccagcgggcaggcaaagacccaccggccgccccacctctgccagacaggccatggggcaccggcacaaggcgggaggcgccggccgcagcgcggagcagtctcggggcgcgggcaagaaccgagcagggctggagctgcccctgggccggcccccgagcgcccccgcagacaaggacggctcaaagcccggccggacccgcggggacggggcgctccagtcgctgtgcctcacgacgcccactgaggaggccgtgtactgcttctacggcaacgactcggacgaggagcccccggcggccgcgcccacgccaacccaccggcgcacatcggccatccctcgcgcttttacgcgggagcgtccgcagggccggaaggaggcccctgccccgtccaaggctgcaccagctgccccgccgcccgcccggacccagcccagcctcattgctgacgagaccccgccctgctactccctgagctcctccgccagctccctcagcgagcccgagccctcggagccgccggccgtccatccacgaggccgggagcccgcggtcaccaaggacccgggcccaggaggcggacgcgacagctcgcccagcccgcgggccgcggaggagcttctgcagcggtgcatcagctcggccctgcccaggcgccggccccccgtgtctggcctgcggcgccgcaagccccgagccacccggctggatgagcggcccgcagaggggtcccgggaacgcggcgaggaggcagcgggctcggaccgggcctccgacctggatagcgtggagtggcgcgccatccaggagggcgccaattcaattgtcacgtggctgcaccaggcagcagctgccacgcgggaggcctcgtccgagtccgactccatcctgtccttcgtatccgggctgtcagtgggatccaccctacagccccccaagcacaggaagggacgacaggcggagggagaaatgggcagtgcccggcggccagagaaaaggggcgcagcctcagtcaagaccagcgggagcccccgttcccctgcaggccccgagaagccacgtggcacacagaagaccacgcccggggtgccagctgtgctccggggacgaacagtgatctacgtccccagcccggcaccccgtgcccagcccaaagggacccccggcccccgcgccacaccgcggaaggtggcgcccccttgcctggcacagcccgcggctccagccaaagtcccgagccccgggcagcagcggtcgcggagcctacaccggcctgccaagacctcggagctggcgacgctgagccagccccccagaagcgccacaccgcccgcccgcctcgccaagaccccctcctccagctcctcccagacctcgcccgcctcccagcccctgcccagaaagcgccccccggtcacccaggctgctggggccctgcccggccccggagcctccccggtgcccaaaacgccggcgcgcacccttctggcgaagcagcacaagacgcagagatcgcccgtgcggatcccgttcatgcagaggccggcccggcgtgggccgccaccgctggctcgggcagtcccggagccgggccccaggggccgggcggggaccgaggcgggcccgggggcgcgcgggggccgcctgggcctggtgcgtgtggcctcagccctctccagcggcagcgagtcctccgaccgctcgggcttccggcgacagctaaccttcatcaaggagtcgccgggcttgcggcgccgccgctccgagctgtcctcggccgagtccgcggcctctgccccccagggcgcctcgccccgccgcggccggcccgcgctgcccgccgtcttcctctgctcctcgcgctgcgaagagctccgagcggcaccccggcagggcccggccccggcccggcagcggccccccgcggcccgacccagccctggcgagcgccctgcccggcgcaccacctccgagagcccgtcccgcctgcctgtgcgcgcgcccgccgcccggccggagactgtcaagcgctacgcgtcgctgccgcacatcagcgtggcccgcaggcccgacggcgccgtccccgcggcccctgcctcagccgacgccgcgcgccgcagcagcgacggggagccccggccgctccccagggtggccgcgccgggcacgacctggcggcgcatccgagatgaggacgtgccccacatcctgcgcagcacgcttcccgccacggccctgccactgcggggctccacgcccgaggacgccccggccgggcccccgccgcgcaagaccagcgacgccgtggtccagaccgaggaggtcgccgcccccaagaccaactccagcacgtccccgagcctggagaccagggagccccccggggcccccgccggcggccagctctccctcctcggcagcgacgtggacggtcccagcctcgccaaggctcccatctccgcacccttcgtgcacgagggcctgggggtcgccgtggggggcttccccgccagccggcacggctcccccagccgctcggcccgagtaccccccttcaactatgtgcccagccccatggtggtcgcagccaccaccgactcggccgcggagaaagccccggccactgcctccgccaccctcctggaatagtggcctaggccggccttctggaacgttctctcccggccctgcggcgcggtctggctgccccatgggcctgcgctgtagacgtcccccataggtcgccccagggcctctgcccacccgagccccaccactctcagaacccccgcccagcgcacggcgacctcgcgcctcaccggaagaccttgcctctgtgccgcggaggtccaggaggaaacggggcggccgctaggcctcaagtcccgaccgtggagcgctggcaagggcgtcctggcccagccctgagcgcgcggcccttcccctgtcggaagccgttgcttgaccccgggcgagggaggcggtagcctccgggtccgggtctgggtctgggtccgctgcttcgcagggacagcgctggggaggtgacggcgcccgccgcaggtggggcgaggctgggggagggcggcgccgcggcgggcctgccagctgggggcctttgcggcgcgcaggggcgaagcctgtaatcactgcagccgccggtaattcgctaatgagggctttgcagggattgttttcattctcagccccagctgtgggagtgcgggtgggggtgtggccgagccccggcaggaagccccgcccagacggtgttcagggaacccggagcccaagcgctccggcggagcccaaaagggtgggggtgggaggggcagaggccaacggatccccctgcctgtcgcaccccttggcgggagacgggaaggcagcgggctgcgtacgatgggaccctggtgcagacgccgggccggctgacatttggaccccatcccagaggagatgctggctaccagctggggcgaccccaagggtcgctggagtcagtatcggcccggcgcagccgcggcgggcgaggccaatggaaaggagactgaggggagtcccggcagtgagcccgaggccctgggacctggagcccgcgctggcctctccccagcggagcctgcacgttacggagaccatcacatgtgggcgtggtcagtgcccaggaccgcaccgctgctcatcttgtcccttttcaattcccttctggttcatgatgcataaagcgctaggccctagaactccagaaacagcacagctggggcggggacccagccttgccctccacccgaggctctgggacaaggcgggaggttcgggggccttccggcaggtgaacgcagggctggagagtatttggtgccagatgaggtgaaagcttatagaagggcctgaggggctcggctgcctcatcccctggcgggggaggctgggagctgggcctcctgcgtggggtgggactcgcaggggccgggtctccgtgactggggcaacgcctcgtcctgcagagggagccgacgacctcttttctgcagaaaagctccagcaggcgctgccttcacccacggatctgcccaggctgaaggcacacgctcaatgccccacgtgccttctccaggaggaacgaagcagggtttgagggttgggtggatggagctcagaaggaaaccccagccccaccacggatgacaccatccctcccgtcccatccccagcatgggcaaggccagcctttctggcagaaggagctgtcctcaactcagggccgctgtgagcaaagctgaccccagcccccacccccagttaacactgctgcttctctgaatgcatgtcacgctgcaccccatgctccgggcccacaccctgcaggacaaggagctccagacaggacgtccataagtcaccgaggtgtgccacccagcaggtgctggaggtgcccaatgctccctcctaggacctcgcagccaggcaaggctgtcaggttgttttgggggaagagggggtcatggatggctgagcagagagcggggaaaatgcaggctgagtggggcgacctcctgcctgccaggagccccctttcaggacacagcgggggtctcacacttgctgtccccatccatggcccgagggggaacctggtggtctcttctgagcttttggacttggggatgccaaacacgtgctcaccctcacactcgccccggcccgctgcgcccctaattgccaaagggtagggaaatggcgaagccagccaccaggtcgctggtgacagggccagggttatgcaggaaggtggtgcggcattgccttccacatatgtaagtctctgggcggcgccctcccagctccctgcctctgtttccccatgtgggccgtggggaactcccagagctacctcttgggggagcgtggtggcagcgatgatggggagacgcctggaagctcacagaacttgggtctggctggctcctgcccgtgacgccttgcccagcagcaaggtgcgcaacatggctgccagccccgcctcccacccccaccccgagtcctgagctcactttcgccttctccatcccctgccgtgggggccacagccacacctcaccgcccagtccagctgtctccagaaggggacaggcagtccgcggtctctggacaatcaactcaaggtacgcccactgcaaggcctccctcccaccgcggcccctgcctggccacctggcctctctgcaccagggtgacaaggggtcctcgtctgccccccaatgctccagggccagtcctaaggagctgagggtctgaggacgcagggagggtggaggtgtcctgaggctgatggacagtgaccgccactggcccccaacatgaccacacgtgggtgctgaactcggggcgccgtgcccaccggcatggtcctcccgagctccgacagcattacctcacccggccccatctgttgccccggtccagccctgatggcgcgcgcctggtctgtctgattcccctagccgccaccccacgtttctgtaccgggtctctgcagtgttaaacggacgtgtaaatagtggtaaatagtgaaagcctgtccttccctaaatgtaaagccatctgtccggcgtaaggacgacaccgtcagctgtccgactcgcacacatttaataaactgagctcttgcattgaaaaaaaaaaaaaaaaaaacaaaaaaaacacaaaaacaaaaaaagaaaaacaaaatacacagagagacacaaacacaaacaataaaacaaacaaaaaaaaaaccaggagggagcggcaggaaagacaacaaaacacgccaggagaagagaaaaaacaaaagaaagacgaaaaagaagaaggagaacaaagacaagaaacgcaccacacaaaaaagaaagaacactaaacacaaagaaaacaagaacagacgaagaacaggagagaaaaaaaaagagcagagcagagggaaagagaaacaacaaagacactcaggaacgaacggagagaaaccacggggaggagagaagacacgaagacaaaaacaccaggagccgggggaggacagaaaacaacaaaagaagcaaacagaacatacaccagcagaagcaagaggaaacacaagcaagagcagagggaaaaagaaa

SEQ ID NO: 356061 - DNA, 11452 bp, Homo sapiens
gggtttggggagcaggaggcagacatgtgttgctttgcacgtcatctggtccttccacctggctgggcatgggatggtgacctcagctggaacatggggctcgagccagacctcagggtctccctgcgtgtagcccccaaccccaagcctgatccccaccggagacctgaacagccttggacatcatcggatcagggtgggaggtgccagcctctgccacctgacttccagtccctgtgcccctcccaccctgcccttgggcactcctgccctgcaggttcctcagaggggcaacccaaagccagagaggggcgggtcttgtcgggcctccagcctggacttcccagcccctctggggcagcatctgggtgccagacctcggttcctagggcctcgtttctccctctgggaacagccaaatggtggtccctgagactcaggacagaccaagaagaagccggatgacatggcaagccacacactgcgtcccctgagcaggacgggacagcccgactccatcctcccacctgcgactgagcccccacccctactcctgtcccagccgtgcccctggtgacatttgggtgggaggggaggggatgagggggcacctgggggtcagagaacaaatgacgggtgaatacatgtgtgtggccaggtggaggagggaggggaggagcaggtgggctggacagggccggtgtgaggaaggggctcaggctggcagggggaggtggcaagagggatgggctgccattggtggtctgagacaaaggcggagggaggaggcgagcgctgatgggaaaggaacaaagagggaaggggggcgtgaagggggttccggcgggagggccgagccgagggaggaggcgccggccagctggacagagggaggaggccaggccagagccagaagacggccagaggcacaaagaagccagcgcgctggcagagtcaagggatggggcagaggctgccggggccagcagggaccagctgaaggctgcgcagggggtgcgggccacacagacgctgcaggagctgaagatggcgagctccgtggcgccctacgagcagctggtgaggcaggtggaggccttgaaggctgagaacagccacctgaggcaggagctaagggacaactccagccacctgtccaagctggagacagagacgtcgggcatgaaggaggtcctgaagcacctacagggaaaactggagcaggaggcccgagtgctggtgtcctcggggcagacggaggtgctggagcagctgaaggccctacagatggacatcaccagcctgtacaacctcaagttccagccgcccaccctgggcccggagcctgccgcccggacccccgagggcagcccagtacacggctccgggccctccaaggacagctttggggagctgagccgggccaccatccggctgctggaggaactggaccgggaacggtgtttcctgctgaatgagattgagaaggaggagaaggagaagctctggtactactctcagctgcagggcctgtccaagcgcctggacgagctgccgcacgtggagacgcgttctcgatgcagatggacctgatccggcagcagcttgagttcgaggcccagcacatccgctcgctgatggaggagcgcttcggcacctcggacgagatggtgcagcgggcacagatccgcgcctcgcgcctggagcagattgacaaggagctgctggaggcgcaggaccgagtgcagcagacggagccccaggccttgctggcggtgaagtcggtgccggtggacgaggaccccgagacagaggtccccacacaccctgaggatggcacccctcagccgggcaacagcaaggtggaggtggtcttctggctgttgtccatgttggcgacgcgcgaccaggaggatacagcgcgcacgctgctggccatgtccagctcgcccgagagctgcgtggccatgcgccgctcgggctgtctgcctctgctgctgcaaatcctccacggcaccgaggccgcggccgggggtcgcgccggggccccaggggcaccgggcgccaaggacgcacgcatgcgcgccaacgcggcgctgcacaacatcgtcttctcgcagccggaccagggcctggcgcgcaaggagatgcgcgtcctgcacgtgctggagcagatccgggcctactgcgagacctgctgggactggctgcaggcccgagacggcgggcccgagggaggtggcgccggcagcgccccgatccccatcgagccgcagatctgccaggccacctgtgctgttatgaagctgtcctttgatgaggagtaccgccgtgccatgaacgagctaggtgggctgcaggccgtggcagagctgctgcaggttgactatgagatgcacaagatgacccgggacccgctgaacctggcgctgcgccgctacgcgggcatgaccctcaccaacctcacctttggggacgttgccaacaaggccaccctgtgtgcgcgccgcggctgcatggaggccatcgtggcccagctggcctccgacagtgaggagctccaccaggtggtgtccagcatccttcggaacttgtcctggagggccgacatcaacagcaagaaggtgctgagggaggcgggcagcgtgactgccctggtgcagtgtgtcctgcgggccaccaaggagtccaccctgaagagcgtgctgagcgccctgtggaatctgtctgcacacagcacagagaacaaggcggccatctgccaggtggatggcgccctgggcttcctggtgagcaccctgacctacaagtgtcagagcaactcgctggccatcatcgagagcggcggcggcatcctccgcaatgtgtccagcctcgtcgccacccgtgaggactacaggcaggtgctccgggatcacaactgtctgcagacgctgctgcagcatctgacttcgcacagcctgaccatcgtgagcaacgcgtgcggcacgctctggaacctgtcggcccgcagcgcccgtgaccaggagctgctgtgggacctgggcgccgtgggcatgctgcgtaatctggtgcactccaagcacaagatgatcgccatgggcagcgccgccgccctgcgcaacctgctggcccatcggcccgccaagcaccaggcggccgccaccgccgtgtccccaggcagctgcgtgcccagcctgtacgtgcgcaagcagcgggcgctggaggccgagctggacgcacggcacctcgcgcaggcgctggagcacctggagaagcagggcccgccggcagccgaggccgccactaagaagccgctgccgcccctgcgacacctggacggcctggcccaagactatgcttccgattcgggctgctttgacgacgacgatgcaccgtcatccctggctgcggccgcggccaccggggagccagccagccctgccgcgctgtccctcttcctgggcagccccttcctgcaggggcaggcgctggctcgcaccccgcccacccgccgaggcggcaaggaggcagagaaggacaccagtggggaggcagccgtggcggccaaggccaaggccaagctggcgcttgcagtggcgcgcatcgaccagctggtggaggacatctccgccctgcacacctcgtccgacgatagcttcagcctcagctctggagacccgggacaggaggcgccacgggagggccgcgcccagtcctgctcgccatgccgcggcccggagggcgggcggcgagaggcaggaagccgggcgcacccgctgctgcggctcaaggcggcccacgccagcctctccaacgacagcctcaacagcggcagtgccagcgacgggtactgcccacgcgaacatatgctgccctgcccgctggccgcactggcttcgcgccgcgaggaccccaggtgtgggcagcctcggcccagccggcttgaccttgacctgcccggctgccaggccgagcccccggcccgcgaggccacctccgccgacgcccgcgtgcgcaccatcaagctgtcgcctacctatcagcacgtgccactgcttgagggtgcctcaagggcgggtgcagagcccctcgcggggcctggaatctctccaggggcccggaagcaggcctggctgccggcagaccacctgagcaaggttcccgagaagctggcggctgccccgctgtctgtggccagcaaggcactgcagaaactggcggcgcaagaggggccactctcgctgtcccgatgcagctccctttcctcgctgtcctcggccggccgcccaggccccagcgagggtggtgacctggatgacagtgactcctccctggaggggctggaggaggccggccccagcgaggctgagctggacagcacgtggcgggcgcccggggccacctcgctgcccgtagccattccggctccccggcgtaaccgaggccggggcctgggggtggaagacgccacgccgtccagctcgtcggagaactacgtgcaggagacaccgcttgtgctgagccgctgcagctctgtgagctcgctgggcagcttcgagagcccgtccatcgccagctccatccccagtgaaccttgcagcgggcagggcagcggcaccatcagccctagcgagctgcccgacagccccggacagaccatgcctcccagccggagcaagacgccaccgctggcgcccgcgccacagggtccccccgaggccacccagttcagcctgcagtgggagagctacgtgaagcgcttcctggacatcgccgactgccgggagcgctgccggctgccatctgagctggacgcaggcagcgtgcgctttaccgtggagaagccagacgagaacttctcgtgcgcctccagcctcagcgcgctggccttgcacgagcactacgtgcagcaggacgtggagctgcggctgctgccctcggcctgccccgagcgcggcgggggcgccgggggcgccggcctccactttgcagggcaccggcggcgggaggaggggccggcgcccacgggttctcgccctcgcggcgccgcggaccaggagctggaactgctgcgggagtgcctgggagccgccgtgcctgcccggctgcgcaaggtggcctccgcgctggtgccaggtcgccgcgcactccccgtgcccgtctacatgttggtgcccgccccggccccggcccaggaggacgactcctgcactgactccgcggagggcacgccggtcaacttctctagcgccgcctcgctcagcgacgagacgctgcagggaccccccagggaccagcccgggggaccagcgggcaggcaaagacccaccggccgccccacctctgccagacaggccatggggcaccggcacaaggcgggaggcgccggccgcagcgcggagcagtctcggggcgcgggcaagaaccgagcagggctggagctgcccctgggccggcccccgagcgcccccgcagacaaggacggctcaaagcccggccggacccgcggggacggggcgctccagtcgctgtgcctcacgacgcccactgaggaggccgtgtactgcttctacggcaacgactcggacgaggagcccccggcggccgcgcccacgccaacccaccggcgcacatcggccatccctcgcgcttttacgcgggagcgtccgcagggccggaaggaggcccctgccccgtccaaggctgcaccagctgccccgccgcccgcccggacccagcccagcctcattgctgacgagaccccgccctgctactccctgagctcctccgccagctccctcagcgagcccgagccctcggagccgccggccgtccatccacgaggccgggagcccgcggtcaccaaggacccgggcccaggaggcggacgcgacagctcgcccagcccgcgggccgcggaggagcttctgcagcggtgcatcagctcggccctgcccaggcgccggccccccgtgtctggcctgcggcgccgcaagccccgagccacccggctggatgagcggcccgcagaggggtcccgggaacgcggcgaggaggcagcgggctcggaccgggcctccgacctggatagcgtggagtggcgcgccatccaggagggcgccaattcaattgtcacgtggctgcaccaggcagcagctgccacgcgggaggcctcgtccgagtccgactccatcctgtccttcgtatccgggctgtcagtgggatccaccctacagccccccaagcacaggaagggacgacaggcggagggagaaatgggcagtgcccggcggccagagaaaaggggcgcagcctcagtcaagaccagcgggagcccccgttcccctgcaggccccgagaagccacgtggcacacagaagaccacgcccggggtgccagctgtgctccggggacgaacagtgatctacgtccccagcccggcaccccgtgcccagcccaaagggacccccggcccccgcgccacaccgcggaaggtggcgcccccttgcctggcacagcccgcggctccagccaaagtcccgagccccgggcagcagcggtcgcggagcctacaccggcctgccaagacctcggagctggcgacgctgagccagccccccagaagcgccacaccgcccgcccgcctcgccaagaccccctcctccagctcctcccagacctcgcccgcctcccagcccctgcccagaaagcgccccccggtcacccaggctgctggggccctgcccggccccggagcctccccggtgcccaaaacgccggcgcgcacccttctggcgaagcagcacaagacgcagagatcgcccgtgcggatcccgttcatgcagaggccggcccggcgtgggccgccaccgctggctcgggcagtcccggagccgggccccaggggccgggcggggaccgaggcgggcccgggggcgcgcgggggccgcctgggcctggtgcgtgtggcctcagccctctccagcggcagcgagtcctccgaccgctcgggcttccggcgacagctaaccttcatcaaggagtcgccgggcttgcggcgccgccgctccgagctgtcctcggccgagtccgcggcctctgccccccagggcgcctcgccccgccgcggccggcccgcgctgcccgccgtcttcctctgctcctcgcgctgcgaagagctccgagcggcaccccggcagggcccggccccggcccggcagcggccccccgcggcccgacccagccctggcgagcgccctgcccggcgcaccacctccgagagcccgtcccgcctgcctgtgcgcgcgcccgccgcccggccggagactgtcaagcgctacgcgtcgctgccgcacatcagcgtggcccgcaggcccgacggcgccgtccccgcggcccctgcctcagccgacgccgcgcgccgcagcagcgacggggagccccggccgctccccagggtggccgcgccgggcacgacctggcggcgcatccgagatgaggacgtgccccacatcctgcgcagcacgcttcccgccacggccctgccactgcggggctccacgcccgaggacgccccggccgggcccccgccgcgcaagaccagcgacgccgtggtccagaccgaggaggtcgccgcccccaagaccaactccagcacgtccccgagcctggagaccagggagccccccggggcccccgccggcggccagctctccctcctcggcagcgacgtggacggtcccagcctcgccaaggctcccatctccgcacccttcgtgcacgagggcctgggggtcgccgtggggggcttccccgccagccggcacggctcccccagccgctcggcccgagtaccccccttcaactatgtgcccagccccatggtggtcgcagccaccaccgactcggccgcggagaaagccccggccactgcctccgccaccctcctggaatagtggcctaggccggccttctggaacgttctctcccggccctgcggcgcggtctggctgccccatgggcctgcgctgtagacgtcccccataggtcgccccagggcctctgcccacccgagccccaccactctcagaacccccgcccagcgcacggcgacctcgcgcctcaccggaagaccttgcctctgtgccgcggaggtccaggaggaaacggggcggccgctaggcctcaagtcccgaccgtggagcgctggcaagggcgtcctggcccagccctgagcgcgcggcccttcccctgtcggaagccgttgcttgaccccgggcgagggaggcggtagcctccgggtccgggtctgggtctgggtccgctgcttcgcagggacagcgctggggaggtgacggcgcccgccgcaggtggggcgaggctgggggagggcggcgccgcggcgggcctgccagctgggggcctttgcggcgcgcaggggcgaagcctgtaatcactgcagccgccggtaattcgctaatgagggctttgcagggattgttttcattctcagccccagctgtgggagtgcgggtgggggtgtggccgagccccggcaggaagccccgcccagacggtgttcagggaacccggagcccaagcgctccggcggagcccaaaagggtgggggtgggaggggcagaggccaacggatccccctgcctgtcgcaccccttggcgggagacgggaaggcagcgggctgcgtacgatgggaccctggtgcagacgccgggccggctgacatttggaccccatcccagaggagatgctggctaccagctggggcgaccccaagggtcgctggagtcagtatcggcccggcgcagccgcggcgggcgaggccaatggaaaggagactgaggggagtcccggcagtgagcccgaggccctgggacctggagcccgcgctggcctctccccagcggagcctgcacgttacggagaccatcacatgtgggcgtggtcagtgcccaggaccgcaccgctgctcatcttgtcccttttcaattcccttctggttcatgatgcataaagcgctaggccctagaactccagaaacagcacagctggggcggggacccagccttgccctccacccgaggctctgggacaaggcgggaggttcgggggccttccggcaggtgaacgcagggctggagagtatttggtgccagatgaggtgaaagcttatagaagggcctgaggggctcggctgcctcatcccctggcgggggaggctgggagctgggcctcctgcgtggggtgggactcgcaggggccgggtctccgtgactggggcaacgcctcgtcctgcagagggagccgacgacctcttttctgcagaaaagctccagcaggcgctgccttcacccacggatctgcccaggctgaaggcacacgctcaatgccccacgtgccttctccaggaggaacgaagcagggtttgagggttgggtggatggagctcagaaggaaaccccagccccaccacggatgacaccatccctcccgtcccatccccagcatgggcaaggccagcctttctggcagaaggagctgtcctcaactcagggccgctgtgagcaaagctgaccccagcccccacccccagttaacactgctgcttctctgaatgcatgtcacgctgcaccccatgctccgggcccacaccctgcaggacaaggagctccagacaggacgtccataagtcaccgaggtgtgccacccagcaggtgctggaggtgcccaatgctccctcctaggacctcgcagccaggcaaggctgtcaggttgttttgggggaagagggggtcatggatggctgagcagagagcggggaaaatgcaggctgagtggggcgacctcctgcctgccaggagccccctttcaggacacagcgggggtctcacacttgctgtccccatccatggcccgagggggaacctggtggtctcttctgagcttttggacttggggatgccaaacacgtgctcaccctcacactcgccccggcccgctgcgcccctaattgccaaagggtagggaaatggcgaagccagccaccaggtcgctggtgacagggccagggttatgcaggaaggtggtgcggcattgccttccacatatgtaagtctctgggcggcgccctcccagctccctgcctctgtttccccatgtgggccgtggggaactcccagagctacctcttgggggagcgtggtggcagcgatgatggggagacgcctggaagctcacagaacttgggtctggctggctcctgcccgtgacgccttgcccagcagcaaggtgcgcaacatggctgccagccccgcctcccacccccaccccgagtcctgagctcactttcgccttctccatcccctgccgtgggggccacagccacacctcaccgcccagtccagctgtctccagaaggggacaggcagtccgcggtctctggacaatcaactcaaggtacgcccactgcaaggcctccctcccaccgcggcccctgcctggccacctggcctctctgcaccagggtgacaaggggtcctcgtctgccccccaatgctccagggccagtcctaaggagctgagggtctgaggacgcagggagggtggaggtgtcctgaggctgatggacagtgaccgccactggcccccaacatgaccacacgtgggtgctgaactcggggcgccgtgcccaccggcatggtcctcccgagctccgacagcattacctcacccggccccatctgttgccccggtccagccctgatggcgcgcgcctggtctgtctgattcccctagccgccaccccacgtttctgtaccgggtctctgcagtgttaaacggacgtgtaaatagtggtaaatagtgaaagcctgtccttccctaaatgtaaagccatctgtccggcgtaaggacgacaccgtcagctgtccgactcgcacacatttaataaactgagctcttgcattgaaaaaaaaaaaaaaaaaaacaaaaaaaacacaaaaacaaaaaaagaaaaacaaaatacacagagagacacaaacacaaacaataaaacaaacaaaaaaaaaaccaggagggagcggcaggaaagacaacaaaacacgccaggagaagagaaaaaacaaaagaaagacgaaaaagaagaaggagaacaaagacaagaaacgcaccacacaaaaaagaaagaacactaaacacaaagaaaacaagaacagacgaagaacaggagagaaaaaaaaagagcagagcagagggaaagagaaacaacaaagacactcaggaacgaacggagagaaaccacggggaggagagaagacacgaagacaaaaacaccaggagccgggggaggacagaaaacaacaaaagaagcaaacagaacatacaccagcagaagcaagaggaaacacaagcaagagcagagggaaaaagaaa

SEQ ID NO: 356062 - DNA, 10464 bp, Homo sapiens
ggctcctgagcctgctgcactcggccttcttcggggaccagacgctgcaggagctgaagatggcgagctccgtggcgccctacgagcagctggtgaggcaggtggaggccttgaaggctgagaacagccacctgaggcaggagctaagggacaactccagccacctgtccaagctggagacagagacgtcgggcatgaaggaggtcctgaagcacctacagggaaaactggagcaggaggcccgagtgctggtgtcctcggggcagacggaggtgctggagcagctgaaggccctacagatggacatcaccagcctgtacaacctcaagttccagccgcccaccctgggcccggagcctgccgcccggacccccgagggcagcccagtacacggctccgggccctccaaggacagctttggggagctgagccgggccaccatccggctgctggaggaactggaccgggaacggtgtttcctgctgaatgagattgagaaggaggagaaggagaagctctggtactactctcagctgcagggcctgtccaagcgcctggacgagctgccgcacgtggagacgcgttctcgatgcagatggacctgatccggcagcagcttgagttcgaggcccagcacatccgctcgctgatggaggagcgcttcggcacctcggacgagatggtgcagcgggcacagatccgcgcctcgcgcctggagcagattgacaaggagctgctggaggcgcaggaccgagtgcagcagacggagccccaggccttgctggcggtgaagtcggtgccggtggacgaggaccccgagacagaggtccccacacaccctgaggatggcacccctcagccgggcaacagcaaggtggaggtggtcttctggctgttgtccatgttggcgacgcgcgaccaggaggatacagcgcgcacgctgctggccatgtccagctcgcccgagagctgcgtggccatgcgccgctcgggctgtctgcctctgctgctgcaaatcctccacggcaccgaggccgcggccgggggtcgcgccggggccccaggggcaccgggcgccaaggacgcacgcatgcgcgccaacgcggcgctgcacaacatcgtcttctcgcagccggaccagggcctggcgcgcaaggagatgcgcgtcctgcacgtgctggagcagatccgggcctactgcgagacctgctgggactggctgcaggcccgagacggcgggcccgagggaggtggcgccggcagcgccccgatccccatcgagccgcagatctgccaggccacctgtgctgttatgaagctgtcctttgatgaggagtaccgccgtgccatgaacgagctaggtgggctgcaggccgtggcagagctgctgcaggttgactatgagatgcacaagatgacccgggacccgctgaacctggcgctgcgccgctacgcgggcatgaccctcaccaacctcacctttggggacgttgccaacaaggccaccctgtgtgcgcgccgcggctgcatggaggccatcgtggcccagctggcctccgacagtgaggagctccaccaggtggtgtccagcatccttcggaacttgtcctggagggccgacatcaacagcaagaaggtgctgagggaggcgggcagcgtgactgccctggtgcagtgtgtcctgcgggccaccaaggagtccaccctgaagagcgtgctgagcgccctgtggaatctgtctgcacacagcacagagaacaaggcggccatctgccaggtggatggcgccctgggcttcctggtgagcaccctgacctacaagtgtcagagcaactcgctggccatcatcgagagcggcggcggcatcctccgcaatgtgtccagcctcgtcgccacccgtgaggactacaggcaggtgctccgggatcacaactgtctgcagacgctgctgcagcatctgacttcgcacagcctgaccatcgtgagcaacgcgtgcggcacgctctggaacctgtcggcccgcagcgcccgtgaccaggagctgctgtgggacctgggcgccgtgggcatgctgcgtaatctggtgcactccaagcacaagatgatcgccatgggcagcgccgccgccctgcgcaacctgctggcccatcggcccgccaagcaccaggcggccgccaccgccgtgtccccaggcagctgcgtgcccagcctgtacgtgcgcaagcagcgggcgctggaggccgagctggacgcacggcacctcgcgcaggcgctggagcacctggagaagcagggcccgccggcagccgaggccgccactaagaagccgctgccgcccctgcgacacctggacggcctggcccaagactatgcttccgattcgggctgctttgacgacgacgatgcaccgtcatccctggctgcggccgcggccaccggggagccagccagccctgccgcgctgtccctcttcctgggcagccccttcctgcaggggcaggcgctggctcgcaccccgcccacccgccgaggcggcaaggaggcagagaaggacaccagtggggaggcagccgtggcggccaaggccaaggccaagctggcgcttgcagtggcgcgcatcgaccagctggtggaggacatctccgccctgcacacctcgtccgacgatagcttcagcctcagctctggagacccgggacaggaggcgccacgggagggccgcgcccagtcctgctcgccatgccgcggcccggagggcgggcggcgagaggcaggaagccgggcgcacccgctgctgcggctcaaggcggcccacgccagcctctccaacgacagcctcaacagcggcagtgccagcgacgggtactgcccacgcgaacatatgctgccctgcccgctggccgcactggcttcgcgccgcgaggaccccaggtgtgggcagcctcggcccagccggcttgaccttgacctgcccggctgccaggccgagcccccggcccgcgaggccacctccgccgacgcccgcgtgcgcaccatcaagctgtcgcctacctatcagcacgtgccactgcttgagggtgcctcaagggcgggtgcagagcccctcgcggggcctggaatctctccaggggcccggaagcaggcctggctgccggcagaccacctgagcaaggttcccgagaagctggcggctgccccgctgtctgtggccagcaaggcactgcagaaactggcggcgcaagaggggccactctcgctgtcccgatgcagctccctttcctcgctgtcctcggccggccgcccaggccccagcgagggtggtgacctggatgacagtgactcctccctggaggggctggaggaggccggccccagcgaggctgagctggacagcacgtggcgggcgcccggggccacctcgctgcccgtagccattccggctccccggcgtaaccgaggccggggcctgggggtggaagacgccacgccgtccagctcgtcggagaactacgtgcaggagacaccgcttgtgctgagccgctgcagctctgtgagctcgctgggcagcttcgagagcccgtccatcgccagctccatccccagtgaaccttgcagcgggcagggcagcggcaccatcagccctagcgagctgcccgacagccccggacagaccatgcctcccagccggagcaagacgccaccgctggcgcccgcgccacagggtccccccgaggccacccagttcagcctgcagtgggagagctacgtgaagcgcttcctggacatcgccgactgccgggagcgctgccggctgccatctgagctggacgcaggcagcgtgcgctttaccgtggagaagccagacgagaacttctcgtgcgcctccagcctcagcgcgctggccttgcacgagcactacgtgcagcaggacgtggagctgcggctgctgccctcggcctgccccgagcgcggcgggggcgccgggggcgccggcctccactttgcagggcaccggcggcgggaggaggggccggcgcccacgggttctcgccctcgcggcgccgcggaccaggagctggaactgctgcgggagtgcctgggagccgccgtgcctgcccggctgcgcaaggtggcctccgcgctggtgccaggtcgccgcgcactccccgtgcccgtctacatgttggtgcccgccccggccccggcccaggaggacgactcctgcactgactccgcggagggcacgccggtcaacttctctagcgccgcctcgctcagcgacgagacgctgcagggaccccccagggaccagcccgggggaccagcgggcaggcaaagacccaccggccgccccacctctgccagacaggccatggggcaccggcacaaggcgggaggcgccggccgcagcgcggagcagtctcggggcgcgggcaagaaccgagcagggctggagctgcccctgggccggcccccgagcgcccccgcagacaaggacggctcaaagcccggccggacccgcggggacggggcgctccagtcgctgtgcctcacgacgcccactgaggaggccgtgtactgcttctacggcaacgactcggacgaggagcccccggcggccgcgcccacgccaacccaccggcgcacatcggccatccctcgcgcttttacgcgggagcgtccgcagggccggaaggaggcccctgccccgtccaaggctgcaccagctgccccgccgcccgcccggacccagcccagcctcattgctgacgagaccccgccctgctactccctgagctcctccgccagctccctcagcgagcccgagccctcggagccgccggccgtccatccacgaggccgggagcccgcggtcaccaaggacccgggcccaggaggcggacgcgacagctcgcccagcccgcgggccgcggaggagcttctgcagcggtgcatcagctcggccctgcccaggcgccggccccccgtgtctggcctgcggcgccgcaagccccgagccacccggctggatgagcggcccgcagaggggtcccgggaacgcggcgaggaggcagcgggctcggaccgggcctccgacctggatagcgtggagtggcgcgccatccaggagggcgccaattcaattgtcacgtggctgcaccaggcagcagctgccacgcgggaggcctcgtccgagtccgactccatcctgtccttcgtatccgggctgtcagtgggatccaccctacagccccccaagcacaggaagggacgacaggcggagggagaaatgggcagtgcccggcggccagagaaaaggggcgcagcctcagtcaagaccagcgggagcccccgttcccctgcaggccccgagaagccacgtggcacacagaagaccacgcccggggtgccagctgtgctccggggacgaacagtgatctacgtccccagcccggcaccccgtgcccagcccaaagggacccccggcccccgcgccacaccgcggaaggtggcgcccccttgcctggcacagcccgcggctccagccaaagtcccgagccccgggcagcagcggtcgcggagcctacaccggcctgccaagacctcggagctggcgacgctgagccagccccccagaagcgccacaccgcccgcccgcctcgccaagaccccctcctccagctcctcccagacctcgcccgcctcccagcccctgcccagaaagcgccccccggtcacccaggctgctggggccctgcccggccccggagcctccccggtgcccaaaacgccggcgcgcacccttctggcgaagcagcacaagacgcagagatcgcccgtgcggatcccgttcatgcagaggccggcccggcgtgggccgccaccgctggctcgggcagtcccggagccgggccccaggggccgggcggggaccgaggcgggcccgggggcgcgcgggggccgcctgggcctggtgcgtgtggcctcagccctctccagcggcagcgagtcctccgaccgctcgggcttccggcgacagctaaccttcatcaaggagtcgccgggcttgcggcgccgccgctccgagctgtcctcggccgagtccgcggcctctgccccccagggcgcctcgccccgccgcggccggcccgcgctgcccgccgtcttcctctgctcctcgcgctgcgaagagctccgagcggcaccccggcagggcccggccccggcccggcagcggccccccgcggcccgacccagccctggcgagcgccctgcccggcgcaccacctccgagagcccgtcccgcctgcctgtgcgcgcgcccgccgcccggccggagactgtcaagcgctacgcgtcgctgccgcacatcagcgtggcccgcaggcccgacggcgccgtccccgcggcccctgcctcagccgacgccgcgcgccgcagcagcgacggggagccccggccgctccccagggtggccgcgccgggcacgacctggcggcgcatccgagatgaggacgtgccccacatcctgcgcagcacgcttcccgccacggccctgccactgcggggctccacgcccgaggacgccccggccgggcccccgccgcgcaagaccagcgacgccgtggtccagaccgaggaggtcgccgcccccaagaccaactccagcacgtccccgagcctggagaccagggagccccccggggcccccgccggcggccagctctccctcctcggcagcgacgtggacggtcccagcctcgccaaggctcccatctccgcacccttcgtgcacgagggcctgggggtcgccgtggggggcttccccgccagccggcacggctcccccagccgctcggcccgagtaccccccttcaactatgtgcccagccccatggtggtcgcagccaccaccgactcggccgcggagaaagccccggccactgcctccgccaccctcctggaatagtggcctaggccggccttctggaacgttctctcccggccctgcggcgcggtctggctgccccatgggcctgcgctgtagacgtcccccataggtcgccccagggcctctgcccacccgagccccaccactctcagaacccccgcccagcgcacggcgacctcgcgcctcaccggaagaccttgcctctgtgccgcggaggtccaggaggaaacggggcggccgctaggcctcaagtcccgaccgtggagcgctggcaagggcgtcctggcccagccctgagcgcgcggcccttcccctgtcggaagccgttgcttgaccccgggcgagggaggcggtagcctccgggtccgggtctgggtctgggtccgctgcttcgcagggacagcgctggggaggtgacggcgcccgccgcaggtggggcgaggctgggggagggcggcgccgcggcgggcctgccagctgggggcctttgcggcgcgcaggggcgaagcctgtaatcactgcagccgccggtaattcgctaatgagggctttgcagggattgttttcattctcagccccagctgtgggagtgcgggtgggggtgtggccgagccccggcaggaagccccgcccagacggtgttcagggaacccggagcccaagcgctccggcggagcccaaaagggtgggggtgggaggggcagaggccaacggatccccctgcctgtcgcaccccttggcgggagacgggaaggcagcgggctgcgtacgatgggaccctggtgcagacgccgggccggctgacatttggaccccatcccagaggagatgctggctaccagctggggcgaccccaagggtcgctggagtcagtatcggcccggcgcagccgcggcgggcgaggccaatggaaaggagactgaggggagtcccggcagtgagcccgaggccctgggacctggagcccgcgctggcctctccccagcggagcctgcacgttacggagaccatcacatgtgggcgtggtcagtgcccaggaccgcaccgctgctcatcttgtcccttttcaattcccttctggttcatgatgcataaagcgctaggccctagaactccagaaacagcacagctggggcggggacccagccttgccctccacccgaggctctgggacaaggcgggaggttcgggggccttccggcaggtgaacgcagggctggagagtatttggtgccagatgaggtgaaagcttatagaagggcctgaggggctcggctgcctcatcccctggcgggggaggctgggagctgggcctcctgcgtggggtgggactcgcaggggccgggtctccgtgactggggcaacgcctcgtcctgcagagggagccgacgacctcttttctgcagaaaagctccagcaggcgctgccttcacccacggatctgcccaggctgaaggcacacgctcaatgccccacgtgccttctccaggaggaacgaagcagggtttgagggttgggtggatggagctcagaaggaaaccccagccccaccacggatgacaccatccctcccgtcccatccccagcatgggcaaggccagcctttctggcagaaggagctgtcctcaactcagggccgctgtgagcaaagctgaccccagcccccacccccagttaacactgctgcttctctgaatgcatgtcacgctgcaccccatgctccgggcccacaccctgcaggacaaggagctccagacaggacgtccataagtcaccgaggtgtgccacccagcaggtgctggaggtgcccaatgctccctcctaggacctcgcagccaggcaaggctgtcaggttgttttgggggaagagggggtcatggatggctgagcagagagcggggaaaatgcaggctgagtggggcgacctcctgcctgccaggagccccctttcaggacacagcgggggtctcacacttgctgtccccatccatggcccgagggggaacctggtggtctcttctgagcttttggacttggggatgccaaacacgtgctcaccctcacactcgccccggcccgctgcgcccctaattgccaaagggtagggaaatggcgaagccagccaccaggtcgctggtgacagggccagggttatgcaggaaggtggtgcggcattgccttccacatatgtaagtctctgggcggcgccctcccagctccctgcctctgtttccccatgtgggccgtggggaactcccagagctacctcttgggggagcgtggtggcagcgatgatggggagacgcctggaagctcacagaacttgggtctggctggctcctgcccgtgacgccttgcccagcagcaaggtgcgcaacatggctgccagccccgcctcccacccccaccccgagtcctgagctcactttcgccttctccatcccctgccgtgggggccacagccacacctcaccgcccagtccagctgtctccagaaggggacaggcagtccgcggtctctggacaatcaactcaaggtacgcccactgcaaggcctccctcccaccgcggcccctgcctggccacctggcctctctgcaccagggtgacaaggggtcctcgtctgccccccaatgctccagggccagtcctaaggagctgagggtctgaggacgcagggagggtggaggtgtcctgaggctgatggacagtgaccgccactggcccccaacatgaccacacgtgggtgctgaactcggggcgccgtgcccaccggcatggtcctcccgagctccgacagcattacctcacccggccccatctgttgccccggtccagccctgatggcgcgcgcctggtctgtctgattcccctagccgccaccccacgtttctgtaccgggtctctgcagtgttaaacggacgtgtaaatagtggtaaatagtgaaagcctgtccttccctaaatgtaaagccatctgtccggcgtaaggacgacaccgtcagctgtccgactcgcacacatttaataaactgagctcttgcattgaaaaaaaaaaaaaaaaaaacaaaaaaaacacaaaaacaaaaaaagaaaaacaaaatacacagagagacacaaacacaaacaataaaacaaacaaaaaaaaaaccaggagggagcggcaggaaagacaacaaaacacgccaggagaagagaaaaaacaaaagaaagacgaaaaagaagaaggagaacaaagacaagaaacgcaccacacaaaaaagaaagaacactaaacacaaagaaaacaagaacagacgaagaacaggagagaaaaaaaaagagcagagcagagggaaagagaaacaacaaagacactcaggaacgaacggagagaaaccacggggaggagagaagacacgaagacaaaaacaccaggagccgggggaggacagaaaacaacaaaagaagcaaacagaacatacaccagcagaagcaagaggaaacacaagcaagagcagagggaaaaagaaa

SEQ ID NO: 356063 - DNA, 2185 bp, Homo sapiens
  misc_feature (13)..(13): n is a, c, g, or t
gctcgcgatctanaaccggacgcgtgggctggggcaacgcctcgtcctgcagagggagccgacgacctcttttctgcagaaaagctccagcaggcgctgccttcacccacggatctgcccaggctgaaggcacacgctcaatgccccacgtgccttctccaggaggaacgaagcagggtttgagggttgggtggatggagctcagaaggaaaccccagccccaccacggatgacaccatccctcccgtcccatccccagcatgggcaaggccagcctttctggcagaaggagctgtcctcaactcagggccgctgtgagcaaagctgaccccagcccccacccccagttaacactgctgcttctctgaatgcatgtcacgctgcaccccatgctccgggcccacaccctgcaggacaaggagctccagacaggacgtccataagtcaccgaggtgtgccacccagcaggtgctggaggtgcccaatgctccctcctaggacctcgcagccaggcaaggctgtcaggttgttttgggggaagagggggtcatggatggctgagcagagagcggggaaaatgcaggctgagtggggcgacctcctgcctgccaggagccccctttcaggacacagcgggggtctcacacttgctgtccccatccatggcccgagggggaacctggtggtctcttctgagcttttggacttggggatgccaaacacgtgctcaccctcacactcgccccggcccgctgcgcccctaattgccaaagggtagggaaatggcgaagccagccaccaggtcgctggtgacagggccagggttatgcaggaaggtggtgcggcattgccttccacatatgtaagtctctgggcggcgccctcccagctccctgcctctgtttccccatgtgggccgtggggaactcccagagctacctcttgggggagcgtggtggcagcgatgatggggagacgcctggaagctcacagaacttgggtctggctggctcctgcccgtgacgccttgcccagcagcaaggtgcgcaacatggctgccagccccgcctcccacccccaccccgagtcctgagctcactttcgccttctccatcccctgccgtgggggccacagccacacctcaccgcccagtccagctgtctccagaaggggacaggcagtccgcggtctctggacaatcaactcaaggtacgcccactgcaaggcctccctcccaccgcggcccctgcctggccacctggcctctctgcaccagggtgacaaggggtcctcgtctgccccccaatgctccagggccagtcctaaggagctgagggtctgaggacgcagggagggtggaggtgtcctgaggctgatggacagtgaccgccactggcccccaacatgaccacacgtgggtgctgaactcggggcgccgtgcccaccggcatggtcctcccgagctccgacagcattacctcacccggccccatctgttgccccggtccagccctgatggcgcgcgcctggtctgtctgattcccctagccgccaccccacgtttctgtaccgggtctctgcagtgttaaacggacgtgtaaatagtggtaaatagtgaaagcctgtccttccctaaatgtaaagccatctgtccggcgtaaggacgacaccgtcagctgtccgactcgcacacatttaataaactgagctcttgcattgaaaaaaaaaaaaaaaaaaacaaaaaaaacacaaaaacaaaaaaagaaaaacaaaatacacagagagacacaaacacaaacaataaaacaaacaaaaaaaaaaccaggagggagcggcaggaaagacaacaaaacacgccaggagaagagaaaaaacaaaagaaagacgaaaaagaagaaggagaacaaagacaagaaacgcaccacacaaaaaagaaagaacactaaacacaaagaaaacaagaacagacgaagaacaggagagaaaaaaaaagagcagagcagagggaaagagaaacaacaaagacactcaggaacgaacggagagaaaccacggggaggagagaagacacgaagacaaaaacaccaggagccgggggaggacagaaaacaacaaaagaagcaaacagaacatacaccagcagaagcaagaggaaacacaagcaagagcagagggaaaaagaaa

SEQ ID NO: 356064 - DNA, 1422 bp, Homo sapiens
cgggcacattggtgcacaggcggttttgggcgcggcgttgttatagtgtcggcgctttcccccgtgttccgtggtggccattgtttaccctgctctcgttgtgtagtgtctgtcgcgtgggccgccctgccgtctgtcgttattgagctagttttggcattacgccgtgggcgatggttgcccgcgagtctcccggcctcgccctgtttgtggttccgctaactcggggtttggtgtttttttttctggacaacagagcgagaccctgtctcgtcagttttatttttaaaaagggcagaagcacagctgaaaggtgtggtgctccaggaactacctcgcctcccttcccaaggctgagtgagagaggccaccccatcatcccatcttagagaggctgggaaaggaagtcccaactttgcagccatttgcaaagctcccgggatccttcaggcctggggcgggcgggttgcgggaccttcgggagtcacctgggacatttcctgggaatgggggctctgatctggtccctgtgcccacagccccgatccccatcgagccgcagatctgccaggccacctgtgctgttatgaagctgtcctttgatgaggagtaccgccgtgccatgaacgagctaggtgagtgtcccaggtcctctgggaagccatcctccagcccccgaacaggtggtggctcctcggccgctaaagggacacaggctgggtcatctgagcttgggctggggattggagcccggagagggacagactccctggagtcacatagcacctctcatgagtggaccgtcaccctgggccctctgtccccatgagctgcgtgtggcctcccgatctggtctgaggcttcgggggtgactttcagccctaagttccctggggctcagaacagggaacggaccagaagggcaaagatagatagaagacaggcccagaattggaactgtagggggtgttttacgtttgaggacattgcaacatcttctctttgtcaatataaaaagtaattgaggccgggcgaggctgctcatacctgtaatcccagcagtttgggaggccaaggcaggaggatgactttagctcagaagttcgagaccaggctgggcaaaaatagtgagaccccatcactacaaaaaaaaaattagtcccagctactggggaggctgaggtgggaggatctcttgagcccaggaggttaaaggtgcaaggagctatgatcatgccaccacactccagactgggcaacagagccagaccctgtctcaaaaagaaaagtcttgctgtaacttttttttgagacagagtctcactctgttgcccaggctggagtgcagtggtacaatctcagctcactgcaaactccacctccgagtagctgggattacaggtgcccgcccccacacctgac

SEQ ID NO: 356065 - DNA, 1181 bp, Homo sapiens
  misc_feature (1157)..(1157): n is a, c, g, or t
  misc_feature (1161)..(1161): n is a, c, g, or t
cgggcacattggtgcacaggcggttttgggcgcggcgttgttatagtgtcggcgctttcccccgtgttccgtggtggccattgtttaccctgctctcgttgtgtagtgtctgtcgcgtgggccgccctgccgtctgtcgttattgagctagttttggcattacgccgtgggcgatggttgcccgcgagtctcccggcctcgccctgtttgtggttccgctaactcggggtttggtgtttttttttctggacaacagagcgagaccctgtctcgtcagttttatttttaaaaagggcagaagcacagctgaaaggtgtggtgctccaggaactacctcgcctcccttcccaaggctgagtgagagaggccaccccatcatcccatcttagagaggctgggaaaggaagtcccaactttgcagccatttgcaaagctcccgggatccttcaggcctggggcgggcgggttgcgggaccttcgggagtcacctgggacatttcctgggaatgggggctctgatctggtccctgtgcccacagccccgatccccatcgagccgcagatctgccaggccacctgtgctgttatgaagctgtcctttgatgaggagtaccgccgtgccatgaacgagctaggtgagtgtcccaggtcctctgggaagccatcctccagcccccgaacaggtggtggctcctcggccgctaaagggacacaggctgggtcatctgagcttgggctggggattggagcccggagagggacagactccctggagtcacatagcacctctcatgagtggaccgtcaccctgggccctctgtccccatgagctgcgtgtggcctcccgatctggtctgaggcttcgggggtgactttcagccctaagttccctggggctcagaacagggaacggaccagaagggcaaagatagatagaagacaggcccagaattggaactgtagggggtgttttacgtttgaggacattgcaacatcttctctttgtcaatataaaaagtaattgaggccgggcgaggctgctcatacctgtaatcccagcagtttgggaggccaaggcaggaggatgactttagctcagaagttcgagaccaggctgggcaaaaatagtgagaccccatcactacaaaaaaaaacancacncagcctcgtacctagccctc

SEQ ID NO: 356066 - DNA, 639 bp, Homo sapiens
gtgcagcagacggagccccaggtaccgggtggggcagagccagggaccaggggtggtgtcggcccaggcagaacggggctcctcgagttctgcccgcccccgcccacatcatcacgggtgagcagactgggtgctctgggactgtacccccgaccctggtgctctccctgcaggccttgctggcggtgaagtcggtgccggtggacgaggaccccgagacagaggtccccacacaccctgaggatggcacccctcagccgggcaacagcaaggtgagggggagggtgaaacgggggctggcgcagctgtctgggctggaagggggatcaggtctgcatcctcgccagtggtggtgccctcccatgcctccatccagcaccccctcgggtgtaggaaggcccctctggcgtgcagctcatgcagaagctgcgggcctggcgaggtggatggggaaatacgtcccgtagcgggggctaagtggggcaccatagacgtccccgtggagtcccttggctctgcgcggccaccctaggaatgccaggtgaggggggccagcctccccgaagcacgtgtgcagcctcctagcgtcccctcatctgtcccccaggtgggcgtggggctgcccttggggacggggca

SEQ ID NO: 356067 - DNA, 364 bp, Homo sapiens
cagttgatcgcaaagttaatatgggggccgggcgctgtgactcacacctgtgatcccagcactttggaaggcagaagcaggagaattgcttgagcccaggaatttggggctgcagtgagctgagatcatgctactgcactccagtctggacaacagagcgagaccctgtctcgtcagttttatttttaaaaagggcagaagcacagctgaaaggtgtggtgctccaggaactacctcgcctcccttcccaaggctgagtgagagaggccaccccatcatcccatcttagagaggctgggaaaggaagtcccaactttgcagccatttgcaaagctcccgggatccttcaggcctggggcgggcg

SEQ ID NO: 356068 - DNA, 12117 bp, Homo sapiens
gggtttggggagcaggaggcagacatgtgttgctttgcacgtcatctggtccttccacctggctgggcatgggatggtgacctcagctggaacatggggctcgagccagacctcagggtctccctgcgtgtagcccccaaccccaagcctgatccccaccggagacctgaacagccttggacatcatcggatcagggtgggaggtgccagcctctgccacctgacttccagtccctgtgcccctcccaccctgcccttgggcactcctgccctgcaggttcctcagaggggcaacccaaagccagagaggggcgggtcttgtcgggcctccagcctggacttcccagcccctctggggcagcatctgggtgccagacctcggttcctagggcctcgtttctccctctgggaacagccaaatggtggtccctgagactcaggacagaccaagaagaagccggatgacatggcaagccacacactgcgtcccctgagcaggacgggacagcccgactccatcctcccacctgcgactgagcccccacccctactcctgtcccagccgtgcccctggtgacatttgggtgggaggggaggggatgagggggcacctgggggtcagagaacaaatgacgggtgaatacatgtgtgtggccaggtggaggagggaggggaggagcaggtgggctggacagggccggtgtgaggaaggggctcaggctggcagggggaggtggcaagagggatgggctgccattggtggtctgagacaaaggcggagggaggaggcgagcgctgatgggaaaggaacaaagagggaaggggggcgtgaagggggttccggcgggagggccgagccgagggaggaggcgccggccagctggacagagggaggaggccaggccagagccagaagacggccagaggcacaaagaagccagcgcgctggcagagtcaagggatggggcagaggctgccggggccagcagggaccagctgaaggctgcgcagggggtgcgggccacacaggtagccaccctgagctcagccaccgatggagggtcgtggggctgctgcggtgatggcggtgggcttgggtccatctgtcctgccgtttctgcacagcttaggtgtcacccactggccttcgtggtgttttcattgtccatcggcagggacagctggtggtctgtctgccccgcctgtctggctgtcagcctctgggcaggcttgcttttatgggggagggtcctgtctgtctgtctgtcgccctctctggctgtgagcctgggggtgctgggctggccagtcggcttgctgggttaggctgtcccagctgtctgagtgtttgtccggctgtcaggatgtgtcctgggggctgggaaggagaggccgacccatcgtctgtcggtcgactggtcagttggacgttcagctgtctgtacgtctgtctgctggcccatctgtctccccttggggccacctctcactccacctgcccctctgcgccccggattgcctggccaccaccacgtgggcctgtacttgtccacaccagtgactcctgcctgagaccccccccaacccaggatcaggcaggacggctggggcttaggtcaggggccgtctgtccggaaggcatcaccgcgccctccccagaccatcagctgaaccctctgaccctgtgatcccagacgctgcaggagctgaagatggcgagctccgtggcgccctacgagcagctggtgaggcaggtggaggccttgaaggctgagaacagccacctgaggcaggagctaagggacaactccagccacctgtccaagctggagacagagacgtcgggcatgaaggaggtcctgaagcacctacagggaaaactggagcaggaggcccgagtgctggtgtcctcggggcagacggaggtgctggagcagctgaaggccctacagatggacatcaccagcctgtacaacctcaagttccagccgcccaccctgggcccggagcctgccgcccggacccccgagggcagcccagtacacggctccgggccctccaaggacagctttggggagctgagccgggccaccatccggctgctggaggaactggaccgggaacggtgtttcctgctgaatgagattgagaaggaggagaaggagaagctctggtactactctcagctgcagggcctgtccaagcgcctggacgagctgccgcacgtggagacgcgttctcgatgcagatggacctgatccggcagcagcttgagttcgaggcccagcacatccgctcgctgatggaggagcgcttcggcacctcggacgagatggtgcagcgggcacagatccgcgcctcgcgcctggagcagattgacaaggagctgctggaggcgcaggaccgagtgcagcagacggagccccaggccttgctggcggtgaagtcggtgccggtggacgaggaccccgagacagaggtccccacacaccctgaggatggcacccctcagccgggcaacagcaaggtggaggtggtcttctggctgttgtccatgttggcgacgcgcgaccaggaggatacagcgcgcacgctgctggccatgtccagctcgcccgagagctgcgtggccatgcgccgctcgggctgtctgcctctgctgctgcaaatcctccacggcaccgaggccgcggccgggggtcgcgccggggccccaggggcaccgggcgccaaggacgcacgcatgcgcgccaacgcggcgctgcacaacatcgtcttctcgcagccggaccagggcctggcgcgcaaggagatgcgcgtcctgcacgtgctggagcagatccgggcctactgcgagacctgctgggactggctgcaggcccgagacggcgggcccgagggaggtggcgccggcagcgccccgatccccatcgagccgcagatctgccaggccacctgtgctgttatgaagctgtcctttgatgaggagtaccgccgtgccatgaacgagctaggtgggctgcaggccgtggcagagctgctgcaggttgactatgagatgcacaagatgacccgggacccgctgaacctggcgctgcgccgctacgcgggcatgaccctcaccaacctcacctttggggacgttgccaacaaggccaccctgtgtgcgcgccgcggctgcatggaggccatcgtggcccagctggcctccgacagtgaggagctccaccaggtggtgtccagcatccttcggaacttgtcctggagggccgacatcaacagcaagaaggtgctgagggaggcgggcagcgtgactgccctggtgcagtgtgtcctgcgggccaccaaggagtccaccctgaagagcgtgctgagcgccctgtggaatctgtctgcacacagcacagagaacaaggcggccatctgccaggtggatggcgccctgggcttcctggtgagcaccctgacctacaagtgtcagagcaactcgctggccatcatcgagagcggcggcggcatcctccgcaatgtgtccagcctcgtcgccacccgtgaggactacaggcaggtgctccgggatcacaactgtctgcagacgctgctgcagcatctgacttcgcacagcctgaccatcgtgagcaacgcgtgcggcacgctctggaacctgtcggcccgcagcgcccgtgaccaggagctgctgtgggacctgggcgccgtgggcatgctgcgtaatctggtgcactccaagcacaagatgatcgccatgggcagcgccgccgccctgcgcaacctgctggcccatcggcccgccaagcaccaggcggccgccaccgccgtgtccccaggcagctgcgtgcccagcctgtacgtgcgcaagcagcgggcgctggaggccgagctggacgcacggcacctcgcgcaggcgctggagcacctggagaagcagggcccgccggcagccgaggccgccactaagaagccgctgccgcccctgcgacacctggacggcctggcccaagactatgcttccgattcgggctgctttgacgacgacgatgcaccgtcatccctggctgcggccgcggccaccggggagccagccagccctgccgcgctgtccctcttcctgggcagccccttcctgcaggggcaggcgctggctcgcaccccgcccacccgccgaggcggcaaggaggcagagaaggacaccagtggggaggcagccgtggcggccaaggccaaggccaagctggcgcttgcagtggcgcgcatcgaccagctggtggaggacatctccgccctgcacacctcgtccgacgatagcttcagcctcagctctggagacccgggacaggaggcgccacgggagggccgcgcccagtcctgctcgccatgccgcggcccggagggcgggcggcgagaggcaggaagccgggcgcacccgctgctgcggctcaaggcggcccacgccagcctctccaacgacagcctcaacagcggcagtgccagcgacgggtactgcccacgcgaacatatgctgccctgcccgctggccgcactggcttcgcgccgcgaggaccccaggtgtgggcagcctcggcccagccggcttgaccttgacctgcccggctgccaggccgagcccccggcccgcgaggccacctccgccgacgcccgcgtgcgcaccatcaagctgtcgcctacctatcagcacgtgccactgcttgagggtgcctcaagggcgggtgcagagcccctcgcggggcctggaatctctccaggggcccggaagcaggcctggctgccggcagaccacctgagcaaggttcccgagaagctggcggctgccccgctgtctgtggccagcaaggcactgcagaaactggcggcgcaagaggggccactctcgctgtcccgatgcagctccctttcctcgctgtcctcggccggccgcccaggccccagcgagggtggtgacctggatgacagtgactcctccctggaggggctggaggaggccggccccagcgaggctgagctggacagcacgtggcgggcgcccggggccacctcgctgcccgtagccattccggctccccggcgtaaccgaggccggggcctgggggtggaagacgccacgccgtccagctcgtcggagaactacgtgcaggagacaccgcttgtgctgagccgctgcagctctgtgagctcgctgggcagcttcgagagcccgtccatcgccagctccatccccagtgaaccttgcagcgggcagggcagcggcaccatcagccctagcgagctgcccgacagccccggacagaccatgcctcccagccggagcaagacgccaccgctggcgcccgcgccacagggtccccccgaggccacccagttcagcctgcagtgggagagctacgtgaagcgcttcctggacatcgccgactgccgggagcgctgccggctgccatctgagctggacgcaggcagcgtgcgctttaccgtggagaagccagacgagaacttctcgtgcgcctccagcctcagcgcgctggccttgcacgagcactacgtgcagcaggacgtggagctgcggctgctgccctcggcctgccccgagcgcggcgggggcgccgggggcgccggcctccactttgcagggcaccggcggcgggaggaggggccggcgcccacgggttctcgccctcgcggcgccgcggaccaggagctggaactgctgcgggagtgcctgggagccgccgtgcctgcccggctgcgcaaggtggcctccgcgctggtgccaggtcgccgcgcactccccgtgcccgtctacatgttggtgcccgccccggccccggcccaggaggacgactcctgcactgactccgcggagggcacgccggtcaacttctctagcgccgcctcgctcagcgacgagacgctgcagggaccccccagggaccagcccgggggaccagcgggcaggcaaagacccaccggccgccccacctctgccagacaggccatggggcaccggcacaaggcgggaggcgccggccgcagcgcggagcagtctcggggcgcgggcaagaaccgagcagggctggagctgcccctgggccggcccccgagcgcccccgcagacaaggacggctcaaagcccggccggacccgcggggacggggcgctccagtcgctgtgcctcacgacgcccactgaggaggccgtgtactgcttctacggcaacgactcggacgaggagcccccggcggccgcgcccacgccaacccaccggcgcacatcggccatccctcgcgcttttacgcgggagcgtccgcagggccggaaggaggcccctgccccgtccaaggctgcaccagctgccccgccgcccgcccggacccagcccagcctcattgctgacgagaccccgccctgctactccctgagctcctccgccagctccctcagcgagcccgagccctcggagccgccggccgtccatccacgaggccgggagcccgcggtcaccaaggacccgggcccaggaggcggacgcgacagctcgcccagcccgcgggccgcggaggagcttctgcagcggtgcatcagctcggccctgcccaggcgccggccccccgtgtctggcctgcggcgccgcaagccccgagccacccggctggatgagcggcccgcagaggggtcccgggaacgcggcgaggaggcagcgggctcggaccgggcctccgacctggatagcgtggagtggcgcgccatccaggagggcgccaattcaattgtcacgtggctgcaccaggcagcagctgccacgcgggaggcctcgtccgagtccgactccatcctgtccttcgtatccgggctgtcagtgggatccaccctacagccccccaagcacaggaagggacgacaggcggagggagaaatgggcagtgcccggcggccagagaaaaggggcgcagcctcagtcaagaccagcgggagcccccgttcccctgcaggccccgagaagccacgtggcacacagaagaccacgcccggggtgccagctgtgctccggggacgaacagtgatctacgtccccagcccggcaccccgtgcccagcccaaagggacccccggcccccgcgccacaccgcggaaggtggcgcccccttgcctggcacagcccgcggctccagccaaagtcccgagccccgggcagcagcggtcgcggagcctacaccggcctgccaagacctcggagctggcgacgctgagccagccccccagaagcgccacaccgcccgcccgcctcgccaagaccccctcctccagctcctcccagacctcgcccgcctcccagcccctgcccagaaagcgccccccggtcacccaggctgctggggccctgcccggccccggagcctccccggtgcccaaaacgccggcgcgcacccttctggcgaagcagcacaagacgcagagatcgcccgtgcggatcccgttcatgcagaggccggcccggcgtgggccgccaccgctggctcgggcagtcccggagccgggccccaggggccgggcggggaccgaggcgggcccgggggcgcgcgggggccgcctgggcctggtgcgtgtggcctcagccctctccagcggcagcgagtcctccgaccgctcgggcttccggcgacagctaaccttcatcaaggagtcgccgggcttgcggcgccgccgctccgagctgtcctcggccgagtccgcggcctctgccccccagggcgcctcgccccgccgcggccggcccgcgctgcccgccgtcttcctctgctcctcgcgctgcgaagagctccgagcggcaccccggcagggcccggccccggcccggcagcggccccccgcggcccgacccagccctggcgagcgccctgcccggcgcaccacctccgagagcccgtcccgcctgcctgtgcgcgcgcccgccgcccggccggagactgtcaagcgctacgcgtcgctgccgcacatcagcgtggcccgcaggcccgacggcgccgtccccgcggcccctgcctcagccgacgccgcgcgccgcagcagcgacggggagccccggccgctccccagggtggccgcgccgggcacgacctggcggcgcatccgagatgaggacgtgccccacatcctgcgcagcacgcttcccgccacggccctgccactgcggggctccacgcccgaggacgccccggccgggcccccgccgcgcaagaccagcgacgccgtggtccagaccgaggaggtcgccgcccccaagaccaactccagcacgtccccgagcctggagaccagggagccccccggggcccccgccggcggccagctctccctcctcggcagcgacgtggacggtcccagcctcgccaaggctcccatctccgcacccttcgtgcacgagggcctgggggtcgccgtggggggcttccccgccagccggcacggctcccccagccgctcggcccgagtaccccccttcaactatgtgcccagccccatggtggtcgcagccaccaccgactcggccgcggagaaagccccggccactgcctccgccaccctcctggaatagtggcctaggccggccttctggaacgttctctcccggccctgcggcgcggtctggctgccccatgggcctgcgctgtagacgtcccccataggtcgccccagggcctctgcccacccgagccccaccactctcagaacccccgcccagcgcacggcgacctcgcgcctcaccggaagaccttgcctctgtgccgcggaggtccaggaggaaacggggcggccgctaggcctcaagtcccgaccgtggagcgctggcaagggcgtcctggcccagccctgagcgcgcggcccttcccctgtcggaagccgttgcttgaccccgggcgagggaggcggtagcctccgggtccgggtctgggtctgggtccgctgcttcgcagggacagcgctggggaggtgacggcgcccgccgcaggtggggcgaggctgggggagggcggcgccgcggcgggcctgccagctgggggcctttgcggcgcgcaggggcgaagcctgtaatcactgcagccgccggtaattcgctaatgagggctttgcagggattgttttcattctcagccccagctgtgggagtgcgggtgggggtgtggccgagccccggcaggaagccccgcccagacggtgttcagggaacccggagcccaagcgctccggcggagcccaaaagggtgggggtgggaggggcagaggccaacggatccccctgcctgtcgcaccccttggcgggagacgggaaggcagcgggctgcgtacgatgggaccctggtgcagacgccgggccggctgacatttggaccccatcccagaggagatgctggctaccagctggggcgaccccaagggtcgctggagtcagtatcggcccggcgcagccgcggcgggcgaggccaatggaaaggagactgaggggagtcccggcagtgagcccgaggccctgggacctggagcccgcgctggcctctccccagcggagcctgcacgttacggagaccatcacatgtgggcgtggtcagtgcccaggaccgcaccgctgctcatcttgtcccttttcaattcccttctggttcatgatgcataaagcgctaggccctagaactccagaaacagcacagctggggcggggacccagccttgccctccacccgaggctctgggacaaggcgggaggttcgggggccttccggcaggtgaacgcagggctggagagtatttggtgccagatgaggtgaaagcttatagaagggcctgaggggctcggctgcctcatcccctggcgggggaggctgggagctgggcctcctgcgtggggtgggactcgcaggggccgggtctccgtgactggggcaacgcctcgtcctgcagagggagccgacgacctcttttctgcagaaaagctccagcaggcgctgccttcacccacggatctgcccaggctgaaggcacacgctcaatgccccacgtgccttctccaggaggaacgaagcagggtttgagggttgggtggatggagctcagaaggaaaccccagccccaccacggatgacaccatccctcccgtcccatccccagcatgggcaaggccagcctttctggcagaaggagctgtcctcaactcagggccgctgtgagcaaagctgaccccagcccccacccccagttaacactgctgcttctctgaatgcatgtcacgctgcaccccatgctccgggcccacaccctgcaggacaaggagctccagacaggacgtccataagtcaccgaggtgtgccacccagcaggtgctggaggtgcccaatgctccctcctaggacctcgcagccaggcaaggctgtcaggttgttttgggggaagagggggtcatggatggctgagcagagagcggggaaaatgcaggctgagtggggcgacctcctgcctgccaggagccccctttcaggacacagcgggggtctcacacttgctgtccccatccatggcccgagggggaacctggtggtctcttctgagcttttggacttggggatgccaaacacgtgctcaccctcacactcgccccggcccgctgcgcccctaattgccaaagggtagggaaatggcgaagccagccaccaggtcgctggtgacagggccagggttatgcaggaaggtggtgcggcattgccttccacatatgtaagtctctgggcggcgccctcccagctccctgcctctgtttccccatgtgggccgtggggaactcccagagctacctcttgggggagcgtggtggcagcgatgatggggagacgcctggaagctcacagaacttgggtctggctggctcctgcccgtgacgccttgcccagcagcaaggtgcgcaacatggctgccagccccgcctcccacccccaccccgagtcctgagctcactttcgccttctccatcccctgccgtgggggccacagccacacctcaccgcccagtccagctgtctccagaaggggacaggcagtccgcggtctctggacaatcaactcaaggtacgcccactgcaaggcctccctcccaccgcggcccctgcctggccacctggcctctctgcaccagggtgacaaggggtcctcgtctgccccccaatgctccagggccagtcctaaggagctgagggtctgaggacgcagggagggtggaggtgtcctgaggctgatggacagtgaccgccactggcccccaacatgaccacacgtgggtgctgaactcggggcgccgtgcccaccggcatggtcctcccgagctccgacagcattacctcacccggccccatctgttgccccggtccagccctgatggcgcgcgcctggtctgtctgattcccctagccgccaccccacgtttctgtaccgggtctctgcagtgttaaacggacgtgtaaatagtggtaaatagtgaaagcctgtccttccctaaatgtaaagccatctgtccggcgtaaggacgacaccgtcagctgtccgactcgcacacatttaataaactgagctcttgcattgaaaaaaaaaaaaaaaaaaacaaaaaaaacacaaaaacaaaaaaagaaaaacaaaatacacagagagacacaaacacaaacaataaaacaaacaaaaaaaaaaccaggagggagcggcaggaaagacaacaaaacacgccaggagaagagaaaaaacaaaagaaagacgaaaaagaagaaggagaacaaagacaagaaacgcaccacacaaaaaagaaagaacactaaacacaaagaaaacaagaacagacgaagaacaggagagaaaaaaaaagagcagagcagagggaaagagaaacaacaaagacactcaggaacgaacggagagaaaccacggggaggagagaagacacgaagacaaaaacaccaggagccgggggaggacagaaaacaacaaaagaagcaaacagaacatacaccagcagaagcaagaggaaacacaagcaagagcagagggaaaaagaaa

SEQ ID NO: 356069 - DNA, 10613 bp, Homo sapiens
gcagcgccgcctgcccaggcccggaccgggctttgtccgccccggagcccctgcccgcgccgcggagaccccggagcccgcgcgctccgaggccaccccgggccgggatttccggtggggcccgcggagccgcgcagagggaggaggccccagacccaggcgccccgccagcccagctgcacgtaagcggacgctgcaggagctgaagatggcgagctccgtggcgccctacgagcagctggtgaggcaggtggaggccttgaaggctgagaacagccacctgaggcaggagctaagggacaactccagccacctgtccaagctggagacagagacgtcgggcatgaaggaggtcctgaagcacctacagggaaaactggagcaggaggcccgagtgctggtgtcctcggggcagacggaggtgctggagcagctgaaggccctacagatggacatcaccagcctgtacaacctcaagttccagccgcccaccctgggcccggagcctgccgcccggacccccgagggcagcccagtacacggctccgggccctccaaggacagctttggggagctgagccgggccaccatccggctgctggaggaactggaccgggaacggtgtttcctgctgaatgagattgagaaggaggagaaggagaagctctggtactactctcagctgcagggcctgtccaagcgcctggacgagctgccgcacgtggagacgcgttctcgatgcagatggacctgatccggcagcagcttgagttcgaggcccagcacatccgctcgctgatggaggagcgcttcggcacctcggacgagatggtgcagcgggcacagatccgcgcctcgcgcctggagcagattgacaaggagctgctggaggcgcaggaccgagtgcagcagacggagccccaggccttgctggcggtgaagtcggtgccggtggacgaggaccccgagacagaggtccccacacaccctgaggatggcacccctcagccgggcaacagcaaggtggaggtggtcttctggctgttgtccatgttggcgacgcgcgaccaggaggatacagcgcgcacgctgctggccatgtccagctcgcccgagagctgcgtggccatgcgccgctcgggctgtctgcctctgctgctgcaaatcctccacggcaccgaggccgcggccgggggtcgcgccggggccccaggggcaccgggcgccaaggacgcacgcatgcgcgccaacgcggcgctgcacaacatcgtcttctcgcagccggaccagggcctggcgcgcaaggagatgcgcgtcctgcacgtgctggagcagatccgggcctactgcgagacctgctgggactggctgcaggcccgagacggcgggcccgagggaggtggcgccggcagcgccccgatccccatcgagccgcagatctgccaggccacctgtgctgttatgaagctgtcctttgatgaggagtaccgccgtgccatgaacgagctaggtgggctgcaggccgtggcagagctgctgcaggttgactatgagatgcacaagatgacccgggacccgctgaacctggcgctgcgccgctacgcgggcatgaccctcaccaacctcacctttggggacgttgccaacaaggccaccctgtgtgcgcgccgcggctgcatggaggccatcgtggcccagctggcctccgacagtgaggagctccaccaggtggtgtccagcatccttcggaacttgtcctggagggccgacatcaacagcaagaaggtgctgagggaggcgggcagcgtgactgccctggtgcagtgtgtcctgcgggccaccaaggagtccaccctgaagagcgtgctgagcgccctgtggaatctgtctgcacacagcacagagaacaaggcggccatctgccaggtggatggcgccctgggcttcctggtgagcaccctgacctacaagtgtcagagcaactcgctggccatcatcgagagcggcggcggcatcctccgcaatgtgtccagcctcgtcgccacccgtgaggactacaggcaggtgctccgggatcacaactgtctgcagacgctgctgcagcatctgacttcgcacagcctgaccatcgtgagcaacgcgtgcggcacgctctggaacctgtcggcccgcagcgcccgtgaccaggagctgctgtgggacctgggcgccgtgggcatgctgcgtaatctggtgcactccaagcacaagatgatcgccatgggcagcgccgccgccctgcgcaacctgctggcccatcggcccgccaagcaccaggcggccgccaccgccgtgtccccaggcagctgcgtgcccagcctgtacgtgcgcaagcagcgggcgctggaggccgagctggacgcacggcacctcgcgcaggcgctggagcacctggagaagcagggcccgccggcagccgaggccgccactaagaagccgctgccgcccctgcgacacctggacggcctggcccaagactatgcttccgattcgggctgctttgacgacgacgatgcaccgtcatccctggctgcggccgcggccaccggggagccagccagccctgccgcgctgtccctcttcctgggcagccccttcctgcaggggcaggcgctggctcgcaccccgcccacccgccgaggcggcaaggaggcagagaaggacaccagtggggaggcagccgtggcggccaaggccaaggccaagctggcgcttgcagtggcgcgcatcgaccagctggtggaggacatctccgccctgcacacctcgtccgacgatagcttcagcctcagctctggagacccgggacaggaggcgccacgggagggccgcgcccagtcctgctcgccatgccgcggcccggagggcgggcggcgagaggcaggaagccgggcgcacccgctgctgcggctcaaggcggcccacgccagcctctccaacgacagcctcaacagcggcagtgccagcgacgggtactgcccacgcgaacatatgctgccctgcccgctggccgcactggcttcgcgccgcgaggaccccaggtgtgggcagcctcggcccagccggcttgaccttgacctgcccggctgccaggccgagcccccggcccgcgaggccacctccgccgacgcccgcgtgcgcaccatcaagctgtcgcctacctatcagcacgtgccactgcttgagggtgcctcaagggcgggtgcagagcccctcgcggggcctggaatctctccaggggcccggaagcaggcctggctgccggcagaccacctgagcaaggttcccgagaagctggcggctgccccgctgtctgtggccagcaaggcactgcagaaactggcggcgcaagaggggccactctcgctgtcccgatgcagctccctttcctcgctgtcctcggccggccgcccaggccccagcgagggtggtgacctggatgacagtgactcctccctggaggggctggaggaggccggccccagcgaggctgagctggacagcacgtggcgggcgcccggggccacctcgctgcccgtagccattccggctccccggcgtaaccgaggccggggcctgggggtggaagacgccacgccgtccagctcgtcggagaactacgtgcaggagacaccgcttgtgctgagccgctgcagctctgtgagctcgctgggcagcttcgagagcccgtccatcgccagctccatccccagtgaaccttgcagcgggcagggcagcggcaccatcagccctagcgagctgcccgacagccccggacagaccatgcctcccagccggagcaagacgccaccgctggcgcccgcgccacagggtccccccgaggccacccagttcagcctgcagtgggagagctacgtgaagcgcttcctggacatcgccgactgccgggagcgctgccggctgccatctgagctggacgcaggcagcgtgcgctttaccgtggagaagccagacgagaacttctcgtgcgcctccagcctcagcgcgctggccttgcacgagcactacgtgcagcaggacgtggagctgcggctgctgccctcggcctgccccgagcgcggcgggggcgccgggggcgccggcctccactttgcagggcaccggcggcgggaggaggggccggcgcccacgggttctcgccctcgcggcgccgcggaccaggagctggaactgctgcgggagtgcctgggagccgccgtgcctgcccggctgcgcaaggtggcctccgcgctggtgccaggtcgccgcgcactccccgtgcccgtctacatgttggtgcccgccccggccccggcccaggaggacgactcctgcactgactccgcggagggcacgccggtcaacttctctagcgccgcctcgctcagcgacgagacgctgcagggaccccccagggaccagcccgggggaccagcgggcaggcaaagacccaccggccgccccacctctgccagacaggccatggggcaccggcacaaggcgggaggcgccggccgcagcgcggagcagtctcggggcgcgggcaagaaccgagcagggctggagctgcccctgggccggcccccgagcgcccccgcagacaaggacggctcaaagcccggccggacccgcggggacggggcgctccagtcgctgtgcctcacgacgcccactgaggaggccgtgtactgcttctacggcaacgactcggacgaggagcccccggcggccgcgcccacgccaacccaccggcgcacatcggccatccctcgcgcttttacgcgggagcgtccgcagggccggaaggaggcccctgccccgtccaaggctgcaccagctgccccgccgcccgcccggacccagcccagcctcattgctgacgagaccccgccctgctactccctgagctcctccgccagctccctcagcgagcccgagccctcggagccgccggccgtccatccacgaggccgggagcccgcggtcaccaaggacccgggcccaggaggcggacgcgacagctcgcccagcccgcgggccgcggaggagcttctgcagcggtgcatcagctcggccctgcccaggcgccggccccccgtgtctggcctgcggcgccgcaagccccgagccacccggctggatgagcggcccgcagaggggtcccgggaacgcggcgaggaggcagcgggctcggaccgggcctccgacctggatagcgtggagtggcgcgccatccaggagggcgccaattcaattgtcacgtggctgcaccaggcagcagctgccacgcgggaggcctcgtccgagtccgactccatcctgtccttcgtatccgggctgtcagtgggatccaccctacagccccccaagcacaggaagggacgacaggcggagggagaaatgggcagtgcccggcggccagagaaaaggggcgcagcctcagtcaagaccagcgggagcccccgttcccctgcaggccccgagaagccacgtggcacacagaagaccacgcccggggtgccagctgtgctccggggacgaacagtgatctacgtccccagcccggcaccccgtgcccagcccaaagggacccccggcccccgcgccacaccgcggaaggtggcgcccccttgcctggcacagcccgcggctccagccaaagtcccgagccccgggcagcagcggtcgcggagcctacaccggcctgccaagacctcggagctggcgacgctgagccagccccccagaagcgccacaccgcccgcccgcctcgccaagaccccctcctccagctcctcccagacctcgcccgcctcccagcccctgcccagaaagcgccccccggtcacccaggctgctggggccctgcccggccccggagcctccccggtgcccaaaacgccggcgcgcacccttctggcgaagcagcacaagacgcagagatcgcccgtgcggatcccgttcatgcagaggccggcccggcgtgggccgccaccgctggctcgggcagtcccggagccgggccccaggggccgggcggggaccgaggcgggcccgggggcgcgcgggggccgcctgggcctggtgcgtgtggcctcagccctctccagcggcagcgagtcctccgaccgctcgggcttccggcgacagctaaccttcatcaaggagtcgccgggcttgcggcgccgccgctccgagctgtcctcggccgagtccgcggcctctgccccccagggcgcctcgccccgccgcggccggcccgcgctgcccgccgtcttcctctgctcctcgcgctgcgaagagctccgagcggcaccccggcagggcccggccccggcccggcagcggccccccgcggcccgacccagccctggcgagcgccctgcccggcgcaccacctccgagagcccgtcccgcctgcctgtgcgcgcgcccgccgcccggccggagactgtcaagcgctacgcgtcgctgccgcacatcagcgtggcccgcaggcccgacggcgccgtccccgcggcccctgcctcagccgacgccgcgcgccgcagcagcgacggggagccccggccgctccccagggtggccgcgccgggcacgacctggcggcgcatccgagatgaggacgtgccccacatcctgcgcagcacgcttcccgccacggccctgccactgcggggctccacgcccgaggacgccccggccgggcccccgccgcgcaagaccagcgacgccgtggtccagaccgaggaggtcgccgcccccaagaccaactccagcacgtccccgagcctggagaccagggagccccccggggcccccgccggcggccagctctccctcctcggcagcgacgtggacggtcccagcctcgccaaggctcccatctccgcacccttcgtgcacgagggcctgggggtcgccgtggggggcttccccgccagccggcacggctcccccagccgctcggcccgagtaccccccttcaactatgtgcccagccccatggtggtcgcagccaccaccgactcggccgcggagaaagccccggccactgcctccgccaccctcctggaatagtggcctaggccggccttctggaacgttctctcccggccctgcggcgcggtctggctgccccatgggcctgcgctgtagacgtcccccataggtcgccccagggcctctgcccacccgagccccaccactctcagaacccccgcccagcgcacggcgacctcgcgcctcaccggaagaccttgcctctgtgccgcggaggtccaggaggaaacggggcggccgctaggcctcaagtcccgaccgtggagcgctggcaagggcgtcctggcccagccctgagcgcgcggcccttcccctgtcggaagccgttgcttgaccccgggcgagggaggcggtagcctccgggtccgggtctgggtctgggtccgctgcttcgcagggacagcgctggggaggtgacggcgcccgccgcaggtggggcgaggctgggggagggcggcgccgcggcgggcctgccagctgggggcctttgcggcgcgcaggggcgaagcctgtaatcactgcagccgccggtaattcgctaatgagggctttgcagggattgttttcattctcagccccagctgtgggagtgcgggtgggggtgtggccgagccccggcaggaagccccgcccagacggtgttcagggaacccggagcccaagcgctccggcggagcccaaaagggtgggggtgggaggggcagaggccaacggatccccctgcctgtcgcaccccttggcgggagacgggaaggcagcgggctgcgtacgatgggaccctggtgcagacgccgggccggctgacatttggaccccatcccagaggagatgctggctaccagctggggcgaccccaagggtcgctggagtcagtatcggcccggcgcagccgcggcgggcgaggccaatggaaaggagactgaggggagtcccggcagtgagcccgaggccctgggacctggagcccgcgctggcctctccccagcggagcctgcacgttacggagaccatcacatgtgggcgtggtcagtgcccaggaccgcaccgctgctcatcttgtcccttttcaattcccttctggttcatgatgcataaagcgctaggccctagaactccagaaacagcacagctggggcggggacccagccttgccctccacccgaggctctgggacaaggcgggaggttcgggggccttccggcaggtgaacgcagggctggagagtatttggtgccagatgaggtgaaagcttatagaagggcctgaggggctcggctgcctcatcccctggcgggggaggctgggagctgggcctcctgcgtggggtgggactcgcaggggccgggtctccgtgactggggcaacgcctcgtcctgcagagggagccgacgacctcttttctgcagaaaagctccagcaggcgctgccttcacccacggatctgcccaggctgaaggcacacgctcaatgccccacgtgccttctccaggaggaacgaagcagggtttgagggttgggtggatggagctcagaaggaaaccccagccccaccacggatgacaccatccctcccgtcccatccccagcatgggcaaggccagcctttctggcagaaggagctgtcctcaactcagggccgctgtgagcaaagctgaccccagcccccacccccagttaacactgctgcttctctgaatgcatgtcacgctgcaccccatgctccgggcccacaccctgcaggacaaggagctccagacaggacgtccataagtcaccgaggtgtgccacccagcaggtgctggaggtgcccaatgctccctcctaggacctcgcagccaggcaaggctgtcaggttgttttgggggaagagggggtcatggatggctgagcagagagcggggaaaatgcaggctgagtggggcgacctcctgcctgccaggagccccctttcaggacacagcgggggtctcacacttgctgtccccatccatggcccgagggggaacctggtggtctcttctgagcttttggacttggggatgccaaacacgtgctcaccctcacactcgccccggcccgctgcgcccctaattgccaaagggtagggaaatggcgaagccagccaccaggtcgctggtgacagggccagggttatgcaggaaggtggtgcggcattgccttccacatatgtaagtctctgggcggcgccctcccagctccctgcctctgtttccccatgtgggccgtggggaactcccagagctacctcttgggggagcgtggtggcagcgatgatggggagacgcctggaagctcacagaacttgggtctggctggctcctgcccgtgacgccttgcccagcagcaaggtgcgcaacatggctgccagccccgcctcccacccccaccccgagtcctgagctcactttcgccttctccatcccctgccgtgggggccacagccacacctcaccgcccagtccagctgtctccagaaggggacaggcagtccgcggtctctggacaatcaactcaaggtacgcccactgcaaggcctccctcccaccgcggcccctgcctggccacctggcctctctgcaccagggtgacaaggggtcctcgtctgccccccaatgctccagggccagtcctaaggagctgagggtctgaggacgcagggagggtggaggtgtcctgaggctgatggacagtgaccgccactggcccccaacatgaccacacgtgggtgctgaactcggggcgccgtgcccaccggcatggtcctcccgagctccgacagcattacctcacccggccccatctgttgccccggtccagccctgatggcgcgcgcctggtctgtctgattcccctagccgccaccccacgtttctgtaccgggtctctgcagtgttaaacggacgtgtaaatagtggtaaatagtgaaagcctgtccttccctaaatgtaaagccatctgtccggcgtaaggacgacaccgtcagctgtccgactcgcacacatttaataaactgagctcttgcattgaaaaaaaaaaaaaaaaaaacaaaaaaaacacaaaaacaaaaaaagaaaaacaaaatacacagagagacacaaacacaaacaataaaacaaacaaaaaaaaaaccaggagggagcggcaggaaagacaacaaaacacgccaggagaagagaaaaaacaaaagaaagacgaaaaagaagaaggagaacaaagacaagaaacgcaccacacaaaaaagaaagaacactaaacacaaagaaaacaagaacagacgaagaacaggagagaaaaaaaaagagcagagcagagggaaagagaaacaacaaagacactcaggaacgaacggagagaaaccacggggaggagagaagacacgaagacaaaaacaccaggagccgggggaggacagaaaacaacaaaagaagcaaacagaacatacaccagcagaagcaagaggaaacacaagcaagagcagagggaaaaagaaa

SEQ ID NO: 356070 - DNA, 9738 bp, Homo sapiens
cgggcacattggtgcacaggcggttttgggcgcggcgttgttatagtgtcggcgctttcccccgtgttccgtggtggccattgtttaccctgctctcgttgtgtagtgtctgtcgcgtgggccgccctgccgtctgtcgttattgagctagttttggcattacgccgtgggcgatggttgcccgcgagtctcccggcctcgccctgtttgtggttccgctaactcggggtttggtgtttttttttctggacaacagagcgagaccctgtctcgtcagttttatttttaaaaagggcagaagcacagctgaaaggtgtggtgctccaggaactacctcgcctcccttcccaaggctgagtgagagaggccaccccatcatcccatcttagagaggctgggaaaggaagtcccaactttgcagccatttgcaaagctcccgggatccttcaggcctggggcgggcgggttgcgggaccttcgggagtcacctgggacatttcctgggaatgggggctctgatctggtccctgtgcccacagccccgatccccatcgagccgcagatctgccaggccacctgtgctgttatgaagctgtcctttgatgaggagtaccgccgtgccatgaacgagctaggtgggctgcaggccgtggcagagctgctgcaggttgactatgagatgcacaagatgacccgggacccgctgaacctggcgctgcgccgctacgcgggcatgaccctcaccaacctcacctttggggacgttgccaacaaggccaccctgtgtgcgcgccgcggctgcatggaggccatcgtggcccagctggcctccgacagtgaggagctccaccaggtggtgtccagcatccttcggaacttgtcctggagggccgacatcaacagcaagaaggtgctgagggaggcgggcagcgtgactgccctggtgcagtgtgtcctgcgggccaccaaggagtccaccctgaagagcgtgctgagcgccctgtggaatctgtctgcacacagcacagagaacaaggcggccatctgccaggtggatggcgccctgggcttcctggtgagcaccctgacctacaagtgtcagagcaactcgctggccatcatcgagagcggcggcggcatcctccgcaatgtgtccagcctcgtcgccacccgtgaggactacaggcaggtgctccgggatcacaactgtctgcagacgctgctgcagcatctgacttcgcacagcctgaccatcgtgagcaacgcgtgcggcacgctctggaacctgtcggcccgcagcgcccgtgaccaggagctgctgtgggacctgggcgccgtgggcatgctgcgtaatctggtgcactccaagcacaagatgatcgccatgggcagcgccgccgccctgcgcaacctgctggcccatcggcccgccaagcaccaggcggccgccaccgccgtgtccccaggcagctgcgtgcccagcctgtacgtgcgcaagcagcgggcgctggaggccgagctggacgcacggcacctcgcgcaggcgctggagcacctggagaagcagggcccgccggcagccgaggccgccactaagaagccgctgccgcccctgcgacacctggacggcctggcccaagactatgcttccgattcgggctgctttgacgacgacgatgcaccgtcatccctggctgcggccgcggccaccggggagccagccagccctgccgcgctgtccctcttcctgggcagccccttcctgcaggggcaggcgctggctcgcaccccgcccacccgccgaggcggcaaggaggcagagaaggacaccagtggggaggcagccgtggcggccaaggccaaggccaagctggcgcttgcagtggcgcgcatcgaccagctggtggaggacatctccgccctgcacacctcgtccgacgatagcttcagcctcagctctggagacccgggacaggaggcgccacgggagggccgcgcccagtcctgctcgccatgccgcggcccggagggcgggcggcgagaggcaggaagccgggcgcacccgctgctgcggctcaaggcggcccacgccagcctctccaacgacagcctcaacagcggcagtgccagcgacgggtactgcccacgcgaacatatgctgccctgcccgctggccgcactggcttcgcgccgcgaggaccccaggtgtgggcagcctcggcccagccggcttgaccttgacctgcccggctgccaggccgagcccccggcccgcgaggccacctccgccgacgcccgcgtgcgcaccatcaagctgtcgcctacctatcagcacgtgccactgcttgagggtgcctcaagggcgggtgcagagcccctcgcggggcctggaatctctccaggggcccggaagcaggcctggctgccggcagaccacctgagcaaggttcccgagaagctggcggctgccccgctgtctgtggccagcaaggcactgcagaaactggcggcgcaagaggggccactctcgctgtcccgatgcagctccctttcctcgctgtcctcggccggccgcccaggccccagcgagggtggtgacctggatgacagtgactcctccctggaggggctggaggaggccggccccagcgaggctgagctggacagcacgtggcgggcgcccggggccacctcgctgcccgtagccattccggctccccggcgtaaccgaggccggggcctgggggtggaagacgccacgccgtccagctcgtcggagaactacgtgcaggagacaccgcttgtgctgagccgctgcagctctgtgagctcgctgggcagcttcgagagcccgtccatcgccagctccatccccagtgaaccttgcagcgggcagggcagcggcaccatcagccctagcgagctgcccgacagccccggacagaccatgcctcccagccggagcaagacgccaccgctggcgcccgcgccacagggtccccccgaggccacccagttcagcctgcagtgggagagctacgtgaagcgcttcctggacatcgccgactgccgggagcgctgccggctgccatctgagctggacgcaggcagcgtgcgctttaccgtggagaagccagacgagaacttctcgtgcgcctccagcctcagcgcgctggccttgcacgagcactacgtgcagcaggacgtggagctgcggctgctgccctcggcctgccccgagcgcggcgggggcgccgggggcgccggcctccactttgcagggcaccggcggcgggaggaggggccggcgcccacgggttctcgccctcgcggcgccgcggaccaggagctggaactgctgcgggagtgcctgggagccgccgtgcctgcccggctgcgcaaggtggcctccgcgctggtgccaggtcgccgcgcactccccgtgcccgtctacatgttggtgcccgccccggccccggcccaggaggacgactcctgcactgactccgcggagggcacgccggtcaacttctctagcgccgcctcgctcagcgacgagacgctgcagggaccccccagggaccagcccgggggaccagcgggcaggcaaagacccaccggccgccccacctctgccagacaggccatggggcaccggcacaaggcgggaggcgccggccgcagcgcggagcagtctcggggcgcgggcaagaaccgagcagggctggagctgcccctgggccggcccccgagcgcccccgcagacaaggacggctcaaagcccggccggacccgcggggacggggcgctccagtcgctgtgcctcacgacgcccactgaggaggccgtgtactgcttctacggcaacgactcggacgaggagcccccggcggccgcgcccacgccaacccaccggcgcacatcggccatccctcgcgcttttacgcgggagcgtccgcagggccggaaggaggcccctgccccgtccaaggctgcaccagctgccccgccgcccgcccggacccagcccagcctcattgctgacgagaccccgccctgctactccctgagctcctccgccagctccctcagcgagcccgagccctcggagccgccggccgtccatccacgaggccgggagcccgcggtcaccaaggacccgggcccaggaggcggacgcgacagctcgcccagcccgcgggccgcggaggagcttctgcagcggtgcatcagctcggccctgcccaggcgccggccccccgtgtctggcctgcggcgccgcaagccccgagccacccggctggatgagcggcccgcagaggggtcccgggaacgcggcgaggaggcagcgggctcggaccgggcctccgacctggatagcgtggagtggcgcgccatccaggagggcgccaattcaattgtcacgtggctgcaccaggcagcagctgccacgcgggaggcctcgtccgagtccgactccatcctgtccttcgtatccgggctgtcagtgggatccaccctacagccccccaagcacaggaagggacgacaggcggagggagaaatgggcagtgcccggcggccagagaaaaggggcgcagcctcagtcaagaccagcgggagcccccgttcccctgcaggccccgagaagccacgtggcacacagaagaccacgcccggggtgccagctgtgctccggggacgaacagtgatctacgtccccagcccggcaccccgtgcccagcccaaagggacccccggcccccgcgccacaccgcggaaggtggcgcccccttgcctggcacagcccgcggctccagccaaagtcccgagccccgggcagcagcggtcgcggagcctacaccggcctgccaagacctcggagctggcgacgctgagccagccccccagaagcgccacaccgcccgcccgcctcgccaagaccccctcctccagctcctcccagacctcgcccgcctcccagcccctgcccagaaagcgccccccggtcacccaggctgctggggccctgcccggccccggagcctccccggtgcccaaaacgccggcgcgcacccttctggcgaagcagcacaagacgcagagatcgcccgtgcggatcccgttcatgcagaggccggcccggcgtgggccgccaccgctggctcgggcagtcccggagccgggccccaggggccgggcggggaccgaggcgggcccgggggcgcgcgggggccgcctgggcctggtgcgtgtggcctcagccctctccagcggcagcgagtcctccgaccgctcgggcttccggcgacagctaaccttcatcaaggagtcgccgggcttgcggcgccgccgctccgagctgtcctcggccgagtccgcggcctctgccccccagggcgcctcgccccgccgcggccggcccgcgctgcccgccgtcttcctctgctcctcgcgctgcgaagagctccgagcggcaccccggcagggcccggccccggcccggcagcggccccccgcggcccgacccagccctggcgagcgccctgcccggcgcaccacctccgagagcccgtcccgcctgcctgtgcgcgcgcccgccgcccggccggagactgtcaagcgctacgcgtcgctgccgcacatcagcgtggcccgcaggcccgacggcgccgtccccgcggcccctgcctcagccgacgccgcgcgccgcagcagcgacggggagccccggccgctccccagggtggccgcgccgggcacgacctggcggcgcatccgagatgaggacgtgccccacatcctgcgcagcacgcttcccgccacggccctgccactgcggggctccacgcccgaggacgccccggccgggcccccgccgcgcaagaccagcgacgccgtggtccagaccgaggaggtcgccgcccccaagaccaactccagcacgtccccgagcctggagaccagggagccccccggggcccccgccggcggccagctctccctcctcggcagcgacgtggacggtcccagcctcgccaaggctcccatctccgcacccttcgtgcacgagggcctgggggtcgccgtggggggcttccccgccagccggcacggctcccccagccgctcggcccgagtaccccccttcaactatgtgcccagccccatggtggtcgcagccaccaccgactcggccgcggagaaagccccggccactgcctccgccaccctcctggaatagtggcctaggccggccttctggaacgttctctcccggccctgcggcgcggtctggctgccccatgggcctgcgctgtagacgtcccccataggtcgccccagggcctctgcccacccgagccccaccactctcagaacccccgcccagcgcacggcgacctcgcgcctcaccggaagaccttgcctctgtgccgcggaggtccaggaggaaacggggcggccgctaggcctcaagtcccgaccgtggagcgctggcaagggcgtcctggcccagccctgagcgcgcggcccttcccctgtcggaagccgttgcttgaccccgggcgagggaggcggtagcctccgggtccgggtctgggtctgggtccgctgcttcgcagggacagcgctggggaggtgacggcgcccgccgcaggtggggcgaggctgggggagggcggcgccgcggcgggcctgccagctgggggcctttgcggcgcgcaggggcgaagcctgtaatcactgcagccgccggtaattcgctaatgagggctttgcagggattgttttcattctcagccccagctgtgggagtgcgggtgggggtgtggccgagccccggcaggaagccccgcccagacggtgttcagggaacccggagcccaagcgctccggcggagcccaaaagggtgggggtgggaggggcagaggccaacggatccccctgcctgtcgcaccccttggcgggagacgggaaggcagcgggctgcgtacgatgggaccctggtgcagacgccgggccggctgacatttggaccccatcccagaggagatgctggctaccagctggggcgaccccaagggtcgctggagtcagtatcggcccggcgcagccgcggcgggcgaggccaatggaaaggagactgaggggagtcccggcagtgagcccgaggccctgggacctggagcccgcgctggcctctccccagcggagcctgcacgttacggagaccatcacatgtgggcgtggtcagtgcccaggaccgcaccgctgctcatcttgtcccttttcaattcccttctggttcatgatgcataaagcgctaggccctagaactccagaaacagcacagctggggcggggacccagccttgccctccacccgaggctctgggacaaggcgggaggttcgggggccttccggcaggtgaacgcagggctggagagtatttggtgccagatgaggtgaaagcttatagaagggcctgaggggctcggctgcctcatcccctggcgggggaggctgggagctgggcctcctgcgtggggtgggactcgcaggggccgggtctccgtgactggggcaacgcctcgtcctgcagagggagccgacgacctcttttctgcagaaaagctccagcaggcgctgccttcacccacggatctgcccaggctgaaggcacacgctcaatgccccacgtgccttctccaggaggaacgaagcagggtttgagggttgggtggatggagctcagaaggaaaccccagccccaccacggatgacaccatccctcccgtcccatccccagcatgggcaaggccagcctttctggcagaaggagctgtcctcaactcagggccgctgtgagcaaagctgaccccagcccccacccccagttaacactgctgcttctctgaatgcatgtcacgctgcaccccatgctccgggcccacaccctgcaggacaaggagctccagacaggacgtccataagtcaccgaggtgtgccacccagcaggtgctggaggtgcccaatgctccctcctaggacctcgcagccaggcaaggctgtcaggttgttttgggggaagagggggtcatggatggctgagcagagagcggggaaaatgcaggctgagtggggcgacctcctgcctgccaggagccccctttcaggacacagcgggggtctcacacttgctgtccccatccatggcccgagggggaacctggtggtctcttctgagcttttggacttggggatgccaaacacgtgctcaccctcacactcgccccggcccgctgcgcccctaattgccaaagggtagggaaatggcgaagccagccaccaggtcgctggtgacagggccagggttatgcaggaaggtggtgcggcattgccttccacatatgtaagtctctgggcggcgccctcccagctccctgcctctgtttccccatgtgggccgtggggaactcccagagctacctcttgggggagcgtggtggcagcgatgatggggagacgcctggaagctcacagaacttgggtctggctggctcctgcccgtgacgccttgcccagcagcaaggtgcgcaacatggctgccagccccgcctcccacccccaccccgagtcctgagctcactttcgccttctccatcccctgccgtgggggccacagccacacctcaccgcccagtccagctgtctccagaaggggacaggcagtccgcggtctctggacaatcaactcaaggtacgcccactgcaaggcctccctcccaccgcggcccctgcctggccacctggcctctctgcaccagggtgacaaggggtcctcgtctgccccccaatgctccagggccagtcctaaggagctgagggtctgaggacgcagggagggtggaggtgtcctgaggctgatggacagtgaccgccactggcccccaacatgaccacacgtgggtgctgaactcggggcgccgtgcccaccggcatggtcctcccgagctccgacagcattacctcacccggccccatctgttgccccggtccagccctgatggcgcgcgcctggtctgtctgattcccctagccgccaccccacgtttctgtaccgggtctctgcagtgttaaacggacgtgtaaatagtggtaaatagtgaaagcctgtccttccctaaatgtaaagccatctgtccggcgtaaggacgacaccgtcagctgtccgactcgcacacatttaataaactgagctcttgcattgaaaaaaaaaaaaaaaaaaacaaaaaaaacacaaaaacaaaaaaagaaaaacaaaatacacagagagacacaaacacaaacaataaaacaaacaaaaaaaaaaccaggagggagcggcaggaaagacaacaaaacacgccaggagaagagaaaaaacaaaagaaagacgaaaaagaagaaggagaacaaagacaagaaacgcaccacacaaaaaagaaagaacactaaacacaaagaaaacaagaacagacgaagaacaggagagaaaaaaaaagagcagagcagagggaaagagaaacaacaaagacactcaggaacgaacggagagaaaccacggggaggagagaagacacgaagacaaaaacaccaggagccgggggaggacagaaaacaacaaaagaagcaaacagaacatacaccagcagaagcaagaggaaacacaagcaagagcagagggaaaaagaaa

SEQ ID NO: 356071 - DNA, 9687 bp, Homo sapiens
tgagaacagtcacatttgcctctgttgtctttgaagagggagaaaagtgttttggtgacaagtcctcctctccctctgactcacaggcgccatctccccgttgatttcccccttttgtaatggggaagcggggcgagtgaagagggtgggtgtggccgtcacccatccctacagccctgtctgtgctggggatgctgctctccatctgatggtcttggggtgtattattagaggactcagggggccttccccgaggcacctatcaaacagggcagggaagaacattccaggctgagggaacaacaggtgcagaggcccagtggctggaggaagcgtgagccaggaccgagggctgacaggaggcgggggtggcagtcacagggcactgggggtacccctgtgggtctggcagcagggtgaggccataccggctcctggaggaggtctcagacttgggcctggaaggggaacttgagggcaggtctggggcatagggagggcctctgggcaagggagtgaggtggggcgctgggcagcaggcagggtcatccctgccacccaccaaccttgttgggtcctcacaggtgggctgcaggccgtggcagagctgctgcaggttgactatgagatgcacaagatgacccgggacccgctgaacctggcgctgcgccgctacgcgggcatgaccctcaccaacctcacctttggggacgttgccaacaaggccaccctgtgtgcgcgccgcggctgcatggaggccatcgtggcccagctggcctccgacagtgaggagctccaccaggtggtgtccagcatccttcggaacttgtcctggagggccgacatcaacagcaagaaggtgctgagggaggcgggcagcgtgactgccctggtgcagtgtgtcctgcgggccaccaaggagtccaccctgaagagcgtgctgagcgccctgtggaatctgtctgcacacagcacagagaacaaggcggccatctgccaggtggatggcgccctgggcttcctggtgagcaccctgacctacaagtgtcagagcaactcgctggccatcatcgagagcggcggcggcatcctccgcaatgtgtccagcctcgtcgccacccgtgaggactacaggcaggtgctccgggatcacaactgtctgcagacgctgctgcagcatctgacttcgcacagcctgaccatcgtgagcaacgcgtgcggcacgctctggaacctgtcggcccgcagcgcccgtgaccaggagctgctgtgggacctgggcgccgtgggcatgctgcgtaatctggtgcactccaagcacaagatgatcgccatgggcagcgccgccgccctgcgcaacctgctggcccatcggcccgccaagcaccaggcggccgccaccgccgtgtccccaggcagctgcgtgcccagcctgtacgtgcgcaagcagcgggcgctggaggccgagctggacgcacggcacctcgcgcaggcgctggagcacctggagaagcagggcccgccggcagccgaggccgccactaagaagccgctgccgcccctgcgacacctggacggcctggcccaagactatgcttccgattcgggctgctttgacgacgacgatgcaccgtcatccctggctgcggccgcggccaccggggagccagccagccctgccgcgctgtccctcttcctgggcagccccttcctgcaggggcaggcgctggctcgcaccccgcccacccgccgaggcggcaaggaggcagagaaggacaccagtggggaggcagccgtggcggccaaggccaaggccaagctggcgcttgcagtggcgcgcatcgaccagctggtggaggacatctccgccctgcacacctcgtccgacgatagcttcagcctcagctctggagacccgggacaggaggcgccacgggagggccgcgcccagtcctgctcgccatgccgcggcccggagggcgggcggcgagaggcaggaagccgggcgcacccgctgctgcggctcaaggcggcccacgccagcctctccaacgacagcctcaacagcggcagtgccagcgacgggtactgcccacgcgaacatatgctgccctgcccgctggccgcactggcttcgcgccgcgaggaccccaggtgtgggcagcctcggcccagccggcttgaccttgacctgcccggctgccaggccgagcccccggcccgcgaggccacctccgccgacgcccgcgtgcgcaccatcaagctgtcgcctacctatcagcacgtgccactgcttgagggtgcctcaagggcgggtgcagagcccctcgcggggcctggaatctctccaggggcccggaagcaggcctggctgccggcagaccacctgagcaaggttcccgagaagctggcggctgccccgctgtctgtggccagcaaggcactgcagaaactggcggcgcaagaggggccactctcgctgtcccgatgcagctccctttcctcgctgtcctcggccggccgcccaggccccagcgagggtggtgacctggatgacagtgactcctccctggaggggctggaggaggccggccccagcgaggctgagctggacagcacgtggcgggcgcccggggccacctcgctgcccgtagccattccggctccccggcgtaaccgaggccggggcctgggggtggaagacgccacgccgtccagctcgtcggagaactacgtgcaggagacaccgcttgtgctgagccgctgcagctctgtgagctcgctgggcagcttcgagagcccgtccatcgccagctccatccccagtgaaccttgcagcgggcagggcagcggcaccatcagccctagcgagctgcccgacagccccggacagaccatgcctcccagccggagcaagacgccaccgctggcgcccgcgccacagggtccccccgaggccacccagttcagcctgcagtgggagagctacgtgaagcgcttcctggacatcgccgactgccgggagcgctgccggctgccatctgagctggacgcaggcagcgtgcgctttaccgtggagaagccagacgagaacttctcgtgcgcctccagcctcagcgcgctggccttgcacgagcactacgtgcagcaggacgtggagctgcggctgctgccctcggcctgccccgagcgcggcgggggcgccgggggcgccggcctccactttgcagggcaccggcggcgggaggaggggccggcgcccacgggttctcgccctcgcggcgccgcggaccaggagctggaactgctgcgggagtgcctgggagccgccgtgcctgcccggctgcgcaaggtggcctccgcgctggtgccaggtcgccgcgcactccccgtgcccgtctacatgttggtgcccgccccggccccggcccaggaggacgactcctgcactgactccgcggagggcacgccggtcaacttctctagcgccgcctcgctcagcgacgagacgctgcagggaccccccagggaccagcccgggggaccagcgggcaggcaaagacccaccggccgccccacctctgccagacaggccatggggcaccggcacaaggcgggaggcgccggccgcagcgcggagcagtctcggggcgcgggcaagaaccgagcagggctggagctgcccctgggccggcccccgagcgcccccgcagacaaggacggctcaaagcccggccggacccgcggggacggggcgctccagtcgctgtgcctcacgacgcccactgaggaggccgtgtactgcttctacggcaacgactcggacgaggagcccccggcggccgcgcccacgccaacccaccggcgcacatcggccatccctcgcgcttttacgcgggagcgtccgcagggccggaaggaggcccctgccccgtccaaggctgcaccagctgccccgccgcccgcccggacccagcccagcctcattgctgacgagaccccgccctgctactccctgagctcctccgccagctccctcagcgagcccgagccctcggagccgccggccgtccatccacgaggccgggagcccgcggtcaccaaggacccgggcccaggaggcggacgcgacagctcgcccagcccgcgggccgcggaggagcttctgcagcggtgcatcagctcggccctgcccaggcgccggccccccgtgtctggcctgcggcgccgcaagccccgagccacccggctggatgagcggcccgcagaggggtcccgggaacgcggcgaggaggcagcgggctcggaccgggcctccgacctggatagcgtggagtggcgcgccatccaggagggcgccaattcaattgtcacgtggctgcaccaggcagcagctgccacgcgggaggcctcgtccgagtccgactccatcctgtccttcgtatccgggctgtcagtgggatccaccctacagccccccaagcacaggaagggacgacaggcggagggagaaatgggcagtgcccggcggccagagaaaaggggcgcagcctcagtcaagaccagcgggagcccccgttcccctgcaggccccgagaagccacgtggcacacagaagaccacgcccggggtgccagctgtgctccggggacgaacagtgatctacgtccccagcccggcaccccgtgcccagcccaaagggacccccggcccccgcgccacaccgcggaaggtggcgcccccttgcctggcacagcccgcggctccagccaaagtcccgagccccgggcagcagcggtcgcggagcctacaccggcctgccaagacctcggagctggcgacgctgagccagccccccagaagcgccacaccgcccgcccgcctcgccaagaccccctcctccagctcctcccagacctcgcccgcctcccagcccctgcccagaaagcgccccccggtcacccaggctgctggggccctgcccggccccggagcctccccggtgcccaaaacgccggcgcgcacccttctggcgaagcagcacaagacgcagagatcgcccgtgcggatcccgttcatgcagaggccggcccggcgtgggccgccaccgctggctcgggcagtcccggagccgggccccaggggccgggcggggaccgaggcgggcccgggggcgcgcgggggccgcctgggcctggtgcgtgtggcctcagccctctccagcggcagcgagtcctccgaccgctcgggcttccggcgacagctaaccttcatcaaggagtcgccgggcttgcggcgccgccgctccgagctgtcctcggccgagtccgcggcctctgccccccagggcgcctcgccccgccgcggccggcccgcgctgcccgccgtcttcctctgctcctcgcgctgcgaagagctccgagcggcaccccggcagggcccggccccggcccggcagcggccccccgcggcccgacccagccctggcgagcgccctgcccggcgcaccacctccgagagcccgtcccgcctgcctgtgcgcgcgcccgccgcccggccggagactgtcaagcgctacgcgtcgctgccgcacatcagcgtggcccgcaggcccgacggcgccgtccccgcggcccctgcctcagccgacgccgcgcgccgcagcagcgacggggagccccggccgctccccagggtggccgcgccgggcacgacctggcggcgcatccgagatgaggacgtgccccacatcctgcgcagcacgcttcccgccacggccctgccactgcggggctccacgcccgaggacgccccggccgggcccccgccgcgcaagaccagcgacgccgtggtccagaccgaggaggtcgccgcccccaagaccaactccagcacgtccccgagcctggagaccagggagccccccggggcccccgccggcggccagctctccctcctcggcagcgacgtggacggtcccagcctcgccaaggctcccatctccgcacccttcgtgcacgagggcctgggggtcgccgtggggggcttccccgccagccggcacggctcccccagccgctcggcccgagtaccccccttcaactatgtgcccagccccatggtggtcgcagccaccaccgactcggccgcggagaaagccccggccactgcctccgccaccctcctggaatagtggcctaggccggccttctggaacgttctctcccggccctgcggcgcggtctggctgccccatgggcctgcgctgtagacgtcccccataggtcgccccagggcctctgcccacccgagccccaccactctcagaacccccgcccagcgcacggcgacctcgcgcctcaccggaagaccttgcctctgtgccgcggaggtccaggaggaaacggggcggccgctaggcctcaagtcccgaccgtggagcgctggcaagggcgtcctggcccagccctgagcgcgcggcccttcccctgtcggaagccgttgcttgaccccgggcgagggaggcggtagcctccgggtccgggtctgggtctgggtccgctgcttcgcagggacagcgctggggaggtgacggcgcccgccgcaggtggggcgaggctgggggagggcggcgccgcggcgggcctgccagctgggggcctttgcggcgcgcaggggcgaagcctgtaatcactgcagccgccggtaattcgctaatgagggctttgcagggattgttttcattctcagccccagctgtgggagtgcgggtgggggtgtggccgagccccggcaggaagccccgcccagacggtgttcagggaacccggagcccaagcgctccggcggagcccaaaagggtgggggtgggaggggcagaggccaacggatccccctgcctgtcgcaccccttggcgggagacgggaaggcagcgggctgcgtacgatgggaccctggtgcagacgccgggccggctgacatttggaccccatcccagaggagatgctggctaccagctggggcgaccccaagggtcgctggagtcagtatcggcccggcgcagccgcggcgggcgaggccaatggaaaggagactgaggggagtcccggcagtgagcccgaggccctgggacctggagcccgcgctggcctctccccagcggagcctgcacgttacggagaccatcacatgtgggcgtggtcagtgcccaggaccgcaccgctgctcatcttgtcccttttcaattcccttctggttcatgatgcataaagcgctaggccctagaactccagaaacagcacagctggggcggggacccagccttgccctccacccgaggctctgggacaaggcgggaggttcgggggccttccggcaggtgaacgcagggctggagagtatttggtgccagatgaggtgaaagcttatagaagggcctgaggggctcggctgcctcatcccctggcgggggaggctgggagctgggcctcctgcgtggggtgggactcgcaggggccgggtctccgtgactggggcaacgcctcgtcctgcagagggagccgacgacctcttttctgcagaaaagctccagcaggcgctgccttcacccacggatctgcccaggctgaaggcacacgctcaatgccccacgtgccttctccaggaggaacgaagcagggtttgagggttgggtggatggagctcagaaggaaaccccagccccaccacggatgacaccatccctcccgtcccatccccagcatgggcaaggccagcctttctggcagaaggagctgtcctcaactcagggccgctgtgagcaaagctgaccccagcccccacccccagttaacactgctgcttctctgaatgcatgtcacgctgcaccccatgctccgggcccacaccctgcaggacaaggagctccagacaggacgtccataagtcaccgaggtgtgccacccagcaggtgctggaggtgcccaatgctccctcctaggacctcgcagccaggcaaggctgtcaggttgttttgggggaagagggggtcatggatggctgagcagagagcggggaaaatgcaggctgagtggggcgacctcctgcctgccaggagccccctttcaggacacagcgggggtctcacacttgctgtccccatccatggcccgagggggaacctggtggtctcttctgagcttttggacttggggatgccaaacacgtgctcaccctcacactcgccccggcccgctgcgcccctaattgccaaagggtagggaaatggcgaagccagccaccaggtcgctggtgacagggccagggttatgcaggaaggtggtgcggcattgccttccacatatgtaagtctctgggcggcgccctcccagctccctgcctctgtttccccatgtgggccgtggggaactcccagagctacctcttgggggagcgtggtggcagcgatgatggggagacgcctggaagctcacagaacttgggtctggctggctcctgcccgtgacgccttgcccagcagcaaggtgcgcaacatggctgccagccccgcctcccacccccaccccgagtcctgagctcactttcgccttctccatcccctgccgtgggggccacagccacacctcaccgcccagtccagctgtctccagaaggggacaggcagtccgcggtctctggacaatcaactcaaggtacgcccactgcaaggcctccctcccaccgcggcccctgcctggccacctggcctctctgcaccagggtgacaaggggtcctcgtctgccccccaatgctccagggccagtcctaaggagctgagggtctgaggacgcagggagggtggaggtgtcctgaggctgatggacagtgaccgccactggcccccaacatgaccacacgtgggtgctgaactcggggcgccgtgcccaccggcatggtcctcccgagctccgacagcattacctcacccggccccatctgttgccccggtccagccctgatggcgcgcgcctggtctgtctgattcccctagccgccaccccacgtttctgtaccgggtctctgcagtgttaaacggacgtgtaaatagtggtaaatagtgaaagcctgtccttccctaaatgtaaagccatctgtccggcgtaaggacgacaccgtcagctgtccgactcgcacacatttaataaactgagctcttgcattgaaaaaaaaaaaaaaaaaaacaaaaaaaacacaaaaacaaaaaaagaaaaacaaaatacacagagagacacaaacacaaacaataaaacaaacaaaaaaaaaaccaggagggagcggcaggaaagacaacaaaacacgccaggagaagagaaaaaacaaaagaaagacgaaaaagaagaaggagaacaaagacaagaaacgcaccacacaaaaaagaaagaacactaaacacaaagaaaacaagaacagacgaagaacaggagagaaaaaaaaagagcagagcagagggaaagagaaacaacaaagacactcaggaacgaacggagagaaaccacggggaggagagaagacacgaagacaaaaacaccaggagccgggggaggacagaaaacaacaaaagaagcaaacagaacatacaccagcagaagcaagaggaaacacaagcaagagcagagggaaaaagaaa

SEQ ID NO: 356072 - DNA, 2689 bp, Homo sapiens
ccgctccttcaggcctgaatgtggcggctgcctctgcgaatggacggcgtgggaagagaatggcttctgcaaggaaagccagccgtcccatgcgtgatgtttttggtgacttcagtgatgtttccttggaagattcaacaatggaagaaatcagaaacttccagatcagtagaaatcttaccaaaatagcacctggtcatagcagatttctaaaaagaaaccaaactctagatgagaaacacttactcctgaaagagaaccctgtgctcgggagtggacccaggcttgcctcatgtagaccgcccaccactgcctccaggatccgagccaatgccgcactcatgaagctggcccagctggaaacccggatcatgaatcggaagctgcagaggaatttgtctgacacggaatctgactcaatgaccgccgatgctggtcttccaaagagagctgacagaatcctctctgggggtgcactcgaactcgcgtcccagaacacagacaaaacttcccagaatcaagcccgtgaacttcctgtcaccgaaaataatgcacagaacgcgaaggtcagtaggtttctaaagaagaaacaagcacctgttgaaaacatatcccctgaagcacctgctgggaaagagaggactttgcaaacccccaaacagaaagaacctgctagaacatttgattctccagacagtgacgaagaagaaatgaaagtattgctaggaagcttgatggactcttctagagaaaaaaacacgaatcaaggcttcagcagcgctaacgtcagcgaggaagaagaaagaaaactattttcggtcccatctcaactgagagcatttactgtacccagcgtggaactctccagcgcaaagccttctcagacatcacacctgccaacctccctggcagcagacagaacccttcacagcactcgctcaagagcagactacccacagagtcacgtttccagtgacaccgcctcccacacgccgtcagtttccatcacaggcgccttttcaaactcagtgtctttaaagatggggcatgtcaagcttgtgtcctccccgggaaggagtgaggctgagactgtggacgagccagtctcagaaggtgctgatgacagcctcgacgagtttagaataaatattttatcgcttgacggtctggctccagctgtcagtgagaactccgatttggaacaggaagaggaaagtgctcagagacaaaaaacagctggcaaaatcttcagagccgaggcgtccactgggcaggatgccccgaggcaggcccaggcgaggagctgggcatcacagggaaaggccgcctctgcagagggggatgagagcgaggtctcggagcatctcagtgccagctcggcttctgccatccagcaggacagcacttccagcatgcagccaccatctgaagcccccatggtgaacacagtcagctcagcttattcggaggattttgaaaactctccaagtctgacagcatctgagccaaccgcccattccaaggagtctcttgacagaacactggacgctttgtctgaatcctcttcaagtgtgaagacagaccttccacaaacagccgagtctaggaaaaagtcgggcaggcacgtgacaagagtgcttgtgaaggacacagctgtgcagacgccagatcctgccttcacctacgagtggaccaaggtggccagcatggcagccatggggcctgccctgggaggcgcctacgtggacccgacacccatcgccaatcatgttatcagtgcagatgcaatagaagccctgaccgcttacagcccggccgtgctggcactccatgatgtgctgaagcagcagctgagcctgacgcagcagttcatccaggccagccggcacctgcacgcctccctcctgcgctccctggacgcggactccttccactaccacaccctggaggaagccaaagagtacattaggtgccacagacctgccccactgaccatggaggatgccctggaggaggtgaacaaggagctgtgagcgccagcaggtggagcttgacgtgacgtcttaacaaaagctacaggaaatctagaacaaaatcaaatattcatcacgttgggttgaaaagttggaagattttgcatcttattgaaaagaatttttcaaaaatgtttctgtacaaatgaatggaattgcaccaggctgcccatggacaccaggtgtggccgattcccaacggtcacccaccagcttctggcaggagcagctcccctcctggcctcccctcccttcgggggtgtgaaatgaaatgatggagtggaaggcgctggctggggtcgggctccatgctctggatgggactgggccgtcgcacacgccagccggtgcagggttcttccaagtgcaaaactcaagcaggggacgcgacgggcacagactccgaggcagcgctcaacctgaagtgtcttaggctggtttcctgttagaatcttgtttcccagataacagcaaatggctacattccagaaaaaaaatatcaacttatacaactaaaataactgaactaagggccagtacgccttcgaagaattaggtttcagaatctcactgggcctcctctcaggtcagtattcttctttctagacctaaaccaaggagagtaaaaatgaaaaccctgcttcacttcgcaagtc

SEQ ID NO: 356073 - DNA, 2130 bp, Homo sapiens
ccgctccttcaggcctgaatgtggcggctgcctctgcgaatggacggcgtgggaagagaatggcttctgcaaggaaagccagccgtcccatgcgtgatgtttttggtgacttcagtgatgtttccttggaagattcaacaatggaagaaatcagaaacttccagatcagtagaaatcttaccaaaatagcacctggtcatagcagatttctaaaaagaaaccaaactctagatgagaaacacttactcctgaaagagaaccctgtgctcgggagtggacccaggcttgcctcatgtagaccgcccaccactgcctccaggatccgagccaatgccgcactcatgaagctggcccagctggaaacccggatcatgaatcggaagctgcagaggaatttgtctgacacggaatctgactcaatgaccgccgatgctggtcttccaaagagagctgacagaatcctctctgggggtgcactcgaactcgcgtcccagaacacagacaaaacttcccagaatcaagcccgtgaacttcctgtcaccgaaaataatgcacagaacgcgaaggtcagtaggtttctaaagaagaaacaagcacctgttgaaaacatatcccctgaagcacctgctgggaaagagaggactttgcaaacccccaaacagaaagaacctgctagaacatttgattctccagacagtgacgaagaagaaatgaaagtattgctaggaagcttgatggactcttctagagaaaaaaacacgaatcaaggcttcagcagcgctaacgtcagcgaggaagaagaaagaaaactattttcggtcccatctcaactgagagcatttactgtacccagcgtggaactctccagcgcaaagccttctcagacatcacacctgccaacctccctggcagcagacagaacccttcacagcactcgctcaagagcagactacccacagagtcacgtttccagtgacaccgcctcccacacgccgtcagtttccatcacaggcgccttttcaaactcagtgtctttaaagatggggcatgtcaagcttgtgtcctccccgggaaggagtgaggctgagactgtggacgagccagtctcagaaggtgctgatgacagcctcgacgagtttagaataaatattttatcgcttgacggtctggctccagctgtcagtgagaactccgatttggaacaggaagaggaaagtgctcagagacaaaaaacagctggcaaaatcttcagagccgaggcgtccactgggcaggatgccccgaggcaggcccaggcgaggagctgggcatcacagggaaaggccgcctctgcagagggggatgagagcgaggtctcggagcatctcagtgccagctcggcttctgccatccagcaggacagcacttccagcatgcagccaccatctgaagcccccatggtgaacacagtcagctcagcttattcggaggattttgaaaactctccaagtctgacagcatctgagccaaccgcccattccaaggagtctcttgacagaacactggacgctttgtctgaatcctcttcaagtgtgaagacagaccttccacaaacagccgagtctaggaaaaagtcgggcaggcacgtgacaagagtgcttgtgaaggacacagctgtgcagacgccagatcctgccttcacctacgagtggaccaaggtggccagcatggcagccatggggcctgccctgggaggcgcctacgtggacccgacacccatcgccaatcatgttatcagtgcagatgcaatagaagccctgaccgcttacagcccggccgtgctggcactccatgatgtgctgaagcagcagctgagcctgacgcagcagttcatccaggccagccggcacctgcacgcctccctcctgcgctccctggacgcggactccttccactaccacaccctggaggaagccaaagagtacattaggtgccacagacctgccccactgaccatggaggatgccctggaggaggtgaacaaggagctgtgagcgccagcaggtggagcttgacgtgacgtcttaacaaaagttacaggcatatctagtattatgtgcatagaaaagtatttttcatgaggataaaaag

SEQ ID NO: 356074 - DNA, 3362 bp, Homo sapiens
ccgctccttcaggcctgaatgtggcggctgcctctgcgaatggacggcgtgggaagagaatggcttctgcaaggaaagccagccgtcccatgcgtgatgtttttggtgacttcagtgatgtttccttggaagattcaacaatggaagaaatcagaaacttccagatcagtagaaatcttaccaaaatagcacctggtcatagcagatttctaaaaagaaaccaaactctagatgagaaacacttactcctgaaagagaaccctgtgctcgggagtggacccaggcttgcctcatgtagaccgcccaccactgcctccaggatccgagccaatgccgcactcatgaagctggcccagctggaaacccggatcatgaatcggaagctgcagaggaatttgtctgacacggaatctgactcaatgaccgccgatgctggtcttccaaagagagctgacagaatcctctctgggggtgcactcgaactcgcgtcccagaacacagacaaaacttcccagaatcaagcccgtgaacttcctgtcaccgaaaataatgcacagaacgcgaaggtcagtaggtttctaaagaagaaacaagcacctgttgaaaacatatcccctgaagcacctgctgggaaagagaggactttgcaaacccccaaacagaaagaacctgctagaacatttgattctccagacagtgacgaagaagaaatgaaagtattgctaggaagcttgatggactcttctagagaaaaaaacacgaatcaaggcttcagcagcgctaacgtcagcgaggaagaagaaagaaaactattttcggtcccatctcaactgagagcatttactgtacccagcgtggaactctccagcgcaaagccttctcagacatcacacctgccaacctccctggcagcagacagaacccttcacagcactcgctcaagagcagactacccacagagtcacgtttccagtgacaccgcctcccacacgccgtcagtttccatcacaggcgccttttcaaactcagtgtctttaaagatggggcatgtcaagcttgtgtcctccccgggaaggagtgaggctgagactgtggacgagccagtctcagaaggtgctgatgacagcctcgacgagtttagaataaatattttatcgcttgacggtctggctccagctgtcagtgagaactccgatttggaacaggaagaggaaagtgctcagagacaaaaaacagctggcaaaatcttcagagccgaggcgtccactgggcaggatgccccgaggcaggcccaggcgaggagctgggcatcacagggaaaggccgcctctgcagagggggatgagagcgaggtctcggagcatctcagtgccagctcggcttctgccatccagcaggacagcacttccagcatgcagccaccatctgaagcccccatggtgaacacagtcagctcagcttattcggaggattttgaaaactctccaagtctgacagcatctgagccaaccgcccattccaaggagtctcttgacagaacactggacgctttgtctgaatcctcttcaagtgtgaagacagaccttccacaaacagccgagtctaggaaaaagtcgggcaggcacgtgacaagagtgcttgtgaaggacacagctgtgcagacgccagatcctgccttcacctacgagtggaccaaggtggccagcatggcagccatggggcctgccctgggaggcgcctacgtggacccgacacccatcgccaatcatgttatcagtgcagatgcaatagaagccctgaccgcttacagcccggccgtgctggcactccatgatgtgctgaagcagcagctgagcctgacgcagcagttcatccaggccagccggcacctgcacgcctccctcctgcgctccctggacgcggactccttccactaccacaccctggaggaagccaaagagtacattaggtgccacagacctgccccactgaccatggaggatgccctggaggaggtgaacaaggagctgtgagcgccagcaggtggagcttgacgtgacgtcttaacaaaagcaaagcaccgcagcttcccagagttaccagcgcagcacttaagacaggatcttacggcggggtggggctcctggaccgtgaccggcgtcttcttcctggggagtacgacttggaccgggaccgcgactgggaccgggagcggcttctggaggagcgcgacctgctccgacttctgcagggaagggtgcccaagggtcagcagcagccaggcgtcgtggggaggccacaggaagaggcctcaggcactgccctgaggcagcctctgcctacctagatctggagcgggagtaggaacgggagcaggagcgcgaccttgaccttgagtacgagcctgaagacttggaggatcttgagttggagcgggaggaagaacgccctcgactcttggatctgctccgagacctcgagggtccgctgtggggagaggcctgatgatcaggtgccccagtggatgggctgcaacccagcccaccctggccctcaggttcctagaccaccccagatgcaggggctctggctgtggatgtggcgccatagccacagcaacggtaccaagttcctaaatagtgtggccgagcctgctgctgtgtgaattcaggccttgtggaaaacaccgccccataggcacaggctgtgtgagggtggacgtgatgagtgtatctggggtctgctcccacccatcacaagctgtggaccctggccccccggccactgcagacatctgcgcttttacctgttcctcttctcctggcctttcctccgccgggcccgcatttttgctcggaagaactcatagaggccgttctgctcccagccttcactgtaagacacggcattccgtgtgtgaccacgtgacacccacccacaaggaagtcgtgaaaaagtcatcaggagttaatccacagaaccttggagagtacatggccctgtggctgtgggctccgagcatgggcgcagtagagcttggttcagtgttcccacagggctgtcctcctgcagcccagtggctcctctggtgcccacgcccttgccaccctgctgttccgctgaggtggtggggacccatggtctgtggaactgggaaacaggaacactgactcatgggtggacaggcctgcagcccagcacaggaaggaggggtgaccactgggaagggtgggctgagggccctgtggcagccggctgcttgagacgtgccgccgtgccacaccttccctaacttcttctgatgtgtctccattaaaacgcccttcattgagggccacgtgtgtgctgtgaaaaaacacaca

SEQ ID NO: 356075 - DNA, 2593 bp, Homo sapiens
ccgctccttcaggcctgaatgtggcggctgcctctgcgaatggacggcgtgggaagagaatggcttctgcaaggaaagccagccgtcccatgcgtgatgtttttggtgacttcagtgatgtttccttggaagattcaacaatggaagaaatcagaaacttccagatcagtagaaatcttaccaaaatagcacctggtcatagcagatttctaaaaagaaaccaaactctagatgagaaacacttactcctgaaagagaaccctgtgctcgggagtggacccaggcttgcctcatgtagaccgcccaccactgcctccaggatccgagccaatgccgcactcatgaagctggcccagctggaaacccggatcatgaatcggaagctgcagaggaatttgtctgacacggaatctgactcaatgaccgccgatgctggtcttccaaagagagctgacagaatcctctctgggggtgcactcgaactcgcgtcccagaacacagacaaaacttcccagaatcaagcccgtgaacttcctgtcaccgaaaataatgcacagaacgcgaaggtcagtaggtttctaaagaagaaacaagcacctgttgaaaacatatcccctgaagcacctgctgggaaagagaggactttgcaaacccccaaacagaaagaacctgctagaacatttgattctccagacagtgacgaagaagaaatgaaagtattgctaggaagcttgatggactcttctagagaaaaaaacacgaatcaaggcttcagcagcgctaacgtcagcgaggaagaagaaagaaaactattttcggtcccatctcaactgagagcatttactgtacccagcgtggaactctccagcgcaaagccttctcagacatcacacctgccaacctccctggcagcagacagaacccttcacagcactcgctcaagagcagactacccacagagtcacgtttccagtgacaccgcctcccacacgccgtcagtttccatcacaggcgccttttcaaactcagtgtctttaaagatggggcatgtcaagcttgtgtcctccccgggaaggagtgaggctgagactgtggacgagccagtctcagaaggtgctgatgacagcctcgacgagtttagaataaatattttatcgcttgacggtctggctccagctgtcagtgagaactccgatttggaacaggaagaggaaagtgctcagagacaaaaaacagctggcaaaatcttcagagccgaggcgtccactgggcaggatgccccgaggcaggcccaggcgaggagctgggcatcacagggaaaggccgcctctgcagagggggatgagagcgaggtctcggagcatctcagtgccagctcggcttctgccatccagcaggacagcacttccagcatgcagccaccatctgaagcccccatggtgaacacagtcagctcagcttattcggaggattttgaaaactctccaagtctgacagcatctgagccaaccgcccattccaaggagtctcttgacagaacactggacgctttgtctgaatcctcttcaagtgtgaagacagaccttccacaaacagccgagtctaggaaaaagtcgggcaggcacgtgacaagagtgcttgtgaaggacacagctgtgcagacgccagatcctgccttcacctacgagtggaccaaggccctgaccgcttacagcccggccgtgctggcactccatgatgtgctgaagcagcagctgagcctgacgcagcagttcatccaggccagccggcacctgcacgcctccctcctgcgctccctggacgcggactccttccactaccacaccctggaggaagccaaagagtacattaggtgccacagacctgccccactgaccatggaggatgccctggaggaggtgaacaaggagctgtgagcgccagcaggtggagcttgacgtgacgtcttaacaaaagctacaggaaatctagaacaaaatcaaatattcatcacgttgggttgaaaagttggaagattttgcatcttattgaaaagaatttttcaaaaatgtttctgtacaaatgaatggaattgcaccaggctgcccatggacaccaggtgtggccgattcccaacggtcacccaccagcttctggcaggagcagctcccctcctggcctcccctcccttcgggggtgtgaaatgaaatgatggagtggaaggcgctggctggggtcgggctccatgctctggatgggactgggccgtcgcacacgccagccggtgcagggttcttccaagtgcaaaactcaagcaggggacgcgacgggcacagactccgaggcagcgctcaacctgaagtgtcttaggctggtttcctgttagaatcttgtttcccagataacagcaaatggctacattccagaaaaaaaatatcaacttatacaactaaaataactgaactaagggccagtacgccttcgaagaattaggtttcagaatctcactgggcctcctctcaggtcagtattcttctttctagacctaaaccaaggagagtaaaaatgaaaaccctgcttcacttcgcaagtc

SEQ ID NO: 356076 - DNA, 414 bp, Homo sapiens
acctcaattttcccacctggaaaatggagacagcactacctgcccaaaggtactttcagatgaacggagacaatcacaaacagtatagcctgagcgctctcctaatttacacatggattgaggacactgactcctttaggattttaagaatctactgtaaattgacatctcaccaaatcatgtagatataaaactcaaattttattgtataggttaaaaagtatcccagttataggtctgggccttcagtagggtggaaaactagtttcagtcttaaaattatagagttggtcaggtgtgggcgtacgcctgtaatcccaatactttggaaggctgaggtgggcggatcacttgaggtcagtttgagaccagcctggccaacatggtgaaaccgtgtctctactaaaaatacaa

SEQ ID NO: 356077 - DNA, 410 bp, Homo sapiens
ggggattttcattatacattatgattttaccctattttaaaagcatatttatgttatcttagactgtgatcttctattagcacatttgcgtgtatttagattgattagcgattttagtcactgaattactttcagagtctgaagagaaatattacaaatgccaatgatgtcagagtcctcattgccaaccagggccattaaccaaaagatcctaaaaagccaaggcaatatgcatctctctgtctctgtttctgactgtgtggtccctcatcttatcctctttttggatgtctgtttcatcctccttttccctactgaccagctctttctcctttactctcacttaactcaaacttgggtttacatcaactacctgactttttgtcacctaccagttcaagtgcttaaaa

SEQ ID NO: 356078 - DNA, 366 bp, Homo sapiens
aagttttaaaagctgtgtaccgtttatttttatgtacctcctatttttaagttgatagaaaaaatctttgtaagtttaaatattactgaagattatgcttctgatgtattatcaatattgacattttaaaatacagcaattaaaattattacatcactcttaaatatatccagtggaatagaaagcaatattattttattttttcctctctttgaaattgtacttccattcctgcttgtttaggctaagattcactggggtaatctctttttagaattaaaagcctttaagttaatctcactgatctacacctctctcacaaaaatttctgtataacttgaaagtttaaaaagttgttttcccctg

SEQ ID NO: 356079 - DNA, 5835 bp, Homo sapiens
  misc_feature (633)..(633): n is a, c, g, or t
  misc_feature (670)..(670): n is a, c, g, or t
  misc_feature (706)..(706): n is a, c, g, or t
  misc_feature (840)..(840): n is a, c, g, or t
gagacggagtcttgctctgtcacccaggctgtagtgcaatggcgtgatctcaaccactgcttcctgggttcaagcgattctcctgcctcagcctcccgagtagctgggactataggcgtacgccaccacgcccggctaatttgtttgtatttttagtagagacggggtttcaccatattggccagactggtctccaactcctgacctcaagtgatccgcccgcctcggcctcccaaagtgctgggattataggcgtaagccaccgcgcccggcaccttgccactgattttgcatcatgaatgcaacggaaagatcagccaatttgactttaatagttttcagtctcttaaatctctaacgtatctcttaaatctctaaactatttgtctgtgacctattttactgtttgtgtttcttctgcatcaagttggaggattggtagtgacaaagaaagaagcccctaaacaattaatattagttcaagtaccaaaaaagttcagggcgcttgcattttccagttcttgccctacaggaagcagttcctccaagggaacttactctcttctgcggagcaaggaagaactttcccagaatcttgccacatggcttccaaggcaaactcaaactcaagtncagcgtcatagatcagttcatagtctgggtccgaagncacggcgatgcttcttgcgcacccccacggagcttnttattccgattccgccagccccccgcccctccccaaaaaaagcctaagatgggagtggctatgattcagaggacagagggcagaagctgtttgcgttaaggagtggggggcttgccctattaaggtaatccgcnaacaccgagtctgacccggcccatagaggtacttctaccccgcttacctccccttttctctcgaagggcacccgaagattgtcacgagtccttagactccaactactgcggcagcttccaaatttcctgaaaaccctaagctgggccagcccggcagcccacgcacttccggcctcggacccgccccaaacacccaagcgccccagcgcctcatctctaggtccggaaataaacgaacatctccgattatggttataccagggtcgagggtttccgaatatattcgattcaaagcttcggcaagacgaagaaaaccgagcctgaaagcagggcgagaaaaggggcgctgcagggcggatggaaagaattgattggtaacgatgtggagacggaaacatccgaggacatccggaggaacccggggagttctgagtggtaatcgaggggtagagtatggcagtgggcggggtcatctcggtacgttcgaagggcgttggcggaaattaccgaagatgcccgaagccgtcgggacggacccgagtacctcacgcaagatggcggagctggaggaggtgactctggacgggaagcctcttcaggcgctgcgggtgaccgacctgaaggccgcactggagcagcgaggcctagccaagagcgggcagaagagtgccctggtcaagcggctcaaaggggctctaatgctagaaaatttacagaaacactcaacaccccatgctgcattccagccaaattcccagattggtgaggaaatgagccagaacagtttcataaaacagtatctggaaaagcagcaggagctacttaggcagcgtctggaacgtgaagctcgagaagctgcagaacttgaagaagcttcagctgagtcggaggacgagatgatccatcctgagggagtggcttccctgctgcctcctgactttcagagcagcctggagagaccagagctggagctcagcagacattcgcccagaaaaagctcctcaatttctgaagagaaaggtgactctgatgatgagaaaccaaggaaaggagaaagacgatcatctagggtcagacaggcaagagcagctaaactgtctgagggcagccaacctgctgaggaggaagaggatcaagaaacaccttccagaaacctaagggtcagagcagatcgaaatttgaaaacagaggaggaagaagaggaggaggaggaggaggaagaagatgatgaagaagaggaaggtgatgatgagggacaaaaatctagggaggcaccaatcctgaaagagtttaaggaagaaggggaagagatacctagagtaaaaccagaggagatgatggatgagagacccaaaacaagatcccaggaacaggaggtgttagagagaggagggagatttacaagatcccaggaagaggctagaaaaagtcatctggccagacagcagcaggagaaggaaatgaaaacaacatctccccttgaggaggaagaaagagaaataaaatcttcacaaggcttaaaggaaaaatcgaagtctccttcccctcctcgactgactgaagatcgaaagaaggcctcacttgtagcgctgccagagcaaactgccagcgaggaggagactcctccacctttactaacaaaggaagcatcttctccaccacctcatccacagctccatagcgaagaagaaatagagcccatggaaggcccagccccccctgtcctcattcagttatctcctcctaatacagatgctgacaccagggagctattagtatctcagcatactgtccagttggtaggaggcctgtctcctttgtcaagtccttcagacaccaaagcagaatctccagcagagaaagtgccagaggagagtgtcctgcctctggttcagaaaagcacactggctgactactcagcccagaaggatcttgaacctgagtcagacagatctgctcagcccctccctctaaaaattgaggaattagcactggccaaaggaatcactgaagaatgtctgaaacagccatctttggaacagaaggaaggcagaagagcttctcatacccttctcccaagccacagattgaaacagtcagctgattcatcctctagccggtcctcctcatcttcctcctccagttctagatcaagatctcgctctcctgacagttcaggttctcggtctcattcaccgctcagatccaagcagagagatgtagcccaggcacgtactcatgccaaccctcgtggtagacccaagatgggctccagatcaacatcagagtccagatcaaggtccgttcacgttcacgttctcgttcagcatcaagcaacagcagaaaatctctgagccctggagtctccagggacagcagcaccagctatactgaaaccaaagatccctcttctggtcaggaggttgcaactccaccagtgccacaactgcaggtctgtgagccaaaggagaggacttccacctcctcatcctctgtccaagcaaggcgtctgagtcagcctgaatcagctgaaaagcatgtgacccagaggttacagcctgagcgggggagcccaaagaagtgtgaagctgaagaggcagagccaccagctgccacacagccccaaacctcagagactcagacctctcatctgccagaatcagaaagaattcatcacactgttgaggagaaggaggaagtgaccatggacacaagtgaaaacagacctgaaaatgatgttccagaacctcccatgcctattgcagaccaagtcagcaatgatgaccgcccggagggcagtgttgaagatgaggagaagaaagagagctcgctgcccaaatcattcaagaggaagatctccgttgtctcagctaccaagggggtgccagctggaaacagtgacacagaggggggccagcctggtcggaaacgacgctggggagccagcacagccaccacacagaagaaaccttccatcagtatcaccactgaatcactaaagagcctcatccccgacatcaaacccctggcggggcaggaggctgttgtggatcttcatgctgatgactctcgcatctctgaggatgagacagagcgtaatggcgatgatgggacccatgacaaggggctgaaaatatgccggacagtcactcaggtagtacctgcagagggccaggagaatgggcagagggaagaagaggaagaagagaaggaacctgaagcagaacctcctgtacctccccaggtgtcagtagaggtggccttgcccccacctgcagagcatgaagtaaagaaagtgactttaggagataccttaactcgacgttccattagccagcagaagtccggagtttccattaccattgatgacccagtccgaactgcccaggtgccctccccaccccggggcaagattagcaacattgtccatatctccaatttggtccgtcctttcactttaggccagctaaaggagttgttggggcgcacaggaaccttggtggaagaggccttctggattgacaagatcaaatctcattgctttgtaacgtactcaacagtagaggaagctgttgccacccgcacagctctgcacggggtcaaatggccccagtccaatcccaaattcctttgtgctgactatgccgagcaagatgagctggattatcaccgaggcctcttggtggaccgtccctctgaaactaagacagaggagcagggaataccacggcccctgcaccccccacccccacccccggtccagccaccacagcacccccgggcagagcagcgggagcaggaacgggcagtgcgggaacagtgggcagaacgggaacgggaaatggagcggcgggagcggactcgatcagagcgtgaatgggatcgggacaaagttcgagaagggccccgttcccgatcaaggtcccgtgaccgccgccgcaaggaacgtgcgaagtctaaagaaaagaagagtgagaagaaagagaaagcccaggaggaaccacctgccaagctgctggatgaccttttccgaaagaccaaggcagctccctgcatctattggctcccactgactgacagccagatcgttcagaaagaggcagagcgggccgaacgggccaaggagcgggagaagcggcgaaaggagcaagaagaagaagagcaaaaggagcgggagaaggaagccgagcgggaacggaaccgacagctggagcgagagaaacgtcgggagcacagtcgggagagggacagggagagagagagagaaagggagcgggacaggggggaccgagatcgggatagggaaagggaccgagaacgaggcagggaaagggatcgcagggacaccaagcgccacagcagaagccggagtcggagcacacctgtgcgggaccggggtgggcgccgctagctgggaaaacactagagctgcaggtaccagccactcggccccagggggttatggccacagagggataggcacagtctccaccaccctggagccaagggtctttcacatcacctatccctacatacataccaaatggaaaagtggccatccttttccccccaaacacacccccttaacctatctcttgggacttagcccgaccctccctctcatttcccattaagtctgagaggcaagagctaggttaggcaaggaggtggttggccagagatggggaacagccaggtgccccagtcctctgatttttcctccatcctgcttaccacctccctgggtacttacagccttctcttgggaacagccggggccaggactgggtcacctatgagctgaatcagcatctcctcctgagtcccagggcccctgcagttcccagtctcttctgtcctgcagcccttgcctctttcccacaggttccactttatatccaccttttccttttgttcaatttttatttttattttttttattattaaatgatgtggtctatggaaaaaaaaataaaaatctgacttagttttaaa

SEQ ID NO: 356080 - DNA, 1787 bp, Homo sapiens
  misc_feature (633)..(633): n is a, c, g, or t
  misc_feature (670)..(670): n is a, c, g, or t
  misc_feature (706)..(706): n is a, c, g, or t
  misc_feature (840)..(840): n is a, c, g, or t
gagacggagtcttgctctgtcacccaggctgtagtgcaatggcgtgatctcaaccactgcttcctgggttcaagcgattctcctgcctcagcctcccgagtagctgggactataggcgtacgccaccacgcccggctaatttgtttgtatttttagtagagacggggtttcaccatattggccagactggtctccaactcctgacctcaagtgatccgcccgcctcggcctcccaaagtgctgggattataggcgtaagccaccgcgcccggcaccttgccactgattttgcatcatgaatgcaacggaaagatcagccaatttgactttaatagttttcagtctcttaaatctctaacgtatctcttaaatctctaaactatttgtctgtgacctattttactgtttgtgtttcttctgcatcaagttggaggattggtagtgacaaagaaagaagcccctaaacaattaatattagttcaagtaccaaaaaagttcagggcgcttgcattttccagttcttgccctacaggaagcagttcctccaagggaacttactctcttctgcggagcaaggaagaactttcccagaatcttgccacatggcttccaaggcaaactcaaactcaagtncagcgtcatagatcagttcatagtctgggtccgaagncacggcgatgcttcttgcgcacccccacggagcttnttattccgattccgccagccccccgcccctccccaaaaaaagcctaagatgggagtggctatgattcagaggacagagggcagaagctgtttgcgttaaggagtggggggcttgccctattaaggtaatccgcnaacaccgagtctgacccggcccatagaggtacttctaccccgcttacctccccttttctctcgaagggcacccgaagattgtcacgagtccttagactccaactactgcggcagcttccaaatttcctgaaaaccctaagctgggccagcccggcagcccacgcacttccggcctcggacccgccccaaacacccaagcgccccagcgcctcatctctaggtccggaaataaacgaacatctccgattatggttataccagggtcgagggtttccgaatatattcgattcaaagcttcggcaagacgaagaaaaccgagcctgaaagcagggcgagaaaaggggcgctgcagggcggatggaaagaattgattggtaacgatgtggagacggaaacatccgaggacatccggaggaacccggggagttctgagtggtaatcgaggggtagagtatggcagtgggcggggtcatctcggtacgttcgaagggcgttggcggaaattaccgaagatgcccgaagccgtcgggacggacccgagtacctcacgcaagatggcggagctggaggaggtgactctggacgggaagcctcttcaggcgctgcgggtgaccgacctgaaggccgcactggagcagcgaggcctagccaagagcgggcagaagagtgccctggtcaagcggctcaaaggggtgaggagtcggcgttgctggggtgtcggaggagagcggacccggtagagacgagcctctgccgcggcgcaggcgcagtatccgggctcggcgcgagctcgctcaggccgccagcgcgagcctctggatccgcgcgcacggtggttgatgaggttcgcgctggaatggagatcgcgccggttcccgccttaacggcagcagcgcgagcccaaatgggagggtgtgcactactctccaggagtgtcttaagctcct

SEQ ID NO: 356081 - DNA, 598 bp, Homo sapiens
  misc_feature (344)..(344): n is a, c, g, or t
  misc_feature (347)..(347): n is a, c, g, or t
  misc_feature (350)..(350): n is a, c, g, or t
  misc_feature (354)..(354): n is a, c, g, or t
  misc_feature (357)..(357): n is a, c, g, or t
  misc_feature (360)..(360): n is a, c, g, or t
tgaggatccccgaaagaaagagaaagaaggaaggtgtggtttttttctttatttttttttaggattttttttgtttggtttttgttatttcttccattccagaaagggataaacagcacttccagggggagaaaaaaaatcatgttatcagaaagcaaagaagggtgagagcttcacatttccatgtatgccttttccccgccgccctagctcccttcgtcttccttctcttcctcatggctttcattccgtctttcgttttggtttgttttcagtcattctgccttccttctttctctttcttcgaggaggtggtgggatcttggaacaaggaaggtgtggtnttnttncttnatnttnttttaggattttttttgtttggtttctgctatttcttcccttccagaaagggataaacagcagttccagggcgagaaaaaaaatcatcagatcagataatgacgaagatacgcggtgagagcctcacacgaccatcaatgcctcgctgcccgccgccgtacctccgttcgtggtccatctccgtacgctcatggcatggtcatgtccgtctttcgttctcgggatctttcaatcatta

SEQ ID NO: 356082 - DNA, 7039 bp, Homo sapiens
  misc_feature (633)..(633): n is a, c, g, or t
  misc_feature (670)..(670): n is a, c, g, or t
  misc_feature (706)..(706): n is a, c, g, or t
  misc_feature (840)..(840): n is a, c, g, or t
gagacggagtcttgctctgtcacccaggctgtagtgcaatggcgtgatctcaaccactgcttcctgggttcaagcgattctcctgcctcagcctcccgagtagctgggactataggcgtacgccaccacgcccggctaatttgtttgtatttttagtagagacggggtttcaccatattggccagactggtctccaactcctgacctcaagtgatccgcccgcctcggcctcccaaagtgctgggattataggcgtaagccaccgcgcccggcaccttgccactgattttgcatcatgaatgcaacggaaagatcagccaatttgactttaatagttttcagtctcttaaatctctaacgtatctcttaaatctctaaactatttgtctgtgacctattttactgtttgtgtttcttctgcatcaagttggaggattggtagtgacaaagaaagaagcccctaaacaattaatattagttcaagtaccaaaaaagttcagggcgcttgcattttccagttcttgccctacaggaagcagttcctccaagggaacttactctcttctgcggagcaaggaagaactttcccagaatcttgccacatggcttccaaggcaaactcaaactcaagtncagcgtcatagatcagttcatagtctgggtccgaagncacggcgatgcttcttgcgcacccccacggagcttnttattccgattccgccagccccccgcccctccccaaaaaaagcctaagatgggagtggctatgattcagaggacagagggcagaagctgtttgcgttaaggagtggggggcttgccctattaaggtaatccgcnaacaccgagtctgacccggcccatagaggtacttctaccccgcttacctccccttttctctcgaagggcacccgaagattgtcacgagtccttagactccaactactgcggcagcttccaaatttcctgaaaaccctaagctgggccagcccggcagcccacgcacttccggcctcggacccgccccaaacacccaagcgccccagcgcctcatctctaggtccggaaataaacgaacatctccgattatggttataccagggtcgagggtttccgaatatattcgattcaaagcttcggcaagacgaagaaaaccgagcctgaaagcagggcgagaaaaggggcgctgcagggcggatggaaagaattgattggtaacgatgtggagacggaaacatccgaggacatccggaggaacccggggagttctgagtggtaatcgaggggtagagtatggcagtgggcggggtcatctcggtacgttcgaagggcgttggcggaaattaccgaagatgcccgaagccgtcgggacggacccgagtacctcacgcaagatggcggagctggaggaggtgactctggacgggaagcctcttcaggcgctgcgggtgaccgacctgaaggccgcactggagcagcgaggcctagccaagagcgggcagaagagtgccctggtcaagcggctcaaaggggctctaatgctagaaaatttacagaaacactcaacaccccatgctgcattccagccaaattcccagattggtgaggaaatgagccagaacagtttcataaaacagtatctggaaaagcagcaggagctacttaggcagcgtctggaacgtgaagctcgagaagctgcagaacttgaaggaaaaagctcctcaatttctgaagagaaaggtgactctgatgatgagaaaccaaggaaaggagaaagacgatcatctagggtcagacaggcaagagcagctaaactgtctgagggcagccaacctgctgaggaggaagaggatcaagaaacaccttccagaaacctaagggtcagagcagatcgaaatttgaaaacagaggaggaagaagaggaggaggaggaggaggaagaagatgatgaagaagaggaaggtgatgatgagggacaaaaatctagggaggcaccaatcctgaaagagtttaaggaagaaggggaagagatacctagagtaaaaccagaggagatgatggatgagagacccaaaacaagatcccaggaacaggaggtgttagagagaggagggagatttacaagatcccaggaagaggctagaaaaagtcatctggccagacagcagcaggagaaggaaatgaaaacaacatctccccttgaggaggaagaaagagaaataaaatcttcacaaggcttaaaggaaaaatcgaagtctccttcccctcctcgactgactgaagatcgaaagaaggcctcacttgtagcgctgccagagcaaactgccagcgaggaggagactcctccacctttactaacaaaggaagcatcttctccaccacctcatccacagctccatagcgaagaagaaatagagcccatggaaggcccagccccccctgtcctcattcagttatctcctcctaatacagatgctgacaccagggagctattagtatctcagcatactgtccagttggtaggaggcctgtctcctttgtcaagtccttcagacaccaaagcagaatctccagcagagaaagtgccagaggagagtgtcctgcctctggttcagaaaagcacactggctgactactcagcccagaaggatcttgaacctgagtcagacagatctgctcagcccctccctctaaaaattgaggaattagcactggccaaaggaatcactgaagaatgtctgaaacagccatctttggaacagaaggaaggcagaagagcttctcatacccttctcccaagccacagattgaaacagtcagctgattcatcctctagccggtcctcctcatcttcctcctccagttctagatcaagatctcgctctcctgacagttcaggttctcggtctcattcaccgctcagatccaagcagagagatgtagcccaggcacgtactcatgccaaccctcgtggtagacccaagatgggctccagatcaacatcagagtccagatcaaggtccgttcacgttcacgttctcgttcagcatcaagcaacagcagaaaatctctgagccctggagtctccagggacagcagcaccagctatactgaaaccaaagatccctcttctggtcaggaggttgcaactccaccagtgccacaactgcaggtctgtgagccaaaggagaggacttccacctcctcatcctctgtccaagcaaggcgtctgagtcagcctgaatcagctgaaaagcatgtgacccagaggttacagcctgagcgggggagcccaaagaagtgtgaagctgaagaggcagagccaccagctgccacacagccccaaacctcagagactcagacctctcatctgccagaatcagaaagaattcatcacactgttgaggagaaggaggaagtgaccatggacacaagtgaaaacagacctgaaaatgatgttccagaacctcccatgcctattgcagaccaagtcagcaatgatgaccgcccggagggcagtgttgaagatgaggagaagaaagagtacctcatgtacggtaatccgcccgtaaaatataaccctgcccaactggccaatcgctgatgccgcctcttcctctggacccacccgctgctactgagctgcccaatcagagccaagtctgctatccaggtgtcttggccagaggggggcatgtatatgggctcctgtgatgggcccccttttgcctccctgtcttgcttacatcagggggccaagaagaacactgttctggagagacttgtattgagcaagcaaaaaacatttggaaaggggtggacttgcatcatctccctacttgggacaccccaagaagagcttgtgccagtgctggggcgcctgcccacatgcccttgcccttttgaggactgtgggttgccttgtttgctacagactgttgggatccccatctagggcaccaagacctcctaaagtttgtgatcgcagtgccatgctgtaaaacactgagtgggaccctctacttaagctgtgacgactaggaaccgtgcagaggagtctagggtctgagcccctggggatttaatgctgatgacagcccagcccatgtgtcaccacttgctcatcagatggactttcctttggtccctgttgtccatggtgaagggcagcatgttggttgctccaacttctcctccatccctggaggcagggactcatttcatccacctgactggaaccactgtctcagctggagtccctgaggagatgccagccacaactctccgaagagaagtattctgaccttgctgctgaatgtctgccaggtcctggggtattcacctacccccaggctaccttcatcagaggctccatgatcccactcggtgagaggaccccctccccagttacaggcagaggagaaagggactctggagtcatcacctggattccaagtattgggtggtgttattgctgcagcttgccactggtggacatagggtcctgcctgcctctcacgataaaaggcaaggatcattcctgctactcacaggccatctcatcagggactgcaagatgatgtcccttcagggccaggactgatgtctctgcccctttcccccctctatccctcgctgagcctggccaccgccagtgaactgtcttgacatcatggaaactgggcagcgtccccccacacgtttccctcccgccccccctgcgcccctgggaggactctggcagtgccgtgctgactaccacgccgtgcgcccaccttttttgccaacccaaccccccaccaattgcacagcgcctagcagggagggctcattctgattggaccggcggttgactagatacagtccccacagtgaggtgcgattggctgaactgaagatcccagagctcgctgcccaaatcattcaagaggaagatctccgttgtctcagctaccaagggggtgccagctggaaacagtgacacagaggggggccagcctggtcggaaacgacgctggggagccagcacagccaccacacagaagaaaccttccatcagtatcaccactgaatcactaaaggaggctgttgtggatcttcatgctgatgactctcgcatctctgaggatgagacagagcgtaatggcgatgatgggacccatgacaaggggctgaaaatatgccggacagtcactcaggtagtacctgcagagggccaggagaatgggcagagggaagaagaggaagaagagaaggaacctgaagcagaacctcctgtacctccccaggtgtcagtagaggtggccttgcccccacctgcagagcatgaagtaaagaaagtgactttaggagataccttaactcgacgttccattagccagcagaagtccggagtttccattaccattgatgacccagtccgaactgcccaggtgccctccccaccccggggcaagattagcaacattgtccatatctccaatttggtccgtcctttcactttaggccagctaaaggagttgttggggcgcacaggaaccttggtggaagaggccttctggattgacaagatcaaatctcattgctttgtaacgtactcaacagtagaggaagctgttgccacccgcacagctctgcacggggtcaaatggccccagtccaatcccaaattcctttgtgctgactatgccgagcaagatgagctggattatcaccgaggcctcttggtggaccgtccctctgaaactaagacagaggagcagggaataccacggcccctgcaccccccacccccacccccggtccagccaccacagcacccccgggcagagcagcgggagcaggaacgggcagtgcgggaacagtgggcagaacgggaacgggaaatggagcggcgggagcggactcgatcagagcgtgaatgggatcgggacaaagttcgagaagggccccgttcccgatcaaggtcccgtgaccgccgccgcaaggaacgtgcgaagtctaaagaaaagaagagtgagaagaaagagaaagcccaggaggaaccacctgccaagctgctggatgaccttttccgaaagaccaaggcagctccctgcatctattggctcccactgactgacagccagatcgttcagaaagaggcagagcgggccgaacgggccaaggagcgggagaagcggcgaaaggagcaagaagaagaagagcaaaaggagcgggagaaggaagccgagcgggaacggaaccgacagctggagcgagagaaacgtcgggagcacagtcgggagagggacagggagagagagagagaaagggagcgggacaggggggaccgagatcgggatagggaaagggaccgagaacgaggcagggaaagggatcgcagggacaccaagcgccacagcagaagccggagtcggagcacacctgtgcgggaccggggtgggcgccgctagctgggaaaacactagagctgcaggtaccagccactcggccccagggggttatggccacagagggataggcacagtctccaccaccctggagccaagggtctttcacatcacctatccctacatacataccaaatggaaaagtggccatccttttccccccaaacacacccccttaacctatctcttgggacttagcccgaccctccctctcatttcccattaagtctgagaggcaagagctaggttaggcaaggaggtggttggccagagatggggaacagccaggtgccccagtcctctgatttttcctccatcctgcttaccacctccctgggtacttacagccttctcttgggaacagccggggccaggactgggtcacctatgagctgaatcagcatctcctcctgagtcccagggcccctgcagttcccagtctcttctgtcctgcagcccttgcctctttcccacaggttccactttatatccaccttttccttttgttcaatttttatttttattttttttattattaaatgatgtggtctatggaaaaaaaaataaaaatctgacttagttttaaa

SEQ ID NO: 356083 - DNA, 2567 bp, Homo sapiens
cctcccctgctgcagcaaggccctcccccatccgcacacacaggctgctgggtaagtggcaagatggctcccctgcatgtctccggctgatcgctgccgctccgccaatacaatagagccagccactaccagcagcctggccctcttcctccttctccagagagaccaatccagccgaactcggggtttgccaaagggataaacagcacttccagggggagaaaaaaaatcatgttatcagaaagcaaagaaggtgaggagaaggaggaagtgaccatggacacaagtgaaaacagacctgaaaatgatgttccagaacctcccatgcctattgcagaccaagtcagcaatgatgaccgcccggagggcagtgttgaagatgaggagaagaaagagagctcgctgcccaaatcattcaagaggaagatctccgttgtctcagctaccaagggggtgccagctggaaacagtgacacagaggggggccagcctggtcggaaacgacgctggggagccagcacagccaccacacagaagaaaccttccatcagtatcaccactgaatcactaaagagcctcatccccgacatcaaacccctggcggggcaggaggctgttgtggatcttcatgctgatgactctcgcatctctgaggatgagacagagcgtaatggcgatgatgggacccatgacaaggggctgaaaatatgccggacagtcactcaggtagtacctgcagagggccaggagaatgggcagagggaagaagaggaagaagagaaggaacctgaagcagaacctcctgtacctccccaggtgtcagtagaggtggccttgcccccacctgcagagcatgaagtaaagaaagtgactttaggagataccttaactcgacgttccattagccagcagaagtccggagtttccattaccattgatgacccagtccgaactgcccaggtgccctccccaccccggggcaagattagcaacattgtccatatctccaatttggtccgtcctttcactttaggccagctaaaggagttgttggggcgcacaggaaccttggtggaagaggccttctggattgacaagatcaaatctcattgctttgtaacgtactcaacagtagaggaagctgttgccacccgcacagctctgcacggggtcaaatggccccagtccaatcccaaattcctttgtgctgactatgccgagcaagatgagctggattatcaccgaggcctcttggtggaccgtccctctgaaactaagacagaggagcagggaataccacggcccctgcaccccccacccccacccccggtccagccaccacagcacccccgggcagagcagcgggagcaggaacgggcagtgcgggaacagtgggcagaacgggaacgggaaatggagcggcgggagcggactcgatcagagcgtgaatgggatcgggacaaagttcgagaagggccccgttcccgatcaaggtcccgtgaccgccgccgcaaggaacgtgcgaagtctaaagaaaagaagagtgagaagaaagagaaagcccaggaggaaccacctgccaagctgctggatgaccttttccgaaagaccaaggcagctccctgcatctattggctcccactgactgacagccagatcgttcagaaagaggcagagcgggccgaacgggccaaggagcgggagaagcggcgaaaggagcaagaagaagaagagcaaaaggagcgggagaaggaagccgagcgggaacggaaccgacagctggagcgagagaaacgtcgggagcacagtcgggagagggacagggagagagagagagaaagggagcgggacaggggggaccgagatcgggatagggaaagggaccgagaacgaggcagggaaagggatcgcagggacaccaagcgccacagcagaagccggagtcggagcacacctgtgcgggaccggggtgggcgccgctagctgggaaaacactagagctgcaggtaccagccactcggccccagggggttatggccacagagggataggcacagtctccaccaccctggagccaagggtctttcacatcacctatccctacatacataccaaatggaaaagtggccatccttttccccccaaacacacccccttaacctatctcttgggacttagcccgaccctccctctcatttcccattaagtctgagaggcaagagctaggttaggcaaggaggtggttggccagagatggggaacagccaggtgccccagtcctctgatttttcctccatcctgcttaccacctccctgggtacttacagccttctcttgggaacagccggggccaggactgggtcacctatgagctgaatcagcatctcctcctgagtcccagggcccctgcagttcccagtctcttctgtcctgcagcccttgcctctttcccacaggttccactttatatccaccttttccttttgttcaatttttatttttattttttttattattaaatgatgtggtctatggaaaaaaaaataaaaatctgacttagttttaaa

SEQ ID NO: 356084 - DNA, 2505 bp, Homo sapiens
cctcccctgctgcagcaaggccctcccccatccgcacacacaggctgctgggtaagtggcaagatggctcccctgcatgtctccggctgatcgctgccgctccgccaatacaatagagccagccactaccagcagcctggccctcttcctccttctccagagagaccaatccagccgaactcggggtttgcctgaggagaaggaggaagtgaccatggacacaagtgaaaacagacctgaaaatgatgttccagaacctcccatgcctattgcagaccaagtcagcaatgatgaccgcccggagggcagtgttgaagatgaggagaagaaagagagctcgctgcccaaatcattcaagaggaagatctccgttgtctcagctaccaagggggtgccagctggaaacagtgacacagaggggggccagcctggtcggaaacgacgctggggagccagcacagccaccacacagaagaaaccttccatcagtatcaccactgaatcactaaagagcctcatccccgacatcaaacccctggcggggcaggaggctgttgtggatcttcatgctgatgactctcgcatctctgaggatgagacagagcgtaatggcgatgatgggacccatgacaaggggctgaaaatatgccggacagtcactcaggtagtacctgcagagggccaggagaatgggcagagggaagaagaggaagaagagaaggaacctgaagcagaacctcctgtacctccccaggtgtcagtagaggtggccttgcccccacctgcagagcatgaagtaaagaaagtgactttaggagataccttaactcgacgttccattagccagcagaagtccggagtttccattaccattgatgacccagtccgaactgcccaggtgccctccccaccccggggcaagattagcaacattgtccatatctccaatttggtccgtcctttcactttaggccagctaaaggagttgttggggcgcacaggaaccttggtggaagaggccttctggattgacaagatcaaatctcattgctttgtaacgtactcaacagtagaggaagctgttgccacccgcacagctctgcacggggtcaaatggccccagtccaatcccaaattcctttgtgctgactatgccgagcaagatgagctggattatcaccgaggcctcttggtggaccgtccctctgaaactaagacagaggagcagggaataccacggcccctgcaccccccacccccacccccggtccagccaccacagcacccccgggcagagcagcgggagcaggaacgggcagtgcgggaacagtgggcagaacgggaacgggaaatggagcggcgggagcggactcgatcagagcgtgaatgggatcgggacaaagttcgagaagggccccgttcccgatcaaggtcccgtgaccgccgccgcaaggaacgtgcgaagtctaaagaaaagaagagtgagaagaaagagaaagcccaggaggaaccacctgccaagctgctggatgaccttttccgaaagaccaaggcagctccctgcatctattggctcccactgactgacagccagatcgttcagaaagaggcagagcgggccgaacgggccaaggagcgggagaagcggcgaaaggagcaagaagaagaagagcaaaaggagcgggagaaggaagccgagcgggaacggaaccgacagctggagcgagagaaacgtcgggagcacagtcgggagagggacagggagagagagagagaaagggagcgggacaggggggaccgagatcgggatagggaaagggaccgagaacgaggcagggaaagggatcgcagggacaccaagcgccacagcagaagccggagtcggagcacacctgtgcgggaccggggtgggcgccgctagctgggaaaacactagagctgcaggtaccagccactcggccccagggggttatggccacagagggataggcacagtctccaccaccctggagccaagggtctttcacatcacctatccctacatacataccaaatggaaaagtggccatccttttccccccaaacacacccccttaacctatctcttgggacttagcccgaccctccctctcatttcccattaagtctgagaggcaagagctaggttaggcaaggaggtggttggccagagatggggaacagccaggtgccccagtcctctgatttttcctccatcctgcttaccacctccctgggtacttacagccttctcttgggaacagccggggccaggactgggtcacctatgagctgaatcagcatctcctcctgagtcccagggcccctgcagttcccagtctcttctgtcctgcagcccttgcctctttcccacaggttccactttatatccaccttttccttttgttcaatttttatttttattttttttattattaaatgatgtggtctatggaaaaaaaaataaaaatctgacttagttttaaa

SEQ ID NO: 356085 - DNA, 5947 bp, Homo sapiens
tgaggatccccgaaagaaagagaaagaaggaaggtgtggtttttttctttatttttttttaggattttttttgtttggtttttgttatttcttccattccagaaagggataaacagcacttccagggggagaaaaaaaatcatgttatcagaaagcaaagaaggtgaggagaaggaggaagtgaccatggacacaagtgaaaacagacctgaaaatgatgttccagaacctcccatgcctattgcagaccaagtcagcaatgatgaccgcccggagggcagtgttgaagatgaggagaagaaagaggtaaacatccaagccacctattggggcgggtgggcaggaatggacctaggggaaagagtagagcactctagtgatccctcttacacggtgggttaacttaaaggagggatgaggcagggacttggatcagaatagggccaagggagaattcgctggtttagcaagggagaccccttgtgacggggacagggctcattcattttcctttccttgttggggaagtagtgcccagactctagacgtttgtaactaacgggaaagtctgataatggccctttatctaagatttatgttcagcttttcctgctgtcttcccaagcttctcctggtggtaactcctttagctttccctcctttttaaaagcctgatggagcccaacgccatctagtggacattggtggttctcaccagaccagccatgctgagaaatttttgttcctcctctgccctccagtggtctgactgcagagatgtagctacttagaagccagcacttgtgatccggaaggcccattctcagttacctgtgacccctctacctccttttttggcatatgttatcttgtgtcctgcacccacttcagggggcttcccccatcagagccagcgaagtcttcttggctcttaaagtaattgagaaagaatgagctgggtttaggagaggggtaacaaggtgggagggactgttgtgtgtgtagcctttttctggtgtgtgttgcgggggtgggggccggtgaaagtgatttgatgtgcagaatattatttattacaaggtccttcttccccgtaaaactttgtccaagtacctcatgtacggtaatccgcccgtaaaatataaccctgcccaactggccaatcgctgatgccgcctcttcctctggacccacccgctgctactgagctgcccaatcagagccaagtctgctatccaggtgtcttggccagaggggggcatgtatatgggctcctgtgatgggcccccttttgcctccctgtcttgcttacatcagggggccaagaagaacactgttctggagagacttgtattgagcaagcaaaaaacatttggaaaggggtggacttgcatcatctccctacttgggacaccccaagaagagcttgtgccagtgctggggcgcctgcccacatgcccttgcccttttgaggactgtgggttgccttgtttgctacagactgttgggatccccatctagggcaccaagacctcctaaagtttgtgatcgcagtgccatgctgtaaaacactgagtgggaccctctacttaagctgtgacgactaggaaccgtgcagaggagtctagggtctgagcccctggggatttaatgctgatgacagcccagcccatgtgtcaccacttgctcatcagatggactttcctttggtccctgttgtccatggtgaagggcagcatgttggttgctccaacttctcctccatccctggaggcagggactcatttcatccacctgactggaaccactgtctcagctggagtccctgaggagatgccagccacaactctccgaagagaagtattctgaccttgctgctgaatgtctgccaggtcctggggtattcacctacccccaggctaccttcatcagaggctccatgatcccactcggtgagaggaccccctccccagttacaggcagaggagaaagggactctggagtcatcacctggattccaagtattgggtggtgttattgctgcagcttgccactggtggacatagggtcctgcctgcctctcacgataaaaggcaaggatcattcctgctactcacaggccatctcatcagggactgcaagatgatgtcccttcagggccaggactgatgtctctgcccctttcccccctctatccctcgctgagcctggccaccgccagtgaactgtcttgacatcatggaaactgggcagcgtccccccacacgtttccctcccgccccccctgcgcccctgggaggactctggcagtgccgtgctgactaccacgccgtgcgcccaccttttttgccaacccaaccccccaccaattgcacagcgcctagcagggagggctcattctgattggaccggcggttgactagatacagtccccacagtgaggtgcgattggctgaactgaagatcccaggtgtgagatggtacctggaacatttgtcatattcctagtttattttcttctttattttcttcttctttttttaatattttattttattttttttctatatctttattttttctgatttcttttatttatttatttggttcatgtttttcctgttttaattaagacctttttttttgttttgtttttctcactaacttacccatcgagagcggcccagctaggggtcaggctggcccttaacagagaccaaggagacttggttagacgacacaaacggggctgcgggtgggggtggatgggaaagggatttcatcacgaggtttctgccctaccctttagaagagtggtagagtggtcttagtttttccagaaataagcacctacacttgaaaatactctattccctttttctctctcacttttctcccccgccccccatagtctttcgtcattcacccactgagtgtttggggtagagacttgtcccaaagatgtcttctggtctttggcagagcccctaaggcttgagccctggttggagaggaaacagtaagactctgctggagctccctgcggtggctggaaagtctaaggatctccttggggacaatctgcccttcataaaaaccttcctttatcaaagacacctttgagttctttttgctagcacttggctcaagagcctcatctccagtgggtctggtgctgcccttttccacagtgtggtgggggtctgggcagtcttgacatgacagtctgctgtccaagcatctcaaagccattgtcagtgggcatcagtctggccattgaagaaaggagggttaccttgttgaagttgccatccaaagttggttttccttgtttcctcgagttagcaaggaaggacctgggaggactagatgacccagtttggggcacagtttgtttggcttggtgtcctctcgactcagacggtgaaagagggggtatgaccaacatctttagggggctgagaggctactgaactcctcttccagcttatttctggttaagctaatacacaggtgtgatacggagtagatgacttttccctgctctgatgtttagttttatttttttctctaacttgcattgattctgcttcgtttttgccgtttgccgcttctgttttggtctctgtctgtctctgtgtctctctctgtctctctctctcactctatctgtgtctttggaggctaagctaagactgccccatctaacctccttcccccctctctgtggggtgtctctctttctcttttttttcccctttttcttcttcatacagagctcgctgcccaaatcattcaagaggaagatctccgttgtctcagctaccaagggggtgccagctggaaacagtgacacagaggggggccagcctggtcggaaacgacgctggggagccagcacagccaccacacagaagaaaccttccatcagtatcaccactgaatcactaaagagcctcatccccgacatcaaacccctggcggggcaggaggctgttgtggatcttcatgctgatgactctcgcatctctgaggatgagacagagcgtaatggcgatgatgggacccatgacaaggggctgaaaatatgccggacagtcactcaggtagtacctgcagagggccaggagaatgggcagagggaagaagaggaagaagagaaggaacctgaagcagaacctcctgtacctccccaggtgtcagtagaggtggccttgcccccacctgcagagcatgaagtaaagaaagtgactttaggagataccttaactcgacgttccattagccagcagaagtccggagtttccattaccattgatgacccagtccgaactgcccaggtgccctccccaccccggggcaagattagcaacattgtccatatctccaatttggtccgtcctttcactttaggccagctaaaggagttgttggggcgcacaggaaccttggtggaagaggccttctggattgacaagatcaaatctcattgctttgtaacgtactcaacagtagaggaagctgttgccacccgcacagctctgcacggggtcaaatggccccagtccaatcccaaattcctttgtgctgactatgccgagcaagatgagctggattatcaccgaggcctcttggtggaccgtccctctgaaactaagacagaggagcagggaataccacggcccctgcaccccccacccccacccccggtccagccaccacagcacccccgggcagagcagcgggagcaggaacgggcagtgcgggaacagtgggcagaacgggaacgggaaatggagcggcgggagcggactcgatcagagcgtgaatgggatcgggacaaagttcgagaagggccccgttcccgatcaaggtcccgtgaccgccgccgcaaggaacgtgcgaagtctaaagaaaagaagagtgagaagaaagagaaagcccaggaggaaccacctgccaagctgctggatgaccttttccgaaagaccaaggcagctccctgcatctattggctcccactgactgacagccagatcgttcagaaagaggcagagcgggccgaacgggccaaggagcgggagaagcggcgaaaggagcaagaagaagaagagcaaaaggagcgggagaaggaagccgagcgggaacggaaccgacagctggagcgagagaaacgtcgggagcacagtcgggagagggacagggagagagagagagaaagggagcgggacaggggggaccgagatcgggatagggaaagggaccgagaacgaggcagggaaagggatcgcagggacaccaagcgccacagcagaagccggagtcggagcacacctgtgcgggaccggggtgggcgccgctagctgggaaaacactagagctgcaggtaccagccactcggccccagggggttatggccacagagggataggcacagtctccaccaccctggagccaagggtctttcacatcacctatccctacatacataccaaatggaaaagtggccatccttttccccccaaacacacccccttaacctatctcttgggacttagcccgaccctccctctcatttcccattaagtctgagaggcaagagctaggttaggcaaggaggtggttggccagagatggggaacagccaggtgccccagtcctctgatttttcctccatcctgcttaccacctccctgggtacttacagccttctcttgggaacagccggggccaggactgggtcacctatgagctgaatcagcatctcctcctgagtcccagggcccctgcagttcccagtctcttctgtcctgcagcccttgcctctttcccacaggttccactttatatccaccttttccttttgttcaatttttatttttattttttttattattaaatgatgtggtctatggaaaaaaaaataaaaatctgacttagttttaaa

SEQ ID NO: 356086 - DNA, 8001 bp, Homo sapiens
  misc_feature (633)..(633): n is a, c, g, or t
  misc_feature (670)..(670): n is a, c, g, or t
  misc_feature (706)..(706): n is a, c, g, or t
  misc_feature (840)..(840): n is a, c, g, or t
gagacggagtcttgctctgtcacccaggctgtagtgcaatggcgtgatctcaaccactgcttcctgggttcaagcgattctcctgcctcagcctcccgagtagctgggactataggcgtacgccaccacgcccggctaatttgtttgtatttttagtagagacggggtttcaccatattggccagactggtctccaactcctgacctcaagtgatccgcccgcctcggcctcccaaagtgctgggattataggcgtaagccaccgcgcccggcaccttgccactgattttgcatcatgaatgcaacggaaagatcagccaatttgactttaatagttttcagtctcttaaatctctaacgtatctcttaaatctctaaactatttgtctgtgacctattttactgtttgtgtttcttctgcatcaagttggaggattggtagtgacaaagaaagaagcccctaaacaattaatattagttcaagtaccaaaaaagttcagggcgcttgcattttccagttcttgccctacaggaagcagttcctccaagggaacttactctcttctgcggagcaaggaagaactttcccagaatcttgccacatggcttccaaggcaaactcaaactcaagtncagcgtcatagatcagttcatagtctgggtccgaagncacggcgatgcttcttgcgcacccccacggagcttnttattccgattccgccagccccccgcccctccccaaaaaaagcctaagatgggagtggctatgattcagaggacagagggcagaagctgtttgcgttaaggagtggggggcttgccctattaaggtaatccgcnaacaccgagtctgacccggcccatagaggtacttctaccccgcttacctccccttttctctcgaagggcacccgaagattgtcacgagtccttagactccaactactgcggcagcttccaaatttcctgaaaaccctaagctgggccagcccggcagcccacgcacttccggcctcggacccgccccaaacacccaagcgccccagcgcctcatctctaggtccggaaataaacgaacatctccgattatggttataccagggtcgagggtttccgaatatattcgattcaaagcttcggcaagacgaagaaaaccgagcctgaaagcagggcgagaaaaggggcgctgcagggcggatggaaagaattgattggtaacgatgtggagacggaaacatccgaggacatccggaggaacccggggagttctgagtggtaatcgaggggtagagtatggcagtgggcggggtcatctcggtacgttcgaagggcgttggcggaaattaccgaagatgcccgaagccgtcgggacggacccgagtacctcacgcaagatggcggagctggaggaggtgactctggacgggaagcctcttcaggcgctgcgggtgaccgacctgaaggccgcactggagcagcgaggcctagccaagagcgggcagaagagtgccctggtcaagcggctcaaaggggctctaatgctagaaaatttacagaaacactcaacaccccatgctgcattccagccaaattcccagattggtgaggaaatgagccagaacagtttcataaaacagtatctggaaaagcagcaggagctacttaggcagcgtctggaacgtgaagctcgagaagctgcagaacttgaagaagcttcagctgagtcggaggacgagatgatccatcctgagggagtggcttccctgctgcctcctgactttcagagcagcctggagagaccagagctggagctcagcagacattcgcccagaaaaagctcctcaatttctgaagagaaaggtgactctgatgatgagaaaccaaggaaaggagaaagacgatcatctagggtcagacaggcaagagcagctaaactgtctgagggcagccaacctgctgaggaggaagaggatcaagaaacaccttccagaaacctaagggtcagagcagatcgaaatttgaaaacagaggaggaagaagaggaggaggaggaggaggaagaagatgatgaagaagaggaaggtgatgatgagggacaaaaatctagggaggcaccaatcctgaaagagtttaaggaagaaggggaagagatacctagagtaaaaccagaggagatgatggatgagagacccaaaacaagatcccaggaacaggaggtgttagagagaggagggagatttacaagatcccaggaagaggctagaaaaagtcatctggccagacagcagcaggagaaggaaatgaaaacaacatctccccttgaggaggaagaaagagaaataaaatcttcacaaggcttaaaggaaaaatcgaagtctccttcccctcctcgactgactgaagatcgaaagaaggcctcacttgtagcgctgccagagcaaactgccagcgaggaggagactcctccacctttactaacaaaggaagcatcttctccaccacctcatccacagctccatagcgaagaagaaatagagcccatggaaggcccagccccccctgtcctcattcagttatctcctcctaatacagatgctgacaccagggagctattagtatctcagcatactgtccagttggtaggaggcctgtctcctttgtcaagtccttcagacaccaaagcagaatctccagcagagaaagtgccagaggagagtgtcctgcctctggttcagaaaagcacactggctgactactcagcccagaaggatcttgaacctgagtcagacagatctgctcagcccctccctctaaaaattgaggaattagcactggccaaaggaatcactgaagaatgtctgaaacagccatctttggaacagaaggaaggcagaagagcttctcatacccttctcccaagccacagattgaaacagtcagctgattcatcctctagccggtcctcctcatcttcctcctccagttctagatcaagatctcgctctcctgacagttcaggttctcggtctcattcaccgctcagatccaagcagagagatgtagcccaggcacgtactcatgccaaccctcgtggtagacccaagatgggctccagatcaacatcagagtccagatcaaggtccgttcacgttcacgttctcgttcagcatcaagcaacagcagaaaatctctgagccctggagtctccagggacagcagcaccagctatactgaaaccaaagatccctcttctggtcaggaggttgcaactccaccagtgccacaactgcaggtctgtgagccaaaggagaggacttccacctcctcatcctctgtccaagcaaggcgtctgagtcagcctgaatcagctgaaaagcatgtgacccagaggttacagcctgagcgggggagcccaaagaagtgtgaagctgaagaggcagagccaccagctgccacacagccccaaacctcagagactcagacctctcatctgccagaatcagaaagaattcatcacactgttgaggagaaggaggaagtgaccatggacacaagtgaaaacagacctgaaaatgatgttccagaacctcccatgcctattgcagaccaagtcagcaatgatgaccgcccggagggcagtgttgaagatgaggagaagaaagaggtaaacatccaagccacctattggggcgggtgggcaggaatggacctaggggaaagagtagagcactctagtgatccctcttacacggtgggttaacttaaaggagggatgaggcagggacttggatcagaatagggccaagggagaattcgctggtttagcaagggagaccccttgtgacggggacagggctcattcattttcctttccttgttggggaagtagtgcccagactctagacgtttgtaactaacgggaaagtctgataatggccctttatctaagatttatgttcagcttttcctgctgtcttcccaagcttctcctggtggtaactcctttagctttccctcctttttaaaagcctgatggagcccaacgccatctagtggacattggtggttctcaccagaccagccatgctgagaaatttttgttcctcctctgccctccagtggtctgactgcagagatgtagctacttagaagccagcacttgtgatccggaaggcccattctcagttacctgtgacccctctacctccttttttggcatatgttatcttgtgtcctgcacccacttcagggggcttcccccatcagagccagcgaagtcttcttggctcttaaagtaattgagaaagaatgagctgggtttaggagaggggtaacaaggtgggagggactgttgtgtgtgtagcctttttctggtgtgtgttgcgggggtgggggccggtgaaagtgatttgatgtgcagaatattatttattacaaggtccttcttccccgtaaaactttgtccaagtacctcatgtacggtaatccgcccgtaaaatataaccctgcccaactggccaatcgctgatgccgcctcttcctctggacccacccgctgctactgagctgcccaatcagagccaagtctgctatccaggtgtcttggccagaggggggcatgtatatgggctcctgtgatgggcccccttttgcctccctgtcttgcttacatcagggggccaagaagaacactgttctggagagacttgtattgagcaagcaaaaaacatttggaaaggggtggacttgcatcatctccctacttgggacaccccaagaagagcttgtgccagtgctggggcgcctgcccacatgcccttgcccttttgaggactgtgggttgccttgtttgctacagactgttgggatccccatctagggcaccaagacctcctaaagtttgtgatcgcagtgccatgctgtaaaacactgagtgggaccctctacttaagctgtgacgactaggaaccgtgcagaggagtctagggtctgagcccctggggatttaatgctgatgacagcccagcccatgtgtcaccacttgctcatcagatggactttcctttggtccctgttgtccatggtgaagggcagcatgttggttgctccaacttctcctccatccctggaggcagggactcatttcatccacctgactggaaccactgtctcagctggagtccctgaggagatgccagccacaactctccgaagagaagtattctgaccttgctgctgaatgtctgccaggtcctggggtattcacctacccccaggctaccttcatcagaggctccatgatcccactcggtgagaggaccccctccccagttacaggcagaggagaaagggactctggagtcatcacctggattccaagtattgggtggtgttattgctgcagcttgccactggtggacatagggtcctgcctgcctctcacgataaaaggcaaggatcattcctgctactcacaggccatctcatcagggactgcaagatgatgtcccttcagggccaggactgatgtctctgcccctttcccccctctatccctcgctgagcctggccaccgccagtgaactgtcttgacatcatggaaactgggcagcgtccccccacacgtttccctcccgccccccctgcgcccctgggaggactctggcagtgccgtgctgactaccacgccgtgcgcccaccttttttgccaacccaaccccccaccaattgcacagcgcctagcagggagggctcattctgattggaccggcggttgactagatacagtccccacagtgaggtgcgattggctgaactgaagatcccagagctcgctgcccaaatcattcaagaggaagatctccgttgtctcagctaccaagggggtgccagctggaaacagtgacacagaggggggccagcctttcctaatttcatcctcccgatccagcgcaggctccacacacaatggcctttcaatcagtatcatctttgaatcaatacagacagcctcatccccgacatcaaacccctggcggggcaggaggctgttgtggatcttcatgctgatgactctcgcatctctgaggatgagacagagcgtaatggcgatgatgggacccatgacaaggggctgaaaatatgccggacagtcactcaggtagtacctgcagagggccaggagaatgggcagagggaagaagaggaagaagagaaggaacctgaagcagaacctcctgtacctccccaggtgtcagtagaggtggccttgcccccacctgcagagcatgaagtaaagaaagtgactttaggagataccttaactcgacgttccattagccagcagaagtccggagtttccattaccattgatgacccagtccgaactgcccaggtgccctccccaccccggggcaagattagcaacattgtccatatctccaatttggtccgtcctttcactttaggccagctaaaggagttgttggggcgcacaggaaccttggtggaagaggccttctggattgacaagatcaaatctcattgctttgtaacgtactcaacagtagaggaagctgttgccacccgcacagctctgcacggggtcaaatggccccagtccaatcccaaattcctttgtgctgactatgccgagcaagatgagctggattatcaccgaggcctcttggtggaccgtccctctgaaactaagacagaggagcagggaataccacggcccctgcaccccccacccccacccccggtccagccaccacagcacccccgggcagagcagcgggagcaggaacgggcagtgcgggaacagtgggcagaacgggaacgggaaatggagcggcgggagcggactcgatcagagcgtgaatgggatcgggacaaagttcgagaagggccccgttcccgatcaaggtcccgtgaccgccgccgcaaggaacgtgcgaagtctaaagaaaagaagagtgagaagaaagagaaagcccaggaggaaccacctgccaagctgctggatgaccttttccgaaagaccaaggcagctccctgcatctattggctcccactgactgacagccagatcgttcagaaagaggcagagcgggccgaacgggccaaggagcgggagaagcggcgaaaggagcaagaagaagaagagcaaaaggagcgggagaaggaagccgagcgggaacggaaccgacagctggagcgagagaaacgtcgggagcacagtcgggagagggacagggagagagagagagaaagggagcgggacaggggggaccgagatcgggatagggaaagggaccgagaacgaggcagggaaagggatcgcagggacaccaagcgccacagcagaagccggagtcggagcacacctgtgcgggaccggggtgggcgccgctagctgggaaaacactagagctgcaggtaccagccactcggccccagggggttatggccacagagggataggcacagtctccaccaccctggagccaagggtctttcacatcacctatccctacatacataccaaatggaaaagtggccatccttttccccccaaacacacccccttaacctatctcttgggacttagcccgaccctccctctcatttcccattaagtctgagaggcaagagctaggttaggcaaggaggtggttggccagagatggggaacagccaggtgccccagtcctctgatttttcctccatcctgcttaccacctccctgggtacttacagccttctcttgggaacagccggggccaggactgggtcacctatgagctgaatcagcatctcctcctgagtcccagggcccctgcagttcccagtctcttctgtcctgcagcccttgcctctttcccacaggttccactttatatccaccttttccttttgttcaatttttatttttattttttttattattaaatgatgtggtctatggaaaaaaaaataaaaatctgacttagttttaaa

SEQ ID NO: 356087 - DNA, 2647 bp, Homo sapiens
gccgaatggctcggacctgcagctctagtgttctcccagctagcggcgcccaccccggtcccgcacaggtgtgctccgactccggcttctgctgtggcgcttggtgtcctctcgactcagacggtgaaagagggggtatgaccaacatctttagggggctgagaggctactgaactcctcttccagcttatttctggttaagctaatacacaggtgtgatacggagtagatgacttttccctgctctgatgtttagttttatttttttctctaacttgcattgattctgcttcgtttttgccgtttgccgcttctgttttggtctctgtctgtctctgtgtctctctctgtctctctctctcactctatctgtgtctttggaggctaagctaagactgccccatctaacctccttcccccctctctgtggggtgtctctctttctcttttttttcccctttttcttcttcatacagagctcgctgcccaaatcattcaagaggaagatctccgttgtctcagctaccaagggggtgccagctggaaacagtgacacagaggggggccagcctggtcggaaacgacgctggggagccagcacagccaccacacagaagaaaccttccatcagtatcaccactgaatcactaaagagcctcatccccgacatcaaacccctggcggggcaggaggctgttgtggatcttcatgctgatgactctcgcatctctgaggatgagacagagcgtaatggcgatgatgggacccatgacaaggggctgaaaatatgccggacagtcactcaggtagtacctgcagagggccaggagaatgggcagagggaagaagaggaagaagagaaggaacctgaagcagaacctcctgtacctccccaggtgtcagtagaggtggccttgcccccacctgcagagcatgaagtaaagaaagtgactttaggagataccttaactcgacgttccattagccagcagaagtccggagtttccattaccattgatgacccagtccgaactgcccaggtgccctccccaccccggggcaagattagcaacattgtccatatctccaatttggtccgtcctttcactttaggccagctaaaggagttgttggggcgcacaggaaccttggtggaagaggccttctggattgacaagatcaaatctcattgctttgtaacgtactcaacagtagaggaagctgttgccacccgcacagctctgcacggggtcaaatggccccagtccaatcccaaattcctttgtgctgactatgccgagcaagatgagctggattatcaccgaggcctcttggtggaccgtccctctgaaactaagacagaggagcagggaataccacggcccctgcaccccccacccccacccccggtccagccaccacagcacccccgggcagagcagcgggagcaggaacgggcagtgcgggaacagtgggcagaacgggaacgggaaatggagcggcgggagcggactcgatcagagcgtgaatgggatcgggacaaagttcgagaagggccccgttcccgatcaaggtcccgtgaccgccgccgcaaggaacgtgcgaagtctaaagaaaagaagagtgagaagaaagagaaagcccaggaggaaccacctgccaagctgctggatgaccttttccgaaagaccaaggcagctccctgcatctattggctcccactgactgacagccagatcgttcagaaagaggcagagcgggccgaacgggccaaggagcgggagaagcggcgaaaggagcaagaagaagaagagcaaaaggagcgggagaaggaagccgagcgggaacggaaccgacagctggagcgagagaaacgtcgggagcacagtcgggagagggacagggagagagagagagaaagggagcgggacaggggggaccgagatcgggatagggaaagggaccgagaacgaggcagggaaagggatcgcagggacaccaagcgccacagcagaagccggagtcggagcacacctgtgcgggaccggggtgggcgccgctagctgggaaaacactagagctgcaggtaccagccactcggccccagggggttatggccacagagggataggcacagtctccaccaccctggagccaagggtctttcacatcacctatccctacatacataccaaatggaaaagtggccatccttttccccccaaacacacccccttaacctatctcttgggacttagcccgaccctccctctcatttcccattaagtctgagaggcaagagctaggttaggcaaggaggtggttggccagagatggggaacagccaggtgccccagtcctctgatttttcctccatcctgcttaccacctccctgggtacttacagccttctcttgggaacagccggggccaggactgggtcacctatgagctgaatcagcatctcctcctgagtcccagggcccctgcagttcccagtctcttctgtcctgcagcccttgcctctttcccacaggttccactttatatccaccttttccttttgttcaatttttatttttattttttttattattaaatgatgtggtctatggaaaaaaaaataaaaatctgacttagttttaaa

SEQ ID NO: 356088 - DNA, 2506 bp, Homo sapiens
gagtgcagtcagtggcaccatcttggctcactgcagcctccgcctcccgggttcaagcaattctgcttcagcaccctgagtagctgggattacaggcatgcaccacaacgcctggctaatttttgtatttttagtagagatggggtttcaccatgttggtcaggctagtctcaaactcctgacctcgtgatccacccgccttggcctcccaaagtgctgggattacaggtgtgagccaccacactcagcctccaaatatgatttctttaagttaaccttttaccaaaactccagccagaggtaacctgtaggtattacggtttgaactagcagaggtcctgagaccatctaactgttgggtctatttcttggggacagcagctaccaagggggtgccagctggaaacagtgacacagaggggggccagcctggtcggaaacgacgctggggagccagcacagccaccacacagaagaaaccttccatcagtatcaccactgaatcactaaagagcctcatccccgacatcaaacccctggcggggcaggaggctgttgtggatcttcatgctgatgactctcgcatctctgaggatgagacagagcgtaatggcgatgatgggacccatgacaaggggctgaaaatatgccggacagtcactcaggtagtacctgcagagggccaggagaatgggcagagggaagaagaggaagaagagaaggaacctgaagcagaacctcctgtacctccccaggtgtcagtagaggtggccttgcccccacctgcagagcatgaagtaaagaaagtgactttaggagataccttaactcgacgttccattagccagcagaagtccggagtttccattaccattgatgacccagtccgaactgcccaggtgccctccccaccccggggcaagattagcaacattgtccatatctccaatttggtccgtcctttcactttaggccagctaaaggagttgttggggcgcacaggaaccttggtggaagaggccttctggattgacaagatcaaatctcattgctttgtaacgtactcaacagtagaggaagctgttgccacccgcacagctctgcacggggtcaaatggccccagtccaatcccaaattcctttgtgctgactatgccgagcaagatgagctggattatcaccgaggcctcttggtggaccgtccctctgaaactaagacagaggagcagggaataccacggcccctgcaccccccacccccacccccggtccagccaccacagcacccccgggcagagcagcgggagcaggaacgggcagtgcgggaacagtgggcagaacgggaacgggaaatggagcggcgggagcggactcgatcagagcgtgaatgggatcgggacaaagttcgagaagggccccgttcccgatcaaggtcccgtgaccgccgccgcaaggaacgtgcgaagtctaaagaaaagaagagtgagaagaaagagaaagcccaggaggaaccacctgccaagctgctggatgaccttttccgaaagaccaaggcagctccctgcatctattggctcccactgactgacagccagatcgttcagaaagaggcagagcgggccgaacgggccaaggagcgggagaagcggcgaaaggagcaagaagaagaagagcaaaaggagcgggagaaggaagccgagcgggaacggaaccgacagctggagcgagagaaacgtcgggagcacagtcgggagagggacagggagagagagagagaaagggagcgggacaggggggaccgagatcgggatagggaaagggaccgagaacgaggcagggaaagggatcgcagggacaccaagcgccacagcagaagccggagtcggagcacacctgtgcgggaccggggtgggcgccgctagctgggaaaacactagagctgcaggtaccagccactcggccccagggggttatggccacagagggataggcacagtctccaccaccctggagccaagggtctttcacatcacctatccctacatacataccaaatggaaaagtggccatccttttccccccaaacacacccccttaacctatctcttgggacttagcccgaccctccctctcatttcccattaagtctgagaggcaagagctaggttaggcaaggaggtggttggccagagatggggaacagccaggtgccccagtcctctgatttttcctccatcctgcttaccacctccctgggtacttacagccttctcttgggaacagccggggccaggactgggtcacctatgagctgaatcagcatctcctcctgagtcccagggcccctgcagttcccagtctcttctgtcctgcagcccttgcctctttcccacaggttccactttatatccaccttttccttttgttcaatttttatttttattttttttattattaaatgatgtggtctatggaaaaaaaaataaaaatctgacttagttttaaa

SEQ ID NO: 356089 - DNA, 2470 bp, Homo sapiens
gagtgcagtcagtggcaccatcttggctcactgcagcctccgcctcccgggttcaagcaattctgcttcagcaccctgagtagctgggattacaggcatgcaccacaacgcctggctaatttttgtatttttagtagagatggggtttcaccatgttggtcaggctagtctcaaactcctgacctcgtgatccacccgccttggcctcccaaagtgctgggattacaggtgtgagccaccacactcagcctccaaatatgatttctttaagttaaccttttaccaaaactccagccagaggtaacctgtaggtattacggtttgaactagcagaggtcctgagaccatctaactgttgggtctatttcttggggacagcagctaccaagggggtgccagctggaaacagtgacacagaggggggccagcctggtcggaaacgacgctggggagccagcacagccaccacacagaagaaaccttccatcagtatcaccactgaatcactaaaggaggctgttgtggatcttcatgctgatgactctcgcatctctgaggatgagacagagcgtaatggcgatgatgggacccatgacaaggggctgaaaatatgccggacagtcactcaggtagtacctgcagagggccaggagaatgggcagagggaagaagaggaagaagagaaggaacctgaagcagaacctcctgtacctccccaggtgtcagtagaggtggccttgcccccacctgcagagcatgaagtaaagaaagtgactttaggagataccttaactcgacgttccattagccagcagaagtccggagtttccattaccattgatgacccagtccgaactgcccaggtgccctccccaccccggggcaagattagcaacattgtccatatctccaatttggtccgtcctttcactttaggccagctaaaggagttgttggggcgcacaggaaccttggtggaagaggccttctggattgacaagatcaaatctcattgctttgtaacgtactcaacagtagaggaagctgttgccacccgcacagctctgcacggggtcaaatggccccagtccaatcccaaattcctttgtgctgactatgccgagcaagatgagctggattatcaccgaggcctcttggtggaccgtccctctgaaactaagacagaggagcagggaataccacggcccctgcaccccccacccccacccccggtccagccaccacagcacccccgggcagagcagcgggagcaggaacgggcagtgcgggaacagtgggcagaacgggaacgggaaatggagcggcgggagcggactcgatcagagcgtgaatgggatcgggacaaagttcgagaagggccccgttcccgatcaaggtcccgtgaccgccgccgcaaggaacgtgcgaagtctaaagaaaagaagagtgagaagaaagagaaagcccaggaggaaccacctgccaagctgctggatgaccttttccgaaagaccaaggcagctccctgcatctattggctcccactgactgacagccagatcgttcagaaagaggcagagcgggccgaacgggccaaggagcgggagaagcggcgaaaggagcaagaagaagaagagcaaaaggagcgggagaaggaagccgagcgggaacggaaccgacagctggagcgagagaaacgtcgggagcacagtcgggagagggacagggagagagagagagaaagggagcgggacaggggggaccgagatcgggatagggaaagggaccgagaacgaggcagggaaagggatcgcagggacaccaagcgccacagcagaagccggagtcggagcacacctgtgcgggaccggggtgggcgccgctagctgggaaaacactagagctgcaggtaccagccactcggccccagggggttatggccacagagggataggcacagtctccaccaccctggagccaagggtctttcacatcacctatccctacatacataccaaatggaaaagtggccatccttttccccccaaacacacccccttaacctatctcttgggacttagcccgaccctccctctcatttcccattaagtctgagaggcaagagctaggttaggcaaggaggtggttggccagagatggggaacagccaggtgccccagtcctctgatttttcctccatcctgcttaccacctccctgggtacttacagccttctcttgggaacagccggggccaggactgggtcacctatgagctgaatcagcatctcctcctgagtcccagggcccctgcagttcccagtctcttctgtcctgcagcccttgcctctttcccacaggttccactttatatccaccttttccttttgttcaatttttatttttattttttttattattaaatgatgtggtctatggaaaaaaaaataaaaatctgacttagttttaaa

SEQ ID NO: 356090 - DNA, 2603 bp, Homo sapiens
gagtgcagtcagtggcaccatcttggctcactgcagcctccgcctcccgggttcaagcaattctgcttcagcaccctgagtagctgggattacaggcatgcaccacaacgcctggctaatttttgtatttttagtagagatggggtttcaccatgttggtcaggctagtctcaaactcctgacctcgtgatccacccgccttggcctcccaaagtgctgggattacaggtgtgagccaccacactcagcctccaaatatgatttctttaagttaaccttttaccaaaactccagccagaggtaacctgtaggtattacggtttgaactagcagaggtcctgagaccatctaactgttgggtctatttcttggggacagcagctaccaagggggtgccagctggaaacagtgacacagaggggggccagcctggtcggaaacgacgctggggagccagcacagccaccacacagaagaaaccttccatcagtatcaccactgaatcactaaaggtgaggtgggaggagccagggaagggaggatgagacctgttaaggtgggagtagacatgggcccagtgtaacggggtggggggtatctgtgtcccagagcctcatccccgacatcaaacccctggcggggcaggaggctgttgtggatcttcatgctgatgactctcgcatctctgaggatgagacagagcgtaatggcgatgatgggacccatgacaaggggctgaaaatatgccggacagtcactcaggtagtacctgcagagggccaggagaatgggcagagggaagaagaggaagaagagaaggaacctgaagcagaacctcctgtacctccccaggtgtcagtagaggtggccttgcccccacctgcagagcatgaagtaaagaaagtgactttaggagataccttaactcgacgttccattagccagcagaagtccggagtttccattaccattgatgacccagtccgaactgcccaggtgccctccccaccccggggcaagattagcaacattgtccatatctccaatttggtccgtcctttcactttaggccagctaaaggagttgttggggcgcacaggaaccttggtggaagaggccttctggattgacaagatcaaatctcattgctttgtaacgtactcaacagtagaggaagctgttgccacccgcacagctctgcacggggtcaaatggccccagtccaatcccaaattcctttgtgctgactatgccgagcaagatgagctggattatcaccgaggcctcttggtggaccgtccctctgaaactaagacagaggagcagggaataccacggcccctgcaccccccacccccacccccggtccagccaccacagcacccccgggcagagcagcgggagcaggaacgggcagtgcgggaacagtgggcagaacgggaacgggaaatggagcggcgggagcggactcgatcagagcgtgaatgggatcgggacaaagttcgagaagggccccgttcccgatcaaggtcccgtgaccgccgccgcaaggaacgtgcgaagtctaaagaaaagaagagtgagaagaaagagaaagcccaggaggaaccacctgccaagctgctggatgaccttttccgaaagaccaaggcagctccctgcatctattggctcccactgactgacagccagatcgttcagaaagaggcagagcgggccgaacgggccaaggagcgggagaagcggcgaaaggagcaagaagaagaagagcaaaaggagcgggagaaggaagccgagcgggaacggaaccgacagctggagcgagagaaacgtcgggagcacagtcgggagagggacagggagagagagagagaaagggagcgggacaggggggaccgagatcgggatagggaaagggaccgagaacgaggcagggaaagggatcgcagggacaccaagcgccacagcagaagccggagtcggagcacacctgtgcgggaccggggtgggcgccgctagctgggaaaacactagagctgcaggtaccagccactcggccccagggggttatggccacagagggataggcacagtctccaccaccctggagccaagggtctttcacatcacctatccctacatacataccaaatggaaaagtggccatccttttccccccaaacacacccccttaacctatctcttgggacttagcccgaccctccctctcatttcccattaagtctgagaggcaagagctaggttaggcaaggaggtggttggccagagatggggaacagccaggtgccccagtcctctgatttttcctccatcctgcttaccacctccctgggtacttacagccttctcttgggaacagccggggccaggactgggtcacctatgagctgaatcagcatctcctcctgagtcccagggcccctgcagttcccagtctcttctgtcctgcagcccttgcctctttcccacaggttccactttatatccaccttttccttttgttcaatttttatttttattttttttattattaaatgatgtggtctatggaaaaaaaaataaaaatctgacttagttttaaa

SEQ ID NO: 356091 - DNA, 9251 bp, Homo sapiens
  misc_feature (633)..(633): n is a, c, g, or t
  misc_feature (670)..(670): n is a, c, g, or t
  misc_feature (706)..(706): n is a, c, g, or t
  misc_feature (840)..(840): n is a, c, g, or t
gagacggagtcttgctctgtcacccaggctgtagtgcaatggcgtgatctcaaccactgcttcctgggttcaagcgattctcctgcctcagcctcccgagtagctgggactataggcgtacgccaccacgcccggctaatttgtttgtatttttagtagagacggggtttcaccatattggccagactggtctccaactcctgacctcaagtgatccgcccgcctcggcctcccaaagtgctgggattataggcgtaagccaccgcgcccggcaccttgccactgattttgcatcatgaatgcaacggaaagatcagccaatttgactttaatagttttcagtctcttaaatctctaacgtatctcttaaatctctaaactatttgtctgtgacctattttactgtttgtgtttcttctgcatcaagttggaggattggtagtgacaaagaaagaagcccctaaacaattaatattagttcaagtaccaaaaaagttcagggcgcttgcattttccagttcttgccctacaggaagcagttcctccaagggaacttactctcttctgcggagcaaggaagaactttcccagaatcttgccacatggcttccaaggcaaactcaaactcaagtncagcgtcatagatcagttcatagtctgggtccgaagncacggcgatgcttcttgcgcacccccacggagcttnttattccgattccgccagccccccgcccctccccaaaaaaagcctaagatgggagtggctatgattcagaggacagagggcagaagctgtttgcgttaaggagtggggggcttgccctattaaggtaatccgcnaacaccgagtctgacccggcccatagaggtacttctaccccgcttacctccccttttctctcgaagggcacccgaagattgtcacgagtccttagactccaactactgcggcagcttccaaatttcctgaaaaccctaagctgggccagcccggcagcccacgcacttccggcctcggacccgccccaaacacccaagcgccccagcgcctcatctctaggtccggaaataaacgaacatctccgattatggttataccagggtcgagggtttccgaatatattcgattcaaagcttcggcaagacgaagaaaaccgagcctgaaagcagggcgagaaaaggggcgctgcagggcggatggaaagaattgattggtaacgatgtggagacggaaacatccgaggacatccggaggaacccggggagttctgagtggtaatcgaggggtagagtatggcagtgggcggggtcatctcggtacgttcgaagggcgttggcggaaattaccgaagatgcccgaagccgtcgggacggacccgagtacctcacgcaagatggcggagctggaggaggtgactctggacgggaagcctcttcaggcgctgcgggtgaccgacctgaaggccgcactggagcagcgaggcctagccaagagcgggcagaagagtgccctggtcaagcggctcaaaggggctctaatgctagaaaatttacagaaacactcaacaccccatgctgcattccagccaaattcccagattggtgaggaaatgagccagaacagtttcataaaacagtatctggaaaagcagcaggagctacttaggcagcgtctggaacgtgaagctcgagaagctgcagaacttgaagaagcttcagctgagtcggaggacgagatgatccatcctgagggagtggcttccctgctgcctcctgactttcagagcagcctggagagaccagagctggagctcagcagacattcgcccagaaaaagctcctcaatttctgaagagaaaggtgactctgatgatgagaaaccaaggaaaggagaaagacgatcatctagggtcagacaggcaagagcagctaaactgtctgagggcagccaacctgctgaggaggaagaggatcaagaaacaccttccagaaacctaagggtcagagcagatcgaaatttgaaaacagaggaggaagaagaggaggaggaggaggaggaagaagatgatgaagaagaggaaggtgatgatgagggacaaaaatctagggaggcaccaatcctgaaagagtttaaggaagaaggggaagagatacctagagtaaaaccagaggagatgatggatgagagacccaaaacaagatcccaggaacaggaggtgttagagagaggagggagatttacaagatcccaggaagaggctagaaaaagtcatctggccagacagcagcaggagaaggaaatgaaaacaacatctccccttgaggaggaagaaagagaaataaaatcttcacaaggcttaaaggaaaaatcgaagtctccttcccctcctcgactgactgaagatcgaaagaaggcctcacttgtagcgctgccagagcaaactgccagcgaggaggagactcctccacctttactaacaaaggaagcatcttctccaccacctcatccacagctccatagcgaagaagaaatagagcccatggaaggcccagccccccctgtcctcattcagttatctcctcctaatacagatgctgacaccagggagctattagtatctcagcatactgtccagttggtaggaggcctgtctcctttgtcaagtccttcagacaccaaagcagaatctccagcagagaaagtgccagaggagagtgtcctgcctctggttcagaaaagcacactggctgactactcagcccagaaggatcttgaacctgagtcagacagatctgctcagcccctccctctaaaaattgaggaattagcactggccaaaggaatcactgaagaatgtctgaaacagccatctttggaacagaaggaaggcagaagagcttctcatacccttctcccaagccacagattgaaacagtcagctgattcatcctctagccggtcctcctcatcttcctcctccagttctagatcaagatctcgctctcctgacagttcaggttctcggtctcattcaccgctcagatccaagcagagagatgtagcccaggcacgtactcatgccaaccctcgtggtagacccaagatgggctccagatcaacatcagagtccagatcaaggtccgttcacgttcacgttctcgttcagcatcaagcaacagcagaaaatctctgagccctggagtctccagggacagcagcaccagctatactgaaaccaaagatccctcttctggtcaggaggttgcaactccaccagtgccacaactgcaggtctgtgagccaaaggagaggacttccacctcctcatcctctgtccaagcaaggcgtctgagtcagcctgaatcagctgaaaagcatgtgacccagaggttacagcctgagcgggggagcccaaagaagtgtgaagctgaagaggcagagccaccagctgccacacagccccaaacctcagagactcagacctctcatctgccagaatcagaaagaattcatcacactgttgaggagaaggaggaagtgaccatggacacaagtgaaaacagacctgaaaatgatgttccagaacctcccatgcctattgcagaccaagtcagcaatgatgaccgcccggagggcagtgttgaagatgaggagaagaaagaggtaaacatccaagccacctattggggcgggtgggcaggaatggacctaggggaaagagtagagcactctagtgatccctcttacacggtgggttaacttaaaggagggatgaggcagggacttggatcagaatagggccaagggagaattcgctggtttagcaagggagaccccttgtgacggggacagggctcattcattttcctttccttgttggggaagtagtgcccagactctagacgtttgtaactaacgggaaagtctgataatggccctttatctaagatttatgttcagcttttcctgctgtcttcccaagcttctcctggtggtaactcctttagctttccctcctttttaaaagcctgatggagcccaacgccatctagtggacattggtggttctcaccagaccagccatgctgagaaatttttgttcctcctctgccctccagtggtctgactgcagagatgtagctacttagaagccagcacttgtgatccggaaggcccattctcagttacctgtgacccctctacctccttttttggcatatgttatcttgtgtcctgcacccacttcagggggcttcccccatcagagccagcgaagtcttcttggctcttaaagtaattgagaaagaatgagctgggtttaggagaggggtaacaaggtgggagggactgttgtgtgtgtagcctttttctggtgtgtgttgcgggggtgggggccggtgaaagtgatttgatgtgcagaatattatttattacaaggtccttcttccccgtaaaactttgtccaagtacctcatgtacggtaatccgcccgtaaaatataaccctgcccaactggccaatcgctgatgccgcctcttcctctggacccacccgctgctactgagctgcccaatcagagccaagtctgctatccaggtgtcttggccagaggggggcatgtatatgggctcctgtgatgggcccccttttgcctccctgtcttgcttacatcagggggccaagaagaacactgttctggagagacttgtattgagcaagcaaaaaacatttggaaaggggtggacttgcatcatctccctacttgggacaccccaagaagagcttgtgccagtgctggggcgcctgcccacatgcccttgcccttttgaggactgtgggttgccttgtttgctacagactgttgggatccccatctagggcaccaagacctcctaaagtttgtgatcgcagtgccatgctgtaaaacactgagtgggaccctctacttaagctgtgacgactaggaaccgtgcagaggagtctagggtctgagcccctggggatttaatgctgatgacagcccagcccatgtgtcaccacttgctcatcagatggactttcctttggtccctgttgtccatggtgaagggcagcatgttggttgctccaacttctcctccatccctggaggcagggactcatttcatccacctgactggaaccactgtctcagctggagtccctgaggagatgccagccacaactctccgaagagaagtattctgaccttgctgctgaatgtctgccaggtcctggggtattcacctacccccaggctaccttcatcagaggctccatgatcccactcggtgagaggaccccctccccagttacaggcagaggagaaagggactctggagtcatcacctggattccaagtattgggtggtgttattgctgcagcttgccactggtggacatagggtcctgcctgcctctcacgataaaaggcaaggatcattcctgctactcacaggccatctcatcagggactgcaagatgatgtcccttcagggccaggactgatgtctctgcccctttcccccctctatccctcgctgagcctggccaccgccagtgaactgtcttgacatcatggaaactgggcagcgtccccccacacgtttccctcccgccccccctgcgcccctgggaggactctggcagtgccgtgctgactaccacgccgtgcgcccaccttttttgccaacccaaccccccaccaattgcacagcgcctagcagggagggctcattctgattggaccggcggttgactagatacagtccccacagtgaggtgcgattggctgaactgaagatcccaggtgtgagatggtacctggaacatttgtcatattcctagtttattttcttctttattttcttcttctttttttaatattttattttattttttttctatatctttattttttctgatttcttttatttatttatttggttcatgtttttcctgttttaattaagacctttttttttgttttgtttttctcactaacttacccatcgagagcggcccagctaggggtcaggctggcccttaacagagaccaaggagacttggttagacgacacaaacggggctgcgggtgggggtggatgggaaagggatttcatcacgaggtttctgccctaccctttagaagagtggtagagtggtcttagtttttccagaaataagcacctacacttgaaaatactctattccctttttctctctcacttttctcccccgccccccatagtctttcgtcattcacccactgagtgtttggggtagagacttgtcccaaagatgtcttctggtctttggcagagcccctaaggcttgagccctggttggagaggaaacagtaagactctgctggagctccctgcggtggctggaaagtctaaggatctccttggggacaatctgcccttcataaaaaccttcctttatcaaagacacctttgagttctttttgctagcacttggctcaagagcctcatctccagtgggtctggtgctgcccttttccacagtgtggtgggggtctgggcagtcttgacatgacagtctgctgtccaagcatctcaaagccattgtcagtgggcatcagtctggccattgaagaaaggagggttaccttgttgaagttgccatccaaagttggttttccttgtttcctcgagttagcaaggaaggacctgggaggactagatgacccagtttggggcacagtttgtttggcttggtgtcctctcgactcagacggtgaaagagggggtatgaccaacatctttagggggctgagaggctactgaactcctcttccagcttatttctggttaagctaatacacaggtgtgatacggagtagatgacttttccctgctctgatgtttagttttatttttttctctaacttgcattgattctgcttcgtttttgccgtttgccgcttctgttttggtctctgtctgtctctgtgtctctctctgtctctctctctcactctatctgtgtctttggaggctaagctaagactgccccatctaacctccttcccccctctctgtggggtgtctctctttctcttttttttcccctttttcttcttcatacagagctcgctgcccaaatcattcaagaggaagatctccgttgtctcagctaccaagggggtgccagctggaaacagtgacacagaggggggccagcctggtcggaaacgacgctggggagccagcacagccaccacacagaagaaaccttccatcagtatcaccactgaatcactaaagagcctcatccccgacatcaaacccctggcggggcaggaggctgttgtggatcttcatgctgatgactctcgcatctctgaggatgagacagagcgtaatggcgatgatgggacccatgacaaggggctgaaaatatgccggacagtcactcaggtagtacctgcagagggccaggagaatgggcagagggaagaagaggaagaagagaaggaacctgaagcagaacctcctgtacctccccaggtgtcagtagaggtggccttgcccccacctgcagagcatgaagtaaagaaagtgactttaggagataccttaactcgacgttccattagccagcagaagtccggagtttccattaccattgatgacccagtccgaactgcccaggtgccctccccaccccggggcaagattagcaacattgtccatatctccaatttggtccgtcctttcactttaggccagctaaaggagttgttggggcgcacaggaaccttggtggaagaggccttctggattgacaagatcaaatctcattgctttgtaacgtactcaacagtagaggaagctgttgccacccgcacagctctgcacggggtcaaatggccccagtccaatcccaaattcctttgtgctgactatgccgagcaagatgagctggattatcaccgaggcctcttggtggaccgtccctctgaaactaagacagaggagcagggaataccacggcccctgcaccccccacccccacccccggtccagccaccacagcacccccgggcagagcagcgggagcaggaacgggcagtgcgggaacagtgggcagaacgggaacgggaaatggagcggcgggagcggactcgatcagagcgtgaatgggatcgggacaaagttcgagaagggccccgttcccgatcaaggtcccgtgaccgccgccgcaaggaacgtgcgaagtctaaagaaaagaagagtgagaagaaagagaaagcccaggaggaaccacctgccaagctgctggatgaccttttccgaaagaccaaggcagctccctgcatctattggctcccactgactgacagccagatcgttcagaaagaggcagagcgggccgaacgggccaaggagcgggagaagcggcgaaaggagcaagaagaagaagagcaaaaggagcgggagaaggaagccgagcgggaacggaaccgacagctggagcgagagaaacgtcgggagcacagtcgggagagggacagggagagagagagagaaagggagcgggacaggggggaccgagatcgggatagggaaagggaccgagaacgaggcagggaaagggatcgcagggacaccaagcgccacagcagaagccggagtcggagcacacctgtgcgggaccggggtgggcgccgctagctgggaaaacactagagctgcaggtaccagccactcggccccagggggttatggccacagagggataggcacagtctccaccaccctggagccaagggtctttcacatcacctatccctacatacataccaaatggattagcccgaccctccctctcatttcccattaagtctgagaggcaagagctaggttaggcaaggaggtggttggccagagatggggaacagccaggtgccccagtcctctgatttttcctccatcctgcttaccacctccctgggtacttacagccttctcttgggaacagccggggccaggactgggtcacctatgagctgaatcagcatctcctcctgagtcccagggcccctgcagttcccagtctcttctgtcctgcagcccttgcctctttcccacaggttccactttatatccaccttttccttttgttcaatttttatttttattttttttattattaaatgatgtggtctatggaaaaaaaaataaaaatctgacttagttttaaa

SEQ ID NO: 356092 - DNA, 1991 bp, Homo sapiens
tgtctcagtttcgggacgcatatctccaatttggtaagtcattgtttctcaccatcccagcttgcttagtggttaagtttgagctttaggcttatgcctcctaggttccactcatagttgaactggtctaccaatagattaagttactcactgatcttgagtgagttacttaacatatttacccatctaaaaatgagggggaaaagctgttgccctgcagggttgttttgaggacttgcagaaggcctcacatacaacgtctcaattagtgctgggaagcaccaccactcttctcacattcttactgcaaggttcctaaactctctgccctcccccaaaccttgaaactatactcctgtgacagcagctcgggaaatctaaagattgggtggtggtcttgccttctgctagaccctgaaagtctattttcattggcaggtccgtcctttcactttaggccagctaaaggagttgttggggcgcacaggaaccttggtggaagaggccttctggattgacaagatcaaatctcattgctttgtaacgtactcaacagtagaggaagctgttgccacccgcacagctctgcacggggtcaaatggccccagtccaatcccaaattcctttgtgctgactatgccgagcaagatgagctggattatcaccgaggcctcttggtggaccgtccctctgaaactaagacagaggagcagggaataccacggcccctgcaccccccacccccacccccggtccagccaccacagcacccccgggcagagcagcgggagcaggaacgggcagtgcgggaacagtgggcagaacgggaacgggaaatggagcggcgggagcggactcgatcagagcgtgaatgggatcgggacaaagttcgagaagggccccgttcccgatcaaggtcccgtgaccgccgccgcaaggaacgtgcgaagtctaaagaaaagaagagtgagaagaaagagaaagcccaggaggaaccacctgccaagctgctggatgaccttttccgaaagaccaaggcagctccctgcatctattggctcccactgactgacagccagatcgttcagaaagaggcagagcgggccgaacgggccaaggagcgggagaagcggcgaaaggagcaagaagaagaagagcaaaaggagcgggagaaggaagccgagcgggaacggaaccgacagctggagcgagagaaacgtcgggagcacagtcgggagagggacagggagagagagagagaaagggagcgggacaggggggaccgagatcgggatagggaaagggaccgagaacgaggcagggaaagggatcgcagggacaccaagcgccacagcagaagccggagtcggagcacacctgtgcgggaccggggtgggcgccgctagctgggaaaacactagagctgcaggtaccagccactcggccccagggggttatggccacagagggataggcacagtctccaccaccctggagccaagggtctttcacatcacctatccctacatacataccaaatggaaaagtggccatccttttccccccaaacacacccccttaacctatctcttgggacttagcccgaccctccctctcatttcccattaagtctgagaggcaagagctaggttaggcaaggaggtggttggccagagatggggaacagccaggtgccccagtcctctgatttttcctccatcctgcttaccacctccctgggtacttacagccttctcttgggaacagccggggccaggactgggtcacctatgagctgaatcagcatctcctcctgagtcccagggcccctgcagttcccagtctcttctgtcctgcagcccttgcctctttcccacaggttccactttatatccaccttttccttttgttcaatttttatttttattttttttattattaaatgatgtggtctatggaaaaaaaaataaaaatctgacttagttttaaa

SEQ ID NO: 356093 - DNA, 1392 bp, Homo sapiens
  misc_feature (101)..(101): n is a, c, g, or t
  misc_feature (124)..(125): n is a, c, g, or t
  misc_feature (128)..(128): n is a, c, g, or t
  misc_feature (130)..(130): n is a, c, g, or t
tccattaaccccaacccatttattaatttaactccctcattatccccccaactttacattttaaactcccattcctaccttactcaaaatttaacaaatancaatttccacaatattcacttanncantnacgcaccccccacccccacccccggtccagccaccacagcacccccgggcagagcagcgggagcaggaacgggcagtgcgggaacagtgggcagaacgggaacgggaaatggagcggcgggagcggactcgatcagagcgtgaatgggatcgggacaaagttcgagaagggccccgttcccgatcaaggtcccgtgaccgccgccgcaaggaacgtgcgaagtctaaagaaaagaagagtgagaagaaagagaaagcccaggaggaaccacctgccaagctgctggatgaccttttccgaaagaccaaggcagctccctgcatctattggctcccactgactgacagccagatcgttcagaaagaggcagagcgggccgaacgggccaaggagcgggagaagcggcgaaaggagcaagaagaagaagagcaaaaggagcgggagaaggaagccgagcgggaacggaaccgacagctggagcgagagaaacgtcgggagcacagtcgggagagggacagggagagagagagagaaagggagcgggacaggggggaccgagatcgggatagggaaagggaccgagaacgaggcagggaaagggatcgcagggacaccaagcgccacagcagaagccggagtcggagcacacctgtgcgggaccggggtgggcgccgctagctgggaaaacactagagctgcaggtaccagccactcggccccagggggttatggccacagagggataggcacagtctccaccaccctggagccaagggtctttcacatcacctatccctacatacataccaaatggaaaagtggccatccttttccccccaaacacacccccttaacctatctcttgggacttagcccgaccctccctctcatttcccattaagtctgagaggcaagagctaggttaggcaaggaggtggttggccagagatggggaacagccaggtgccccagtcctctgatttttcctccatcctgcttaccacctccctgggtacttacagccttctcttgggaacagccggggccaggactgggtcacctatgagctgaatcagcatctcctcctgagtcccagggcccctgcagttcccagtctcttctgtcctgcagcccttgcctctttcccacaggttccactttatatccaccttttccttttgttcaatttttatttttattttttttattattaaatgatgtggtctatggaaaaaaaaataaaaatctgacttagttttaaa

SEQ ID NO: 356094 - DNA, 1334 bp, Homo sapiens
gagtgcagtcagtggcaccatcttggctcactgcagcctccgcctcccgggttcaagcaattctgcttcagcaccctgagtagctgggattacaggcatgcaccacaacgcctggctaatttttgtatttttagtagagatggggtttcaccatgttggtcaggctagtctcaaactcctgacctcgtgatccacccgccttggcctcccaaagtgctgggattacaggtgtgagccaccacactcagcctccaaatatgatttctttaagttaaccttttaccaaaactccagccagaggtaacctgtaggtattacggtttgaactagcagaggtcctgagaccatctaatgctggatgaccttttccgaaagaccaaggcagctccctgcatctattggctcccactgactgacagccagatcgttcagaaagaggcagagcgggccgaacgggccaaggagcgggagaagcggcgaaaggagcaagaagaagaagagcaaaaggagcgggagaaggaagccgagcgggaacggaaccgacagctggagcgagagaaacgtcgggagcacagtcgggagagggacagggagagagagagagaaagggagcgggacaggggggaccgagatcgggatagggaaagggaccgagaacgaggcagggaaagggatcgcagggacaccaagcgccacagcagaagccggagtcggagcacacctgtgcgggaccggggtgggcgccgctagctgggaaaacactagagctgcaggtaccagccactcggccccagggggttatggccacagagggataggcacagtctccaccaccctggagccaagggtctttcacatcacctatccctacatacataccaaatggaaaagtggccatccttttccccccaaacacacccccttaacctatctcttgggacttagcccgaccctccctctcatttcccattaagtctgagaggcaagagctaggttaggcaaggaggtggttggccagagatggggaacagccaggtgccccagtcctctgatttttcctccatcctgcttaccacctccctgggtacttacagccttctcttgggaacagccggggccaggactgggtcacctatgagctgaatcagcatctcctcctgagtcccagggcccctgcagttcccagtctcttctgtcctgcagcccttgcctctttcccacaggttccactttatatccaccttttccttttgttcaatttttatttttattttttttattattaaatgatgtggtctatggaaaaaaaaataaaaatctgacttagttttaaa

SEQ ID NO: 356095 - DNA, 7575 bp, Homo sapiens
  misc_feature (633)..(633): n is a, c, g, or t
  misc_feature (670)..(670): n is a, c, g, or t
  misc_feature (706)..(706): n is a, c, g, or t
  misc_feature (840)..(840): n is a, c, g, or t
  misc_feature (7543)..(7544): n is a, c, g, or t
  misc_feature (7562)..(7562): n is a, c, g, or t
gagacggagtcttgctctgtcacccaggctgtagtgcaatggcgtgatctcaaccactgcttcctgggttcaagcgattctcctgcctcagcctcccgagtagctgggactataggcgtacgccaccacgcccggctaatttgtttgtatttttagtagagacggggtttcaccatattggccagactggtctccaactcctgacctcaagtgatccgcccgcctcggcctcccaaagtgctgggattataggcgtaagccaccgcgcccggcaccttgccactgattttgcatcatgaatgcaacggaaagatcagccaatttgactttaatagttttcagtctcttaaatctctaacgtatctcttaaatctctaaactatttgtctgtgacctattttactgtttgtgtttcttctgcatcaagttggaggattggtagtgacaaagaaagaagcccctaaacaattaatattagttcaagtaccaaaaaagttcagggcgcttgcattttccagttcttgccctacaggaagcagttcctccaagggaacttactctcttctgcggagcaaggaagaactttcccagaatcttgccacatggcttccaaggcaaactcaaactcaagtncagcgtcatagatcagttcatagtctgggtccgaagncacggcgatgcttcttgcgcacccccacggagcttnttattccgattccgccagccccccgcccctccccaaaaaaagcctaagatgggagtggctatgattcagaggacagagggcagaagctgtttgcgttaaggagtggggggcttgccctattaaggtaatccgcnaacaccgagtctgacccggcccatagaggtacttctaccccgcttacctccccttttctctcgaagggcacccgaagattgtcacgagtccttagactccaactactgcggcagcttccaaatttcctgaaaaccctaagctgggccagcccggcagcccacgcacttccggcctcggacccgccccaaacacccaagcgccccagcgcctcatctctaggtccggaaataaacgaacatctccgattatggttataccagggtcgagggtttccgaatatattcgattcaaagcttcggcaagacgaagaaaaccgagcctgaaagcagggcgagaaaaggggcgctgcagggcggatggaaagaattgattggtaacgatgtggagacggaaacatccgaggacatccggaggaacccggggagttctgagtggtaatcgaggggtagagtatggcagtgggcggggtcatctcggtacgttcgaagggcgttggcggaaattaccgaagatgcccgaagccgtcgggacggacccgagtacctcacgcaagatggcggagctggaggaggtgactctggacgggaagcctcttcaggcgctgcgggtgaccgacctgaaggccgcactggagcagcgaggcctagccaagagcgggcagaagagtgccctggtcaagcggctcaaaggggctctaatgctagaaaatttacagaaacactcaacaccccatgctgcattccagccaaattcccagattggtgaggaaatgagccagaacagtttcataaaacagtatctggaaaagcagcaggagctacttaggcagcgtctggaacgtgaagctcgagaagctgcagaacttgaagaagcttcagctgagtcggaggacgagatgatccatcctgagggagtggcttccctgctgcctcctgactttcagagcagcctggagagaccagagctggagctcagcagacattcgcccagaaaaagctcctcaatttctgaagagaaaggtgactctgatgatgagaaaccaaggaaaggagaaagacgatcatctagggtcagacaggcaagagcagctaaactgtctgagggcagccaacctgctgaggaggaagaggatcaagaaacaccttccagaaacctaagggtcagagcagatcgaaatttgaaaacagaggaggaagaagaggaggaggaggaggaggaagaagatgatgaagaagaggaaggtgatgatgagggacaaaaatctagggaggcaccaatcctgaaagagtttaaggaagaaggggaagagatacctagagtaaaaccagaggagatgatggatgagagacccaaaacaagatcccaggaacaggaggtgttagagagaggagggagatttacaagatcccaggaagaggctagaaaaagtcatctggccagacagcagcaggagaaggaaatgaaaacaacatctccccttgaggaggaagaaagagaaataaaatcttcacaaggcttaaaggaaaaatcgaagtctccttcccctcctcgactgactgaagatcgaaagaaggcctcacttgtagcgctgccagagcaaactgccagcgaggaggagactcctccacctttactaacaaaggaagcatcttctccaccacctcatccacagctccatagcgaagaagaaatagagcccatggaaggcccagccccccctgtcctcattcagttatctcctcctaatacagatgctgacaccagggagctattagtatctcagcatactgtccagttggtaggaggcctgtctcctttgtcaagtccttcagacaccaaagcagaatctccagcagagaaagtgccagaggagagtgtcctgcctctggttcagaaaagcacactggctgactactcagcccagaaggatcttgaacctgagtcagacagatctgctcagcccctccctctaaaaattgaggaattagcactggccaaaggaatcactgaagaatgtctgaaacagccatctttggaacagaaggaaggcagaagagcttctcatacccttctcccaagccacagattgaaacagtcagctgattcatcctctagccggtcctcctcatcttcctcctccagttctagatcaagatctcgctctcctgacagttcaggttctcggtctcattcaccgctcagatccaagcagagagatgtagcccaggcacgtactcatgccaaccctcgtggtagacccaagatgggctccagatcaacatcagagtccagatcaaggtccgttcacgttcacgttctcgttcagcatcaagcaacagcagaaaatctctgagccctggagtctccagggacagcagcaccagctatactgaaaccaaagatccctcttctggtcaggaggttgcaactccaccagtgccacaactgcaggtctgtgagccaaaggagaggacttccacctcctcatcctctgtccaagcaaggcgtctgagtcagcctgaatcagctgaaaagcatgtgacccagaggttacagcctgagcgggggagcccaaagaagtgtgaagctgaagaggcagagccaccagctgccacacagccccaaacctcagagactcagacctctcatctgccagaatcagaaagaattcatcacactgttgaggagaaggaggaagtgaccatggacacaagtgaaaacagacctgaaaatgatgttccagaacctcccatgcctattgcagaccaagtcagcaatgatgaccgcccggagggcagtgttgaagatgaggagaagaaagaggtaaacatccaagccacctattggggcgggtgggcaggaatggacctaggggaaagagtagagcactctagtgatccctcttacacggtgggttaacttaaaggagggatgaggcagggacttggatcagaatagggccaagggagaattcgctggtttagcaagggagaccccttgtgacggggacagggctcattcattttcctttccttgttggggaagtagtgcccagactctagacgtttgtaactaacgggaaagtctgataatggccctttatctaagatttatgttcagcttttcctgctgtcttcccaagcttctcctggtggtaactcctttagctttccctcctttttaaaagcctgatggagcccaacgccatctagtggacattggtggttctcaccagaccagccatgctgagaaatttttgttcctcctctgccctccagtggtctgactgcagagatgtagctacttagaagccagcacttgtgatccggaaggcccattctcagttacctgtgacccctctacctccttttttggcatatgttatcttgtgtcctgcacccacttcagggggcttcccccatcagagccagcgaagtcttcttggctcttaaagtaattgagaaagaatgagctgggtttaggagaggggtaacaaggtgggagggactgttgtgtgtgtagcctttttctggtgtgtgttgcgggggtgggggccggtgaaagtgatttgatgtgcagaatattatttattacaaggtccttcttccccgtaaaactttgtccaagtacctcatgtacggtaatccgcccgtaaaatataaccctgcccaactggccaatcgctgatgccgcctcttcctctggacccacccgctgctactgagctgcccaatcagagccaagtctgctatccaggtgtcttggccagaggggggcatgtatatgggctcctgtgatgggcccccttttgcctccctgtcttgcttacatcagggggccaagaagaacactgttctggagagacttgtattgagcaagcaaaaaacatttggaaaggggtggacttgcatcatctccctacttgggacaccccaagaagagcttgtgccagtgctggggcgcctgcccacatgcccttgcccttttgaggactgtgggttgccttgtttgctacagactgttgggatccccatctagggcaccaagacctcctaaagtttgtgatcgcagtgccatgctgtaaaacactgagtgggaccctctacttaagctgtgacgactaggaaccgtgcagaggagtctagggtctgagcccctggggatttaatgctgatgacagcccagcccatgtgtcaccacttgctcatcagatggactttcctttggtccctgttgtccatggtgaagggcagcatgttggttgctccaacttctcctccatccctggaggcagggactcatttcatccacctgactggaaccactgtctcagctggagtccctgaggagatgccagccacaactctccgaagagaagtattctgaccttgctgctgaatgtctgccaggtcctggggtattcacctacccccaggctaccttcatcagaggctccatgatcccactcggtgagaggaccccctccccagttacaggcagaggagaaagggactctggagtcatcacctggattccaagtattgggtggtgttattgctgcagcttgccactggtggacatagggtcctgcctgcctctcacgataaaaggcaaggatcattcctgctactcacaggccatctcatcagggactgcaagatgatgtcccttcagggccaggactgatgtctctgcccctttcccccctctatccctcgctgagcctggccaccgccagtgaactgtcttgacatcatggaaactgggcagcgtccccccacacgtttccctcccgccccccctgcgcccctgggaggactctggcagtgccgtgctgactaccacgccgtgcgcccaccttttttgccaacccaaccccccaccaattgcacagcgcctagcagggagggctcattctgattggaccggcggttgactagatacagtccccacagtgaggtgcgattggctgaactgaagatcccaggtgtgagatggtacctggaacatttgtcatattcctagtttattttcttctttattttcttcttctttttttaatattttattttattttttttctatatctttattttttctgatttcttttatttatttatttggttcatgtttttcctgttttaattaagacctttttttttgttttgtttttctcactaacttacccatcgagagcggcccagctaggggtcaggctggcccttaacagagaccaaggagacttggttagacgacacaaacggggctgcgggtgggggtggatgggaaagggatttcatcacgaggtttctgccctaccctttagaagagtggtagagtggtcttagtttttccagaaataagcacctacacttgaaaatactctattccctttttctctctcacttttctcccccgccccccatagtctttcgtcattcacccactgagtgtttggggtagagacttgtcccaaagatgtcttctggtctttggcagagcccctaaggcttgagccctggttggagaggaaacagtaagactctgctggagctccctgcggtggctggaaagtctaaggatctccttggggacaatctgcccttcataaaaaccttcctttatcaaagacacctttgagttctttttgctagcacttggctcaagagcctcatctccagtgggtctggtgctgcccttttccacagtgtggtgggggtctgggcagtcttgacatgacagtctgctgtccaagcatctcaaagccattgtcagtgggcatcagtctggccattgaagaaaggagggttaccttgttgaagttgccatccaaagttggttttccttgtttcctcgagttagcaaggaaggacctgggaggactagatgacccagtttggggcacagtttgtttggcttggtgtcctctcgactcagacggtgaaagagggggtatgaccaacatctttagggggctgagaggctactgaactcctcttccagcttatttctggttaagctaatacacaggtgtgatacggagtagatgacttttccctgctctgatgtttagttttatttttttctctaacttgcattgattctgcttcgtttttgccgtttgccgcttctgttttggtctctgtctgtctctgtgtctctctctgtctctctctctcactctatctgtgtctttggaggctaagctaagactgccccatctaacctccttcccccctctctgtggggtgtctctctttctcttttttttcccctttttcttcttcatacagagctcgctgcccaaatcattcaagaggaagatctccgttgtctcagctaccaagggggtgccagctggaaacagtgacacagaggggggccagcctggtcggaaacgacgctggggagccagcacagccaccacacagaagaaaccttccatcagtatcaccactgaatcactaaagagcctcatccccgacatcaaacccctggcggggcaggaggctgttgtggatcttcatgctgatgactctcgcatctctgaggatgagacagagcgtaatggcgatgatgggacccatgacaaggggctgaaaatatgccggacagtcactcaggtagtacctgcagagggccaggagaatgggcagagggaagaagaggaagaagagaaggaaggaaggagggaaggcccgnnaaggaggggaggaagganggaaggaaggagg

SEQ ID NO: 356096 - DNA, 4364 bp, Homo sapiens
  misc_feature (633)..(633): n is a, c, g, or t
  misc_feature (670)..(670): n is a, c, g, or t
  misc_feature (706)..(706): n is a, c, g, or t
  misc_feature (840)..(840): n is a, c, g, or t
gagacggagtcttgctctgtcacccaggctgtagtgcaatggcgtgatctcaaccactgcttcctgggttcaagcgattctcctgcctcagcctcccgagtagctgggactataggcgtacgccaccacgcccggctaatttgtttgtatttttagtagagacggggtttcaccatattggccagactggtctccaactcctgacctcaagtgatccgcccgcctcggcctcccaaagtgctgggattataggcgtaagccaccgcgcccggcaccttgccactgattttgcatcatgaatgcaacggaaagatcagccaatttgactttaatagttttcagtctcttaaatctctaacgtatctcttaaatctctaaactatttgtctgtgacctattttactgtttgtgtttcttctgcatcaagttggaggattggtagtgacaaagaaagaagcccctaaacaattaatattagttcaagtaccaaaaaagttcagggcgcttgcattttccagttcttgccctacaggaagcagttcctccaagggaacttactctcttctgcggagcaaggaagaactttcccagaatcttgccacatggcttccaaggcaaactcaaactcaagtncagcgtcatagatcagttcatagtctgggtccgaagncacggcgatgcttcttgcgcacccccacggagcttnttattccgattccgccagccccccgcccctccccaaaaaaagcctaagatgggagtggctatgattcagaggacagagggcagaagctgtttgcgttaaggagtggggggcttgccctattaaggtaatccgcnaacaccgagtctgacccggcccatagaggtacttctaccccgcttacctccccttttctctcgaagggcacccgaagattgtcacgagtccttagactccaactactgcggcagcttccaaatttcctgaaaaccctaagctgggccagcccggcagcccacgcacttccggcctcggacccgccccaaacacccaagcgccccagcgcctcatctctaggtccggaaataaacgaacatctccgattatggttataccagggtcgagggtttccgaatatattcgattcaaagcttcggcaagacgaagaaaaccgagcctgaaagcagggcgagaaaaggggcgctgcagggcggatggaaagaattgattggtaacgatgtggagacggaaacatccgaggacatccggaggaacccggggagttctgagtggtaatcgaggggtagagtatggcagtgggcggggtcatctcggtacgttcgaagggcgttggcggaaattaccgaagatgcccgaagccgtcgggacggacccgagtacctcacgcaagatggcggagctggaggaggtgactctggacgggaagcctcttcaggcgctgcgggtgaccgacctgaaggccgcactggagcagcgaggcctagccaagagcgggcagaagagtgccctggtcaagcggctcaaaggggctctaatgctagaaaatttacagaaacactcaacaccccatgctgcattccagccaaattcccagattggtgaggaaatgagccagaacagtttcataaaacagtatctggaaaagcagcaggagctacttaggcagcgtctggaacgtgaagctcgagaagctgcagaacttgaagaagcttcagctgagtcggaggacgagatgatccatcctgagggagtggcttccctgctgcctcctgactttcagagcagcctggagagaccagagctggagctcagcagacattcgcccagaaaaagctcctcaatttctgaagagaaaggtgactctgatgatgagaaaccaaggaaaggagaaagacgatcatctagggtcagacaggcaagagcagctaaactgtctgagggcagccaacctgctgaggaggaagaggatcaagaaacaccttccagaaacctaagggtcagagcagatcgaaatttgaaaacagaggaggaagaagaggaggaggaggaggaggaagaagatgatgaagaagaggaaggtgatgatgagggacaaaaatctagggaggcaccaatcctgaaagagtttaaggaagaaggggaagagatacctagagtaaaaccagaggagatgatggatgagagacccaaaacaagatcccaggaacaggaggtgttagagagaggagggagatttacaagatcccaggaagaggctagaaaaagtcatctggccagacagcagcaggagaaggaaatgaaaacaacatctccccttgaggaggaagaaagagaaataaaatcttcacaaggcttaaaggaaaaatcgaagtctccttcccctcctcgactgactgaagatcgaaagaaggcctcacttgtagcgctgccagagcaaactgccagcgaggaggagactcctccacctttactaacaaaggaagcatcttctccaccacctcatccacagctccatagcgaagaagaaatagagcccatggaaggcccagccccccctgtcctcattcagttatctcctcctaatacagatgctgacaccagggagctattagtatctcagcatactgtccagttggtaggaggcctgtctcctttgtcaagtccttcagacaccaaagcagaatctccagcagagaaagtgccagaggagagtgtcctgcctctggttcagaaaagcacactggctgactactcagcccagaaggatcttgaacctgagtcagacagatctgctcagcccctccctctaaaaattgaggaattagcactggccaaaggaatcactgaagaatgtctgaaacagccatctttggaacagaaggaaggcagaagagcttctcatacccttctcccaagccacagattgaaacagtcagctgattcatcctctagccggtcctcctcatcttcctcctccagttctagatcaagatctcgctctcctgacagttcaggttctcggtctcattcaccgctcagatccaagcagagagatgtagcccaggcacgtactcatgccaaccctcgtggtagacccaagatgggctccagatcaacatcagagtccagatcaaggtccgttcacgttcacgttctcgttcagcatcaagcaacagcagaaaatctctgagccctggagtctccagggacagcagcaccagctatactgaaaccaaagatccctcttctggtcaggaggttgcaactccaccagtgccacaactgcaggtctgtgagccaaaggagaggacttccacctcctcatcctctgtccaagcaaggcgtctgagtcagcctgaatcagctgaaaagcatgtgacccagaggttacagcctgagcgggggagcccaaagaagtgtgaagctgaagaggcagagccaccagctgccacacagccccaaacctcagagactcagacctctcatctgccagaatcagaaagaattcatcacactgtgtaagtgatatatctcgaccggggtataacagggaactatgagtgtgcgatagttcttcgctccctagggttctttgactaagcagtcctagtttccttttaaaacataaaggcagagctttatctggacaaaggctagacttcagttactatgttgggagctgccacctttaaggtaacctgaaaagtggtcgtcagggcacaaggaaaactcacctgggatcatccagccaaaatagtcaactcctttaagatttaggcaatagaagcttctgcttccacactcaaaaccatgtaagggaattgactccgggcatcttaatctttaactcatgtttacctaggaacccagtttaataaaggatattgagggtcttaataaaggcacagctgggtgctattttttagtttgtgcattttccctagttccctagttactacctgtcattaagctatcctagttctgctaggatatcctagttcttacagcatacagtacagcaaattatgaagttcctttcaagtcagaagtttgttcctgggcccttaagaccatttgattgaacttaaaatttatacaattaatgtgagtttttaaaatctttatattaagtcctagagaaatactcatatcaggttaaattagaattaaataggtatgtcattcattcttctgagataggtattataaattaagaagccaatgagccagaattcctggcttcaaagtctcctgggaaatgaaaaaatgaagccttatgggaataagattgcgtagcttttagacatcaggaaccctgaactgctttgtagaatgtcctgtgtagactgttagcctaaag

SEQ ID NO: 356097 - DNA, 3420 bp, Homo sapiens
  misc_feature (633)..(633): n is a, c, g, or t
  misc_feature (670)..(670): n is a, c, g, or t
  misc_feature (706)..(706): n is a, c, g, or t
  misc_feature (840)..(840): n is a, c, g, or t
gagacggagtcttgctctgtcacccaggctgtagtgcaatggcgtgatctcaaccactgcttcctgggttcaagcgattctcctgcctcagcctcccgagtagctgggactataggcgtacgccaccacgcccggctaatttgtttgtatttttagtagagacggggtttcaccatattggccagactggtctccaactcctgacctcaagtgatccgcccgcctcggcctcccaaagtgctgggattataggcgtaagccaccgcgcccggcaccttgccactgattttgcatcatgaatgcaacggaaagatcagccaatttgactttaatagttttcagtctcttaaatctctaacgtatctcttaaatctctaaactatttgtctgtgacctattttactgtttgtgtttcttctgcatcaagttggaggattggtagtgacaaagaaagaagcccctaaacaattaatattagttcaagtaccaaaaaagttcagggcgcttgcattttccagttcttgccctacaggaagcagttcctccaagggaacttactctcttctgcggagcaaggaagaactttcccagaatcttgccacatggcttccaaggcaaactcaaactcaagtncagcgtcatagatcagttcatagtctgggtccgaagncacggcgatgcttcttgcgcacccccacggagcttnttattccgattccgccagccccccgcccctccccaaaaaaagcctaagatgggagtggctatgattcagaggacagagggcagaagctgtttgcgttaaggagtggggggcttgccctattaaggtaatccgcnaacaccgagtctgacccggcccatagaggtacttctaccccgcttacctccccttttctctcgaagggcacccgaagattgtcacgagtccttagactccaactactgcggcagcttccaaatttcctgaaaaccctaagctgggccagcccggcagcccacgcacttccggcctcggacccgccccaaacacccaagcgccccagcgcctcatctctaggtccggaaataaacgaacatctccgattatggttataccagggtcgagggtttccgaatatattcgattcaaagcttcggcaagacgaagaaaaccgagcctgaaagcagggcgagaaaaggggcgctgcagggcggatggaaagaattgattggtaacgatgtggagacggaaacatccgaggacatccggaggaacccggggagttctgagtggtaatcgaggggtagagtatggcagtgggcggggtcatctcggtacgttcgaagggcgttggcggaaattaccgaagatgcccgaagccgtcgggacggacccgagtacctcacgcaagatggcggagctggaggaggtgactctggacgggaagcctcttcaggcgctgcgggtgaccgacctgaaggccgcactggagcagcgaggcctagccaagagcgggcagaagagtgccctggtcaagcggctcaaaggggctctaatgctagaaaatttacagaaacactcaacaccccatgctgcattccagccaaattcccagattggtgaggaaatgagccagaacagtttcataaaacagtatctggaaaagcagcaggagctacttaggcagcgtctggaacgtgaagctcgagaagctgcagaacttgaagaagcttcagctgagtcggaggacgagatgatccatcctgagggagtggcttccctgctgcctcctgactttcagagcagcctggagagaccagagctggagctcagcagacattcgcccagaaaaagctcctcaatttctgaagagaaaggtgactctgatgatgagaaaccaaggaaaggagaaagacgatcatctagggtcagacaggcaagagcagctaaactgtctgagggcagccaacctgctgaggaggaagaggatcaagaaacaccttccagaaacctaagggtcagagcagatcgaaatttgaaaacagaggaggaagaagaggaggaggaggaggaggaagaagatgatgaagaagaggaaggtgatgatgagggacaaaaatctagggaggcaccaatcctgaaagagtttaaggaagaaggggaagagatacctagagtaaaaccagaggagatgatggatgagagacccaaaacaagatcccaggaacaggaggtgttagagagaggagggagatttacaagatcccaggaagaggctagaaaaagtcatctggccagacagcagcaggagaaggaaatgaaaacaacatctccccttgaggaggaagaaagagaaataaaatcttcacaaggcttaaaggaaaaatcgaagtctccttcccctcctcgactgactgaagatcgaaagaaggcctcacttgtagcgctgccagagcaaactgccagcgaggaggagactcctccacctttactaacaaaggaagcatcttctccaccacctcatccacagctccatagcgaagaagaaatagagcccatggaaggcccagccccccctgtcctcattcagttatctcctcctaatacagatgctgacaccagggagctattagtatctcagcatactgtccagttggtaggaggcctgtctcctttgtcaagtccttcagacaccaaagcagaatctccagcagagaaagtgccagaggagagtgtcctgcctctggttcagaaaagcacactggctgactactcagcccagaaggatcttgaacctgagtcagacagatctgctcagcccctccctctaaaaattgaggaattagcactggccaaaggaatcactgaagaatgtctgaaacagccatctttggaacagaaggaaggcagaagagcttctcatacccttctcccaagccacagattgaaacagtcagctgattcatcctctagccggtcctcctcatcttcctcctccagttctagatcaagatctcgctctcctgacagttcaggttctcggtctcattcaccgctcagatccaagcagagagatgtagcccaggcacgtactcatgccaaccctcgtggtagacccaagatgggctccagatcaacatcagagtccagatcaaggtccgttcacgttcacgttctcgttcagcatcaagcaacagcagaaaatctctgagccctggagtctccagggacagcagcaccagctatactgaaaccaaagagaaggcaggcaggaggcccaaatcttccagtgtatacattcttgtgttttctttttcttgtcccagaggctatacagagggaactctgtctcctcctaagcatattggggctgggctgctctggccaggtgcttggcattcctgcagttaacagggagacatctgcgcacttggctt

SEQ ID NO: 356098 - DNA, 903 bp, Homo sapiens
  misc_feature (649)..(649): n is a, c, g, or t
  misc_feature (652)..(652): n is a, c, g, or t
  misc_feature (655)..(655): n is a, c, g, or t
  misc_feature (659)..(659): n is a, c, g, or t
  misc_feature (662)..(662): n is a, c, g, or t
  misc_feature (665)..(665): n is a, c, g, or t
tagagtatcctcgtaagaaagagaaagaaggaaggtgtgttttttttctctatttttttttaggattttttttgtttggtttttgttatttcttccattccagaaagggataaacagcacttccagggggagaaaaaaaatcatgttatcagaaagcaaagaagggtgagagcttcacatttccatgtatgccttttccccgccgccctagctcccttcgtcttccttctctctcctcatggctctcactccgtctttcgttttggcttgctttcactcattctgccttccgtcagtctcattcttcgaggaggtggtgggatcttggaacaaggaaggtgtggtttttttctttatttttttttaggattttttttgtttggtttttgttatttcttccattccagaaagggataaacagcacttccagggggagaaaaaaaatcatgttatcagaaagcaaagaagggtgagagcttcacatttccatgtatgccttttccccgccgccctagctcccttcgtcttccttctcttcctcatggctttcattccgtctttcgttttggtttgttttcagtcattctgccttccttctttctctttcttcgaggaggtggtgggatcttggaacaaggaaggtgtggtnttnttncttnatnttnttttaggattttttttgtttggtttctgctatttcttcccttccagaaagggataaacagcagttccagggcgagaaaaaaaatcatcagatcagataatgacgaagatacgcggtgagagcctcacacgaccatcaatgcctcgctgcccgccgccgtacctccgttcgtggtccatctccgtacgctcatggcatggtcatgtccgtctttcgttctcgggatctttcaatcatta

SEQ ID NO: 356099 - DNA, 7159 bp, Homo sapiens
  misc_feature (633)..(633): n is a, c, g, or t
  misc_feature (670)..(670): n is a, c, g, or t
  misc_feature (706)..(706): n is a, c, g, or t
  misc_feature (840)..(840): n is a, c, g, or t
gagacggagtcttgctctgtcacccaggctgtagtgcaatggcgtgatctcaaccactgcttcctgggttcaagcgattctcctgcctcagcctcccgagtagctgggactataggcgtacgccaccacgcccggctaatttgtttgtatttttagtagagacggggtttcaccatattggccagactggtctccaactcctgacctcaagtgatccgcccgcctcggcctcccaaagtgctgggattataggcgtaagccaccgcgcccggcaccttgccactgattttgcatcatgaatgcaacggaaagatcagccaatttgactttaatagttttcagtctcttaaatctctaacgtatctcttaaatctctaaactatttgtctgtgacctattttactgtttgtgtttcttctgcatcaagttggaggattggtagtgacaaagaaagaagcccctaaacaattaatattagttcaagtaccaaaaaagttcagggcgcttgcattttccagttcttgccctacaggaagcagttcctccaagggaacttactctcttctgcggagcaaggaagaactttcccagaatcttgccacatggcttccaaggcaaactcaaactcaagtncagcgtcatagatcagttcatagtctgggtccgaagncacggcgatgcttcttgcgcacccccacggagcttnttattccgattccgccagccccccgcccctccccaaaaaaagcctaagatgggagtggctatgattcagaggacagagggcagaagctgtttgcgttaaggagtggggggcttgccctattaaggtaatccgcnaacaccgagtctgacccggcccatagaggtacttctaccccgcttacctccccttttctctcgaagggcacccgaagattgtcacgagtccttagactccaactactgcggcagcttccaaatttcctgaaaaccctaagctgggccagcccggcagcccacgcacttccggcctcggacccgccccaaacacccaagcgccccagcgcctcatctctaggtccggaaataaacgaacatctccgattatggttataccagggtcgagggtttccgaatatattcgattcaaagcttcggcaagacgaagaaaaccgagcctgaaagcagggcgagaaaaggggcgctgcagggcggatggaaagaattgattggtaacgatgtggagacggaaacatccgaggacatccggaggaacccggggagttctgagtggtaatcgaggggtagagtatggcagtgggcggggtcatctcggtacgttcgaagggcgttggcggaaattaccgaagatgcccgaagccgtcgggacggacccgagtacctcacgcaagatggcggagctggaggaggtgactctggacgggaagcctcttcaggcgctgcgggtgaccgacctgaaggccgcactggagcagcgaggcctagccaagagcgggcagaagagtgccctggtcaagcggctcaaaggggctctaatgctagaaaatttacagaaacactcaacaccccatgctgcattccagccaaattcccagattggtgaggaaatgagccagaacagtttcataaaacagtatctggaaaagcagcaggagctacttaggcagcgtctggaacgtgaagctcgagaagctgcagaacttgaagaagcttcagctgagtcggaggacgagatgatccatcctgagggagtggcttccctgctgcctcctgactttcagagcagcctggagagaccagagctggagctcagcagacattcgcccagaaaaagctcctcaatttctgaagagaaaggtgactctgatgatgagaaaccaaggaaaggagaaagacgatcatctagggtcagacaggcaagagcagctaaactgtctgagggcagccaacctgctgaggaggaagaggatcaagaaacaccttccagaaacctaagggtcagagcagatcgaaatttgaaaacagaggaggaagaagaggaggaggaggaggaggaagaagatgatgaagaagaggaaggtgatgatgagggacaaaaatctagggaggcaccaatcctgaaagagtttaaggaagaaggggaagagatacctagagtaaaaccagaggagatgatggatgagagacccaaaacaagatcccaggaacaggaggtgttagagagaggagggagatttacaagatcccaggaagaggctagaaaaagtcatctggccagacagcagcaggagaaggaaatgaaaacaacatctccccttgaggaggaagaaagagaaataaaatcttcacaaggcttaaaggaaaaatcgaagtctccttcccctcctcgactgactgaagatcgaaagaaggcctcacttgtagcgctgccagagcaaactgccagcgaggaggagactcctccacctttactaacaaaggaagcatcttctccaccacctcatccacagctccatagcgaagaagaaatagagcccatggaaggcccagccccccctgtcctcattcagttatctcctcctaatacagatgctgacaccagggagctattagtatctcagcatactgtccagttggtaggaggcctgtctcctttgtcaagtccttcagacaccaaagcagaatctccagcagagaaagtgccagaggagagtgtcctgcctctggttcagaaaagcacactggctgactactcagcccagaaggatcttgaacctgagtcagacagatctgctcagcccctccctctaaaaattgaggaattagcactggccaaaggaatcactgaagaatgtctgaaacagccatctttggaacagaaggaaggcagaagagcttctcatacccttctcccaagccacagattgaaacagtcagctgattcatcctctagccggtcctcctcatcttcctcctccagttctagatcaagatctcgctctcctgacagttcaggttctcggtctcattcaccgctcagatccaagcagagagatgtagcccaggcacgtactcatgccaaccctcgtggtagacccaagatgggctccagatcaacatcagagtccagatcaaggtccgttcacgttcacgttctcgttcagcatcaagcaacagcagaaaatctctgagccctggagtctccagggacagcagcaccagctatactgaaaccaaagatccctcttctggtcaggaggttgcaactccaccagtgccacaactgcaggtctgtgagccaaaggagaggacttccacctcctcatcctctgtccaagcaaggcgtctgagtcagcctgaatcagctgaaaagcatgtgacccagaggttacagcctgagcgggggagcccaaagaagtgtgaagctgaagaggcagagccaccagctgccacacagccccaaacctcagagactcagacctctcatctgccagaatcagaaagaattcatcacactgttgaggagaaggaggaagtgaccatggacacaagtgaaaacagacctgaaaatgatgttccagaacctcccatgcctattgcagaccaagtcagcaatgatgaccgcccggagggcagtgttgaagatgaggagaagaaagagtacctcatgtacggtaatccgcccgtaaaatataaccctgcccaactggccaatcgctgatgccgcctcttcctctggacccacccgctgctactgagctgcccaatcagagccaagtctgctatccaggtgtcttggccagaggggggcatgtatatgggctcctgtgatgggcccccttttgcctccctgtcttgcttacatcagggggccaagaagaacactgttctggagagacttgtattgagcaagcaaaaaacatttggaaaggggtggacttgcatcatctccctacttgggacaccccaagaagagcttgtgccagtgctggggcgcctgcccacatgcccttgcccttttgaggactgtgggttgccttgtttgctacagactgttgggatccccatctagggcaccaagacctcctaaagtttgtgatcgcagtgccatgctgtaaaacactgagtgggaccctctacttaagctgtgacgactaggaaccgtgcagaggagtctagggtctgagcccctggggatttaatgctgatgacagcccagcccatgtgtcaccacttgctcatcagatggactttcctttggtccctgttgtccatggtgaagggcagcatgttggttgctccaacttctcctccatccctggaggcagggactcatttcatccacctgactggaaccactgtctcagctggagtccctgaggagatgccagccacaactctccgaagagaagtattctgaccttgctgctgaatgtctgccaggtcctggggtattcacctacccccaggctaccttcatcagaggctccatgatcccactcggtgagaggaccccctccccagttacaggcagaggagaaagggactctggagtcatcacctggattccaagtattgggtggtgttattgctgcagcttgccactggtggacatagggtcctgcctgcctctcacgataaaaggcaaggatcattcctgctactcacaggccatctcatcagggactgcaagatgatgtcccttcagggccaggactgatgtctctgcccctttcccccctctatccctcgctgagcctggccaccgccagtgaactgtcttgacatcatggaaactgggcagcgtccccccacacgtttccctcccgccccccctgcgcccctgggaggactctggcagtgccgtgctgactaccacgccgtgcgcccaccttttttgccaacccaaccccccaccaattgcacagcgcctagcagggagggctcattctgattggaccggcggttgactagatacagtccccacagtgaggtgcgattggctgaactgaagatcccagagctcgctgcccaaatcattcaagaggaagatctccgttgtctcagctaccaagggggtgccagctggaaacagtgacacagaggggggccagcctggtcggaaacgacgctggggagccagcacagccaccacacagaagaaaccttccatcagtatcaccactgaatcactaaaggaggctgttgtggatcttcatgctgatgactctcgcatctctgaggatgagacagagcgtaatggcgatgatgggacccatgacaaggggctgaaaatatgccggacagtcactcaggtagtacctgcagagggccaggagaatgggcagagggaagaagaggaagaagagaaggaacctgaagcagaacctcctgtacctccccaggtgtcagtagaggtggccttgcccccacctgcagagcatgaagtaaagaaagtgactttaggagataccttaactcgacgttccattagccagcagaagtccggagtttccattaccattgatgacccagtccgaactgcccaggtgccctccccaccccggggcaagattagcaacattgtccatatctccaatttggtccgtcctttcactttaggccagctaaaggagttgttggggcgcacaggaaccttggtggaagaggccttctggattgacaagatcaaatctcattgctttgtaacgtactcaacagtagaggaagctgttgccacccgcacagctctgcacggggtcaaatggccccagtccaatcccaaattcctttgtgctgactatgccgagcaagatgagctggattatcaccgaggcctcttggtggaccgtccctctgaaactaagacagaggagcagggaataccacggcccctgcaccccccacccccacccccggtccagccaccacagcacccccgggcagagcagcgggagcaggaacgggcagtgcgggaacagtgggcagaacgggaacgggaaatggagcggcgggagcggactcgatcagagcgtgaatgggatcgggacaaagttcgagaagggccccgttcccgatcaaggtcccgtgaccgccgccgcaaggaacgtgcgaagtctaaagaaaagaagagtgagaagaaagagaaagcccaggaggaaccacctgccaagctgctggatgaccttttccgaaagaccaaggcagctccctgcatctattggctcccactgactgacagccagatcgttcagaaagaggcagagcgggccgaacgggccaaggagcgggagaagcggcgaaaggagcaagaagaagaagagcaaaaggagcgggagaaggaagccgagcgggaacggaaccgacagctggagcgagagaaacgtcgggagcacagtcgggagagggacagggagagagagagagaaagggagcgggacaggggggaccgagatcgggatagggaaagggaccgagaacgaggcagggaaagggatcgcagggacaccaagcgccacagcagaagccggagtcggagcacacctgtgcgggaccggggtgggcgccgctagctgggaaaacactagagctgcaggtaccagccactcggccccagggggttatggccacagagggataggcacagtctccaccaccctggagccaagggtctttcacatcacctatccctacatacataccaaatggaaaagtggccatccttttccccccaaacacacccccttaacctatctcttgggacttagcccgaccctccctctcatttcccattaagtctgagaggcaagagctaggttaggcaaggaggtggttggccagagatggggaacagccaggtgccccagtcctctgatttttcctccatcctgcttaccacctccctgggtacttacagccttctcttgggaacagccggggccaggactgggtcacctatgagctgaatcagcatctcctcctgagtcccagggcccctgcagttcccagtctcttctgtcctgcagcccttgcctctttcccacaggttccactttatatccaccttttccttttgttcaatttttatttttattttttttattattaaatgatgtggtctatggaaaaaaaaataaaaatctgacttagttttaaa

SEQ ID NO: 356100 - DNA, 9305 bp, Homo sapiens
  misc_feature (633)..(633): n is a, c, g, or t
  misc_feature (670)..(670): n is a, c, g, or t
  misc_feature (706)..(706): n is a, c, g, or t
  misc_feature (840)..(840): n is a, c, g, or t
gagacggagtcttgctctgtcacccaggctgtagtgcaatggcgtgatctcaaccactgcttcctgggttcaagcgattctcctgcctcagcctcccgagtagctgggactataggcgtacgccaccacgcccggctaatttgtttgtatttttagtagagacggggtttcaccatattggccagactggtctccaactcctgacctcaagtgatccgcccgcctcggcctcccaaagtgctgggattataggcgtaagccaccgcgcccggcaccttgccactgattttgcatcatgaatgcaacggaaagatcagccaatttgactttaatagttttcagtctcttaaatctctaacgtatctcttaaatctctaaactatttgtctgtgacctattttactgtttgtgtttcttctgcatcaagttggaggattggtagtgacaaagaaagaagcccctaaacaattaatattagttcaagtaccaaaaaagttcagggcgcttgcattttccagttcttgccctacaggaagcagttcctccaagggaacttactctcttctgcggagcaaggaagaactttcccagaatcttgccacatggcttccaaggcaaactcaaactcaagtncagcgtcatagatcagttcatagtctgggtccgaagncacggcgatgcttcttgcgcacccccacggagcttnttattccgattccgccagccccccgcccctccccaaaaaaagcctaagatgggagtggctatgattcagaggacagagggcagaagctgtttgcgttaaggagtggggggcttgccctattaaggtaatccgcnaacaccgagtctgacccggcccatagaggtacttctaccccgcttacctccccttttctctcgaagggcacccgaagattgtcacgagtccttagactccaactactgcggcagcttccaaatttcctgaaaaccctaagctgggccagcccggcagcccacgcacttccggcctcggacccgccccaaacacccaagcgccccagcgcctcatctctaggtccggaaataaacgaacatctccgattatggttataccagggtcgagggtttccgaatatattcgattcaaagcttcggcaagacgaagaaaaccgagcctgaaagcagggcgagaaaaggggcgctgcagggcggatggaaagaattgattggtaacgatgtggagacggaaacatccgaggacatccggaggaacccggggagttctgagtggtaatcgaggggtagagtatggcagtgggcggggtcatctcggtacgttcgaagggcgttggcggaaattaccgaagatgcccgaagccgtcgggacggacccgagtacctcacgcaagatggcggagctggaggaggtgactctggacgggaagcctcttcaggcgctgcgggtgaccgacctgaaggccgcactggagcagcgaggcctagccaagagcgggcagaagagtgccctggtcaagcggctcaaaggggctctaatgctagaaaatttacagaaacactcaacaccccatgctgcattccagccaaattcccagattggtgaggaaatgagccagaacagtttcataaaacagtatctggaaaagcagcaggagctacttaggcagcgtctggaacgtgaagctcgagaagctgcagaacttgaagaagcttcagctgagtcggaggacgagatgatccatcctgagggagtggcttccctgctgcctcctgactttcagagcagcctggagagaccagagctggagctcagcagacattcgcccagaaaaagctcctcaatttctgaagagaaaggtgactctgatgatgagaaaccaaggaaaggagaaagacgatcatctagggtcagacaggcaagagcagctaaactgtctgagggcagccaacctgctgaggaggaagaggatcaagaaacaccttccagaaacctaagggtcagagcagatcgaaatttgaaaacagaggaggaagaagaggaggaggaggaggaggaagaagatgatgaagaagaggaaggtgatgatgagggacaaaaatctagggaggcaccaatcctgaaagagtttaaggaagaaggggaagagatacctagagtaaaaccagaggagatgatggatgagagacccaaaacaagatcccaggaacaggaggtgttagagagaggagggagatttacaagatcccaggaagaggctagaaaaagtcatctggccagacagcagcaggagaaggaaatgaaaacaacatctccccttgaggaggaagaaagagaaataaaatcttcacaaggcttaaaggaaaaatcgaagtctccttcccctcctcgactgactgaagatcgaaagaaggcctcacttgtagcgctgccagagcaaactgccagcgaggaggagactcctccacctttactaacaaaggaagcatcttctccaccacctcatccacagctccatagcgaagaagaaatagagcccatggaaggcccagccccccctgtcctcattcagttatctcctcctaatacagatgctgacaccagggagctattagtatctcagcatactgtccagttggtaggaggcctgtctcctttgtcaagtccttcagacaccaaagcagaatctccagcagagaaagtgccagaggagagtgtcctgcctctggttcagaaaagcacactggctgactactcagcccagaaggatcttgaacctgagtcagacagatctgctcagcccctccctctaaaaattgaggaattagcactggccaaaggaatcactgaagaatgtctgaaacagccatctttggaacagaaggaaggcagaagagcttctcatacccttctcccaagccacagattgaaacagtcagctgattcatcctctagccggtcctcctcatcttcctcctccagttctagatcaagatctcgctctcctgacagttcaggttctcggtctcattcaccgctcagatccaagcagagagatgtagcccaggcacgtactcatgccaaccctcgtggtagacccaagatgggctccagatcaacatcagagtccagatcaaggtccgttcacgttcacgttctcgttcagcatcaagcaacagcagaaaatctctgagccctggagtctccagggacagcagcaccagctatactgaaaccaaagatccctcttctggtcaggaggttgcaactccaccagtgccacaactgcaggtctgtgagccaaaggagaggacttccacctcctcatcctctgtccaagcaaggcgtctgagtcagcctgaatcagctgaaaagcatgtgacccagaggttacagcctgagcgggggagcccaaagaagtgtgaagctgaagaggcagagccaccagctgccacacagccccaaacctcagagactcagacctctcatctgccagaatcagaaagaattcatcacactgttgaggagaaggaggaagtgaccatggacacaagtgaaaacagacctgaaaatgatgttccagaacctcccatgcctattgcagaccaagtcagcaatgatgaccgcccggagggcagtgttgaagatgaggagaagaaagaggtaaacatccaagccacctattggggcgggtgggcaggaatggacctaggggaaagagtagagcactctagtgatccctcttacacggtgggttaacttaaaggagggatgaggcagggacttggatcagaatagggccaagggagaattcgctggtttagcaagggagaccccttgtgacggggacagggctcattcattttcctttccttgttggggaagtagtgcccagactctagacgtttgtaactaacgggaaagtctgataatggccctttatctaagatttatgttcagcttttcctgctgtcttcccaagcttctcctggtggtaactcctttagctttccctcctttttaaaagcctgatggagcccaacgccatctagtggacattggtggttctcaccagaccagccatgctgagaaatttttgttcctcctctgccctccagtggtctgactgcagagatgtagctacttagaagccagcacttgtgatccggaaggcccattctcagttacctgtgacccctctacctccttttttggcatatgttatcttgtgtcctgcacccacttcagggggcttcccccatcagagccagcgaagtcttcttggctcttaaagtaattgagaaagaatgagctgggtttaggagaggggtaacaaggtgggagggactgttgtgtgtgtagcctttttctggtgtgtgttgcgggggtgggggccggtgaaagtgatttgatgtgcagaatattatttattacaaggtccttcttccccgtaaaactttgtccaagtacctcatgtacggtaatccgcccgtaaaatataaccctgcccaactggccaatcgctgatgccgcctcttcctctggacccacccgctgctactgagctgcccaatcagagccaagtctgctatccaggtgtcttggccagaggggggcatgtatatgggctcctgtgatgggcccccttttgcctccctgtcttgcttacatcagggggccaagaagaacactgttctggagagacttgtattgagcaagcaaaaaacatttggaaaggggtggacttgcatcatctccctacttgggacaccccaagaagagcttgtgccagtgctggggcgcctgcccacatgcccttgcccttttgaggactgtgggttgccttgtttgctacagactgttgggatccccatctagggcaccaagacctcctaaagtttgtgatcgcagtgccatgctgtaaaacactgagtgggaccctctacttaagctgtgacgactaggaaccgtgcagaggagtctagggtctgagcccctggggatttaatgctgatgacagcccagcccatgtgtcaccacttgctcatcagatggactttcctttggtccctgttgtccatggtgaagggcagcatgttggttgctccaacttctcctccatccctggaggcagggactcatttcatccacctgactggaaccactgtctcagctggagtccctgaggagatgccagccacaactctccgaagagaagtattctgaccttgctgctgaatgtctgccaggtcctggggtattcacctacccccaggctaccttcatcagaggctccatgatcccactcggtgagaggaccccctccccagttacaggcagaggagaaagggactctggagtcatcacctggattccaagtattgggtggtgttattgctgcagcttgccactggtggacatagggtcctgcctgcctctcacgataaaaggcaaggatcattcctgctactcacaggccatctcatcagggactgcaagatgatgtcccttcagggccaggactgatgtctctgcccctttcccccctctatccctcgctgagcctggccaccgccagtgaactgtcttgacatcatggaaactgggcagcgtccccccacacgtttccctcccgccccccctgcgcccctgggaggactctggcagtgccgtgctgactaccacgccgtgcgcccaccttttttgccaacccaaccccccaccaattgcacagcgcctagcagggagggctcattctgattggaccggcggttgactagatacagtccccacagtgaggtgcgattggctgaactgaagatcccaggtgtgagatggtacctggaacatttgtcatattcctagtttattttcttctttattttcttcttctttttttaatattttattttattttttttctatatctttattttttctgatttcttttatttatttatttggttcatgtttttcctgttttaattaagacctttttttttgttttgtttttctcactaacttacccatcgagagcggcccagctaggggtcaggctggcccttaacagagaccaaggagacttggttagacgacacaaacggggctgcgggtgggggtggatgggaaagggatttcatcacgaggtttctgccctaccctttagaagagtggtagagtggtcttagtttttccagaaataagcacctacacttgaaaatactctattccctttttctctctcacttttctcccccgccccccatagtctttcgtcattcacccactgagtgtttggggtagagacttgtcccaaagatgtcttctggtctttggcagagcccctaaggcttgagccctggttggagaggaaacagtaagactctgctggagctccctgcggtggctggaaagtctaaggatctccttggggacaatctgcccttcataaaaaccttcctttatcaaagacacctttgagttctttttgctagcacttggctcaagagcctcatctccagtgggtctggtgctgcccttttccacagtgtggtgggggtctgggcagtcttgacatgacagtctgctgtccaagcatctcaaagccattgtcagtgggcatcagtctggccattgaagaaaggagggttaccttgttgaagttgccatccaaagttggttttccttgtttcctcgagttagcaaggaaggacctgggaggactagatgacccagtttggggcacagtttgtttggcttggtgtcctctcgactcagacggtgaaagagggggtatgaccaacatctttagggggctgagaggctactgaactcctcttccagcttatttctggttaagctaatacacaggtgtgatacggagtagatgacttttccctgctctgatgtttagttttatttttttctctaacttgcattgattctgcttcgtttttgccgtttgccgcttctgttttggtctctgtctgtctctgtgtctctctctgtctctctctctcactctatctgtgtctttggaggctaagctaagactgccccatctaacctccttcccccctctctgtggggtgtctctctttctcttttttttcccctttttcttcttcatacagagctcgctgcccaaatcattcaagaggaagatctccgttgtctcagctaccaagggggtgccagctggaaacagtgacacagaggggggccagcctggtcggaaacgacgctggggagccagcacagccaccacacagaagaaaccttccatcagtatcaccactgaatcactaaagagcctcatccccgacatcaaacccctggcggggcaggaggctgttgtggatcttcatgctgatgactctcgcatctctgaggatgagacagagcgtaatggcgatgatgggacccatgacaaggggctgaaaatatgccggacagtcactcaggtagtacctgcagagggccaggagaatgggcagagggaagaagaggaagaagagaaggaacctgaagcagaacctcctgtacctccccaggtgtcagtagaggtggccttgcccccacctgcagagcatgaagtaaagaaagtgactttaggagataccttaactcgacgttccattagccagcagaagtccggagtttccattaccattgatgacccagtccgaactgcccaggtgccctccccaccccggggcaagattagcaacattgtccatatctccaatttggtccgtcctttcactttaggccagctaaaggagttgttggggcgcacaggaaccttggtggaagaggccttctggattgacaagatcaaatctcattgctttgtaacgtactcaacagtagaggaagctgttgccacccgcacagctctgcacggggtcaaatggccccagtccaatcccaaattcctttgtgctgactatgccgagcaagatgagctggattatcaccgaggcctcttggtggaccgtccctctgaaactaagacagaggagcagggaataccacggcccctgcaccccccacccccacccccggtccagccaccacagcacccccgggcagagcagcgggagcaggaacgggcagtgcgggaacagtgggcagaacgggaacgggaaatggagcggcgggagcggactcgatcagagcgtgaatgggatcgggacaaagttcgagaagggccccgttcccgatcaaggtcccgtgaccgccgccgcaaggaacgtgcgaagtctaaagaaaagaagagtgagaagaaagagaaagcccaggaggaaccacctgccaagctgctggatgaccttttccgaaagaccaaggcagctccctgcatctattggctcccactgactgacagccagatcgttcagaaagaggcagagcgggccgaacgggccaaggagcgggagaagcggcgaaaggagcaagaagaagaagagcaaaaggagcgggagaaggaagccgagcgggaacggaaccgacagctggagcgagagaaacgtcgggagcacagtcgggagagggacagggagagagagagagaaagggagcgggacaggggggaccgagatcgggatagggaaagggaccgagaacgaggcagggaaagggatcgcagggacaccaagcgccacagcagaagccggagtcggagcacacctgtgcgggaccggggtgggcgccgctagctgggaaaacactagagctgcaggtaccagccactcggccccagggggttatggccacagagggataggcacagtctccaccaccctggagccaagggtctttcacatcacctatccctacatacataccaaatggaaaagtggccatccttttccccccaaacacacccccttaacctatctcttgggacttagcccgaccctccctctcatttcccattaagtctgagaggcaagagctaggttaggcaaggaggtggttggccagagatggggaacagccaggtgccccagtcctctgatttttcctccatcctgcttaccacctccctgggtacttacagccttctcttgggaacagccggggccaggactgggtcacctatgagctgaatcagcatctcctcctgagtcccagggcccctgcagttcccagtctcttctgtcctgcagcccttgcctctttcccacaggttccactttatatccaccttttccttttgttcaatttttatttttattttttttattattaaatgatgtggtctatggaaaaaaaaataaaaatctgacttagttttaaa

SEQ ID NO: 356101 - DNA, 9402 bp, Homo sapiens
  misc_feature (633)..(633): n is a, c, g, or t
  misc_feature (670)..(670): n is a, c, g, or t
  misc_feature (706)..(706): n is a, c, g, or t
  misc_feature (840)..(840): n is a, c, g, or t
gagacggagtcttgctctgtcacccaggctgtagtgcaatggcgtgatctcaaccactgcttcctgggttcaagcgattctcctgcctcagcctcccgagtagctgggactataggcgtacgccaccacgcccggctaatttgtttgtatttttagtagagacggggtttcaccatattggccagactggtctccaactcctgacctcaagtgatccgcccgcctcggcctcccaaagtgctgggattataggcgtaagccaccgcgcccggcaccttgccactgattttgcatcatgaatgcaacggaaagatcagccaatttgactttaatagttttcagtctcttaaatctctaacgtatctcttaaatctctaaactatttgtctgtgacctattttactgtttgtgtttcttctgcatcaagttggaggattggtagtgacaaagaaagaagcccctaaacaattaatattagttcaagtaccaaaaaagttcagggcgcttgcattttccagttcttgccctacaggaagcagttcctccaagggaacttactctcttctgcggagcaaggaagaactttcccagaatcttgccacatggcttccaaggcaaactcaaactcaagtncagcgtcatagatcagttcatagtctgggtccgaagncacggcgatgcttcttgcgcacccccacggagcttnttattccgattccgccagccccccgcccctccccaaaaaaagcctaagatgggagtggctatgattcagaggacagagggcagaagctgtttgcgttaaggagtggggggcttgccctattaaggtaatccgcnaacaccgagtctgacccggcccatagaggtacttctaccccgcttacctccccttttctctcgaagggcacccgaagattgtcacgagtccttagactccaactactgcggcagcttccaaatttcctgaaaaccctaagctgggccagcccggcagcccacgcacttccggcctcggacccgccccaaacacccaagcgccccagcgcctcatctctaggtccggaaataaacgaacatctccgattatggttataccagggtcgagggtttccgaatatattcgattcaaagcttcggcaagacgaagaaaaccgagcctgaaagcagggcgagaaaaggggcgctgcagggcggatggaaagaattgattggtaacgatgtggagacggaaacatccgaggacatccggaggaacccggggagttctgagtggtaatcgaggggtagagtatggcagtgggcggggtcatctcggtacgttcgaagggcgttggcggaaattaccgaagatgcccgaagccgtcgggacggacccgagtacctcacgcaagatggcggagctggaggaggtgactctggacgggaagcctcttcaggcgctgcgggtgaccgacctgaaggccgcactggagcagcgaggcctagccaagagcgggcagaagagtgccctggtcaagcggctcaaaggggctctaatgctagaaaatttacagaaacactcaacaccccatgctgcattccagccaaattcccagattggtgaggaaatgagccagaacagtttcataaaacagtatctggaaaagcagcaggagctacttaggcagcgtctggaacgtgaagctcgagaagctgcagaacttgaagaagcttcagctgagtcggaggacgagatgatccatcctgagggagtggcttccctgctgcctcctgactttcagagcagcctggagagaccagagctggagctcagcagacattcgcccagaaaaagctcctcaatttctgaagagaaaggtgactctgatgatgagaaaccaaggaaaggagaaagacgatcatctagggtcagacaggcaagagcagctaaactgtctgagggcagccaacctgctgaggaggaagaggatcaagaaacaccttccagaaacctaagggtcagagcagatcgaaatttgaaaacagaggaggaagaagaggaggaggaggaggaggaagaagatgatgaagaagaggaaggtgatgatgagggacaaaaatctagggaggcaccaatcctgaaagagtttaaggaagaaggggaagagatacctagagtaaaaccagaggagatgatggatgagagacccaaaacaagatcccaggaacaggaggtgttagagagaggagggagatttacaagatcccaggaagaggctagaaaaagtcatctggccagacagcagcaggagaaggaaatgaaaacaacatctccccttgaggaggaagaaagagaaataaaatcttcacaaggcttaaaggaaaaatcgaagtctccttcccctcctcgactgactgaagatcgaaagaaggcctcacttgtagcgctgccagagcaaactgccagcgaggaggagactcctccacctttactaacaaaggaagcatcttctccaccacctcatccacagctccatagcgaagaagaaatagagcccatggaaggcccagccccccctgtcctcattcagttatctcctcctaatacagatgctgacaccagggagctattagtatctcagcatactgtccagttggtaggaggcctgtctcctttgtcaagtccttcagacaccaaagcagaatctccagcagagaaagtgccagaggagagtgtcctgcctctggttcagaaaagcacactggctgactactcagcccagaaggatcttgaacctgagtcagacagatctgctcagcccctccctctaaaaattgaggaattagcactggccaaaggaatcactgaagaatgtctgaaacagccatctttggaacagaaggaaggcagaagagcttctcatacccttctcccaagccacagattgaaacagtcagctgattcatcctctagccggtcctcctcatcttcctcctccagttctagatcaagatctcgctctcctgacagttcaggttctcggtctcattcaccgctcagatccaagcagagagatgtagcccaggcacgtactcatgccaaccctcgtggtagacccaagatgggctccagatcaacatcagagtccagatcaaggtccgttcacgttcacgttctcgttcagcatcaagcaacagcagaaaatctctgagccctggagtctccagggacagcagcaccagctatactgaaaccaaagatccctcttctggtcaggaggttgcaactccaccagtgccacaactgcaggtctgtgagccaaaggagaggacttccacctcctcatcctctgtccaagcaaggcgtctgagtcagcctgaatcagctgaaaagcatgtgacccagaggttacagcctgagcgggggagcccaaagaagtgtgaagctgaagaggcagagccaccagctgccacacagccccaaacctcagagactcagacctctcatctgccagaatcagaaagaattcatcacactgttgaggagaaggaggaagtgaccatggacacaagtgaaaacagacctgaaaatgatgttccagaacctcccatgcctattgcagaccaagtcagcaatgatgaccgcccggagggcagtgttgaagatgaggagaagaaagaggtaaacatccaagccacctattggggcgggtgggcaggaatggacctaggggaaagagtagagcactctagtgatccctcttacacggtgggttaacttaaaggagggatgaggcagggacttggatcagaatagggccaagggagaattcgctggtttagcaagggagaccccttgtgacggggacagggctcattcattttcctttccttgttggggaagtagtgcccagactctagacgtttgtaactaacgggaaagtctgataatggccctttatctaagatttatgttcagcttttcctgctgtcttcccaagcttctcctggtggtaactcctttagctttccctcctttttaaaagcctgatggagcccaacgccatctagtggacattggtggttctcaccagaccagccatgctgagaaatttttgttcctcctctgccctccagtggtctgactgcagagatgtagctacttagaagccagcacttgtgatccggaaggcccattctcagttacctgtgacccctctacctccttttttggcatatgttatcttgtgtcctgcacccacttcagggggcttcccccatcagagccagcgaagtcttcttggctcttaaagtaattgagaaagaatgagctgggtttaggagaggggtaacaaggtgggagggactgttgtgtgtgtagcctttttctggtgtgtgttgcgggggtgggggccggtgaaagtgatttgatgtgcagaatattatttattacaaggtccttcttccccgtaaaactttgtccaagtacctcatgtacggtaatccgcccgtaaaatataaccctgcccaactggccaatcgctgatgccgcctcttcctctggacccacccgctgctactgagctgcccaatcagagccaagtctgctatccaggtgtcttggccagaggggggcatgtatatgggctcctgtgatgggcccccttttgcctccctgtcttgcttacatcagggggccaagaagaacactgttctggagagacttgtattgagcaagcaaaaaacatttggaaaggggtggacttgcatcatctccctacttgggacaccccaagaagagcttgtgccagtgctggggcgcctgcccacatgcccttgcccttttgaggactgtgggttgccttgtttgctacagactgttgggatccccatctagggcaccaagacctcctaaagtttgtgatcgcagtgccatgctgtaaaacactgagtgggaccctctacttaagctgtgacgactaggaaccgtgcagaggagtctagggtctgagcccctggggatttaatgctgatgacagcccagcccatgtgtcaccacttgctcatcagatggactttcctttggtccctgttgtccatggtgaagggcagcatgttggttgctccaacttctcctccatccctggaggcagggactcatttcatccacctgactggaaccactgtctcagctggagtccctgaggagatgccagccacaactctccgaagagaagtattctgaccttgctgctgaatgtctgccaggtcctggggtattcacctacccccaggctaccttcatcagaggctccatgatcccactcggtgagaggaccccctccccagttacaggcagaggagaaagggactctggagtcatcacctggattccaagtattgggtggtgttattgctgcagcttgccactggtggacatagggtcctgcctgcctctcacgataaaaggcaaggatcattcctgctactcacaggccatctcatcagggactgcaagatgatgtcccttcagggccaggactgatgtctctgcccctttcccccctctatccctcgctgagcctggccaccgccagtgaactgtcttgacatcatggaaactgggcagcgtccccccacacgtttccctcccgccccccctgcgcccctgggaggactctggcagtgccgtgctgactaccacgccgtgcgcccaccttttttgccaacccaaccccccaccaattgcacagcgcctagcagggagggctcattctgattggaccggcggttgactagatacagtccccacagtgaggtgcgattggctgaactgaagatcccaggtgtgagatggtacctggaacatttgtcatattcctagtttattttcttctttattttcttcttctttttttaatattttattttattttttttctatatctttattttttctgatttcttttatttatttatttggttcatgtttttcctgttttaattaagacctttttttttgttttgtttttctcactaacttacccatcgagagcggcccagctaggggtcaggctggcccttaacagagaccaaggagacttggttagacgacacaaacggggctgcgggtgggggtggatgggaaagggatttcatcacgaggtttctgccctaccctttagaagagtggtagagtggtcttagtttttccagaaataagcacctacacttgaaaatactctattccctttttctctctcacttttctcccccgccccccatagtctttcgtcattcacccactgagtgtttggggtagagacttgtcccaaagatgtcttctggtctttggcagagcccctaaggcttgagccctggttggagaggaaacagtaagactctgctggagctccctgcggtggctggaaagtctaaggatctccttggggacaatctgcccttcataaaaaccttcctttatcaaagacacctttgagttctttttgctagcacttggctcaagagcctcatctccagtgggtctggtgctgcccttttccacagtgtggtgggggtctgggcagtcttgacatgacagtctgctgtccaagcatctcaaagccattgtcagtgggcatcagtctggccattgaagaaaggagggttaccttgttgaagttgccatccaaagttggttttccttgtttcctcgagttagcaaggaaggacctgggaggactagatgacccagtttggggcacagtttgtttggcttggtgtcctctcgactcagacggtgaaagagggggtatgaccaacatctttagggggctgagaggctactgaactcctcttccagcttatttctggttaagctaatacacaggtgtgatacggagtagatgacttttccctgctctgatgtttagttttatttttttctctaacttgcattgattctgcttcgtttttgccgtttgccgcttctgttttggtctctgtctgtctctgtgtctctctctgtctctctctctcactctatctgtgtctttggaggctaagctaagactgccccatctaacctccttcccccctctctgtggggtgtctctctttctcttttttttcccctttttcttcttcatacagagctcgctgcccaaatcattcaagaggaagatctccgttgtctcagctaccaagggggtgccagctggaaacagtgacacagaggggggccagcctggtcggaaacgacgctggggagccagcacagccaccacacagaagaaaccttccatcagtatcaccactgaatcactaaaggtgaggtgggaggagccagggaagggaggatgagacctgttaaggtgggagtagacatgggcccagtgtaacggggtggggggtatctgtgtcccagagcctcatccccgacatcaaacccctggcggggcaggaggctgttgtggatcttcatgctgatgactctcgcatctctgaggatgagacagagcgtaatggcgatgatgggacccatgacaaggggctgaaaatatgccggacagtcactcaggtagtacctgcagagggccaggagaatgggcagagggaagaagaggaagaagagaaggaacctgaagcagaacctcctgtacctccccaggtgtcagtagaggtggccttgcccccacctgcagagcatgaagtaaagaaagtgactttaggagataccttaactcgacgttccattagccagcagaagtccggagtttccattaccattgatgacccagtccgaactgcccaggtgccctccccaccccggggcaagattagcaacattgtccatatctccaatttggtccgtcctttcactttaggccagctaaaggagttgttggggcgcacaggaaccttggtggaagaggccttctggattgacaagatcaaatctcattgctttgtaacgtactcaacagtagaggaagctgttgccacccgcacagctctgcacggggtcaaatggccccagtccaatcccaaattcctttgtgctgactatgccgagcaagatgagctggattatcaccgaggcctcttggtggaccgtccctctgaaactaagacagaggagcagggaataccacggcccctgcaccccccacccccacccccggtccagccaccacagcacccccgggcagagcagcgggagcaggaacgggcagtgcgggaacagtgggcagaacgggaacgggaaatggagcggcgggagcggactcgatcagagcgtgaatgggatcgggacaaagttcgagaagggccccgttcccgatcaaggtcccgtgaccgccgccgcaaggaacgtgcgaagtctaaagaaaagaagagtgagaagaaagagaaagcccaggaggaaccacctgccaagctgctggatgaccttttccgaaagaccaaggcagctccctgcatctattggctcccactgactgacagccagatcgttcagaaagaggcagagcgggccgaacgggccaaggagcgggagaagcggcgaaaggagcaagaagaagaagagcaaaaggagcgggagaaggaagccgagcgggaacggaaccgacagctggagcgagagaaacgtcgggagcacagtcgggagagggacagggagagagagagagaaagggagcgggacaggggggaccgagatcgggatagggaaagggaccgagaacgaggcagggaaagggatcgcagggacaccaagcgccacagcagaagccggagtcggagcacacctgtgcgggaccggggtgggcgccgctagctgggaaaacactagagctgcaggtaccagccactcggccccagggggttatggccacagagggataggcacagtctccaccaccctggagccaagggtctttcacatcacctatccctacatacataccaaatggaaaagtggccatccttttccccccaaacacacccccttaacctatctcttgggacttagcccgaccctccctctcatttcccattaagtctgagaggcaagagctaggttaggcaaggaggtggttggccagagatggggaacagccaggtgccccagtcctctgatttttcctccatcctgcttaccacctccctgggtacttacagccttctcttgggaacagccggggccaggactgggtcacctatgagctgaatcagcatctcctcctgagtcccagggcccctgcagttcccagtctcttctgtcctgcagcccttgcctctttcccacaggttccactttatatccaccttttccttttgttcaatttttatttttattttttttattattaaatgatgtggtctatggaaaaaaaaataaaaatctgacttagttttaaa

SEQ ID NO: 356102 - DNA, 9710 bp, Homo sapiens
  misc_feature (633)..(633): n is a, c, g, or t
  misc_feature (670)..(670): n is a, c, g, or t
  misc_feature (706)..(706): n is a, c, g, or t
  misc_feature (840)..(840): n is a, c, g, or t
gagacggagtcttgctctgtcacccaggctgtagtgcaatggcgtgatctcaaccactgcttcctgggttcaagcgattctcctgcctcagcctcccgagtagctgggactataggcgtacgccaccacgcccggctaatttgtttgtatttttagtagagacggggtttcaccatattggccagactggtctccaactcctgacctcaagtgatccgcccgcctcggcctcccaaagtgctgggattataggcgtaagccaccgcgcccggcaccttgccactgattttgcatcatgaatgcaacggaaagatcagccaatttgactttaatagttttcagtctcttaaatctctaacgtatctcttaaatctctaaactatttgtctgtgacctattttactgtttgtgtttcttctgcatcaagttggaggattggtagtgacaaagaaagaagcccctaaacaattaatattagttcaagtaccaaaaaagttcagggcgcttgcattttccagttcttgccctacaggaagcagttcctccaagggaacttactctcttctgcggagcaaggaagaactttcccagaatcttgccacatggcttccaaggcaaactcaaactcaagtncagcgtcatagatcagttcatagtctgggtccgaagncacggcgatgcttcttgcgcacccccacggagcttnttattccgattccgccagccccccgcccctccccaaaaaaagcctaagatgggagtggctatgattcagaggacagagggcagaagctgtttgcgttaaggagtggggggcttgccctattaaggtaatccgcnaacaccgagtctgacccggcccatagaggtacttctaccccgcttacctccccttttctctcgaagggcacccgaagattgtcacgagtccttagactccaactactgcggcagcttccaaatttcctgaaaaccctaagctgggccagcccggcagcccacgcacttccggcctcggacccgccccaaacacccaagcgccccagcgcctcatctctaggtccggaaataaacgaacatctccgattatggttataccagggtcgagggtttccgaatatattcgattcaaagcttcggcaagacgaagaaaaccgagcctgaaagcagggcgagaaaaggggcgctgcagggcggatggaaagaattgattggtaacgatgtggagacggaaacatccgaggacatccggaggaacccggggagttctgagtggtaatcgaggggtagagtatggcagtgggcggggtcatctcggtacgttcgaagggcgttggcggaaattaccgaagatgcccgaagccgtcgggacggacccgagtacctcacgcaagatggcggagctggaggaggtgactctggacgggaagcctcttcaggcgctgcgggtgaccgacctgaaggccgcactggagcagcgaggcctagccaagagcgggcagaagagtgccctggtcaagcggctcaaaggggctctaatgctagaaaatttacagaaacactcaacaccccatgctgcattccagccaaattcccagattggtgaggaaatgagccagaacagtttcataaaacagtatctggaaaagcagcaggagctacttaggcagcgtctggaacgtgaagctcgagaagctgcagaacttgaagaagcttcagctgagtcggaggacgagatgatccatcctgagggagtggcttccctgctgcctcctgactttcagagcagcctggagagaccagagctggagctcagcagacattcgcccagaaaaagctcctcaatttctgaagagaaaggtgactctgatgatgagaaaccaaggaaaggagaaagacgatcatctagggtcagacaggcaagagcagctaaactgtctgagggcagccaacctgctgaggaggaagaggatcaagaaacaccttccagaaacctaagggtcagagcagatcgaaatttgaaaacagaggaggaagaagaggaggaggaggaggaggaagaagatgatgaagaagaggaaggtgatgatgagggacaaaaatctagggaggcaccaatcctgaaagagtttaaggaagaaggggaagagatacctagagtaaaaccagaggagatgatggatgagagacccaaaacaagatcccaggaacaggaggtgttagagagaggagggagatttacaagatcccaggaagaggctagaaaaagtcatctggccagacagcagcaggagaaggaaatgaaaacaacatctccccttgaggaggaagaaagagaaataaaatcttcacaaggcttaaaggaaaaatcgaagtctccttcccctcctcgactgactgaagatcgaaagaaggcctcacttgtagcgctgccagagcaaactgccagcgaggaggagactcctccacctttactaacaaaggaagcatcttctccaccacctcatccacagctccatagcgaagaagaaatagagcccatggaaggcccagccccccctgtcctcattcagttatctcctcctaatacagatgctgacaccagggagctattagtatctcagcatactgtccagttggtaggaggcctgtctcctttgtcaagtccttcagacaccaaagcagaatctccagcagagaaagtgccagaggagagtgtcctgcctctggttcagaaaagcacactggctgactactcagcccagaaggatcttgaacctgagtcagacagatctgctcagcccctccctctaaaaattgaggaattagcactggccaaaggaatcactgaagaatgtctgaaacagccatctttggaacagaaggaaggcagaagagcttctcatacccttctcccaagccacagattgaaacagtcagctgattcatcctctagccggtcctcctcatcttcctcctccagttctagatcaagatctcgctctcctgacagttcaggttctcggtctcattcaccgctcagatccaagcagagagatgtagcccaggcacgtactcatgccaaccctcgtggtagacccaagatgggctccagatcaacatcagagtccagatcaaggtccgttcacgttcacgttctcgttcagcatcaagcaacagcagaaaatctctgagccctggagtctccagggacagcagcaccagctatactgaaaccaaagatccctcttctggtcaggaggttgcaactccaccagtgccacaactgcaggtctgtgagccaaaggagaggacttccacctcctcatcctctgtccaagcaaggcgtctgagtcagcctgaatcagctgaaaagcatgtgacccagaggttacagcctgagcgggggagcccaaagaagtgtgaagctgaagaggcagagccaccagctgccacacagccccaaacctcagagactcagacctctcatctgccagaatcagaaagaattcatcacactgttgaggagaaggaggaagtgaccatggacacaagtgaaaacagacctgaaaatgatgttccagaacctcccatgcctattgcagaccaagtcagcaatgatgaccgcccggagggcagtgttgaagatgaggagaagaaagaggtaaacatccaagccacctattggggcgggtgggcaggaatggacctaggggaaagagtagagcactctagtgatccctcttacacggtgggttaacttaaaggagggatgaggcagggacttggatcagaatagggccaagggagaattcgctggtttagcaagggagaccccttgtgacggggacagggctcattcattttcctttccttgttggggaagtagtgcccagactctagacgtttgtaactaacgggaaagtctgataatggccctttatctaagatttatgttcagcttttcctgctgtcttcccaagcttctcctggtggtaactcctttagctttccctcctttttaaaagcctgatggagcccaacgccatctagtggacattggtggttctcaccagaccagccatgctgagaaatttttgttcctcctctgccctccagtggtctgactgcagagatgtagctacttagaagccagcacttgtgatccggaaggcccattctcagttacctgtgacccctctacctccttttttggcatatgttatcttgtgtcctgcacccacttcagggggcttcccccatcagagccagcgaagtcttcttggctcttaaagtaattgagaaagaatgagctgggtttaggagaggggtaacaaggtgggagggactgttgtgtgtgtagcctttttctggtgtgtgttgcgggggtgggggccggtgaaagtgatttgatgtgcagaatattatttattacaaggtccttcttccccgtaaaactttgtccaagtacctcatgtacggtaatccgcccgtaaaatataaccctgcccaactggccaatcgctgatgccgcctcttcctctggacccacccgctgctactgagctgcccaatcagagccaagtctgctatccaggtgtcttggccagaggggggcatgtatatgggctcctgtgatgggcccccttttgcctccctgtcttgcttacatcagggggccaagaagaacactgttctggagagacttgtattgagcaagcaaaaaacatttggaaaggggtggacttgcatcatctccctacttgggacaccccaagaagagcttgtgccagtgctggggcgcctgcccacatgcccttgcccttttgaggactgtgggttgccttgtttgctacagactgttgggatccccatctagggcaccaagacctcctaaagtttgtgatcgcagtgccatgctgtaaaacactgagtgggaccctctacttaagctgtgacgactaggaaccgtgcagaggagtctagggtctgagcccctggggatttaatgctgatgacagcccagcccatgtgtcaccacttgctcatcagatggactttcctttggtccctgttgtccatggtgaagggcagcatgttggttgctccaacttctcctccatccctggaggcagggactcatttcatccacctgactggaaccactgtctcagctggagtccctgaggagatgccagccacaactctccgaagagaagtattctgaccttgctgctgaatgtctgccaggtcctggggtattcacctacccccaggctaccttcatcagaggctccatgatcccactcggtgagaggaccccctccccagttacaggcagaggagaaagggactctggagtcatcacctggattccaagtattgggtggtgttattgctgcagcttgccactggtggacatagggtcctgcctgcctctcacgataaaaggcaaggatcattcctgctactcacaggccatctcatcagggactgcaagatgatgtcccttcagggccaggactgatgtctctgcccctttcccccctctatccctcgctgagcctggccaccgccagtgaactgtcttgacatcatggaaactgggcagcgtccccccacacgtttccctcccgccccccctgcgcccctgggaggactctggcagtgccgtgctgactaccacgccgtgcgcccaccttttttgccaacccaaccccccaccaattgcacagcgcctagcagggagggctcattctgattggaccggcggttgactagatacagtccccacagtgaggtgcgattggctgaactgaagatcccaggtgtgagatggtacctggaacatttgtcatattcctagtttattttcttctttattttcttcttctttttttaatattttattttattttttttctatatctttattttttctgatttcttttatttatttatttggttcatgtttttcctgttttaattaagacctttttttttgttttgtttttctcactaacttacccatcgagagcggcccagctaggggtcaggctggcccttaacagagaccaaggagacttggttagacgacacaaacggggctgcgggtgggggtggatgggaaagggatttcatcacgaggtttctgccctaccctttagaagagtggtagagtggtcttagtttttccagaaataagcacctacacttgaaaatactctattccctttttctctctcacttttctcccccgccccccatagtctttcgtcattcacccactgagtgtttggggtagagacttgtcccaaagatgtcttctggtctttggcagagcccctaaggcttgagccctggttggagaggaaacagtaagactctgctggagctccctgcggtggctggaaagtctaaggatctccttggggacaatctgcccttcataaaaaccttcctttatcaaagacacctttgagttctttttgctagcacttggctcaagagcctcatctccagtgggtctggtgctgcccttttccacagtgtggtgggggtctgggcagtcttgacatgacagtctgctgtccaagcatctcaaagccattgtcagtgggcatcagtctggccattgaagaaaggagggttaccttgttgaagttgccatccaaagttggttttccttgtttcctcgagttagcaaggaaggacctgggaggactagatgacccagtttggggcacagtttgtttggcttggtgtcctctcgactcagacggtgaaagagggggtatgaccaacatctttagggggctgagaggctactgaactcctcttccagcttatttctggttaagctaatacacaggtgtgatacggagtagatgacttttccctgctctgatgtttagttttatttttttctctaacttgcattgattctgcttcgtttttgccgtttgccgcttctgttttggtctctgtctgtctctgtgtctctctctgtctctctctctcactctatctgtgtctttggaggctaagctaagactgccccatctaacctccttcccccctctctgtggggtgtctctctttctcttttttttcccctttttcttcttcatacagagctcgctgcccaaatcattcaagaggaagatctccgttgtctcagctaccaagggggtgccagctggaaacagtgacacagaggggggccagcctggtcggaaacgacgctggggagccagcacagccaccacacagaagaaaccttccatcagtatcaccactgaatcactaaagagcctcatccccgacatcaaacccctggcggggcaggaggctgttgtggatcttcatgctgatgactctcgcatctctgaggatgagacagagcgtaatggcgatgatgggacccatgacaaggggctgaaaatatgccggacagtcactcaggtagtacctgcagagggccaggagaatgggcagagggaagaagaggaagaagagaaggaacctgaagcagaacctcctgtacctccccaggtgtcagtagaggtggccttgcccccacctgcagagcatgaagtaaagaaagtgactttaggagataccttaactcgacgttccattagccagcagaagtccggagtttccattaccattgatgacccagtccgaactgcccaggtgccctccccaccccggggcaagattagcaacattgtccatatctccaatttggtaagtcattgtttctcaccatcccagcttgcttagtggttaagtttgagctttaggcttatgcctcctaggttccactcatagttgaactggtctaccaatagattaagttactcactgatcttgagtgagttacttaacatatttacccatctaaaaatgagggggaaaagctgttgccctgcagggttgttttgaggacttgcagaaggcctcacatacaacgtctcaattagtgctgggaagcaccaccactcttctcacattcttactgcaaggttcctaaactctctgccctcccccaaaccttgaaactatactcctgtgacagcagctcgggaaatctaaagattgggtggtggtcttgccttctgctagaccctgaaagtctattttcattggcaggtccgtcctttcactttaggccagctaaaggagttgttggggcgcacaggaaccttggtggaagaggccttctggattgacaagatcaaatctcattgctttgtaacgtactcaacagtagaggaagctgttgccacccgcacagctctgcacggggtcaaatggccccagtccaatcccaaattcctttgtgctgactatgccgagcaagatgagctggattatcaccgaggcctcttggtggaccgtccctctgaaactaagacagaggagcagggaataccacggcccctgcaccccccacccccacccccggtccagccaccacagcacccccgggcagagcagcgggagcaggaacgggcagtgcgggaacagtgggcagaacgggaacgggaaatggagcggcgggagcggactcgatcagagcgtgaatgggatcgggacaaagttcgagaagggccccgttcccgatcaaggtcccgtgaccgccgccgcaaggaacgtgcgaagtctaaagaaaagaagagtgagaagaaagagaaagcccaggaggaaccacctgccaagctgctggatgaccttttccgaaagaccaaggcagctccctgcatctattggctcccactgactgacagccagatcgttcagaaagaggcagagcgggccgaacgggccaaggagcgggagaagcggcgaaaggagcaagaagaagaagagcaaaaggagcgggagaaggaagccgagcgggaacggaaccgacagctggagcgagagaaacgtcgggagcacagtcgggagagggacagggagagagagagagaaagggagcgggacaggggggaccgagatcgggatagggaaagggaccgagaacgaggcagggaaagggatcgcagggacaccaagcgccacagcagaagccggagtcggagcacacctgtgcgggaccggggtgggcgccgctagctgggaaaacactagagctgcaggtaccagccactcggccccagggggttatggccacagagggataggcacagtctccaccaccctggagccaagggtctttcacatcacctatccctacatacataccaaatggaaaagtggccatccttttccccccaaacacacccccttaacctatctcttgggacttagcccgaccctccctctcatttcccattaagtctgagaggcaagagctaggttaggcaaggaggtggttggccagagatggggaacagccaggtgccccagtcctctgatttttcctccatcctgcttaccacctccctgggtacttacagccttctcttgggaacagccggggccaggactgggtcacctatgagctgaatcagcatctcctcctgagtcccagggcccctgcagttcccagtctcttctgtcctgcagcccttgcctctttcccacaggttccactttatatccaccttttccttttgttcaatttttatttttattttttttattattaaatgatgtggtctatggaaaaaaaaataaaaatctgacttagttttaaa

SEQ ID NO: 356103 - DNA, 9666 bp, Homo sapiens
  misc_feature (633)..(633): n is a, c, g, or t
  misc_feature (670)..(670): n is a, c, g, or t
  misc_feature (706)..(706): n is a, c, g, or t
  misc_feature (840)..(840): n is a, c, g, or t
gagacggagtcttgctctgtcacccaggctgtagtgcaatggcgtgatctcaaccactgcttcctgggttcaagcgattctcctgcctcagcctcccgagtagctgggactataggcgtacgccaccacgcccggctaatttgtttgtatttttagtagagacggggtttcaccatattggccagactggtctccaactcctgacctcaagtgatccgcccgcctcggcctcccaaagtgctgggattataggcgtaagccaccgcgcccggcaccttgccactgattttgcatcatgaatgcaacggaaagatcagccaatttgactttaatagttttcagtctcttaaatctctaacgtatctcttaaatctctaaactatttgtctgtgacctattttactgtttgtgtttcttctgcatcaagttggaggattggtagtgacaaagaaagaagcccctaaacaattaatattagttcaagtaccaaaaaagttcagggcgcttgcattttccagttcttgccctacaggaagcagttcctccaagggaacttactctcttctgcggagcaaggaagaactttcccagaatcttgccacatggcttccaaggcaaactcaaactcaagtncagcgtcatagatcagttcatagtctgggtccgaagncacggcgatgcttcttgcgcacccccacggagcttnttattccgattccgccagccccccgcccctccccaaaaaaagcctaagatgggagtggctatgattcagaggacagagggcagaagctgtttgcgttaaggagtggggggcttgccctattaaggtaatccgcnaacaccgagtctgacccggcccatagaggtacttctaccccgcttacctccccttttctctcgaagggcacccgaagattgtcacgagtccttagactccaactactgcggcagcttccaaatttcctgaaaaccctaagctgggccagcccggcagcccacgcacttccggcctcggacccgccccaaacacccaagcgccccagcgcctcatctctaggtccggaaataaacgaacatctccgattatggttataccagggtcgagggtttccgaatatattcgattcaaagcttcggcaagacgaagaaaaccgagcctgaaagcagggcgagaaaaggggcgctgcagggcggatggaaagaattgattggtaacgatgtggagacggaaacatccgaggacatccggaggaacccggggagttctgagtggtaatcgaggggtagagtatggcagtgggcggggtcatctcggtacgttcgaagggcgttggcggaaattaccgaagatgcccgaagccgtcgggacggacccgagtacctcacgcaagatggcggagctggaggaggtgactctggacgggaagcctcttcaggcgctgcgggtgaccgacctgaaggccgcactggagcagcgaggcctagccaagagcgggcagaagagtgccctggtcaagcggctcaaaggggctctaatgctagaaaatttacagaaacactcaacaccccatgctgcattccagccaaattcccagattggtgaggaaatgagccagaacagtttcataaaacagtatctggaaaagcagcaggagctacttaggcagcgtctggaacgtgaagctcgagaagctgcagaacttgaagaagcttcagctgagtcggaggacgagatgatccatcctgagggagtggcttccctgctgcctcctgactttcagagcagcctggagagaccagagctggagctcagcagacattcgcccagaaaaagctcctcaatttctgaagagaaaggtgactctgatgatgagaaaccaaggaaaggagaaagacgatcatctagggtcagacaggcaagagcagctaaactgtctgagggcagccaacctgctgaggaggaagaggatcaagaaacaccttccagaaacctaagggtcagagcagatcgaaatttgaaaacagaggaggaagaagaggaggaggaggaggaggaagaagatgatgaagaagaggaaggtgatgatgagggacaaaaatctagggaggcaccaatcctgaaagagtttaaggaagaaggggaagagatacctagagtaaaaccagaggagatgatggatgagagacccaaaacaagatcccaggaacaggaggtgttagagagaggagggagatttacaagatcccaggaagaggctagaaaaagtcatctggccagacagcagcaggagaaggaaatgaaaacaacatctccccttgaggaggaagaaagagaaataaaatcttcacaaggcttaaaggaaaaatcgaagtctccttcccctcctcgactgactgaagatcgaaagaaggcctcacttgtagcgctgccagagcaaactgccagcgaggaggagactcctccacctttactaacaaaggaagcatcttctccaccacctcatccacagctccatagcgaagaagaaatagagcccatggaaggcccagccccccctgtcctcattcagttatctcctcctaatacagatgctgacaccagggagctattagtatctcagcatactgtccagttggtaggaggcctgtctcctttgtcaagtccttcagacaccaaagcagaatctccagcagagaaagtgccagaggagagtgtcctgcctctggttcagaaaagcacactggctgactactcagcccagaaggatcttgaacctgagtcagacagatctgctcagcccctccctctaaaaattgaggaattagcactggccaaaggaatcactgaagaatgtctgaaacagccatctttggaacagaaggaaggcagaagagcttctcatacccttctcccaagccacagattgaaacagtcagctgattcatcctctagccggtcctcctcatcttcctcctccagttctagatcaagatctcgctctcctgacagttcaggttctcggtctcattcaccgctcagatccaagcagagagatgtagcccaggcacgtactcatgccaaccctcgtggtagacccaagatgggctccagatcaacatcagagtccagatcaaggtccgttcacgttcacgttctcgttcagcatcaagcaacagcagaaaatctctgagccctggagtctccagggacagcagcaccagctatactgaaaccaaagatccctcttctggtcaggaggttgcaactccaccagtgccacaactgcaggtctgtgagccaaaggagaggacttccacctcctcatcctctgtccaagcaaggcgtctgagtcagcctgaatcagctgaaaagcatgtgacccagaggttacagcctgagcgggggagcccaaagaagtgtgaagctgaagaggcagagccaccagctgccacacagccccaaacctcagagactcagacctctcatctgccagaatcagaaagaattcatcacactgttgaggagaaggaggaagtgaccatggacacaagtgaaaacagacctgaaaatgatgttccagaacctcccatgcctattgcagaccaagtcagcaatgatgaccgcccggagggcagtgttgaagatgaggagaagaaagaggtaaacatccaagccacctattggggcgggtgggcaggaatggacctaggggaaagagtagagcactctagtgatccctcttacacggtgggttaacttaaaggagggatgaggcagggacttggatcagaatagggccaagggagaattcgctggtttagcaagggagaccccttgtgacggggacagggctcattcattttcctttccttgttggggaagtagtgcccagactctagacgtttgtaactaacgggaaagtctgataatggccctttatctaagatttatgttcagcttttcctgctgtcttcccaagcttctcctggtggtaactcctttagctttccctcctttttaaaagcctgatggagcccaacgccatctagtggacattggtggttctcaccagaccagccatgctgagaaatttttgttcctcctctgccctccagtggtctgactgcagagatgtagctacttagaagccagcacttgtgatccggaaggcccattctcagttacctgtgacccctctacctccttttttggcatatgttatcttgtgtcctgcacccacttcagggggcttcccccatcagagccagcgaagtcttcttggctcttaaagtaattgagaaagaatgagctgggtttaggagaggggtaacaaggtgggagggactgttgtgtgtgtagcctttttctggtgtgtgttgcgggggtgggggccggtgaaagtgatttgatgtgcagaatattatttattacaaggtccttcttccccgtaaaactttgtccaagtacctcatgtacggtaatccgcccgtaaaatataaccctgcccaactggccaatcgctgatgccgcctcttcctctggacccacccgctgctactgagctgcccaatcagagccaagtctgctatccaggtgtcttggccagaggggggcatgtatatgggctcctgtgatgggcccccttttgcctccctgtcttgcttacatcagggggccaagaagaacactgttctggagagacttgtattgagcaagcaaaaaacatttggaaaggggtggacttgcatcatctccctacttgggacaccccaagaagagcttgtgccagtgctggggcgcctgcccacatgcccttgcccttttgaggactgtgggttgccttgtttgctacagactgttgggatccccatctagggcaccaagacctcctaaagtttgtgatcgcagtgccatgctgtaaaacactgagtgggaccctctacttaagctgtgacgactaggaaccgtgcagaggagtctagggtctgagcccctggggatttaatgctgatgacagcccagcccatgtgtcaccacttgctcatcagatggactttcctttggtccctgttgtccatggtgaagggcagcatgttggttgctccaacttctcctccatccctggaggcagggactcatttcatccacctgactggaaccactgtctcagctggagtccctgaggagatgccagccacaactctccgaagagaagtattctgaccttgctgctgaatgtctgccaggtcctggggtattcacctacccccaggctaccttcatcagaggctccatgatcccactcggtgagaggaccccctccccagttacaggcagaggagaaagggactctggagtcatcacctggattccaagtattgggtggtgttattgctgcagcttgccactggtggacatagggtcctgcctgcctctcacgataaaaggcaaggatcattcctgctactcacaggccatctcatcagggactgcaagatgatgtcccttcagggccaggactgatgtctctgcccctttcccccctctatccctcgctgagcctggccaccgccagtgaactgtcttgacatcatggaaactgggcagcgtccccccacacgtttccctcccgccccccctgcgcccctgggaggactctggcagtgccgtgctgactaccacgccgtgcgcccaccttttttgccaacccaaccccccaccaattgcacagcgcctagcagggagggctcattctgattggaccggcggttgactagatacagtccccacagtgaggtgcgattggctgaactgaagatcccaggtgtgagatggtacctggaacatttgtcatattcctagtttattttcttctttattttcttcttctttttttaatattttattttattttttttctatatctttattttttctgatttcttttatttatttatttggttcatgtttttcctgttttaattaagacctttttttttgttttgtttttctcactaacttacccatcgagagcggcccagctaggggtcaggctggcccttaacagagaccaaggagacttggttagacgacacaaacggggctgcgggtgggggtggatgggaaagggatttcatcacgaggtttctgccctaccctttagaagagtggtagagtggtcttagtttttccagaaataagcacctacacttgaaaatactctattccctttttctctctcacttttctcccccgccccccatagtctttcgtcattcacccactgagtgtttggggtagagacttgtcccaaagatgtcttctggtctttggcagagcccctaaggcttgagccctggttggagaggaaacagtaagactctgctggagctccctgcggtggctggaaagtctaaggatctccttggggacaatctgcccttcataaaaaccttcctttatcaaagacacctttgagttctttttgctagcacttggctcaagagcctcatctccagtgggtctggtgctgcccttttccacagtgtggtgggggtctgggcagtcttgacatgacagtctgctgtccaagcatctcaaagccattgtcagtgggcatcagtctggccattgaagaaaggagggttaccttgttgaagttgccatccaaagttggttttccttgtttcctcgagttagcaaggaaggacctgggaggactagatgacccagtttggggcacagtttgtttggcttggtgtcctctcgactcagacggtgaaagagggggtatgaccaacatctttagggggctgagaggctactgaactcctcttccagcttatttctggttaagctaatacacaggtgtgatacggagtagatgacttttccctgctctgatgtttagttttatttttttctctaacttgcattgattctgcttcgtttttgccgtttgccgcttctgttttggtctctgtctgtctctgtgtctctctctgtctctctctctcactctatctgtgtctttggaggctaagctaagactgccccatctaacctccttcccccctctctgtggggtgtctctctttctcttttttttcccctttttcttcttcatacagagctcgctgcccaaatcattcaagaggaagatctccgttgtctcagctaccaagggggtgccagctggaaacagtgacacagaggggggccagcctggtcggaaacgacgctggggagccagcacagccaccacacagaagaaaccttccatcagtatcaccactgaatcactaaagagcctcatccccgacatcaaacccctggcggggcaggaggctgttgtggatcttcatgctgatgactctcgcatctctgaggatgagacagagcgtaatggcgatgatgggacccatgacaaggggctgaaaatatgccggacagtcactcaggtagtacctgcagagggccaggagaatgggcagagggaagaagaggaagaagagaaggaacctgaagcagaacctcctgtacctccccaggtgtcagtagaggtggccttgcccccacctgcagagcatgaagtaaagaaaggtgagtgacatattgtgagagaaatgtaatgcggctccctgaattctcagagcacctcatttggatcgctgaaagctttgaatgtttcctgcctttcattatattttttcgtatatcatatctttctcctacatattaagtaagctacttgagggccagatttgactctgtttaatctttgaatctccatgatgaggaggttagcctagcacagtactttgcagattataggtgctctgcacgtttagattaaggagtggctgcttggtataaaagaaagggaaccgtgagagttacattgagggtgaaaagagccagtattgcttcctaccaaaagctgttcttgtggtcttcttgatagtgactttaggagataccttaactcgacgttccattagccagcagaagtccggagtttccattaccattgatgacccagtccgaactgcccaggtgccctccccaccccggggcaagattagcaacattgtccatatctccaatttggtccgtcctttcactttaggccagctaaaggagttgttggggcgcacaggaaccttggtggaagaggccttctggattgacaagatcaaatctcattgctttgtaacgtactcaacagtagaggaagctgttgccacccgcacagctctgcacggggtcaaatggccccagtccaatcccaaattcctttgtgctgactatgccgagcaagatgagctggattatcaccgaggcctcttggtggaccgtccctctgaaactaagacagaggagcagggaataccacggcccctgcaccccccacccccacccccggtccagccaccacagcacccccgggcagagcagcgggagcaggaacgggcagtgcgggaacagtgggcagaacgggaacgggaaatggagcggcgggagcggactcgatcagagcgtgaatgggatcgggacaaagttcgagaagggccccgttcccgatcaaggtcccgtgaccgccgccgcaaggaacgtgcgaagtctaaagaaaagaagagtgagaagaaagagaaagcccaggaggaaccacctgccaagctgctggatgaccttttccgaaagaccaaggcagctccctgcatctattggctcccactgactgacagccagatcgttcagaaagaggcagagcgggccgaacgggccaaggagcgggagaagcggcgaaaggagcaagaagaagaagagcaaaaggagcgggagaaggaagccgagcgggaacggaaccgacagctggagcgagagaaacgtcgggagcacagtcgggagagggacagggagagagagagagaaagggagcgggacaggggggaccgagatcgggatagggaaagggaccgagaacgaggcagggaaagggatcgcagggacaccaagcgccacagcagaagccggagtcggagcacacctgtgcgggaccggggtgggcgccgctagctgggaaaacactagagctgcaggtaccagccactcggccccagggggttatggccacagagggataggcacagtctccaccaccctggagccaagggtctttcacatcacctatccctacatacataccaaatggaaaagtggccatccttttccccccaaacacacccccttaacctatctcttgggacttagcccgaccctccctctcatttcccattaagtctgagaggcaagagctaggttaggcaaggaggtggttggccagagatggggaacagccaggtgccccagtcctctgatttttcctccatcctgcttaccacctccctgggtacttacagccttctcttgggaacagccggggccaggactgggtcacctatgagctgaatcagcatctcctcctgagtcccagggcccctgcagttcccagtctcttctgtcctgcagcccttgcctctttcccacaggttccactttatatccaccttttccttttgttcaatttttatttttattttttttattattaaatgatgtggtctatggaaaaaaaaataaaaatctgacttagttttaaa

SEQ ID NO: 356104 - DNA, 2807 bp, Homo sapiens
cctcccctgctgcagcaaggccctcccccatccgcacacacaggctgctgggtaagtggcaagatggctcccctgcatgtctccggctgatcgctgccgctccgccaatacaatagagccagccactaccagcagcctggccctcttcctccttctccagagagaccaatccagccgaactcggggtttgccgtgaggacttaacgcttatctcttaaaagccagatctgttttagcctccccgcaccaccaccacctccccttccatttaccattttttggatccccggttgctacatctcaattttctctctctggatcgggtggctggggaggaggtggtgggatcttggaacaaggaaggtgtggtttttttctttatttttttttaggattttttttgtttggtttttgttatttcttccattccagaaagggataaacagcacttccagggggagaaaaaaaatcatgttatcagaaagcaaagaaggtgaggagaaggaggaagtgaccatggacacaagtgaaaacagacctgaaaatgatgttccagaacctcccatgcctattgcagaccaagtcagcaatgatgaccgcccggagggcagtgttgaagatgaggagaagaaagagagctcgctgcccaaatcattcaagaggaagatctccgttgtctcagctaccaagggggtgccagctggaaacagtgacacagaggggggccagcctggtcggaaacgacgctggggagccagcacagccaccacacagaagaaaccttccatcagtatcaccactgaatcactaaagagcctcatccccgacatcaaacccctggcggggcaggaggctgttgtggatcttcatgctgatgactctcgcatctctgaggatgagacagagcgtaatggcgatgatgggacccatgacaaggggctgaaaatatgccggacagtcactcaggtagtacctgcagagggccaggagaatgggcagagggaagaagaggaagaagagaaggaacctgaagcagaacctcctgtacctccccaggtgtcagtagaggtggccttgcccccacctgcagagcatgaagtaaagaaagtgactttaggagataccttaactcgacgttccattagccagcagaagtccggagtttccattaccattgatgacccagtccgaactgcccaggtgccctccccaccccggggcaagattagcaacattgtccatatctccaatttggtccgtcctttcactttaggccagctaaaggagttgttggggcgcacaggaaccttggtggaagaggccttctggattgacaagatcaaatctcattgctttgtaacgtactcaacagtagaggaagctgttgccacccgcacagctctgcacggggtcaaatggccccagtccaatcccaaattcctttgtgctgactatgccgagcaagatgagctggattatcaccgaggcctcttggtggaccgtccctctgaaactaagacagaggagcagggaataccacggcccctgcaccccccacccccacccccggtccagccaccacagcacccccgggcagagcagcgggagcaggaacgggcagtgcgggaacagtgggcagaacgggaacgggaaatggagcggcgggagcggactcgatcagagcgtgaatgggatcgggacaaagttcgagaagggccccgttcccgatcaaggtcccgtgaccgccgccgcaaggaacgtgcgaagtctaaagaaaagaagagtgagaagaaagagaaagcccaggaggaaccacctgccaagctgctggatgaccttttccgaaagaccaaggcagctccctgcatctattggctcccactgactgacagccagatcgttcagaaagaggcagagcgggccgaacgggccaaggagcgggagaagcggcgaaaggagcaagaagaagaagagcaaaaggagcgggagaaggaagccgagcgggaacggaaccgacagctggagcgagagaaacgtcgggagcacagtcgggagagggacagggagagagagagagaaagggagcgggacaggggggaccgagatcgggatagggaaagggaccgagaacgaggcagggaaagggatcgcagggacaccaagcgccacagcagaagccggagtcggagcacacctgtgcgggaccggggtgggcgccgctagctgggaaaacactagagctgcaggtaccagccactcggccccagggggttatggccacagagggataggcacagtctccaccaccctggagccaagggtctttcacatcacctatccctacatacataccaaatggaaaagtggccatccttttccccccaaacacacccccttaacctatctcttgggacttagcccgaccctccctctcatttcccattaagtctgagaggcaagagctaggttaggcaaggaggtggttggccagagatggggaacagccaggtgccccagtcctctgatttttcctccatcctgcttaccacctccctgggtacttacagccttctcttgggaacagccggggccaggactgggtcacctatgagctgaatcagcatctcctcctgagtcccagggcccctgcagttcccagtctcttctgtcctgcagcccttgcctctttcccacaggttccactttatatccaccttttccttttgttcaatttttatttttattttttttattattaaatgatgtggtctatggaaaaaaaaataaaaatctgacttagttttaaa

SEQ ID NO: 356105 - DNA, 2426 bp, Homo sapiens
cctcccctgctgcagcaaggccctcccccatccgcacacacaggctgctggaaagggataaacagcacttccagggggagaaaaaaaatcatgttatcagaaagcaaagaaggtgaggagaaggaggaagtgaccatggacacaagtgaaaacagacctgaaaatgatgttccagaacctcccatgcctattgcagaccaagtcagcaatgatgaccgcccggagggcagtgttgaagatgaggagaagaaagagagctcgctgcccaaatcattcaagaggaagatctccgttgtctcagctaccaagggggtgccagctggaaacagtgacacagaggggggccagcctggtcggaaacgacgctggggagccagcacagccaccacacagaagaaaccttccatcagtatcaccactgaatcactaaagagcctcatccccgacatcaaacccctggcggggcaggaggctgttgtggatcttcatgctgatgactctcgcatctctgaggatgagacagagcgtaatggcgatgatgggacccatgacaaggggctgaaaatatgccggacagtcactcaggtagtacctgcagagggccaggagaatgggcagagggaagaagaggaagaagagaaggaacctgaagcagaacctcctgtacctccccaggtgtcagtagaggtggccttgcccccacctgcagagcatgaagtaaagaaagtgactttaggagataccttaactcgacgttccattagccagcagaagtccggagtttccattaccattgatgacccagtccgaactgcccaggtgccctccccaccccggggcaagattagcaacattgtccatatctccaatttggtccgtcctttcactttaggccagctaaaggagttgttggggcgcacaggaaccttggtggaagaggccttctggattgacaagatcaaatctcattgctttgtaacgtactcaacagtagaggaagctgttgccacccgcacagctctgcacggggtcaaatggccccagtccaatcccaaattcctttgtgctgactatgccgagcaagatgagctggattatcaccgaggcctcttggtggaccgtccctctgaaactaagacagaggagcagggaataccacggcccctgcaccccccacccccacccccggtccagccaccacagcacccccgggcagagcagcgggagcaggaacgggcagtgcgggaacagtgggcagaacgggaacgggaaatggagcggcgggagcggactcgatcagagcgtgaatgggatcgggacaaagttcgagaagggccccgttcccgatcaaggtcccgtgaccgccgccgcaaggaacgtgcgaagtctaaagaaaagaagagtgagaagaaagagaaagcccaggaggaaccacctgccaagctgctggatgaccttttccgaaagaccaaggcagctccctgcatctattggctcccactgactgacagccagatcgttcagaaagaggcagagcgggccgaacgggccaaggagcgggagaagcggcgaaaggagcaagaagaagaagagcaaaaggagcgggagaaggaagccgagcgggaacggaaccgacagctggagcgagagaaacgtcgggagcacagtcgggagagggacagggagagagagagagaaagggagcgggacaggggggaccgagatcgggatagggaaagggaccgagaacgaggcagggaaagggatcgcagggacaccaagcgccacagcagaagccggagtcggagcacacctgtgcgggaccggggtgggcgccgctagctgggaaaacactagagctgcaggtaccagccactcggccccagggggttatggccacagagggataggcacagtctccaccaccctggagccaagggtctttcacatcacctatccctacatacataccaaatggaaaagtggccatccttttccccccaaacacacccccttaacctatctcttgggacttagcccgaccctccctctcatttcccattaagtctgagaggcaagagctaggttaggcaaggaggtggttggccagagatggggaacagccaggtgccccagtcctctgatttttcctccatcctgcttaccacctccctgggtacttacagccttctcttgggaacagccggggccaggactgggtcacctatgagctgaatcagcatctcctcctgagtcccagggcccctgcagttcccagtctcttctgtcctgcagcccttgcctctttcccacaggttccactttatatccaccttttccttttgttcaatttttatttttattttttttattattaaatgatgtggtctatggaaaaaaaaataaaaatctgacttagttttaaa

SEQ ID NO: 356106 - DNA, 2376 bp, Homo sapiens
actagttctagatcgcgagctagaactagtcctgccagaatcagaaagaattcatcacactgttgaggagaaggaggaagtgaccatggacacaagtgaaaacagacctgaaaatgatgttccagaacctcccatgcctattgcagaccaagtcagcaatgatgaccgcccggagggcagtgttgaagatgaggagaagaaagagagctcgctgcccaaatcattcaagaggaagatctccgttgtctcagctaccaagggggtgccagctggaaacagtgacacagaggggggccagcctggtcggaaacgacgctggggagccagcacagccaccacacagaagaaaccttccatcagtatcaccactgaatcactaaagagcctcatccccgacatcaaacccctggcggggcaggaggctgttgtggatcttcatgctgatgactctcgcatctctgaggatgagacagagcgtaatggcgatgatgggacccatgacaaggggctgaaaatatgccggacagtcactcaggtagtacctgcagagggccaggagaatgggcagagggaagaagaggaagaagagaaggaacctgaagcagaacctcctgtacctccccaggtgtcagtagaggtggccttgcccccacctgcagagcatgaagtaaagaaagtgactttaggagataccttaactcgacgttccattagccagcagaagtccggagtttccattaccattgatgacccagtccgaactgcccaggtgccctccccaccccggggcaagattagcaacattgtccatatctccaatttggtccgtcctttcactttaggccagctaaaggagttgttggggcgcacaggaaccttggtggaagaggccttctggattgacaagatcaaatctcattgctttgtaacgtactcaacagtagaggaagctgttgccacccgcacagctctgcacggggtcaaatggccccagtccaatcccaaattcctttgtgctgactatgccgagcaagatgagctggattatcaccgaggcctcttggtggaccgtccctctgaaactaagacagaggagcagggaataccacggcccctgcaccccccacccccacccccggtccagccaccacagcacccccgggcagagcagcgggagcaggaacgggcagtgcgggaacagtgggcagaacgggaacgggaaatggagcggcgggagcggactcgatcagagcgtgaatgggatcgggacaaagttcgagaagggccccgttcccgatcaaggtcccgtgaccgccgccgcaaggaacgtgcgaagtctaaagaaaagaagagtgagaagaaagagaaagcccaggaggaaccacctgccaagctgctggatgaccttttccgaaagaccaaggcagctccctgcatctattggctcccactgactgacagccagatcgttcagaaagaggcagagcgggccgaacgggccaaggagcgggagaagcggcgaaaggagcaagaagaagaagagcaaaaggagcgggagaaggaagccgagcgggaacggaaccgacagctggagcgagagaaacgtcgggagcacagtcgggagagggacagggagagagagagagaaagggagcgggacaggggggaccgagatcgggatagggaaagggaccgagaacgaggcagggaaagggatcgcagggacaccaagcgccacagcagaagccggagtcggagcacacctgtgcgggaccggggtgggcgccgctagctgggaaaacactagagctgcaggtaccagccactcggccccagggggttatggccacagagggataggcacagtctccaccaccctggagccaagggtctttcacatcacctatccctacatacataccaaatggaaaagtggccatccttttccccccaaacacacccccttaacctatctcttgggacttagcccgaccctccctctcatttcccattaagtctgagaggcaagagctaggttaggcaaggaggtggttggccagagatggggaacagccaggtgccccagtcctctgatttttcctccatcctgcttaccacctccctgggtacttacagccttctcttgggaacagccggggccaggactgggtcacctatgagctgaatcagcatctcctcctgagtcccagggcccctgcagttcccagtctcttctgtcctgcagcccttgcctctttcccacaggttccactttatatccaccttttccttttgttcaatttttatttttattttttttattattaaatgatgtggtctatggaaaaaaaaataaaaatctgacttagttttaaa

SEQ ID NO: 356107 - DNA, 2273 bp, Homo sapiens
cctcccctgctgcagcaaggccctcccccatccgcacacacaggctgctgggtaagtggcaagatggctcccctgcatgtctccggctgatcgctgccgctccgccaatacaatagagccagccactaccagcagcctggccctcttcctccttctccagagagaccaatccagccgaactcggggtttgccgtgaggacttaacgcttatctcttaaaaccagcacagccaccacacagaagaaaccttccatcagtatcaccactgaatcactaaagagcctcatccccgacatcaaacccctggcggggcaggaggctgttgtggatcttcatgctgatgactctcgcatctctgaggatgagacagagcgtaatggcgatgatgggacccatgacaaggggctgaaaatatgccggacagtcactcaggtagtacctgcagagggccaggagaatgggcagagggaagaagaggaagaagagaaggaacctgaagcagaacctcctgtacctccccaggtgtcagtagaggtggccttgcccccacctgcagagcatgaagtaaagaaagtgactttaggagataccttaactcgacgttccattagccagcagaagtccggagtttccattaccattgatgacccagtccgaactgcccaggtgccctccccaccccggggcaagattagcaacattgtccatatctccaatttggtccgtcctttcactttaggccagctaaaggagttgttggggcgcacaggaaccttggtggaagaggccttctggattgacaagatcaaatctcattgctttgtaacgtactcaacagtagaggaagctgttgccacccgcacagctctgcacggggtcaaatggccccagtccaatcccaaattcctttgtgctgactatgccgagcaagatgagctggattatcaccgaggcctcttggtggaccgtccctctgaaactaagacagaggagcagggaataccacggcccctgcaccccccacccccacccccggtccagccaccacagcacccccgggcagagcagcgggagcaggaacgggcagtgcgggaacagtgggcagaacgggaacgggaaatggagcggcgggagcggactcgatcagagcgtgaatgggatcgggacaaagttcgagaagggccccgttcccgatcaaggtcccgtgaccgccgccgcaaggaacgtgcgaagtctaaagaaaagaagagtgagaagaaagagaaagcccaggaggaaccacctgccaagctgctggatgaccttttccgaaagaccaaggcagctccctgcatctattggctcccactgactgacagccagatcgttcagaaagaggcagagcgggccgaacgggccaaggagcgggagaagcggcgaaaggagcaagaagaagaagagcaaaaggagcgggagaaggaagccgagcgggaacggaaccgacagctggagcgagagaaacgtcgggagcacagtcgggagagggacagggagagagagagagaaagggagcgggacaggggggaccgagatcgggatagggaaagggaccgagaacgaggcagggaaagggatcgcagggacaccaagcgccacagcagaagccggagtcggagcacacctgtgcgggaccggggtgggcgccgctagctgggaaaacactagagctgcaggtaccagccactcggccccagggggttatggccacagagggataggcacagtctccaccaccctggagccaagggtctttcacatcacctatccctacatacataccaaatggaaaagtggccatccttttccccccaaacacacccccttaacctatctcttgggacttagcccgaccctccctctcatttcccattaagtctgagaggcaagagctaggttaggcaaggaggtggttggccagagatggggaacagccaggtgccccagtcctctgatttttcctccatcctgcttaccacctccctgggtacttacagccttctcttgggaacagccggggccaggactgggtcacctatgagctgaatcagcatctcctcctgagtcccagggcccctgcagttcccagtctcttctgtcctgcagcccttgcctctttcccacaggttccactttatatccaccttttccttttgttcaatttttatttttattttttttattattaaatgatgtggtctatggaaaaaaaaataaaaatctgacttagttttaaa

SEQ ID NO: 356108 - DNA, 1616 bp, Homo sapiens
ccgaataatcagctcagaacacccagcgtcagatccgactcctacatatgtatgaggatcacagtccgtcctttcactttaggccagctaaaggagttgttggggcgcacaggaaccttggtggaagaggccttctggattgacaagatcaaatctcattgctttgtaacgtactcaacagtagaggaagctgttgccacccgcacagctctgcacggggtcaaatggccccagtccaatcccaaattcctttgtgctgactatgccgagcaagatgagctggattatcaccgaggcctcttggtggaccgtccctctgaaactaagacagaggagcagggaataccacggcccctgcaccccccacccccacccccggtccagccaccacagcacccccgggcagagcagcgggagcaggaacgggcagtgcgggaacagtgggcagaacgggaacgggaaatggagcggcgggagcggactcgatcagagcgtgaatgggatcgggacaaagttcgagaagggccccgttcccgatcaaggtcccgtgaccgccgccgcaaggaacgtgcgaagtctaaagaaaagaagagtgagaagaaagagaaagcccaggaggaaccacctgccaagctgctggatgaccttttccgaaagaccaaggcagctccctgcatctattggctcccactgactgacagccagatcgttcagaaagaggcagagcgggccgaacgggccaaggagcgggagaagcggcgaaaggagcaagaagaagaagagcaaaaggagcgggagaaggaagccgagcgggaacggaaccgacagctggagcgagagaaacgtcgggagcacagtcgggagagggacagggagagagagagagaaagggagcgggacaggggggaccgagatcgggatagggaaagggaccgagaacgaggcagggaaagggatcgcagggacaccaagcgccacagcagaagccggagtcggagcacacctgtgcgggaccggggtgggcgccgctagctgggaaaacactagagctgcaggtaccagccactcggccccagggggttatggccacagagggataggcacagtctccaccaccctggagccaagggtctttcacatcacctatccctacatacataccaaatggaaaagtggccatccttttccccccaaacacacccccttaacctatctcttgggacttagcccgaccctccctctcatttcccattaagtctgagaggcaagagctaggttaggcaaggaggtggttggccagagatggggaacagccaggtgccccagtcctctgatttttcctccatcctgcttaccacctccctgggtacttacagccttctcttgggaacagccggggccaggactgggtcacctatgagctgaatcagcatctcctcctgagtcccagggcccctgcagttcccagtctcttctgtcctgcagcccttgcctctttcccacaggttccactttatatccaccttttccttttgttcaatttttatttttattttttttattattaaatgatgtggtctatggaaaaaaaaataaaaatctgacttagttttaaa

SEQ ID NO: 356109 - DNA, 1604 bp, Homo sapiens
gccattctcctgcctcagcctcccgaatagctgggactacaggcgcccgcaccacgcccggctaatttttttgtattttcagtagagacggggtttcactgtgtcagccaggatggtctcggtctcctgacctcgtgatctgaccgccttggcctcccaaagtgctgggattacaggcgtgacccaccgcgcccggccatcctggctccttgagtgggagtgatatcacctctatcctaactgtccttgtccctcctctccccacagctggattatcaccgaggcctcttggtggaccgtccctctgaaactaagacagaggagcagggaataccacggcccctgcaccccccacccccacccccggtccagccaccacagcacccccgggcagagcagcgggagcaggaacgggcagtgcgggaacagtgggcagaacgggaacgggaaatggagcggcgggagcggactcgatcagagcgtgaatgggatcgggacaaagttcgagaagggccccgttcccgatcaaggtcccgtgaccgccgccgcaaggaacgtgcgaagtctaaagaaaagaagagtgagaagaaagagaaagcccaggaggaaccacctgccaagctgctggatgaccttttccgaaagaccaaggcagctccctgcatctattggctcccactgactgacagccagatcgttcagaaagaggcagagcgggccgaacgggccaaggagcgggagaagcggcgaaaggagcaagaagaagaagagcaaaaggagcgggagaaggaagccgagcgggaacggaaccgacagctggagcgagagaaacgtcgggagcacagtcgggagagggacagggagagagagagagaaagggagcgggacaggggggaccgagatcgggatagggaaagggaccgagaacgaggcagggaaagggatcgcagggacaccaagcgccacagcagaagccggagtcggagcacacctgtgcgggaccggggtgggcgccgctagctgggaaaacactagagctgcaggtaccagccactcggccccagggggttatggccacagagggataggcacagtctccaccaccctggagccaagggtctttcacatcacctatccctacatacataccaaatggaaaagtggccatccttttccccccaaacacacccccttaacctatctcttgggacttagcccgaccctccctctcatttcccattaagtctgagaggcaagagctaggttaggcaaggaggtggttggccagagatggggaacagccaggtgccccagtcctctgatttttcctccatcctgcttaccacctccctgggtacttacagccttctcttgggaacagccggggccaggactgggtcacctatgagctgaatcagcatctcctcctgagtcccagggcccctgcagttcccagtctcttctgtcctgcagcccttgcctctttcccacaggttccactttatatccaccttttccttttgttcaatttttatttttattttttttattattaaatgatgtggtctatggaaaaaaaaataaaaatctgacttagttttaaa

SEQ ID NO: 356110 - DNA, 9068 bp, Homo sapiens
  misc_feature (633)..(633): n is a, c, g, or t
  misc_feature (670)..(670): n is a, c, g, or t
  misc_feature (706)..(706): n is a, c, g, or t
  misc_feature (840)..(840): n is a, c, g, or t
gagacggagtcttgctctgtcacccaggctgtagtgcaatggcgtgatctcaaccactgcttcctgggttcaagcgattctcctgcctcagcctcccgagtagctgggactataggcgtacgccaccacgcccggctaatttgtttgtatttttagtagagacggggtttcaccatattggccagactggtctccaactcctgacctcaagtgatccgcccgcctcggcctcccaaagtgctgggattataggcgtaagccaccgcgcccggcaccttgccactgattttgcatcatgaatgcaacggaaagatcagccaatttgactttaatagttttcagtctcttaaatctctaacgtatctcttaaatctctaaactatttgtctgtgacctattttactgtttgtgtttcttctgcatcaagttggaggattggtagtgacaaagaaagaagcccctaaacaattaatattagttcaagtaccaaaaaagttcagggcgcttgcattttccagttcttgccctacaggaagcagttcctccaagggaacttactctcttctgcggagcaaggaagaactttcccagaatcttgccacatggcttccaaggcaaactcaaactcaagtncagcgtcatagatcagttcatagtctgggtccgaagncacggcgatgcttcttgcgcacccccacggagcttnttattccgattccgccagccccccgcccctccccaaaaaaagcctaagatgggagtggctatgattcagaggacagagggcagaagctgtttgcgttaaggagtggggggcttgccctattaaggtaatccgcnaacaccgagtctgacccggcccatagaggtacttctaccccgcttacctccccttttctctcgaagggcacccgaagattgtcacgagtccttagactccaactactgcggcagcttccaaatttcctgaaaaccctaagctgggccagcccggcagcccacgcacttccggcctcggacccgccccaaacacccaagcgccccagcgcctcatctctaggtccggaaataaacgaacatctccgattatggttataccagggtcgagggtttccgaatatattcgattcaaagcttcggcaagacgaagaaaaccgagcctgaaagcagggcgagaaaaggggcgctgcagggcggatggaaagaattgattggtaacgatgtggagacggaaacatccgaggacatccggaggaacccggggagttctgagtggtaatcgaggggtagagtatggcagtgggcggggtcatctcggtacgttcgaagggcgttggcggaaattaccgaagatgcccgaagccgtcgggacggacccgagtacctcacgcaagatggcggagctggaggaggtgactctggacgggaagcctcttcaggcgctgcgggtgaccgacctgaaggccgcactggagcagcgaggcctagccaagagcgggcagaagagtgccctggtcaagcggctcaaaggggctctaatgctagaaaatttacagaaacactcaacaccccatgctgcattccagccaaattcccagattggtgaggaaatgagccagaacagtttcataaaacagtatctggaaaagcagcaggagctacttaggcagcgtctggaacgtgaagctcgagaagctgcagaacttgaagaagcttcagctgagtcggaggacgagatgatccatcctgagggagtggcttccctgctgcctcctgactttcagagcagcctggagagaccagagctggagctcagcagacattcgcccagaaaaagctcctcaatttctgaagagaaaggtgactctgatgatgagaaaccaaggaaaggagaaagacgatcatctagggtcagacaggcaagagcagctaaactgtctgagggcagccaacctgctgaggaggaagaggatcaagaaacaccttccagaaacctaagggtcagagcagatcgaaatttgaaaacagaggaggaagaagaggaggaggaggaggaggaagaagatgatgaagaagaggaaggtgatgatgagggacaaaaatctagggaggcaccaatcctgaaagagtttaaggaagaaggggaagagatacctagagtaaaaccagaggagatgatggatgagagacccaaaacaagatcccaggaacaggaggtgttagagagaggagggagatttacaagatcccaggaagaggctagaaaaagtcatctggccagacagcagcaggagaaggaaatgaaaacaacatctccccttgaggaggaagaaagagaaataaaatcttcacaaggcttaaaggaaaaatcgaagtctccttcccctcctcgactgactgaagatcgaaagaaggcctcacttgtagcgctgccagagcaaactgccagcgaggaggagactcctccacctttactaacaaaggaagcatcttctccaccacctcatccacagctccatagcgaagaagaaatagagcccatggaaggcccagccccccctgtcctcattcagttatctcctcctaatacagatgctgacaccagggagctattagtatctcagcatactgtccagttggtaggaggcctgtctcctttgtcaagtccttcagacaccaaagcagaatctccagcagagaaagtgccagaggagagtgtcctgcctctggttcagaaaagcacactggctgactactcagcccagaaggatcttgaacctgagtcagacagatctgctcagcccctccctctaaaaattgaggaattagcactggccaaaggaatcactgaagaatgtctgaaacagccatctttggaacagaaggaaggcagaagagcttctcatacccttctcccaagccacagattgaaacagtcagctgattcatcctctagccggtcctcctcatcttcctcctccagttctagatcaagatctcgctctcctgacagttcaggttctcggtctcattcaccgctcagatccaagcagagagatgtagcccaggcacgtactcatgccaaccctcgtggtagacccaagatgggctccagatcaacatcagagtccagatcaaggtccgttcacgttcacgttctcgttcagcatcaagcaacagcagaaaatctctgagccctggagtctccagggacagcagcaccagctatactgaaaccaaagatccctcttctggtcaggaggttgcaactccaccagtgccacaactgcaggtctgtgagccaaaggagaggacttccacctcctcatcctctgtccaagcaaggcgtctgagtcagcctgaatcagctgaaaagcatgtgacccagaggttacagcctgagcgggggagcccaaagaagtgtgaagctgaagaggcagagccaccagctgccacacagccccaaacctcagagactcagacctctcatctgccagaatcagaaagaattcatcacactgttgaggagaaggaggaagtgaccatggacacaagtgaaaacagacctgaaaatgatgttccagaacctcccatgcctattgcagaccaagtcagcaatgatgaccgcccggagggcagtgttgaagatgaggagaagaaagaggtaaacatccaagccacctattggggcgggtgggcaggaatggacctaggggaaagagtagagcactctagtgatccctcttacacggtgggttaacttaaaggagggatgaggcagggacttggatcagaatagggccaagggagaattcgctggtttagcaagggagaccccttgtgacggggacagggctcattcattttcctttccttgttggggaagtagtgcccagactctagacgtttgtaactaacgggaaagtctgataatggccctttatctaagatttatgttcagcttttcctgctgtcttcccaagcttctcctggtggtaactcctttagctttccctcctttttaaaagcctgatggagcccaacgccatctagtggacattggtggttctcaccagaccagccatgctgagaaatttttgttcctcctctgccctccagtggtctgactgcagagatgtagctacttagaagccagcacttgtgatccggaaggcccattctcagttacctgtgacccctctacctccttttttggcatatgttatcttgtgtcctgcacccacttcagggggcttcccccatcagagccagcgaagtcttcttggctcttaaagtaattgagaaagaatgagctgggtttaggagaggggtaacaaggtgggagggactgttgtgtgtgtagcctttttctggtgtgtgttgcgggggtgggggccggtgaaagtgatttgatgtgcagaatattatttattacaaggtccttcttccccgtaaaactttgtccaagtacctcatgtacggtaatccgcccgtaaaatataaccctgcccaactggccaatcgctgatgccgcctcttcctctggacccacccgctgctactgagctgcccaatcagagccaagtctgctatccaggtgtcttggccagaggggggcatgtatatgggctcctgtgatgggcccccttttgcctccctgtcttgcttacatcagggggccaagaagaacactgttctggagagacttgtattgagcaagcaaaaaacatttggaaaggggtggacttgcatcatctccctacttgggacaccccaagaagagcttgtgccagtgctggggcgcctgcccacatgcccttgcccttttgaggactgtgggttgccttgtttgctacagactgttgggatccccatctagggcaccaagacctcctaaagtttgtgatcgcagtgccatgctgtaaaacactgagtgggaccctctacttaagctgtgacgactaggaaccgtgcagaggagtctagggtctgagcccctggggatttaatgctgatgacagcccagcccatgtgtcaccacttgctcatcagatggactttcctttggtccctgttgtccatggtgaagggcagcatgttggttgctccaacttctcctccatccctggaggcagggactcatttcatccacctgactggaaccactgtctcagctggagtccctgaggagatgccagccacaactctccgaagagaagtattctgaccttgctgctgaatgtctgccaggtcctggggtattcacctacccccaggctaccttcatcagaggctccatgatcccactcggtgagaggaccccctccccagttacaggcagaggagaaagggactctggagtcatcacctggattccaagtattgggtggtgttattgctgcagcttgccactggtggacatagggtcctgcctgcctctcacgataaaaggcaaggatcattcctgctactcacaggccatctcatcagggactgcaagatgatgtcccttcagggccaggactgatgtctctgcccctttcccccctctatccctcgctgagcctggccaccgccagtgaactgtcttgacatcatggaaactgggcagcgtccccccacacgtttccctcccgccccccctgcgcccctgggaggactctggcagtgccgtgctgactaccacgccgtgcgcccaccttttttgccaacccaaccccccaccaattgcacagcgcctagcagggagggctcattctgattggaccggcggttgactagatacagtccccacagtgaggtgcgattggctgaactgaagatcccaggtgtgagatggtacctggaacatttgtcatattcctagtttattttcttctttattttcttcttctttttttaatattttattttattttttttctatatctttattttttctgatttcttttatttatttatttggttcatgtttttcctgttttaattaagacctttttttttgttttgtttttctcactaacttacccatcgagagcggcccagctaggggtcaggctggcccttaacagagaccaaggagacttggttagacgacacaaacggggctgcgggtgggggtggatgggaaagggatttcatcacgaggtttctgccctaccctttagaagagtggtagagtggtcttagtttttccagaaataagcacctacacttgaaaatactctattccctttttctctctcacttttctcccccgccccccatagtctttcgtcattcacccactgagtgtttggggtagagacttgtcccaaagatgtcttctggtctttggcagagcccctaaggcttgagccctggttggagaggaaacagtaagactctgctggagctccctgcggtggctggaaagtctaaggatctccttggggacaatctgcccttcataaaaaccttcctttatcaaagacacctttgagttctttttgctagcacttggctcaagagcctcatctccagtgggtctggtgctgcccttttccacagtgtggtgggggtctgggcagtcttgacatgacagtctgctgtccaagcatctcaaagccattgtcagtgggcatcagtctggccattgaagaaaggagggttaccttgttgaagttgccatccaaagttggttttccttgtttcctcgagttagcaaggaaggacctgggaggactagatgacccagtttggggcacagtttgtttggcttggtgtcctctcgactcagacggtgaaagagggggtatgaccaacatctttagggggctgagaggctactgaactcctcttccagcttatttctggttaagctaatacacaggtgtgatacggagtagatgacttttccctgctctgatgtttagttttatttttttctctaacttgcattgattctgcttcgtttttgccgtttgccgcttctgttttggtctctgtctgtctctgtgtctctctctgtctctctctctcactctatctgtgtctttggaggctaagctaagactgccccatctaacctccttcccccctctctgtggggtgtctctctttctcttttttttcccctttttcttcttcatacagagctcgctgcccaaatcattcaagaggaagatctccgttgtctcagctaccaagggggtgccagctggaaacagtgacacagaggggggccagcctggtcggaaacgacgctggggagccagcacagccaccacacagaagaaaccttccatcagtatcaccactgaatcactaaagagcctcatccccgacatcaaacccctggcggggcaggaggctgttgtggatcttcatgctgatgactctcgcatctctgaggatgagacagagcgtaatggcgatgatgggacccatgacaaggggctgaaaatatgccggacagtcactcaggtagtacctgcagagggccaggagaatgggcagagggaagaagaggaagaagagaaggaacctgaagcagaacctcctgtacctccccaggtgtcagtagaggtggccttgcccccacctgcagagcatgaagtaaagaaagtgactttaggagataccttaactcgacgttccattagccagcagaagtccggagtttccattaccattgatgacccagtccgaactgcccaggtgccctccccaccccggggcaagattagcaacattgtccatatctccaatttggtccgtcctttcactttaggccagctaaaggagttgttggggcgcacaggaaccttggtggaagaggccttctggattgacaagatcaaatctcattgctttgtaacgtactcaacagtagaggaagctgttgccacccgcacagctctgcacggggtcaaatggccccagtccaatcccaaattcctttgtgctgactatgccgagcaagatgagctggattatcaccgaggcctcttggtggaccgtccctctgaaactaagacagaggagcagggaataccacggcccctgcaccccccacccccacccccggtccagccaccacagcacccccgggcagagcagcgggagcaggaacgggcagtgcgggaacagtgggcagaacgggaacgggaaatggagcggcgggagcggactcgatcagagcgtgaatgggatcgggacaaagttcgagaagggccccgttcccgatcaaggtcccgtgaccgccgccgcaaggaacgtgcgaagtctaaagaaaagaagagtgagaagaaagagaaagcccaggaggaaccacctgccaagctgctggatgaccttttccgaaagaccaaggcagctccctgcatctattggctcccactgactgacagccagatcgttcagaaagaggcagagcgggccgaacgggccaaggagcgggagaagcggcgaaaggagcaagaagaagaagagcaaaaggagcgggagaaggaagccgagcgggaacggaaccgacagctggagcgagagaaacgtcgggagcacagtcgggagagggacagggagagagagagagaaagggagcgggacaggggggaccgagatcgggatagggaaagggaccgagaacgaggcagggaaagggatcgcagggacaccaagcgccacagcagaagccggagtcggagcacacctgtgcgggaccggggtgggcgccgctagctgggaaaacactagagctgcaggtaccagccactcggccccagggggttatggccacagagggataggcacagtctccaccaccctggagccaagggtctttcacatcacctatccctacatacataccaaatggaaaagtggccatccttttccccccaaacacacccccttaacctatctcttgggacttagcccgaccctccctctcatttcccattaagtctgagaggcaagagctaggttaggcaaggaggtggttggccagagatggggaacagccaggtgccccagtcctctgatttttcctccatcctgcgacctatgagggatcctctagatcgccc

SEQ ID NO: 356111 - DNA, 8731 bp, Homo sapiens
  misc_feature (633)..(633): n is a, c, g, or t
  misc_feature (670)..(670): n is a, c, g, or t
  misc_feature (706)..(706): n is a, c, g, or t
  misc_feature (840)..(840): n is a, c, g, or t
gagacggagtcttgctctgtcacccaggctgtagtgcaatggcgtgatctcaaccactgcttcctgggttcaagcgattctcctgcctcagcctcccgagtagctgggactataggcgtacgccaccacgcccggctaatttgtttgtatttttagtagagacggggtttcaccatattggccagactggtctccaactcctgacctcaagtgatccgcccgcctcggcctcccaaagtgctgggattataggcgtaagccaccgcgcccggcaccttgccactgattttgcatcatgaatgcaacggaaagatcagccaatttgactttaatagttttcagtctcttaaatctctaacgtatctcttaaatctctaaactatttgtctgtgacctattttactgtttgtgtttcttctgcatcaagttggaggattggtagtgacaaagaaagaagcccctaaacaattaatattagttcaagtaccaaaaaagttcagggcgcttgcattttccagttcttgccctacaggaagcagttcctccaagggaacttactctcttctgcggagcaaggaagaactttcccagaatcttgccacatggcttccaaggcaaactcaaactcaagtncagcgtcatagatcagttcatagtctgggtccgaagncacggcgatgcttcttgcgcacccccacggagcttnttattccgattccgccagccccccgcccctccccaaaaaaagcctaagatgggagtggctatgattcagaggacagagggcagaagctgtttgcgttaaggagtggggggcttgccctattaaggtaatccgcnaacaccgagtctgacccggcccatagaggtacttctaccccgcttacctccccttttctctcgaagggcacccgaagattgtcacgagtccttagactccaactactgcggcagcttccaaatttcctgaaaaccctaagctgggccagcccggcagcccacgcacttccggcctcggacccgccccaaacacccaagcgccccagcgcctcatctctaggtccggaaataaacgaacatctccgattatggttataccagggtcgagggtttccgaatatattcgattcaaagcttcggcaagacgaagaaaaccgagcctgaaagcagggcgagaaaaggggcgctgcagggcggatggaaagaattgattggtaacgatgtggagacggaaacatccgaggacatccggaggaacccggggagttctgagtggtaatcgaggggtagagtatggcagtgggcggggtcatctcggtacgttcgaagggcgttggcggaaattaccgaagatgcccgaagccgtcgggacggacccgagtacctcacgcaagatggcggagctggaggaggtgactctggacgggaagcctcttcaggcgctgcgggtgaccgacctgaaggccgcactggagcagcgaggcctagccaagagcgggcagaagagtgccctggtcaagcggctcaaaggggctctaatgctagaaaatttacagaaacactcaacaccccatgctgcattccagccaaattcccagattggtgaggaaatgagccagaacagtttcataaaacagtatctggaaaagcagcaggagctacttaggcagcgtctggaacgtgaagctcgagaagctgcagaacttgaagaagcttcagctgagtcggaggacgagatgatccatcctgagggagtggcttccctgctgcctcctgactttcagagcagcctggagagaccagagctggagctcagcagacattcgcccagaaaaagctcctcaatttctgaagagaaaggtgactctgatgatgagaaaccaaggaaaggagaaagacgatcatctagggtcagacaggcaagagcagctaaactgtctgagggcagccaacctgctgaggaggaagaggatcaagaaacaccttccagaaacctaagggtcagagcagatcgaaatttgaaaacagaggaggaagaagaggaggaggaggaggaggaagaagatgatgaagaagaggaaggtgatgatgagggacaaaaatctagggaggcaccaatcctgaaagagtttaaggaagaaggggaagagatacctagagtaaaaccagaggagatgatggatgagagacccaaaacaagatcccaggaacaggaggtgttagagagaggagggagatttacaagatcccaggaagaggctagaaaaagtcatctggccagacagcagcaggagaaggaaatgaaaacaacatctccccttgaggaggaagaaagagaaataaaatcttcacaaggcttaaaggaaaaatcgaagtctccttcccctcctcgactgactgaagatcgaaagaaggcctcacttgtagcgctgccagagcaaactgccagcgaggaggagactcctccacctttactaacaaaggaagcatcttctccaccacctcatccacagctccatagcgaagaagaaatagagcccatggaaggcccagccccccctgtcctcattcagttatctcctcctaatacagatgctgacaccagggagctattagtatctcagcatactgtccagttggtaggaggcctgtctcctttgtcaagtccttcagacaccaaagcagaatctccagcagagaaagtgccagaggagagtgtcctgcctctggttcagaaaagcacactggctgactactcagcccagaaggatcttgaacctgagtcagacagatctgctcagcccctccctctaaaaattgaggaattagcactggccaaaggaatcactgaagaatgtctgaaacagccatctttggaacagaaggaaggcagaagagcttctcatacccttctcccaagccacagattgaaacagtcagctgattcatcctctagccggtcctcctcatcttcctcctccagttctagatcaagatctcgctctcctgacagttcaggttctcggtctcattcaccgctcagatccaagcagagagatgtagcccaggcacgtactcatgccaaccctcgtggtagacccaagatgggctccagatcaacatcagagtccagatcaaggtccgttcacgttcacgttctcgttcagcatcaagcaacagcagaaaatctctgagccctggagtctccagggacagcagcaccagctatactgaaaccaaagatccctcttctggtcaggaggttgcaactccaccagtgccacaactgcaggtctgtgagccaaaggagaggacttccacctcctcatcctctgtccaagcaaggcgtctgagtcagcctgaatcagctgaaaagcatgtgacccagaggttacagcctgagcgggggagcccaaagaagtgtgaagctgaagaggcagagccaccagctgccacacagccccaaacctcagagactcagacctctcatctgccagaatcagaaagaattcatcacactgttgaggagaaggaggaagtgaccatggacacaagtgaaaacagacctgaaaatgatgttccagaacctcccatgcctattgcagaccaagtcagcaatgatgaccgcccggagggcagtgttgaagatgaggagaagaaagaggtaaacatccaagccacctattggggcgggtgggcaggaatggacctaggggaaagagtagagcactctagtgatccctcttacacggtgggttaacttaaaggagggatgaggcagggacttggatcagaatagggccaagggagaattcgctggtttagcaagggagaccccttgtgacggggacagggctcattcattttcctttccttgttggggaagtagtgcccagactctagacgtttgtaactaacgggaaagtctgataatggccctttatctaagatttatgttcagcttttcctgctgtcttcccaagcttctcctggtggtaactcctttagctttccctcctttttaaaagcctgatggagcccaacgccatctagtggacattggtggttctcaccagaccagccatgctgagaaatttttgttcctcctctgccctccagtggtctgactgcagagatgtagctacttagaagccagcacttgtgatccggaaggcccattctcagttacctgtgacccctctacctccttttttggcatatgttatcttgtgtcctgcacccacttcagggggcttcccccatcagagccagcgaagtcttcttggctcttaaagtaattgagaaagaatgagctgggtttaggagaggggtaacaaggtgggagggactgttgtgtgtgtagcctttttctggtgtgtgttgcgggggtgggggccggtgaaagtgatttgatgtgcagaatattatttattacaaggtccttcttccccgtaaaactttgtccaagtacctcatgtacggtaatccgcccgtaaaatataaccctgcccaactggccaatcgctgatgccgcctcttcctctggacccacccgctgctactgagctgcccaatcagagccaagtctgctatccaggtgtcttggccagaggggggcatgtatatgggctcctgtgatgggcccccttttgcctccctgtcttgcttacatcagggggccaagaagaacactgttctggagagacttgtattgagcaagcaaaaaacatttggaaaggggtggacttgcatcatctccctacttgggacaccccaagaagagcttgtgccagtgctggggcgcctgcccacatgcccttgcccttttgaggactgtgggttgccttgtttgctacagactgttgggatccccatctagggcaccaagacctcctaaagtttgtgatcgcagtgccatgctgtaaaacactgagtgggaccctctacttaagctgtgacgactaggaaccgtgcagaggagtctagggtctgagcccctggggatttaatgctgatgacagcccagcccatgtgtcaccacttgctcatcagatggactttcctttggtccctgttgtccatggtgaagggcagcatgttggttgctccaacttctcctccatccctggaggcagggactcatttcatccacctgactggaaccactgtctcagctggagtccctgaggagatgccagccacaactctccgaagagaagtattctgaccttgctgctgaatgtctgccaggtcctggggtattcacctacccccaggctaccttcatcagaggctccatgatcccactcggtgagaggaccccctccccagttacaggcagaggagaaagggactctggagtcatcacctggattccaagtattgggtggtgttattgctgcagcttgccactggtggacatagggtcctgcctgcctctcacgataaaaggcaaggatcattcctgctactcacaggccatctcatcagggactgcaagatgatgtcccttcagggccaggactgatgtctctgcccctttcccccctctatccctcgctgagcctggccaccgccagtgaactgtcttgacatcatggaaactgggcagcgtccccccacacgtttccctcccgccccccctgcgcccctgggaggactctggcagtgccgtgctgactaccacgccgtgcgcccaccttttttgccaacccaaccccccaccaattgcacagcgcctagcagggagggctcattctgattggaccggcggttgactagatacagtccccacagtgaggtgcgattggctgaactgaagatcccaggtgtgagatggtacctggaacatttgtcatattcctagtttattttcttctttattttcttcttctttttttaatattttattttattttttttctatatctttattttttctgatttcttttatttatttatttggttcatgtttttcctgttttaattaagacctttttttttgttttgtttttctcactaacttacccatcgagagcggcccagctaggggtcaggctggcccttaacagagaccaaggagacttggttagacgacacaaacggggctgcgggtgggggtggatgggaaagggatttcatcacgaggtttctgccctaccctttagaagagtggtagagtggtcttagtttttccagaaataagcacctacacttgaaaatactctattccctttttctctctcacttttctcccccgccccccatagtctttcgtcattcacccactgagtgtttggggtagagacttgtcccaaagatgtcttctggtctttggcagagcccctaaggcttgagccctggttggagaggaaacagtaagactctgctggagctccctgcggtggctggaaagtctaaggatctccttggggacaatctgcccttcataaaaaccttcctttatcaaagacacctttgagttctttttgctagcacttggctcaagagcctcatctccagtgggtctggtgctgcccttttccacagtgtggtgggggtctgggcagtcttgacatgacagtctgctgtccaagcatctcaaagccattgtcagtgggcatcagtctggccattgaagaaaggagggttaccttgttgaagttgccatccaaagttggttttccttgtttcctcgagttagcaaggaaggacctgggaggactagatgacccagtttggggcacagtttgtttggcttggtgtcctctcgactcagacggtgaaagagggggtatgaccaacatctttagggggctgagaggctactgaactcctcttccagcttatttctggttaagctaatacacaggtgtgatacggagtagatgacttttccctgctctgatgtttagttttatttttttctctaacttgcattgattctgcttcgtttttgccgtttgccgcttctgttttggtctctgtctgtctctgtgtctctctctgtctctctctctcactctatctgtgtctttggaggctaagctaagactgccccatctaacctccttcccccctctctgtggggtgtctctctttctcttttttttcccctttttcttcttcatacagagctcgctgcccaaatcattcaagaggaagatctccgttgtctcagctaccaagggggtgccagctggaaacagtgacacagaggggggccagcctggtcggaaacgacgctggggagccagcacagccaccacacagaagaaaccttccatcagtatcaccactgaatcactaaagagcctcatccccgacatcaaacccctggcggggcaggaggctgttgtggatcttcatgctgatgactctcgcatctctgaggatgagacagagcgtaatggcgatgatgggacccatgacaaggggctgaaaatatgccggacagtcactcaggtagtacctgcagagggccaggagaatgggcagagggaagaagaggaagaagagaaggaacctgaagcagaacctcctgtacctccccaggtgtcagtagaggtggccttgcccccacctgcagagcatgaagtaaagaaagtgactttaggagataccttaactcgacgttccattagccagcagaagtccggagtttccattaccattgatgacccagtccgaactgcccaggtgccctccccaccccggggcaagattagcaacattgtccatatctccaatttggtccgtcctttcactttaggccagctaaaggagttgttggggcgcacaggaaccttggtggaagaggccttctggattgacaagatcaaatctcattgctttgtaacgtactcaacagtagaggaagctgttgccacccgcacagctctgcacggggtcaaatggccccagtccaatcccaaattcctttgtgctgactatgccgagcaagatgagctggattatcaccgaggcctcttggtggaccgtccctctgaaactaagacagaggagcagggaataccacggcccctgcaccccccacccccacccccggtccagccaccacagcacccccgggcagagcagcgggagcaggaacgggcagtgcgggaacagtgggcagaacgggaacgggaaatggagcggcgggagcggactcgatcagagcgtgaatgggatcgggacaaagttcgagaagggccccgttcccgatcaaggtcccgtgaccgccgccgcaaggaacgtgcgaagtctaaagaaaagaagagtgagaagaaagagaaagcccaggaggaaccacctgccaagctgctggatgaccttttccgaaagaccaaggcagctccctgcatctattggctcccactgactgacagccagatcgttcagaaagaggcagagcgggccgaacgggccaaggagcgggagaagcggcgaaaggagcaagaagaagaagagcaaaaggagcgggagaaggaagccgagcgggaacagccggggccaggactgggtcacctatgagctgaatcagcatctcctcctgagtcccagggcccctgcagttcccagtctcttctgtcctgcagcccttgcctctttcccacaggttccactttatatccaccttttccttttgttcaatttttatttttattttttttattattaaatgatgtggtctatggaaaaaaaaataaaaatctgacttagttttaaa

SEQ ID NO: 356112 - DNA, 3556 bp, Homo sapiens
  misc_feature (633)..(633): n is a, c, g, or t
  misc_feature (670)..(670): n is a, c, g, or t
  misc_feature (706)..(706): n is a, c, g, or t
  misc_feature (840)..(840): n is a, c, g, or t
gagacggagtcttgctctgtcacccaggctgtagtgcaatggcgtgatctcaaccactgcttcctgggttcaagcgattctcctgcctcagcctcccgagtagctgggactataggcgtacgccaccacgcccggctaatttgtttgtatttttagtagagacggggtttcaccatattggccagactggtctccaactcctgacctcaagtgatccgcccgcctcggcctcccaaagtgctgggattataggcgtaagccaccgcgcccggcaccttgccactgattttgcatcatgaatgcaacggaaagatcagccaatttgactttaatagttttcagtctcttaaatctctaacgtatctcttaaatctctaaactatttgtctgtgacctattttactgtttgtgtttcttctgcatcaagttggaggattggtagtgacaaagaaagaagcccctaaacaattaatattagttcaagtaccaaaaaagttcagggcgcttgcattttccagttcttgccctacaggaagcagttcctccaagggaacttactctcttctgcggagcaaggaagaactttcccagaatcttgccacatggcttccaaggcaaactcaaactcaagtncagcgtcatagatcagttcatagtctgggtccgaagncacggcgatgcttcttgcgcacccccacggagcttnttattccgattccgccagccccccgcccctccccaaaaaaagcctaagatgggagtggctatgattcagaggacagagggcagaagctgtttgcgttaaggagtggggggcttgccctattaaggtaatccgcnaacaccgagtctgacccggcccatagaggtacttctaccccgcttacctccccttttctctcgaagggcacccgaagattgtcacgagtccttagactccaactactgcggcagcttccaaatttcctgaaaaccctaagctgggccagcccggcagcccacgcacttccggcctcggacccgccccaaacacccaagcgccccagcgcctcatctctaggtccggaaataaacgaacatctccgattatggttataccagggtcgagggtttccgaatatattcgattcaaagcttcggcaagacgaagaaaaccgagcctgaaagcagggcgagaaaaggggcgctgcagggcggatggaaagaattgattggtaacgatgtggagacggaaacatccgaggacatccggaggaacccggggagttctgagtggtaatcgaggggtagagtatggcagtgggcggggtcatctcggtacgttcgaagggcgttggcggaaattaccgaagatgcccgaagccgtcgggacggacccgagtacctcacgcaagatggcggagctggaggaggtgactctggacgggaagcctcttcaggcgctgcgggtgaccgacctgaaggccgcactggagcagcgaggcctagccaagagcgggcagaagagtgccctggtcaagcggctcaaaggggctctaatgctagaaaatttacagaaacactcaacaccccatgctgcattccagccaaattcccagattggtgaggaaatgagccagaacagtttcataaaacagtatctggaaaagcagcaggagctacttaggcagcgtctggaacgtgaagctcgagaagctgcagaacttgaagaagcttcagctgagtcggaggacgagatgatccatcctgagggagtggcttccctgctgcctcctgactttcagagcagcctggagagaccagagctggagctcagcagacattcgcccagaaaaagctcctcaatttctgaagagaaaggtgactctgatgatgagaaaccaaggaaaggagaaagacgatcatctagggtcagacaggcaagagcagctaaactgtctgagggcagccaacctgctgaggaggaagaggatcaagaaacaccttccagaaacctaagggtcagagcagatcgaaatttgaaaacagaggaggaagaagaggaggaggaggaggaggaagaagatgatgaagaagaggaaggtgatgatgagggacaaaaatctagggaggcaccaatcctgaaagagtttaaggaagaaggggaagagatacctagagtaaaaccagaggagatgatggatgagagacccaaaacaagatcccaggaacaggaggtgttagagagaggagggagatttacaagatcccaggaagaggctagaaaaagtcatctggccagacagcagcaggagaaggaaatgaaaacaacatctccccttgaggaggaagaaagagaaataaaatcttcacaaggcttaaaggaaaaatcgaagtctccttcccctcctcgactgactgaagatcgaaagaaggcctcacttgtagcgctgccagagcaaactgccagcgaggaggagactcctccacctttactaacaaaggaagcatcttctccaccacctcatccacagctccatagcgaagaagaaatagagcccatggaaggcccagccccccctgtcctcattcagttatctcctcctaatacagatgctgacaccagggagctattagtatctcagcatactgtccagttggtaggaggcctgtctcctttgtcaagtccttcagacaccaaagcagaatctccagcagagaaagtgccagaggagagtgtcctgcctctggttcagaaaagcacactggctgactactcagcccagaaggatcttgaacctgagtcagacagatctgctcagcccctccctctaaaaattgaggaattagcactggccaaaggaatcactgaagaatgtctgaaacagccatctttggaacagaaggaaggcagaagagcttctcatacccttctcccaagccacagattgaaacagtcagctgattcatcctctagccggtcctcctcatcttcctcctccagttctagatcaagatctcgctctcctgacagttcaggttctcggtctcattcaccgctcagatccaagcagagagatgtagcccaggcacgtactcatgccaaccctcgtggtagacccaagatgggctccagatcaacatcagagtccagatcaaggtccgttcacgttcacgttctcgttcagcatcaagcaacagcagaaaatctctgagccctggagtctccagggacagcagcaccagctatactgaaaccaaagatccctcttctggtcaggaggttgcaactccaccagtgccacaactgcaggtctgtgagccaaaggagaggacttccacctcctcatcctctgtccaagcaaggcgtctgagtcagcctgaatcagctgaaaagcatgtgacccagaggttacagcctgagcgggggagcccaaagaagtgtgaagctgaagaggcagagccaccagctgccacacagccccaaacctcagagactcagaccctagactcctctgcacggttcctagtcgtcacagcttaagtagagggtcccactcagtgttttacagcatgg

SEQ ID NO: 356113 - DNA, 1707 bp, Homo sapiens
ctgagctgcatcatggtgcggtctgtggcctgggcaggtttcatggtcctgctgatgatcccatggggctctgctgcaaaactggtctgctacttcaccaactgggcccagtacagacagggggaggctcgcttcctgcccaaggacttggaccccagcctttgcacccacctcatctacgccttcgctggcatgaccaaccaccagctgagcaccactgagtggaatgacgagactctctaccaggagttcaatggcctgaagaagatgaatcccaagctgaagaccctgttagccatcggaggctggaatttcggcactcagaagttcacagatatggtagccacggccaacaaccgtcagacctttgtcaactcggccatcaggtttctgcgcaaatacagctttgacggccttgaccttgactgggagtacccaggaagccaggggagccctgccgtagacaaggagcgcttcacaaccctggtacaggacttggccaatgccttccagcaggaagcccagacctcagggaaggaacgccttcttctgagtgcagcggttccagctgggcagacctatgtggatgctggatacgaggtggacaaaatcgcccagaacctggattttgtcaaccttatggcctacgacttccatggctcttgggagaaggtcacgggacataacagccccctctacaagaggcaagaagagagtggtgcagcagccagcctcaacgtggatgctgctgtgcaacagtggctgcagaaggggacccctgccagcaagctgatccttggcatgcctacctacggacgctccttcacactggcctcctcatcagacaccagagtgggggccccagccacagggtctggcactccaggccccttcaccaaggaaggagggatgctggcctactatgaagtctgctcctggaagggggccaccaaacagagaatccaggatcagaaggtgccctacatcttccgggacaaccagtgggtgggctttgatgatgtggagagcttcaaaaccaaggtcagctatctgaagcagaagggactgggcggggccatggtctgggcactggacttagatgactttgccggcttctcctgcaaccagggccgataccccctcatccagacgctacggcaggaactgaatgggtaaagccttaactgcctgtcacatgtgaggccaggtgttgcctgtggcactgtgcttcagctgtaggtcttccatacttgccttcaggcaccccagagcttgaagttccaaaaccaggtcagccctctgaacctgagcatggccccagccctggacaagacacgttctgccagggcaaagctgatgggctctatcccaatcctcgggaacggtccagcttctacagctgtgcagcggggcggctgttccagcaaagctgcccgacaggcctggtgttcagcaactcctgcaaatgctgcacctggaattgagtcgctaaagcccctccagtcccagctttgaggctgggcccaggatcactctacagcctgcctcctgggttttccctgggggccgcaatctggctcctgcaggcctttctgtggtcttcctttatccaggctttctgctctcagccttgccttccttttttctgggtctcctgggctgcccctttcacttgcaaaataaatctttggtttgtgcccctcttca

SEQ ID NO: 356114 - DNA, 1579 bp, Homo sapiens
ctgagctgcatcatggtgcggtctgtggcctgggcaggtttcatggtcctgctgatgatcccatggggctctgctgcaaaactggtctgctacttcaccaactgggcccagtacagacagggggaggctcgcttcctgcccaaggacttggaccccagcctttgcacccacctcatctacgccttcgctggcatgaccaaccaccagctgagcaccactgagtggaatgacgagactctctaccaggagttcaatggcctgaagaagatgttcacagatatggtagccacggccaacaaccgtcagacctttgtcaactcggccatcaggtttctgcgcaaatacagctttgacggccttgaccttgactgggagtacccaggaagccaggggagccctgccgtagacaaggagcgcttcacaaccctggtacaggacttggccaatgccttccagcaggaagcccagacctcagggaaggaacgccttcttctgagtgcagcggttccagctgggcagacctatgtggatgctggatacgaggtggacaaaatcgcccagaacctggattttgtcaaccttatggcctacgacttccatggctcttgggagaaggtcacgggacataacagccccctctacaagaggcaagaagagagtggtgcagcagccagcctcaacgtggatgctgctgtgcaacagtggctgcagaaggggacccctgccagcaagctgatccttggcatgcctacctacggacgctccttcacactggcctcctcatcagacaccagagtgggggccccagccacagggtctggcactccaggccccttcaccaaggaaggagggatgctggcctactatgaagtctgctcctggaagggggccaccaaacagagaatccaggatcagaaggtgccctacatcttccgggacaaccagtgggtgggctttgatgatgtggagagcttcaaaaccaaggtcagctatctgaagcagaagggactgggcggggccatggtctgggcactggacttagatgactttgccggcttctcctgcaaccagggccgataccccctcatccagacgctacggcaggaactgagtcttccatacttgccttcaggcaccccagagcttgaagttccaaaaccaggtcagccctctgaacctgagcatggccccagccctggacaagacacgttctgccagggcaaagctgatgggctctatcccaatcctcgggaacggtccagcttctacagctgtgcagcggggcggctgttccagcaaagctgcccgacaggcctggtgttcagcaactcctgcaaatgctgcacctggaattgagtcgctaaagcccctccagtcccagctttgaggctgggcccaggatcactctacagcctgcctcctgggttttccctgggggccgcaatctggctcctgcaggcctttctgtggtcttcctttatccaggctttctgctctcagccttgccttccttttttctgggtctcctgggctgcccctttcacttgcaaaataaatctttggtttgtgcccctcttca

SEQ ID NO: 356115 - DNA, 1636 bp, Homo sapiens
ctgagctgcatcatggtgcggtctgtggcctgggcaggtttcatggtcctgctgatgatcccatggggctctgctgcaaaactggtctgctacttcaccaactgggcccagtacagacagggggaggctcgcttcctgcccaaggacttggaccccagcctttgcacccacctcatctacgccttcgctggcatgaccaaccaccagctgagcaccactgagtggaatgacgagactctctaccaggagttcaatggcctgaagaagatgaatcccaagctgaagaccctgttagccatcggaggctggaatttcggcactcagaagttcacagatatggtagccacggccaacaaccgtcagacctttgtcaactcggccatcaggtttctgcgcaaatacagctttgacggccttgaccttgactgggagtacccaggaagccaggggagccctgccgtagacaaggagcgcttcacaaccctggtacaggacttggccaatgccttccagcaggaagcccagacctcagggaaggaacgccttcttctgagtgcagcggttccagctgggcagacctatgtggatgctggatacgaggtggacaaaatcgcccagaacctggattttgtcaaccttatggcctacgacttccatggctcttgggagaaggtcacgggacataacagccccctctacaagaggcaagaagagagtggtgcagcagccagcctcaacgtggatgctgctgtgcaacagtggctgcagaaggggacccctgccagcaagctgatccttggcatgcctacctacggacgctccttcacactggcctcctcatcagacaccagagtgggggccccagccacagggtctggcactccaggccccttcaccaaggaaggagggatgctggcctactatgaagtctgctcctggaagggggccaccaaacagagaatccaggatcagaaggtgccctacatcttccgggacaaccagtgggtgggctttgatgatgtggagagcttcaaaaccaaggtcagctatctgaagcagaagggactgggcggggccatggtctgggcactggacttagatgactttgccggcttctcctgcaaccagggccgataccccctcatccagacgctacggcaggaactgagtcttccatacttgccttcaggcaccccagagcttgaagttccaaaaccaggtcagccctctgaacctgagcatggccccagccctggacaagacacgttctgccagggcaaagctgatgggctctatcccaatcctcgggaacggtccagcttctacagctgtgcagcggggcggctgttccagcaaagctgcccgacaggcctggtgttcagcaactcctgcaaatgctgcacctggaattgagtcgctaaagcccctccagtcccagctttgaggctgggcccaggatcactctacagcctgcctcctgggttttccctgggggccgcaatctggctcctgcaggcctttctgtggtcttcctttatccaggctttctgctctcagccttgccttccttttttctgggtctcctgggctgcccctttcacttgcaaaataaatctttggtttgtgcccctcttca

SEQ ID NO: 356116 - DNA, 501 bp, Homo sapiens
aggctcccagcccaaggctgtctccagaatctacagccactcacaggcctgaggctgctggagcaaaaagggccctgtccagaagaggtagccaggctctggggtggccgggtcaggcttccccgggctcctccactgcatcccctccctgcacaggtcagctatctgaagcagaagggactgggcggggccatggtctgggcactggacttagatgactttgccggcttctcctgcaaccagggccgataccccctcatccagacgctacggcaggaactgagtgcagaaatcacttagaggatttccagactgaagtgctatttcatgacaagagcactactctcccaagcccttctattgaataccactgactcttttaatattagtgtccagccattagtccttccttcaaagagacaggggaattaacattcgttgcatgaccagagaccatactaagcatgtattagacatccaataaatagttactgaatgaat

SEQ ID NO: 356117 - DNA, 1468 bp, Homo sapiens
ctgagctgcatcatggtgcggtctgtggcctgggcaggtttcatggtcctgctgatgatcccatggggctctgctgcaaaactggtctgctacttcaccaactgggcccagtacagacagggggaggctcgcttcctgcccaaggacttggaccccagcctttgcacccacctcatctacgccttcgctggcatgaccaaccaccagctgagcaccactgagtggaatgacgagactctctaccaggagttcaatggcctgaagaagatgaatcccaagctgaagaccctgttagccatcggaggctggaatttcggcactcagaagttcacagatatggtagccacggccaacaaccgtcagacctttgtcaactcggccatcaggtttctgcgcaaatacagctttgacggccttgaccttgactgggagtacccaggaagccaggggagccctgccgtagacaaggagcgcttcacaaccctggtacaggacttggccaatgccttccagcaggaagcccagacctcagggaaggaacgccttcttctgagtgcagcggttccagctgggcagacctatgtggatgctggatacgaggtggacaaaatcgcccagaacctggattttgtcaaccttatggcctacgacttccatggctcttgggagaaggtcacgggacataacagccccctctacaagaggcaagaagagagtggtgcagcagccagcctcaacgtggatgctgctgtgcaacagtggctgcagaaggggacccctgccagcaagctgatccttggcatgcctacctacggacgctccttcacactggcctcctcatcagacaccagagtgggggccccagccacagggtctggcactccaggccccttcaccaaggaaggagggatgctggcctactatgaagtctgctcctggaagggggccaccaaacagagaatccaggatcagaaggtgccctacatcttccgggacaaccagtgggtgggctttgatgatgtggagagcttcaaaaccaaggtcagctatctgaagcagaagggactgggcggggccatggtctgggcactggacttagatgactttgccggcttctcctgcaaccagggccgataccccctcatccagacgctacggcaggaactgagctggagtgcagaggcacgatcacagctcactgcagccttgacctcctgggctcagctgatcctcccacctcagcctcccaggtgcagaaatcacttagaggatttccagactgaagtgctatttcatgacaagagcactactctcccaagcccttctattgaataccactgactcttttaatattagtgtccagccattagtccttccttcaaagagacaggggaattaacattcgttgcatgaccagagaccatactaagcatgtattagacatccaataaatagttactgaatgaat

SEQ ID NO: 356118 - DNA, 6438 bp, Homo sapiens
tgcatgaagacaaaaggtcctgtgctcacctgggacccttctggacgttgccctgtgtacctcttcgactgcctgttcatctacgacgaaccccgggtattgaccccagacaacaatgccacttcatattggggacttcgtctgggattccaaggtgcattcattgcaaagttccttaaatattttctcactgcttcctactaaaggacggacagagcatttgttcttcagccacatactttccttccactggccagcattctcctctattagactagaactgtggataaacctcagaaaatggccacccagcagaaagcctctgacgagaggatctcccagtttgatcacaatttgctgccagagctgtctgctcttctgggcctagatgcagttcagttggcaaaggaactagaagaagaggagcagaaggagcgagcaaaaatgcagaaaggctacaactctcaaatgcgcagtgaagcaaaaaggttaaagacttttgtgacttatgagccgtacagctcatggataccacaggagatggcggccgctgggttttacttcactggggtaaaatctgggattcagtgcttctgctgtagcctaatcctctttggtgccggcctcacgagactccccatagaagaccacaagaggtttcatccagattgtgggttccttttgaacaaggatgttggtaacattgccaagtacgacataagggtgaagaatctgaagagcaggctgagaggaggtaaaatgaggtaccaagaagaggaggctagacttgcgtccttcaggaactggccattttatgtccaagggatatccccttgtgtgctctcagaggctggctttgtctttacaggtaaacaggacacggtacagtgtttttcctgtggtggatgtttaggaaattgggaagaaggagatgatccttggaaggaacatgccaaatggttccccaaatgtgaatttcttcggagtaagaaatcctcagaggaaattacccagtatattcaaagctacaagggatttgttgacataacgggagaacattttgtgaattcctgggtccagagagaattacctatggcatcagcttattgcaatgacagcatctttgcttacgaagaactacggctggactcttttaaggactggccccgggaatcagctgtgggagttgcagcactggccaaagcaggtcttttctacacaggtataaaggacatcgtccagtgcttttcctgtggagggtgtttagagaaatggcaggaaggtgatgacccattagacgatcacaccagatgttttcccaattgtccatttctccaaaatatgaagtcctctgcggaagtgactccagaccttcagagccgtggtgaactttgtgaattactggaaaccacaagtgaaagcaatcttgaagattcaatagcagttggtcctatagtgccagaaatggcacagggtgaagcccagtggtttcaagaggcaaagaatctgaatgagcagctgagagcagcttataccagcgccagtttccgccacatgtctttgcttgatatctcttccgatctggccacggaccacttgctgggctgtgatctgtctattgcttcaaaacacatcagcaaacctgtgcaagaacctctggtgctgcctgaggtctttggcaacttgaactctgtcatgtgtgtggagggtgaagctggaagtggaaagacggtcctcctgaagaaaatagcttttctgtgggcatctggatgctgtcccctgttaaacaggttccagctggttttctacctctcccttagttccaccagaccagacgaggggctggccagtatcatctgtgaccagctcctagagaaagaaggatctgttactgaaatgtgcatgaggaacattatccagcagttaaagaatcaggtcttattccttttagatgactacaaagaaatatgttcaatccctcaagtcataggaaaactgattcaaaaaaaccacttatcccggacctgcctattgattgctgtccgtacaaacagggccagggacatccgccgatacctagagaccattctagagatcaaagcatttcccttttataatactgtctgtatattacggaagctcttttcacataatatgactcgtctgcgaaagtttatggtttactttggaaagaaccaaagtttgcagaagatacagaaaactcctctctttgtggcggcgatctgtgctcattggtttcagtatccttttgacccatcctttgatgatgtggctgttttcaagtcctatatggaacgcctttccttaaggaacaaagcgacagctgaaattctcaaagcaactgtgtcctcctgtggtgagctggccttgaaagggtttttttcatgttgctttgagtttaatgatgatgatctcgcagaagcaggggttgatgaagatgaagatctaaccatgtgcttgatgagcaaatttacagcccagagactaagaccattctaccggtttttaagtcctgccttccaagaatttcttgcggggatgaggctgattgaactcctggattcagataggcaggaacatcaagatttgggactgtatcatttgaaacaaatcaactcacccatgatgactgtaagcgcctacaacaattttttgaactatgtctccagcctcccttcaacaaaagcagggcccaaaattgtgtctcatttgctccatttagtggataacaaagagtcattggagaatatatctgaaaatgatgactacttaaagcaccagccagaaatttcactgcagatgcagttacttaggggattgtggcaaatttgtccacaagcttacttttcaatggtttcagaacatttactggttcttgccctgaaaactgcttatcaaagcaacactgttgctgcgtgttctccatttgttttgcaattccttcaagggagaacactgactttgggtgcgcttaacttacagtactttttcgaccacccagaaagcttgtcattgttgaggagcatccacttcccaatacgaggaaataagacatcacccagagcacatttttcagttctggaaacatgttttgacaaatcacaggtgccaactatagatcaggactatgcttctgcctttgaacctatgaatgaatgggagcgaaatttagctgaaaaagaggataatgtaaagagctatatggatatgcagcgcagggcatcaccagaccttagtactggctattggaaactttctccaaagcagtacaagattccctgtctagaagtcgatgtgaatgatattgatgttgtaggccaggatatgcttgagattctaatgacagttttctcagcttcacagcgcatcgaactccatttaaaccacagcagaggctttatagaaagcatccgcccagctcttgagctgtctaaggcctctgtcaccaagtgctccataagcaagttggaactcagcgcagccgaacaggaactgcttctcaccctgccttccctggaatctcttgaagtctcagggacaatccagtcacaagaccaaatctttcctaatctggataagttcctgtgcctgaaagaactgtctgtggatctggagggcaatataaatgttttttcagtcattcctgaagaatttccaaacttccaccatatggagaaattattgatccaaatttcagctgagtatgatccttccaaactagtaaaattaattcaaaattctccaaaccttcatgttttccatctgaagtgtaacttcttttcggattttgggtctctcatgactatgcttgtttcctgtaagaaactcacagaaattaagttttcggattcattttttcaagccgtcccatttgttgccagtttgccaaattttatttctctgaagatattaaatcttgaaggccagcaatttcctgatgaggaaacatcagaaaaatttgcctacattttaggttctcttagtaacctggaagaattgatccttcctactggggatggaatttatcgagtggccaaactgatcatccagcagtgtcagcagcttcattgtctccgagtcctctcatttttcaagactttgaatgatgacagcgtggtggaaattgccaaagtagcaatcagtggaggtttccagaaacttgagaacctaaagctttcaatcaatcacaagattacagaggaaggatacagaaatttctttcaagcactggacaacatgccaaacttgcaggagttggacatctccaggcatttcacagagtgtatcaaagctcaggccacaacagtcaagtctttgagtcaatgtgtgttacgactaccaaggctcattagactgaacatgttaagttggctcttggatgcagatgatattgcattgcttaatgtcatgaaagaaagacatcctcaatctaagtacttaactattctccagaaatggatactgccgttctctccaatcattcagaaataaaagattcagctaaaaactgctgaatcaataatttgtcttggggcatattgaggatgtaaaaaaagttgttgattaatgctaaaaaccaaattatccaaaattattttattaaatattgcatacaaaagaaaatgtgtaaggcttgctaaaaaacaaaacaaaacaaaacacagtcctgcatactcaccaccaagctcaagaaataaatcatcaccaatacctttgaggtccctgagtaatccaccccagctaaaggcaaacccttcaatcaagtttatacagcaaaccctccattgtccatggtcaacagggaaggggttggggacaggtctgccaatctatctaaaagccacaatatggaagaagtattcaatttatataataaatggctaacttaacggttgaatcactttcatacatggatgaaacgggtttaacacaggatccacatgaatcttctgtgggccaagagatgttccttaatccttgtagaacctgttttctatattgaactagctttggtacagtagagttaacttactttccatttatccactgccaatataaagaggaaacaggggttagggaaaaatgacttcattccagaggcttctcagagttcaacatatgctataatttagaattttcttatgaatccactctacttgggtagaaaatattttatctctagtgattgcatattatttccatatcatagtatttcatagtattatatttgatatgagtgtctatatcaatgtcagtgtccagaatttcgttcctaccagttaagtagttttctgaacggccagaagaccattcgaaattcatgatactactataagttggtaaacaaccatacttttatcctcatttttattctcactaagaaaaaagtcaactcccctccccttgcccaagtatgaaatatagggacagtatgtatggtgtggtctcatttgtttagaaaaccacttatgactgggtgcggtggctcacacctgtaatcccagcactttgggaggctgaggcgggcgaatcatttgaggtgaggaattcgagaccagcctggccagcatggtgaaaccccatctctactaaaaatacaaaaattagccaggtgtggtggcacatgcctgtagtcccagccactagggcggctgagacgcaagacttgcttgaacccgggaggcagaggttgcagtgagccaagatggcgccactgcattccagcctgggcaacagagcaagaccctgtctgtctcaaaacaaaaaacaaaaccacttatattgctagctacattaagaatttctgaatatgttactgagcttgcttgtggtaaccatttataatatcagaaagtatatgtacaccaaaacatgttgaacatccatgttgtacaactgaaatataaataattttgtcaattatacctaaataaaactggaaaaaaatttctggaagtttatatctaaaaatgttaatagtgcgtacctctaggaagtgggcctggaagccattcttacttttcagtctctcccattctgtactgttttttgttttactttcgtgcctgcattatttttctatttaaaacaaaaataaatctagtttagcactaaaatattaactggagctacctctggagggcaagagtactagaaggtgggatggattgtcttcttgcttgtctgattttatatgtaatacctttgtaattagaaaggttgttaagcattatatcagaatccagtcaggagacagaaaccacacagaaatttgaatggggaaagtttaatatacagatgctcggcctgacgcagtggctcacgcctgtaattccagcactttgggaggccgaggtgggcagatcacttgaggtcaggagttcgagaccagcctggccaacatggtgaaatcctgtc

SEQ ID NO: 356119 - DNA, 586 bp, Homo sapiens
gtgttggccaggctggtctcagactcctgacctcaggagatccgctggccttggcctcccaaagtgctgggattacaggcatgagccactgcgcccagccccctcatggagcttcaattccagattctggttgccaatctgtttgttgatcaaaggagaatggggcagagggatggtgtgcatcaaagtgcatggtgtgtaggagcattcaatgactacttgccagttaccccattggtggacagagtcttatatagaaaattgcctcactggtaaccaacttctgactgtcacaaaacccaactggagactgaataggctttcactattacaggtctggtggttattatctgcatgttaatggacagatgcccatgccagtggcactgatcaagtttccttacttttaggtataaaggacatcgtccagtgcttttcctgtggagggtgtttagagaaatggcaggaaggtgatgacccattagacgatcacaccagatgttttcccaagtgagtggaatgaatgttaaccatctgcaactttggatgcacttcaacagttttttctttttcctcatttcctgcc

SEQ ID NO: 356120 - DNA, 916 bp, Homo sapiens
caagcgattctcctgcctcggcctcccgagtagctgggattacagctgcctgccacccacgcctggcaaatgtttgtatttttagtagagacagggtttcaccatgttggccaggctggtctcgagctcctgagctcagatgatccacctgcctcggcctcccaaagtgctgggattacaggcatgagccacagcacctggcctctttgtattcttattgtgtaaatgtcatgtacaaacttagagttattaggtgttaaagctgaaggtgatgctactgagtcaatgcttgtattttatagaagagaaaactgttacccagagagggtcaataatgtgtcaaaattcacattacttgctagttgcagaacctgaacccaagcccagtgacctgattcttagatcatgagatcgtggtacctggttttaattaagtattattgaaacaaaataataaactacttggctaattttgatagaaatttgcagtattttctaatttctgaaaatccttgatcttttacagtaaaattaattcaaaattctccaaaccttcatgttttccatctgaagtgtaacttcttttcggattttgggtctctcatgactatgcttgtttcctgtaagaaactcacagaaattaagttttcggattcattttttcaagccgtcccatttggtaagagttataatattacaatggtggtttaaaatgtttctatggacacagagtcatattaagcactctttaaaaagggccatattttgaggctgggtgtggtggctatcataaagccgttctagtagttgtgaagtggtatctcattgtggttttgatttgcatttctctaatgcaaatcatgaaaatgatgtgaagtatcttttcactttttgcaaaaatatctgtttgctcatt

SEQ ID NO: 356121 - DNA, 261 bp, Homo sapiens
tcaccttgtgctttttattcaagcttattgcaatgacagcatctttgcttacgaagaactacggctggactcttttaaggactggccccgggaatcagctgtgggagttgcagcactggccaaagcaggtcttttctacacaggtgagtcagtaggttgtgcccacttgcttgcttgacctttaattcccacatagactttatgctcctgggcttacgtttagctacactcagcaatgtccactagcttcagcgtttcttt

SEQ ID NO: 356122 - DNA, 5550 bp, Homo sapiens
  misc_feature (15)..(15): n is a, c, g, or t
  misc_feature (25)..(25): n is a, c, g, or t
  misc_feature (32)..(33): n is a, c, g, or t
  misc_feature (38)..(42): n is a, c, g, or t
  misc_feature (63)..(63): n is a, c, g, or t
ccccccgggaaaaanctttgccccngtttcgnnatttnnnnnggggccccggccttttttttnccccttaagcctgggcacaaaaataaaaccttccccccaaaaaaaaaaaaaaaaaaaaaaagtcagataatcaacaacttgaattttaatttccctcagggagaacattttgtgaattcctgggtccagagagaattacctatggcatcagcttattgcaatgacagcatctttgcttacgaagaactacggctggactcttttaaggactggccccgggaatcagctgtgggagttgcagcactggccaaagcaggtcttttctacacaggtataaaggacatcgtccagtgcttttcctgtggagggtgtttagagaaatggcaggaaggtgatgacccattagacgatcacaccagatgttttcccaattgtccatttctccaaaatatgaagtcctctgcggaagtgactccagaccttcagagccgtggtgaactttgtgaattactggaaaccacaagtgaaagcaatcttgaagattcaatagcagttggtcctatagtgccagaaatggcacagggtgaagcccagtggtttcaagaggcaaagaatctgaatgagcagctgagagcagcttataccagcgccagtttccgccacatgtctttgcttgatatctcttccgatctggccacggaccacttgctgggctgtgatctgtctattgcttcaaaacacatcagcaaacctgtgcaagaacctctggtgctgcctgaggtctttggcaacttgaactctgtcatgtgtgtggagggtgaagctggaagtggaaagacggtcctcctgaagaaaatagcttttctgtgggcatctggatgctgtcccctgttaaacaggttccagctggttttctacctctcccttagttccaccagaccagacgaggggctggccagtatcatctgtgaccagctcctagagaaagaaggatctgttactgaaatgtgcatgaggaacattatccagcagttaaagaatcaggtcttattccttttagatgactacaaagaaatatgttcaatccctcaagtcataggaaaactgattcaaaaaaaccacttatcccggacctgcctattgattgctgtccgtacaaacagggccagggacatccgccgatacctagagaccattctagagatcaaagcatttcccttttataatactgtctgtatattacggaagctcttttcacataatatgactcgtctgcgaaagtttatggtttactttggaaagaaccaaagtttgcagaagatacagaaaactcctctctttgtggcggcgatctgtgctcattggtttcagtatccttttgacccatcctttgatgatgtggctgttttcaagtcctatatggaacgcctttccttaaggaacaaagcgacagctgaaattctcaaagcaactgtgtcctcctgtggtgagctggccttgaaagggtttttttcatgttgctttgagtttaatgatgatgatctcgcagaagcaggggttgatgaagatgaagatctaaccatgtgcttgatgagcaaatttacagcccagagactaagaccattctaccggtttttaagtcctgccttccaagaatttcttgcggggatgaggctgattgaactcctggattcagataggcaggaacatcaagatttgggactgtatcatttgaaacaaatcaactcacccatgatgactgtaagcgcctacaacaattttttgaactatgtctccagcctcccttcaacaaaagcagggcccaaaattgtgtctcatttgctccatttagtggataacaaagagtcattggagaatatatctgaaaatgatgactacttaaagcaccagccagaaatttcactgcagatgcagttacttaggggattgtggcaaatttgtccacaagcttacttttcaatggtttcagaacatttactggttcttgccctgaaaactgcttatcaaagcaacactgttgctgcgtgttctccatttgttttgcaattccttcaagggagaacactgactttgggtgcgcttaacttacagtactttttcgaccacccagaaagcttgtcattgttgaggagcatccacttcccaatacgaggaaataagacatcacccagagcacatttttcagttctggaaacatgttttgacaaatcacaggtgccaactatagatcaggactatgcttctgcctttgaacctatgaatgaatgggagcgaaatttagctgaaaaagaggataatgtaaagagctatatggatatgcagcgcagggcatcaccagaccttagtactggctattggaaactttctccaaagcagtacaagattccctgtctagaagtcgatgtgaatgatattgatgttgtaggccaggatatgcttgagattctaatgacagttttctcagcttcacagcgcatcgaactccatttaaaccacagcagaggctttatagaaagcatccgcccagctcttgagctgtctaaggcctctgtcaccaagtgctccataagcaagttggaactcagcgcagccgaacaggaactgcttctcaccctgccttccctggaatctcttgaagtctcagggacaatccagtcacaagaccaaatctttcctaatctggataagttcctgtgcctgaaagaactgtctgtggatctggagggcaatataaatgttttttcagtcattcctgaagaatttccaaacttccaccatatggagaaattattgatccaaatttcagctgagtatgatccttccaaactagtaaaattaattcaaaattctccaaaccttcatgttttccatctgaagtgtaacttcttttcggattttgggtctctcatgactatgcttgtttcctgtaagaaactcacagaaattaagttttcggattcattttttcaagccgtcccatttgttgccagtttgccaaattttatttctctgaagatattaaatcttgaaggccagcaatttcctgatgaggaaacatcagaaaaatttgcctacattttaggttctcttagtaacctggaagaattgatccttcctactggggatggaatttatcgagtggccaaactgatcatccagcagtgtcagcagcttcattgtctccgagtcctctcatttttcaagactttgaatgatgacagcgtggtggaaattgccaaagtagcaatcagtggaggtttccagaaacttgagaacctaaagctttcaatcaatcacaagattacagaggaaggatacagaaatttctttcaagcactggacaacatgccaaacttgcaggagttggacatctccaggcatttcacagagtgtatcaaagctcaggccacaacagtcaagtctttgagtcaatgtgtgttacgactaccaaggctcattagactgaacatgttaagttggctcttggatgcagatgatattgcattgcttaatgtcatgaaagaaagacatcctcaatctaagtacttaactattctccagaaatggatactgccgttctctccaatcattcagaaataaaagattcagctaaaaactgctgaatcaataatttgtcttggggcatattgaggatgtaaaaaaagttgttgattaatgctaaaaaccaaattatccaaaattattttattaaatattgcatacaaaagaaaatgtgtaaggcttgctaaaaaacaaaacaaaacaaaacacagtcctgcatactcaccaccaagctcaagaaataaatcatcaccaatacctttgaggtccctgagtaatccaccccagctaaaggcaaacccttcaatcaagtttatacagcaaaccctccattgtccatggtcaacagggaaggggttggggacaggtctgccaatctatctaaaagccacaatatggaagaagtattcaatttatataataaatggctaacttaacggttgaatcactttcatacatggatgaaacgggtttaacacaggatccacatgaatcttctgtgggccaagagatgttccttaatccttgtagaacctgttttctatattgaactagctttggtacagtagagttaacttactttccatttatccactgccaatataaagaggaaacaggggttagggaaaaatgacttcattccagaggcttctcagagttcaacatatgctataatttagaattttcttatgaatccactctacttgggtagaaaatattttatctctagtgattgcatattatttccatatcatagtatttcatagtattatatttgatatgagtgtctatatcaatgtcagtgtccagaatttcgttcctaccagttaagtagttttctgaacggccagaagaccattcgaaattcatgatactactataagttggtaaacaaccatacttttatcctcatttttattctcactaagaaaaaagtcaactcccctccccttgcccaagtatgaaatatagggacagtatgtatggtgtggtctcatttgtttagaaaaccacttatgactgggtgcggtggctcacacctgtaatcccagcactttgggaggctgaggcgggcgaatcatttgaggtgaggaattcgagaccagcctggccagcatggtgaaaccccatctctactaaaaatacaaaaattagccaggtgtggtggcacatgcctgtagtcccagccactagggcggctgagacgcaagacttgcttgaacccgggaggcagaggttgcagtgagccaagatggcgccactgcattccagcctgggcaacagagcaagaccctgtctgtctcaaaacaaaaaacaaaaccacttatattgctagctacattaagaatttctgaatatgttactgagcttgcttgtggtaaccatttataatatcagaaagtatatgtacaccaaaacatgttgaacatccatgttgtacaactgaaatataaataattttgtcaattatacctaaataaaactggaaaaaaatttctggaagtttatatctaaaaatgttaatagtgcgtacctctaggaagtgggcctggaagccattcttacttttcagtctctcccattctgtactgttttttgttttactttcgtgcctgcattatttttctatttaaaacaaaaataaatctagtttagcactaaaatattaactggagctacctctggagggcaagagtactagaaggtgggatggattgtcttcttgcttgtctgattttatatgtaatacctttgtaattagaaaggttgttaagcattatatcagaatccagtcaggagacagaaaccacacagaaatttgaatggggaaagtttaatatacagatgctcggcctgacgcagtggctcacgcctgtaattccagcactttgggaggccgaggtgggcagatcacttgaggtcaggagttcgagaccagcctggccaacatggtgaaatcctgtc

SEQ ID NO: 356123 - DNA, 5504 bp, Homo sapiens
acgagaacctgccactgcacttcagcctgggcaacagagtgagactctgcctcaaaaaaaaaaaaaaaaaaaaaaaaagtcagataatcaacaacttgaattttaatttccctcagggagaacattttgtgaattcctgggtccagagagaattacctatggcatcagcttattgcaatgacagcatctttgcttacgaagaactacggctggactcttttaaggactggccccgggaatcagctgtgggagttgcagcactggccaaagcaggtcttttctacacaggtataaaggacatcgtccagtgcttttcctgtggagggtgtttagagaaatggcaggaaggtgatgacccattagacgatcacaccagatgttttcccaattgtccatttctccaaaatatgaagtcctctgcggaagtgactccagaccttcagagccgtggtgaactttgtgaattactggaaaccacaagtgaaagcaatcttgaagattcaatagcagttggtcctatagtgccagaaatggcacagggtgaagcccagtggtttcaagaggcaaagaatctgaatgagcagctgagagcagcttataccagcgccagtttccgccacatgtctttgcttgatatctcttccgatctggccacggaccacttgctgggctgtgatctgtctattgcttcaaaacacatcagcaaacctgtgcaagaacctctggtgctgcctgaggtctttggcaacttgaactctgtcatgtgtgtggagggtgaagctggaagtggaaagacggtcctcctgaagaaaatagcttttctgtgggcatctggatgctgtcccctgttaaacaggttccagctggttttctacctctcccttagttccaccagaccagacgaggggctggccagtatcatctgtgaccagctcctagagaaagaaggatctgttactgaaatgtgcatgaggaacattatccagcagttaaagaatcaggtcttattccttttagatgactacaaagaaatatgttcaatccctcaagtcataggaaaactgattcaaaaaaaccacttatcccggacctgcctattgattgctgtccgtacaaacagggccagggacatccgccgatacctagagaccattctagagatcaaagcatttcccttttataatactgtctgtatattacggaagctcttttcacataatatgactcgtctgcgaaagtttatggtttactttggaaagaaccaaagtttgcagaagatacagaaaactcctctctttgtggcggcgatctgtgctcattggtttcagtatccttttgacccatcctttgatgatgtggctgttttcaagtcctatatggaacgcctttccttaaggaacaaagcgacagctgaaattctcaaagcaactgtgtcctcctgtggtgagctggccttgaaagggtttttttcatgttgctttgagtttaatgatgatgatctcgcagaagcaggggttgatgaagatgaagatctaaccatgtgcttgatgagcaaatttacagcccagagactaagaccattctaccggtttttaagtcctgccttccaagaatttcttgcggggatgaggctgattgaactcctggattcagataggcaggaacatcaagatttgggactgtatcatttgaaacaaatcaactcacccatgatgactgtaagcgcctacaacaattttttgaactatgtctccagcctcccttcaacaaaagcagggcccaaaattgtgtctcatttgctccatttagtggataacaaagagtcattggagaatatatctgaaaatgatgactacttaaagcaccagccagaaatttcactgcagatgcagttacttaggggattgtggcaaatttgtccacaagcttacttttcaatggtttcagaacatttactggttcttgccctgaaaactgcttatcaaagcaacactgttgctgcgtgttctccatttgttttgcaattccttcaagggagaacactgactttgggtgcgcttaacttacagtactttttcgaccacccagaaagcttgtcattgttgaggagcatccacttcccaatacgaggaaataagacatcacccagagcacatttttcagttctggaaacatgttttgacaaatcacaggtgccaactatagatcaggactatgcttctgcctttgaacctatgaatgaatgggagcgaaatttagctgaaaaagaggataatgtaaagagctatatggatatgcagcgcagggcatcaccagaccttagtactggctattggaaactttctccaaagcagtacaagattccctgtctagaagtcgatgtgaatgatattgatgttgtaggccaggatatgcttgagattctaatgacagttttctcagcttcacagcgcatcgaactccatttaaaccacagcagaggctttatagaaagcatccgcccagctcttgagctgtctaaggcctctgtcaccaagtgctccataagcaagttggaactcagcgcagccgaacaggaactgcttctcaccctgccttccctggaatctcttgaagtctcagggacaatccagtcacaagaccaaatctttcctaatctggataagttcctgtgcctgaaagaactgtctgtggatctggagggcaatataaatgttttttcagtcattcctgaagaatttccaaacttccaccatatggagaaattattgatccaaatttcagctgagtatgatccttccaaactagtaaaattaattcaaaattctccaaaccttcatgttttccatctgaagtgtaacttcttttcggattttgggtctctcatgactatgcttgtttcctgtaagaaactcacagaaattaagttttcggattcattttttcaagccgtcccatttgttgccagtttgccaaattttatttctctgaagatattaaatcttgaaggccagcaatttcctgatgaggaaacatcagaaaaatttgcctacattttaggttctcttagtaacctggaagaattgatccttcctactggggatggaatttatcgagtggccaaactgatcatccagcagtgtcagcagcttcattgtctccgagtcctctcatttttcaagactttgaatgatgacagcgtggtggaaattgccaaagtagcaatcagtggaggtttccagaaacttgagaacctaaagctttcaatcaatcacaagattacagaggaaggatacagaaatttctttcaagcactggacaacatgccaaacttgcaggagttggacatctccaggcatttcacagagtgtatcaaagctcaggccacaacagtcaagtctttgagtcaatgtgtgttacgactaccaaggctcattagactgaacatgttaagttggctcttggatgcagatgatattgcattgcttaatgtcatgaaagaaagacatcctcaatctaagtacttaactattctccagaaatggatactgccgttctctccaatcattcagaaataaaagattcagctaaaaactgctgaatcaataatttgtcttggggcatattgaggatgtaaaaaaagttgttgattaatgctaaaaaccaaattatccaaaattattttattaaatattgcatacaaaagaaaatgtgtaaggcttgctaaaaaacaaaacaaaacaaaacacagtcctgcatactcaccaccaagctcaagaaataaatcatcaccaatacctttgaggtccctgagtaatccaccccagctaaaggcaaacccttcaatcaagtttatacagcaaaccctccattgtccatggtcaacagggaaggggttggggacaggtctgccaatctatctaaaagccacaatatggaagaagtattcaatttatataataaatggctaacttaacggttgaatcactttcatacatggatgaaacgggtttaacacaggatccacatgaatcttctgtgggccaagagatgttccttaatccttgtagaacctgttttctatattgaactagctttggtacagtagagttaacttactttccatttatccactgccaatataaagaggaaacaggggttagggaaaaatgacttcattccagaggcttctcagagttcaacatatgctataatttagaattttcttatgaatccactctacttgggtagaaaatattttatctctagtgattgcatattatttccatatcatagtatttcatagtattatatttgatatgagtgtctatatcaatgtcagtgtccagaatttcgttcctaccagttaagtagttttctgaacggccagaagaccattcgaaattcatgatactactataagttggtaaacaaccatacttttatcctcatttttattctcactaagaaaaaagtcaactcccctccccttgcccaagtatgaaatatagggacagtatgtatggtgtggtctcatttgtttagaaaaccacttatgactgggtgcggtggctcacacctgtaatcccagcactttgggaggctgaggcgggcgaatcatttgaggtgaggaattcgagaccagcctggccagcatggtgaaaccccatctctactaaaaatacaaaaattagccaggtgtggtggcacatgcctgtagtcccagccactagggcggctgagacgcaagacttgcttgaacccgggaggcagaggttgcagtgagccaagatggcgccactgcattccagcctgggcaacagagcaagaccctgtctgtctcaaaacaaaaaacaaaaccacttatattgctagctacattaagaatttctgaatatgttactgagcttgcttgtggtaaccatttataatatcagaaagtatatgtacaccaaaacatgttgaacatccatgttgtacaactgaaatataaataattttgtcaattatacctaaataaaactggaaaaaaatttctggaagtttatatctaaaaatgttaatagtgcgtacctctaggaagtgggcctggaagccattcttacttttcagtctctcccattctgtactgttttttgttttactttcgtgcctgcattatttttctatttaaaacaaaaataaatctagtttagcactaaaatattaactggagctacctctggagggcaagagtactagaaggtgggatggattgtcttcttgcttgtctgattttatatgtaatacctttgtaattagaaaggttgttaagcattatatcagaatccagtcaggagacagaaaccacacagaaatttgaatggggaaagtttaatatacagatgctcggcctgacgcagtggctcacgcctgtaattccagcactttgggaggccgaggtgggcagatcacttgaggtcaggagttcgagaccagcctggccaacatggtgaaatcctgtc

SEQ ID NO: 356124 - DNA, 6118 bp, Homo sapiens
ggtaattttttgttcagtagataaatatattgttatcttaaaaagattttttgtatttacttttgagactgggtctcagtctgttgcccaggctggagtgtagcagcctgatcatggctcagtgcagcctctacctccccgggctcaggtgatcctcccccttcagcctcctgagtagctgggactacagaggtgtggcaccatgcccggctaatttttgtattttttgtggagatggggttttgccatgttgcccaggctagtcttgaactcctggatgtgagccactgcgtctggcctattattttaaatatagttctctttactgccagtagctttcatataaccctagcgactagatttagtcaccactgcttaattccaaaaaacaaaagctccatcctatatttactgtaaatcagtctctttgattgtattgcatgttttatttcaagaaaaaagttaacctgaagatttaattttaaataactacacatgttgtcactaatagaaataacaaataattatatgagaataatggtaattctcctaagttttgtggtaaattttttggcaattttattgaagtataataaaattcaacaattcaatacgtctttataaatgttcattgtgatataggacagctctatcacagtactggggtaaattttaattatatttattaattacagatgtgaatttcttcggagtaagaaatcctcagaggaaattacccagtatattcaaagctacaagggatttgttgacataacgggagaacattttgtgaattcctgggtccagagagaattacctatggcatcagcttattgcaatgacagcatctttgcttacgaagaactacggctggactcttttaaggactggccccgggaatcagctgtgggagttgcagcactggccaaagcaggtcttttctacacaggtataaaggacatcgtccagtgcttttcctgtggagggtgtttagagaaatggcaggaaggtgatgacccattagacgatcacaccagatgttttcccaattgtccatttctccaaaatatgaagtcctctgcggaagtgactccagaccttcagagccgtggtgaactttgtgaattactggaaaccacaagtgaaagcaatcttgaagattcaatagcagttggtcctatagtgccagaaatggcacagggtgaagcccagtggtttcaagaggcaaagaatctgaatgagcagctgagagcagcttataccagcgccagtttccgccacatgtctttgcttgatatctcttccgatctggccacggaccacttgctgggctgtgatctgtctattgcttcaaaacacatcagcaaacctgtgcaagaacctctggtgctgcctgaggtctttggcaacttgaactctgtcatgtgtgtggagggtgaagctggaagtggaaagacggtcctcctgaagaaaatagcttttctgtgggcatctggatgctgtcccctgttaaacaggttccagctggttttctacctctcccttagttccaccagaccagacgaggggctggccagtatcatctgtgaccagctcctagagaaagaaggatctgttactgaaatgtgcatgaggaacattatccagcagttaaagaatcaggtcttattccttttagatgactacaaagaaatatgttcaatccctcaagtcataggaaaactgattcaaaaaaaccacttatcccggacctgcctattgattgctgtccgtacaaacagggccagggacatccgccgatacctagagaccattctagagatcaaagcatttcccttttataatactgtctgtatattacggaagctcttttcacataatatgactcgtctgcgaaagtttatggtttactttggaaagaaccaaagtttgcagaagatacagaaaactcctctctttgtggcggcgatctgtgctcattggtttcagtatccttttgacccatcctttgatgatgtggctgttttcaagtcctatatggaacgcctttccttaaggaacaaagcgacagctgaaattctcaaagcaactgtgtcctcctgtggtgagctggccttgaaagggtttttttcatgttgctttgagtttaatgatgatgatctcgcagaagcaggggttgatgaagatgaagatctaaccatgtgcttgatgagcaaatttacagcccagagactaagaccattctaccggtttttaagtcctgccttccaagaatttcttgcggggatgaggctgattgaactcctggattcagataggcaggaacatcaagatttgggactgtatcatttgaaacaaatcaactcacccatgatgactgtaagcgcctacaacaattttttgaactatgtctccagcctcccttcaacaaaagcagggcccaaaattgtgtctcatttgctccatttagtggataacaaagagtcattggagaatatatctgaaaatgatgactacttaaagcaccagccagaaatttcactgcagatgcagttacttaggggattgtggcaaatttgtccacaagcttacttttcaatggtttcagaacatttactggttcttgccctgaaaactgcttatcaaagcaacactgttgctgcgtgttctccatttgttttgcaattccttcaagggagaacactgactttgggtgcgcttaacttacagtactttttcgaccacccagaaagcttgtcattgttgaggagcatccacttcccaatacgaggaaataagacatcacccagagcacatttttcagttctggaaacatgttttgacaaatcacaggtgccaactatagatcaggactatgcttctgcctttgaacctatgaatgaatgggagcgaaatttagctgaaaaagaggataatgtaaagagctatatggatatgcagcgcagggcatcaccagaccttagtactggctattggaaactttctccaaagcagtacaagattccctgtctagaagtcgatgtgaatgatattgatgttgtaggccaggatatgcttgagattctaatgacagttttctcagcttcacagcgcatcgaactccatttaaaccacagcagaggctttatagaaagcatccgcccagctcttgagctgtctaaggcctctgtcaccaagtgctccataagcaagttggaactcagcgcagccgaacaggaactgcttctcaccctgccttccctggaatctcttgaagtctcagggacaatccagtcacaagaccaaatctttcctaatctggataagttcctgtgcctgaaagaactgtctgtggatctggagggcaatataaatgttttttcagtcattcctgaagaatttccaaacttccaccatatggagaaattattgatccaaatttcagctgagtatgatccttccaaactagtaaaattaattcaaaattctccaaaccttcatgttttccatctgaagtgtaacttcttttcggattttgggtctctcatgactatgcttgtttcctgtaagaaactcacagaaattaagttttcggattcattttttcaagccgtcccatttgttgccagtttgccaaattttatttctctgaagatattaaatcttgaaggccagcaatttcctgatgaggaaacatcagaaaaatttgcctacattttaggttctcttagtaacctggaagaattgatccttcctactggggatggaatttatcgagtggccaaactgatcatccagcagtgtcagcagcttcattgtctccgagtcctctcatttttcaagactttgaatgatgacagcgtggtggaaattgctttcaatcaatcacaagattacagaggaaggatacagaaatttctttcaagcactggacaacatgccaaacttgcaggagttggacatctccaggcatttcacagagtgtatcaaagctcaggccacaacagtcaagtctttgagtcaatgtgtgttacgactaccaaggctcattagactgaacatgttaagttggctcttggatgcagatgatattgcattgcttaatgtcatgaaagaaagacatcctcaatctaagtacttaactattctccagaaatggatactgccgttctctccaatcattcagaaataaaagattcagctaaaaactgctgaatcaataatttgtcttggggcatattgaggatgtaaaaaaagttgttgattaatgctaaaaaccaaattatccaaaattattttattaaatattgcatacaaaagaaaatgtgtaaggcttgctaaaaaacaaaacaaaacaaaacacagtcctgcatactcaccaccaagctcaagaaataaatcatcaccaatacctttgaggtccctgagtaatccaccccagctaaaggcaaacccttcaatcaagtttatacagcaaaccctccattgtccatggtcaacagggaaggggttggggacaggtctgccaatctatctaaaagccacaatatggaagaagtattcaatttatataataaatggctaacttaacggttgaatcactttcatacatggatgaaacgggtttaacacaggatccacatgaatcttctgtgggccaagagatgttccttaatccttgtagaacctgttttctatattgaactagctttggtacagtagagttaacttactttccatttatccactgccaatataaagaggaaacaggggttagggaaaaatgacttcattccagaggcttctcagagttcaacatatgctataatttagaattttcttatgaatccactctacttgggtagaaaatattttatctctagtgattgcatattatttccatatcatagtatttcatagtattatatttgatatgagtgtctatatcaatgtcagtgtccagaatttcgttcctaccagttaagtagttttctgaacggccagaagaccattcgaaattcatgatactactataagttggtaaacaaccatacttttatcctcatttttattctcactaagaaaaaagtcaactcccctccccttgcccaagtatgaaatatagggacagtatgtatggtgtggtctcatttgtttagaaaaccacttatgactgggtgcggtggctcacacctgtaatcccagcactttgggaggctgaggcgggcgaatcatttgaggtgaggaattcgagaccagcctggccagcatggtgaaaccccatctctactaaaaatacaaaaattagccaggtgtggtggcacatgcctgtagtcccagccactagggcggctgagacgcaagacttgcttgaacccgggaggcagaggttgcagtgagccaagatggcgccactgcattccagcctgggcaacagagcaagaccctgtctgtctcaaaacaaaaaacaaaaccacttatattgctagctacattaagaatttctgaatatgttactgagcttgcttgtggtaaccatttataatatcagaaagtatatgtacaccaaaacatgttgaacatccatgttgtacaactgaaatataaataattttgtcaattatacctaaataaaactggaaaaaaatttctggaagtttatatctaaaaatgttaatagtgcgtacctctaggaagtgggcctggaagccattcttacttttcagtctctcccattctgtactgttttttgttttactttcgtgcctgcattatttttctatttaaaacaaaaataaatctagtttagcactaaaatattaactggagctacctctggagggcaagagtactagaaggtgggatggattgtcttcttgcttgtctgattttatatgtaatacctttgtaattagaaaggttgttaagcattatatcagaatccagtcaggagacagaaaccacacagaaatttgaatggggaaagtttaatatacagatgctcggcctgacgcagtggctcacgcctgtaattccagcactttgggaggccgaggtgggcagatcacttgaggtcaggagttcgagaccagcctggccaacatggtgaaatcctgtc

SEQ ID NO: 356125 - DNA, 3092 bp, Homo sapiens
gctgtatttctttttgtgagtctgaagagtagcacagggcttcccatacagtgcataagctgcaaaaagcaatatcttcatatatgtattctttaaaaaaaaaaaagaatgttttatggtatgtggaaggtttgcatgtgaaaatagctggatgaatcaaaatgacagttttaaaatgtccattcagaactctttagattaataatgggaaactgtgctgctttccagaccaaatctttcctaatctggataagttcctgtgcctgaaagaactgtctgtggatctggagggcaatataaatgttttttcagtcattcctgaagaatttccaaacttccaccatatggagaaattattgatccaaatttcagctgagtatgatccttccaaactagtaaaattaattcaaaattctccaaaccttcatgttttccatctgaagtgtaacttcttttcggattttgggtctctcatgactatgcttgtttcctgtaagaaactcacagaaattaagttttcggattcattttttcaagccgtcccatttgttgccagtttgccaaattttatttctctgaagatattaaatcttgaaggccagcaatttcctgatgaggaaacatcagaaaaatttgcctacattttaggttctcttagtaacctggaagaattgatccttcctactggggatggaatttatcgagtggccaaactgatcatccagcagtgtcagcagcttcattgtctccgagtcctctcatttttcaagactttgaatgatgacagcgtggtggaaattgccaaagtagcaatcagtggaggtttccagaaacttgagaacctaaagctttcaatcaatcacaagattacagaggaaggatacagaaatttctttcaagcactggacaacatgccaaacttgcaggagttggacatctccaggcatttcacagagtgtatcaaagctcaggccacaacagtcaagtctttgagtcaatgtgtgttacgactaccaaggctcattagactgaacatgttaagttggctcttggatgcagatgatattgcattgcttaatgtcatgaaagaaagacatcctcaatctaagtacttaactattctccagaaatggatactgccgttctctccaatcattcagaaataaaagattcagctaaaaactgctgaatcaataatttgtcttggggcatattgaggatgtaaaaaaagttgttgattaatgctaaaaaccaaattatccaaaattattttattaaatattgcatacaaaagaaaatgtgtaaggcttgctaaaaaacaaaacaaaacaaaacacagtcctgcatactcaccaccaagctcaagaaataaatcatcaccaatacctttgaggtccctgagtaatccaccccagctaaaggcaaacccttcaatcaagtttatacagcaaaccctccattgtccatggtcaacagggaaggggttggggacaggtctgccaatctatctaaaagccacaatatggaagaagtattcaatttatataataaatggctaacttaacggttgaatcactttcatacatggatgaaacgggtttaacacaggatccacatgaatcttctgtgggccaagagatgttccttaatccttgtagaacctgttttctatattgaactagctttggtacagtagagttaacttactttccatttatccactgccaatataaagaggaaacaggggttagggaaaaatgacttcattccagaggcttctcagagttcaacatatgctataatttagaattttcttatgaatccactctacttgggtagaaaatattttatctctagtgattgcatattatttccatatcatagtatttcatagtattatatttgatatgagtgtctatatcaatgtcagtgtccagaatttcgttcctaccagttaagtagttttctgaacggccagaagaccattcgaaattcatgatactactataagttggtaaacaaccatacttttatcctcatttttattctcactaagaaaaaagtcaactcccctccccttgcccaagtatgaaatatagggacagtatgtatggtgtggtctcatttgtttagaaaaccacttatgactgggtgcggtggctcacacctgtaatcccagcactttgggaggctgaggcgggcgaatcatttgaggtgaggaattcgagaccagcctggccagcatggtgaaaccccatctctactaaaaatacaaaaattagccaggtgtggtggcacatgcctgtagtcccagccactagggcggctgagacgcaagacttgcttgaacccgggaggcagaggttgcagtgagccaagatggcgccactgcattccagcctgggcaacagagcaagaccctgtctgtctcaaaacaaaaaacaaaaccacttatattgctagctacattaagaatttctgaatatgttactgagcttgcttgtggtaaccatttataatatcagaaagtatatgtacaccaaaacatgttgaacatccatgttgtacaactgaaatataaataattttgtcaattatacctaaataaaactggaaaaaaatttctggaagtttatatctaaaaatgttaatagtgcgtacctctaggaagtgggcctggaagccattcttacttttcagtctctcccattctgtactgttttttgttttactttcgtgcctgcattatttttctatttaaaacaaaaataaatctagtttagcactaaaatattaactggagctacctctggagggcaagagtactagaaggtgggatggattgtcttcttgcttgtctgattttatatgtaatacctttgtaattagaaaggttgttaagcattatatcagaatccagtcaggagacagaaaccacacagaaatttgaatggggaaagtttaatatacagatgctcggcctgacgcagtggctcacgcctgtaattccagcactttgggaggccgaggtgggcagatcacttgaggtcaggagttcgagaccagcctggccaacatggtgaaatcctgtc

SEQ ID NO: 356126 - DNA, 3222 bp, Homo sapiens
caagcgattctcctgcctcggcctcccgagtagctgggattacagctgcctgccacccacgcctggcaaatgtttgtatttttagtagagacagggtttcaccatgttggccaggctggtctcgagctcctgagctcagatgatccacctgcctcggcctcccaaagtgctgggattacaggcatgagccacagcacctggcctctttgtattcttattgtgtaaatgtcatgtacaaacttagagttattaggtgttaaagctgaaggtgatgctactgagtcaatgcttgtattttatagaagagaaaactgttacccagagagggtcaataatgtgtcaaaattcacattacttgctagttgcagaacctgaacccaagcccagtgacctgattcttagatcatgagatcgtggtacctggttttaattaagtattattgaaacaaaataataaactacttggctaattttgatagaaatttgcagtattttctaatttctgaaaatccttgatcttttacagtaaaattaattcaaaattctccaaaccttcatgttttccatctgaagtgtaacttcttttcggattttgggtctctcatgactatgcttgtttcctgtaagaaactcacagaaattaagttttcggattcattttttcaagccgtcccatttgttgccagtttgccaaattttatttctctgaagatattaaatcttgaaggccagcaatttcctgatgaggaaacatcagaaaaatttgcctacattttaggttctcttagtaacctggaagaattgatccttcctactggggatggaatttatcgagtggccaaactgatcatccagcagtgtcagcagcttcattgtctccgagtcctctcatttttcaagactttgaatgatgacagcgtggtggaaattgccaaagtagcaatcagtggaggtttccagaaacttgagaacctaaagctttcaatcaatcacaagattacagaggaaggatacagaaatttctttcaagcactggacaacatgccaaacttgcaggagttggacatctccaggcatttcacagagtgtatcaaagctcaggccacaacagtcaagtctttgagtcaatgtgtgttacgactaccaaggctcattagactgaacatgttaagttggctcttggatgcagatgatattgcattgcttaatgtcatgaaagaaagacatcctcaatctaagtacttaactattctccagaaatggatactgccgttctctccaatcattcagaaataaaagattcagctaaaaactgctgaatcaataatttgtcttggggcatattgaggatgtaaaaaaagttgttgattaatgctaaaaaccaaattatccaaaattattttattaaatattgcatacaaaagaaaatgtgtaaggcttgctaaaaaacaaaacaaaacaaaacacagtcctgcatactcaccaccaagctcaagaaataaatcatcaccaatacctttgaggtccctgagtaatccaccccagctaaaggcaaacccttcaatcaagtttatacagcaaaccctccattgtccatggtcaacagggaaggggttggggacaggtctgccaatctatctaaaagccacaatatggaagaagtattcaatttatataataaatggctaacttaacggttgaatcactttcatacatggatgaaacgggtttaacacaggatccacatgaatcttctgtgggccaagagatgttccttaatccttgtagaacctgttttctatattgaactagctttggtacagtagagttaacttactttccatttatccactgccaatataaagaggaaacaggggttagggaaaaatgacttcattccagaggcttctcagagttcaacatatgctataatttagaattttcttatgaatccactctacttgggtagaaaatattttatctctagtgattgcatattatttccatatcatagtatttcatagtattatatttgatatgagtgtctatatcaatgtcagtgtccagaatttcgttcctaccagttaagtagttttctgaacggccagaagaccattcgaaattcatgatactactataagttggtaaacaaccatacttttatcctcatttttattctcactaagaaaaaagtcaactcccctccccttgcccaagtatgaaatatagggacagtatgtatggtgtggtctcatttgtttagaaaaccacttatgactgggtgcggtggctcacacctgtaatcccagcactttgggaggctgaggcgggcgaatcatttgaggtgaggaattcgagaccagcctggccagcatggtgaaaccccatctctactaaaaatacaaaaattagccaggtgtggtggcacatgcctgtagtcccagccactagggcggctgagacgcaagacttgcttgaacccgggaggcagaggttgcagtgagccaagatggcgccactgcattccagcctgggcaacagagcaagaccctgtctgtctcaaaacaaaaaacaaaaccacttatattgctagctacattaagaatttctgaatatgttactgagcttgcttgtggtaaccatttataatatcagaaagtatatgtacaccaaaacatgttgaacatccatgttgtacaactgaaatataaataattttgtcaattatacctaaataaaactggaaaaaaatttctggaagtttatatctaaaaatgttaatagtgcgtacctctaggaagtgggcctggaagccattcttacttttcagtctctcccattctgtactgttttttgttttactttcgtgcctgcattatttttctatttaaaacaaaaataaatctagtttagcactaaaatattaactggagctacctctggagggcaagagtactagaaggtgggatggattgtcttcttgcttgtctgattttatatgtaatacctttgtaattagaaaggttgttaagcattatatcagaatccagtcaggagacagaaaccacacagaaatttgaatggggaaagtttaatatacagatgctcggcctgacgcagtggctcacgcctgtaattccagcactttgggaggccgaggtgggcagatcacttgaggtcaggagttcgagaccagcctggccaacatggtgaaatcctgtc

SEQ ID NO: 356127 - DNA, 3835 bp, Homo sapiens
ggtaattttttgttcagtagataaatatattgttatcttaaaaagattttttgtatttacttttgagactgggtctcagtctgttgcccaggctggagtgtagcagcctgatcatggctcagtgcagcctctacctccccgggctcaggtgatcctcccccttcagcctcctgagtagctgggactacagaggtgtggcaccatgcccggctaatttttgtattttttgtggagatggggttttgccatgttgcccaggctagtcttgaactcctggatgtgagccactgcgtctggcctattattttaaatatagttctctttactgccagtagctttcatataaccctagcgactagatttagtcaccactgcttaattccaaaaaacaaaagctccatcctatatttactgtaaatcagtctctttgattgtattgcatgttttatttcaagaaaaaagttaacctgaagatttaattttaaataactacacatgttgtcactaatagaaataacaaataattatatgagaataatggtaattctcctaagttttgtggtaaattttttggcaattttattgaagtataataaaattcaacaattcaatacgtctttataaatgttcattgtgatataggacagctctatcacagtactggggtaaattttaattatatttattaattacagatgtgaatttcttcggagtaagaaatcctcagaggaaattacccagtatattcaaagctacaagggatttgttgacataacgggagaacattttgtgaattcctgggtccagagagaattacctatggcatcagcttattgcaatgacagcatctttgcttacgaagaactacggctggactcttttaaggactggccccgggaatcagctgtgggagttgcagcactggccaaagcaggtcttttctacacaggtataaaggacatcgtccagtgcttttcctgtggagggtgtttagagaaatggcaggaaggtgatgacccattagacgatcacaccagatgttttcccaattgtccatttctccaaaatatgaagtcctctgcggaagtgactccagaccttcagagccgtggtgaactttgtgaattactggaaaccacaagtgaaagcaatcttgaagattcaatagcagttggtcctatagtgccagaaatggcacagggtgaagcccagtggtttcaagaggcaaagaatctgaatgagcagctgagagcagcttataccagcgccagtttccgccacatgtctttgcttgatatctcttccgatctggccacggaccacttgctgggctgtgatctgtctattgcttcaaaacacatcagcaaacctgtgcaagaacctctggtgctgcctgaggtctttggcaacttgaactctgtcatgtgtgtggagggtgaagctggaagtggaaagacggtcctcctgaagaaaatagcttttctgtgggcatctggatgctgtcccctgttaaacaggttccagctggttttctacctctcccttagttccaccagaccagacgaggggctggccagtatcatctgtgaccagctcctagagaaagaaggatctgttactgaaatgtgcatgaggaacattatccagcagttaaagaatcaggtcttattccttttagatgactacaaagaaatatgttcaatccctcaagtcataggaaaactgattcaaaaaaaccacttatcccggacctgcctattgattgctgtccgtacaaacagggccagggacatccgccgatacctagagaccattctagagatcaaagcatttcccttttataatactgtctgtatattacggaagctcttttcacataatatgactcgtctgcgaaagtttatggtttactttggaaagaaccaaagtttgcagaagatacagaaaactcctctctttgtggcggcgatctgtgctcattggtttcagtatccttttgacccatcctttgatgatgtggctgttttcaagtcctatatggaacgcctttccttaaggaacaaagcgacagctgaaattctcaaagcaactgtgtcctcctgtggtgagctggccttgaaagggtttttttcatgttgctttgagtttaatgatgatgatctcgcagaagcaggggttgatgaagatgaagatctaaccatgtgcttgatgagcaaatttacagcccagagactaagaccattctaccggtttttaagtcctgccttccaagaatttcttgcggggatgaggctgattgaactcctggattcagataggcaggaacatcaagatttgggactgtatcatttgaaacaaatcaactcacccatgatgactgtaagcgcctacaacaattttttgaactatgtctccagcctcccttcaacaaaagcagggcccaaaattgtgtctcatttgctccatttagtggataacaaagagtcattggagaatatatctgaaaatgatgactacttaaagcaccagccagaaatttcactgcagatgcagttacttaggggattgtggcaaatttgtccacaagcttacttttcaatggtttcagaacatttactggttcttgccctgaaaactgcttatcaaagcaacactgttgctgcgtgttctccatttgttttgcaattccttcaagggagaacactgactttgggtgcgcttaacttacagtactttttcgaccacccagaaagcttgtcattgttgaggagcatccacttcccaatacgaggaaataagacatcacccagagcacatttttcagttctggaaacatgttttgacaaatcacaggtgccaactatagatcaggactatgcttctgcctttgaacctatgaatgaatgggagcgaaatttagctgaaaaagaggataatgtaaagagctatatggatatgcagcgcagggcatcaccagaccttagtactggctattggaaactttctccaaagcagtacaagattccctgtctagaagtcgatgtgaatgatattgatgttgtaggccaggatatgcttgagattctaatgacagttttctcagcttcacagcgcatcgaactccatttaaaccacagcagaggctttatagaaagcatccgcccagctcttgagctgtctaaggcctctgtcaccaagtgctccataagcaagttggaactcagcgcagccgaacaggaactgcttctcaccctgccttccctggaatctcttgaagtctcagggacaatccagtcacaaggtatacctgtatatattttggatgactattctgatgtataatttctttttcttactttaagaggttgaaaacttctgaggccatgaaagcatgcatgctcattgatagaacagatataaaataaaccttcactaattttttttgacagtagcatgaattagtgaaaagtccttgaataatagaatggttttcaaataactcagacaaaatgaataaaatatttatattaaattattgaaggttcttaataaagacatgaattatctgttattagtaaaagaattagctatatgtaagatgatgcttagaaattaccttcaccctagctgcctaaaggaagaaaggcctgtagtccctgggaaataaataaattaatgggaaataatatcttcatctatttgtgtcttaactcctctaagcactatttgatagttttcagtgtagacttaacccatctttcattaaatttattcctagatactcatatcttttgaaagtattgtaaatgtcattaaaaatattttttcattttct

SEQ ID NO: 356128 - DNA, 1593 bp, Homo sapiens
ggtaattttttgttcagtagataaatatattgttatcttaaaaagattttttgtatttacttttgagactgggtctcagtctgttgcccaggctggagtgtagcagcctgatcatggctcagtgcagcctctacctccccgggctcaggtgatcctcccccttcagcctcctgagtagctgggactacagaggtgtggcaccatgcccggctaatttttgtattttttgtggagatggggttttgccatgttgcccaggctagtcttgaactcctggatgtgagccactgcgtctggcctattattttaaatatagttctctttactgccagtagctttcatataaccctagcgactagatttagtcaccactgcttaattccaaaaaacaaaagctccatcctatatttactgtaaatcagtctctttgattgtattgcatgttttatttcaagaaaaaagttaacctgaagatttaattttaaataactacacatgttgtcactaatagaaataacaaataattatatgagaataatggtaattctcctaagttttgtggtaaattttttggcaattttattgaagtataataaaattcaacaattcaatacgtctttataaatgttcattgtgatataggacagctctatcacagtactggggtaaattttaattatatttattaattacagatgtgaatttcttcggagtaagaaatcctcagaggaaattacccagtatattcaaagctacaagggatttgttgacataacggtaatgtataacagcaatttttttctcaagtttttggattacctgtaagtgtctgactcagaagggcataggcattctttttatgtcatgggtttgatttctttcttcctttctcctttcattcccctggctcccatcttcaaagtgaaaaatatcacattcacttgctgacctagagcctttttctttttccagggctggcttctgacgggctctgcttgccttcctgatagtcttcccctttatgaatgaagccacttgccccagcttccctctgctgcccctatctgcaggcttgctaagatctcctgacctaggcgctgtcacccacagtgggctgcagagctggctcttcctagctggctaactatcctgaatcagtaaaaatttcctagtggagagtgatgggaaatcgaatccaaactggcttaaacaaaaatgagaatttattgattaacatgactcaggagaccagaactctatagagaacatggcctgacagtgggggaagagaggtgtttcctcaaaaagaaactgggtgcagctttcccagaagaatcagttgctcaatatataataccctgatgaatttagttaccattctatgtctcttacttcctcattcgtcaaagtacatctgtgatatttaaatgcaggtctgttttcaaggtcagtttccggaaacagtgaccctgagaaggcttcctcctgagtatgcataaacacacacacacacacacacgcacgcacgcacaccccttcatatgccaaaatgacattaagtttcatttaaaaatataaaaatattgaaagagc

SEQ ID NO: 356129 - DNA, 1656 bp, Homo sapiens
ggtaattttttgttcagtagataaatatattgttatcttaaaaagattttttgtatttacttttgagactgggtctcagtctgttgcccaggctggagtgtagcagcctgatcatggctcagtgcagcctctacctccccgggctcaggtgatcctcccccttcagcctcctgagtagctgggactacagaggtgtggcaccatgcccggctaatttttgtattttttgtggagatggggttttgccatgttgcccaggctagtcttgaactcctggatgtgagccactgcgtctggcctattattttaaatatagttctctttactgccagtagctttcatataaccctagcgactagatttagtcaccactgcttaattccaaaaaacaaaagctccatcctatatttactgtaaatcagtctctttgattgtattgcatgttttatttcaagaaaaaagttaacctgaagatttaattttaaataactacacatgttgtcactaatagaaataacaaataattatatgagaataatggtaattctcctaagttttgtggtaaattttttggcaattttattgaagtataataaaattcaacaattcaatacgtctttataaatgttcattgtgatataggacagctctatcacagtactggggtaaattttaattatatttattaattacagatgtgaatttcttcggagtaagaaatcctcagaggaaattacccagtatattcaaagctacaagggatttgttgacataacggtaatgtataacagcaatttttttctcaagtttttggattacctgtaagtgtctgactcagaagggcataggcattctttttatgtcatgggtttgatttctttcttcctttctcctttcattcccctggctcccatcttcaaagtgaaaaatatcacattcacttgctgacctagagcctttttctttttccagggctggcttctgacgggctctgcttgccttcctgatagtcttcccctttatgaatgaagccacttgccccagcttccctctgctgcccctatctgcaggcttgctaagatctcctgacctaggcgctgtcacccacagtgggctgcagagctggctcttcctagctggctaactatcctgaatcagtaaaaatttcctagtggagagtgatgggaaatcgaatccaaactggcttaaacaaaaatgagaatttattgattaacatgactcaggagaccagaactctatagagaacatggcctgacagtgggggaagagaggtgtttcctcaaaaagaaactgggtgcagctttcccagaagaatcagttgctcaatatataataccctgatgaatttagttaccattctatgtctcttacttcctcattcgtcaaagtacatctgtgatatttaaatgcaggtctgttttcaaggtcagtttccggaaacagtgaccctgagaaggcttcctcctgagtatgcataaacattcacagcttgcatgcgtgtgtgtgtgtgtgtgtgtgtgtgtgtgtgtgtgtgtatgtttgcttgcactgcataaaaacaattgcaacatcaacagaaataaaaattaaaggaataattctcctccgactctgccgttccatccagtgaaactc

SEQ ID NO: 356130 - DNA, 2190 bp, Homo sapiens
ggtaattttttgttcagtagataaatatattgttatcttaaaaagattttttgtatttacttttgagactgggtctcagtctgttgcccaggctggagtgtagcagcctgatcatggctcagtgcagcctctacctccccgggctcaggtgatcctcccccttcagcctcctgagtagctgggactacagaggtgtggcaccatgcccggctaatttttgtattttttgtggagatggggttttgccatgttgcccaggctagtcttgaactcctggatgtgagccactgcgtctggcctattattttaaatatagttctctttactgccagtagctttcatataaccctagcgactagatttagtcaccactgcttaattccaaaaaacaaaagctccatcctatatttactgtaaatcagtctctttgattgtattgcatgttttatttcaagaaaaaagttaacctgaagatttaattttaaataactacacatgttgtcactaatagaaataacaaataattatatgagaataatggtaattctcctaagttttgtggtaaattttttggcaattttattgaagtataataaaattcaacaattcaatacgtctttataaatgttcattgtgatataggacagctctatcacagtactggggtaaattttaattatatttattaattacagatgtgaatttcttcggagtaagaaatcctcagaggaaattacccagtatattcaaagctacaagggatttgttgacataacgggagaacattttgtgaattcctgggtccagagagaattacctatggcatcagcttattgcaatgacagcatctttgcttacgaagaactacggctggactcttttaaggactggccccgggaatcagctgtgggagttgcagcactggccaaagcaggtcttttctacacaggtataaaggacatcgtccagtgcttttcctgtggagggtgtttagagaaatggcaggaaggtgatgacccattagacgatcacaccagatgttttcccaattgtccatttctccaaaatatgaagtcctctgcggaagtgactccagaccttcagagccgtggtgaactttgtgaattactggaaaccacaagtgaaagcaatcttgaagattcaatagcagttggtcctatagtgccaggtaagaactttgaagtagcacgtgggattatatgtatttgtaaatatatttgtatacagggcagttgcaaaaaaaagagtatttataattgtccaaagagcttccaaagaggagcagcattgcaacagtgtcgtgtatgagcaaaagtcaagattcttgtggcttctccagagtgcaggcaggaccaaactgatagtaggcaacgtgtctcaggtacaagcaaaccagtccttagaagcaccaatcagtaaacttctttcctgagatttttatttttattcattttattttattttattttattccagcctgggcaacagagcaagaccctgtctgtctcaaaacaaaaaacaaaaccacttatattgctagctacattaagaatttctgaatatgttactgagcttgcttgtggtaaccatttataatatcagaaagtatatgtacaccaaaacatgttgaacatccatgttgtacaactgaaatataaataattttgtcaattatacctaaataaaactggaaaaaaatttctggaagtttatatctaaaaatgttaatagtgcgtacctctaggaagtgggcctggaagccattcttacttttcagtctctcccattctgtactgttttttgttttactttcgtgcctgcattatttttctatttaaaacaaaaataaatctagtttagcactaaaatattaactggagctacctctggagggcaagagtactagaaggtgggatggattgtcttcttgcttgtctgattttatatgtaatacctttgtaattagaaaggttgttaagcattatatcagaatccagtcaggagacagaaaccacacagaaatttgaatggggaaagtttaatatacagatgctcggcctgacgcagtggctcacgcctgtaattccagcactttgggaggccgaggtgggcagatcacttgaggtcaggagttcgagaccagcctggccaacatggtgaaatcctgtc

SEQ ID NO: 356131 - DNA, 1094 bp, Homo sapiens
aattttgatttaagaaaagattttatttttcaaaggaaaccacaagtgaaagcaatcttgaagattcaatagcagttggtcctatagtgccaggtaagaactttgaagtagcacgtgggattatatgtatttgtaaatatatttgtatacagggcagttgcaaaaaaaagagtatttataattgtccaaagagcttccaaagaggagcagcattgcaacagtgtcgtgtatgagcaaaagtcaagattcttgtggcttctccagagtgcaggcaggaccaaactgatagtaggcaacgtgtctcaggtacaagcaaaccagtccttagaagcaccaatcagtaaacttctttcctgagatttttatttttattcattttattttattttattttattccagcctgggcaacagagcaagaccctgtctgtctcaaaacaaaaaacaaaaccacttatattgctagctacattaagaatttctgaatatgttactgagcttgcttgtggtaaccatttataatatcagaaagtatatgtacaccaaaacatgttgaacatccatgttgtacaactgaaatataaataattttgtcaattatacctaaataaaactggaaaaaaatttctggaagtttatatctaaaaatgttaatagtgcgtacctctaggaagtgggcctggaagccattcttacttttcagtctctcccattctgtactgttttttgttttactttcgtgcctgcattatttttctatttaaaacaaaaataaatctagtttagcactaaaatattaactggagctacctctggagggcaagagtactagaaggtgggatggattgtcttcttgcttgtctgattttatatgtaatacctttgtaattagaaaggttgttaagcattatatcagaatccagtcaggagacagaaaccacacagaaatttgaatggggaaagtttaatatacagatgctcggcctgacgcagtggctcacgcctgtaattccagcactttgggaggccgaggtgggcagatcacttgaggtcaggagttcgagaccagcctggccaacatggtgaaatcctgtc

SEQ ID NO: 356132 - DNA, 1709 bp, Homo sapiens
aaagcttcatgaatggaggcagatgggtgtctgtcttgttggttgctagatccccaatgtctagcactgtacctgatatatagtaggtgcttagtaaatatttgttgattaagtagatgaatactgatgtttcataattttccaacaatttatcttttgtgttgaaattccaggcattcctttaattcctggtttcttcggaaacagtgggaaatgctcttctaagaaaaatcttactataagggatcaacctgctttattttccttttcagaaaatggccacccagcagaaagcctctgacgagaggatctcccagtttgatcacaatttgctgccagagctgtctgctcttctgggcctagatgcagttcagttggcaaaggaactagaagaagaggagcagaaggagcgagcaaaaatgcagaaaggctacaactctcaaatgcgcagtgaagcaaaaaggttaaagacttttgtgacttatgagccgtacagctcatggataccacaggagatggcggccgctgggttttacttcactggggtaaaatctgggattcagtgcttctgctgtagcctaatcctctttggtgccggcctcacgagactccccatagaagaccacaagaggtttcatccagattgtgggttccttttgaacaaggatgttggtaacattgccaagtacgacataagggtgaagaatctgaagagcaggctgagaggaggtaaaatgaggtaccaagaagaggaggctagacttgcgtccttcaggaactggccattttatgtccaagggatatccccttgtgtgctctcagaggctggctttgtctttacaggtaaacaggacacggtacagtgtttttcctgtggtggatgtttaggaaattgggaagaaggagatgatccttggaaggaacatgccaaatggttccccaaatgtgaatttcttcggagtaagaaatcctcagaggaaattacccagtatattcaaagctacaagggatttgttgacataacgggctggcttctgacgggctctgcttgccttcctgatagtcttcccctttatgaatgaagccacttgccccagcttccctctgctgcccctatctgcaggcttgctaagatctcctgacctaggcgctgtcacccacagtgggctgcagagctggctcttcctagctggctaactatcctgaatcagtaaaaatttcctagtggagagtgatgggaaatcgaatccaaactggcttaaacaaaaatgagaatttattgattaacatgactcaggagaccagaactctatagagaacatggcctgacagtgggggaagagaggtgtttcctcaaaaagaaactgggtgcagctttcccagaagaatcagttgctcaatatataataccctgatgaatttagttaccattctatgtctcttacttcctcattcgtcaaagtacatctgtgatatttaaatgcaggtctgttttcaaggtcagtttccggaaacagtgaccctgagaaggcttcctcctgagtatgcataaacattcacagcttgcatgcgtgtgtgtgtgtgtgtgtgtgtgtgtgtgtgtgtgtgtatgtttgcttgcactgcataaaaacaattgcaacatcaacagaaataaaaattaaaggaataattctcctccgactctgccgttccatccagtgaaactc

SEQ ID NO: 356133 - DNA, 908 bp, Homo sapiens
tgttgacataacgggtaatgtataacaaatcccttgtagctttgaatatactggggtatattcaaagctacaagggatttgttgacataacggtaatgtataacagcaatttttttctcaagtttttggattacctgtaagtgtctgactcagaagggcataggcattctttttatgtcatgggtttgatttctttcttcctttctcctttcattcccctggctcccatcttcaaagtgaaaaatatcacattcacttgctgacctagagcctttttctttttccagggctggcttctgacgggctctgcttgccttcctgatagtcttcccctttatgaatgaagccacttgccccagcttccctctgctgcccctatctgcaggcttgctaagatctcctgacctaggcgctgtcacccacagtgggctgcagagctggctcttcctagctggctaactatcctgaatcagtaaaaatttcctagtggagagtgatgggaaatcgaatccaaactggcttaaacaaaaatgagaatttattgattaacatgactcaggagaccagaactctatagagaacatggcctgacagtgggggaagagaggtgtttcctcaaaaagaaactgggtgcagctttcccagaagaatcagttgctcaatatataataccctgatgaatttagttaccattctatgtctcttacttcctcattcgtcaaagtacatctgtgatatttaaatgcaggtctgttttcaaggtcagtttccggaaacagtgaccctgagaaggcttcctcctgagtatgcataaacacacacacacacacacacgcacgcacgcacaccccttcatatgccaaaatgacattaagtttcatttaaaaatataaaaatattgaaagagc

SEQ ID NO: 356134 - DNA, 1740 bp, Homo sapiens
ggtaattttttgttcagtagataaatatattgttatcttaaaaagattttttgtatttacttttgagactgggtctcagtctgttgcccaggctggagtgtagcagcctgatcatggctcagtgcagcctctacctccccgggctcaggtgatcctcccccttcagcctcctgagtagctgggactacagaggtgtggcaccatgcccggctaatttttgtattttttgtggagatggggttttgccatgttgcccaggctagtcttgaactcctggatgtgagccactgcgtctggcctattattttaaatatagttctctttactgccagtagctttcatataaccctagcgactagatttagtcaccactgcttaattccaaaaaacaaaagctccatcctatatttactgtaaatcagtctctttgattgtattgcatgttttatttcaagaaaaaagttaacctgaagatttaattttaaataactacacatgttgtcactaatagaaataacaaataattatatgagaataatggtaattctcctaagttttgtggtaaattttttggcaattttattgaagtataataaaattcaacaattcaatacgtctttataaatgttcattgtgatataggacagctctatcacagtactggggtaaattttaattatatttattaattacagatgtgaatttcttcggagtaagaaatcctcagaggaaattacccagtatattcaaagctacaagggatttgttgacataacgggagaacattttgtgaattcctgggtccagagagaattacctatggcatcagcttattgcaatgacagcatctttgcttacgaagaactacggctggactcttttaaggactggccccgggaatcagctgtgggagttgcagcactggccaaagcaggtcttttctacacaggtataaaggacatcgtccagtgcttttcctgtggagggtgtttagagaaatggcaggaaggtgatgacccattagacgatcacaccagatgttttcccaatagagacggggtttcaccgtgttagccaggatggtctccatctcctgacctcgtgatccacccgcctcagcctcccaaagtgctctgattacaggcgtgagccaccgcgcccggccagccatctgcttaatttttatgtacattgcttatttttgtttcttgagataaaattcatgtattaataattttatttatttaaatgaaataaatgaagacgaacaccagctcatcttcaacttatcccaaatgtttaaatctcctcttaagtcattcagacctaccagatatctcatcattttcatttcttgaaagagtcatcattttttttttctttttcttttttttttgagacggagtctggctctgtcacccaggctggagtgcagtggcatgatctcggctcactgcagactctgcctcccaggttcaagcaattcttcctgcctcagcatcccaagtagctgggactacaggcatgcaccactatgcctggctaatttttgtatttttaatagagatggagttttgccacgttggccaggctagtttcaaactcctgacctcaagtgatccgcctgcctcagcctcccaaagtgctggtattacaggcgtgagccactgcggctggtccattttcatcttgaaatgagtttccctggaagtcttctggcctgctggattatgaacaact

SEQ ID NO: 356135 - DNA, 1659 bp, Homo sapiens
ggtaattttttgttcagtagataaatatattgttatcttaaaaagattttttgtatttacttttgagactgggtctcagtctgttgcccaggctggagtgtagcagcctgatcatggctcagtgcagcctctacctccccgggctcaggtgatcctcccccttcagcctcctgagtagctgggactacagaggtgtggcaccatgcccggctaatttttgtattttttgtggagatggggttttgccatgttgcccaggctagtcttgaactcctggatgtgagccactgcgtctggcctattattttaaatatagttctctttactgccagtagctttcatataaccctagcgactagatttagtcaccactgcttaattccaaaaaacaaaagctccatcctatatttactgtaaatcagtctctttgattgtattgcatgttttatttcaagaaaaaagttaacctgaagatttaattttaaataactacacatgttgtcactaatagaaataacaaataattatatgagaataatggtaattctcctaagttttgtggtaaattttttggcaattttattgaagtataataaaattcaacaattcaatacgtctttataaatgttcattgtgatataggacagctctatcacagtactggggtaaattttaattatatttattaattacagatgtgaatttcttcggagtaagaaatcctcagaggaaattacccagtatattcaaagctacaagggatttgttgacataacgggagaacattttgtgaattcctgggtccagagagaattacctatggcatcagcttattgcaatgacagcatctttgcttacgaagaactacggctggactcttttaaggactggccccgggaatcagctgtgggagttgcagcactggccaaagcaggtcttttctacacaggtataaaggacatcgtccagtgcttttcctgtggagggtgtttagagaaatggcaggaaggtgatgacccattagacgatcacaccagatgttttcccaatagagacggggtttcaccgtgttagccaggatggtctccatctcctgacctcgtgatccacccgcctcagcctcccaaagtgctctgattacaggcgtgagccaccgcgcccggccagccatctgcttaatttttatgtacattgcttatttttgtttcttgagataaaattcatgtattaataattttatttatttaaatgaaataaatgaagacgaacaccagctcatcttcaacttatcccaaatgtttaaatctcctcttaagtcattcagacctaccagatatctcatcattttcatttcttgaaagagtcatcattttttttttctttttcttttttttttgagacggagtctggctctgtcacccaggctggagtctctttaaaaaaagaaagaaagaaaagaaaaattgtttctcaaataataaagtataggtgtttccagaattttcttttttacctttacgctcagttggatttgaaatttctagaattttaacaacatttctagttatcagaattattttctgagcaaaaatttgttttatctacttagtcatatgaattcaatctgaattattacattaatttctaatttcttcattt

SEQ ID NO: 356136 - DNA, 1067 bp, Homo sapiens
ggtaattttttgttcagtagataaatatattgttatcttaaaaagattttttgtatttacttttgagactgggtctcagtctgttgcccaggctggagtgtagcagcctgatcatggctcagtgcagcctctacctccccgggctcaggtgatcctcccccttcagcctcctgagtagctgggactacagaggtgtggcaccatgcccggctaatttttgtattttttgtggagatggggttttgccatgttgcccaggctagtcttgaactcctggatgtgagccactgcgtctggcctattattttaaatatagttctctttactgccagtagctttcatataaccctagcgactagatttagtcaccactgcttaattccaaaaaacaaaagctccatcctatatttactgtaaatcagtctctttgattgtattgcatgttttatttcaagaaaaaagttaacctgaagatttaattttaaataactacacatgttgtcactaatagaaataacaaataattatatgagaataatggtaattctcctaagttttgtggtaaattttttggcaattttattgaagtataataaaattcaacaattcaatacgtctttataaatgttcattgtgatataggacagctctatcacagtactggggtaaattttaattatatttattaattacagatgtgaatttcttcggagtaagaaatcctcagaggaaattacccagtatattcaaagctacaagggatttgttgacataacgggagaacattttgtgaattcctgggtccagagagaattacctatggcatcagcttattgcaatgacagcatctttgcttacgaagaactacggctggactcttttaaggactggccccgggaatcagctgtgggagttgcagcactggccaaagcaggtcttttctacacaggtgagtcagtaggttgtgcccacttgcttgcttgacctttaattcccacatagactttatgctcctgggcttacgtttagctacactcagcaatgtccactagcttcagcgtttcttt

SEQ ID NO: 356137 - DNA, 1021 bp, Homo sapiens
  misc_feature (967)..(967): n is a, c, g, or t
  misc_feature (969)..(969): n is a, c, g, or t
tgcatgaagacaaaaggtcctgtgctcacctgggacccttctggacgttgccctgtgtacctcttcgactgcctgttcatctacgacgaaccccgggtattgaccccagacaacaatgccacttcatattggggacttcgtctgggattccaaggtgcattcattgcaaagttccttaaatattttctcactgcttcctactaaaggacggacagagcatttgttcttcagccacatactttccttccactggccagcattctcctctattagactagaactgtggataaacctcagatgtgaatttcttcggagtaagaaatcctcagaggaaattacccagtatattcaaagctacaagggatttgttgacataacgggagaacattttgtgaattcctgggtccagagagaattacctatggcatcagcttattgcaatgacagcatctttgcttacgaagaactacggctggactcttttaaggactggccccgggaatcagctgtgggagttgcagcactggccaaagcaggtcttttctacacaggtataaaggacatcgtccagtgcttttcctgtggagggtgtttagagaaatggcaggaaggtgatgacccattagacgatcacaccagatgttttcccaaacggagtctggctctgtcacccaggctggagtgcagtggcatgatctcggctcactgcagactctgcctcccaggttcaagcaattcttcctgcctcagcatcccaagtagctgggactacaggcatgcaccactatgcctggctaatttttgtatttttaatagagatggagttttgccacgttggccaggctagtttcaaactcctgacctcaagtgatccgcctgcctcagcctcccaaagtgctggtattacaggcgtgagccactgcggctggtccattttcatcttgggagtcatcaatcattttcaccntncttgaaatgagtttccctggaagtcttctggcctgctggattatgaacaact

SEQ ID NO: 356138 - DNA, 221 bp, Homo sapiens
ctaagtgatggcacctccattaaaaaataaaccacaggtttggagagctttcggtttggttaaccccaaccacataccaagaaggcgatgcacctcaaactgcatgaagacaaaaggtcctgtgctcacctgggacccttctggacgttgccctgtgtacctcttcgactgcctgttcatctgtatcctttataataaagcagtaaacataagtaaagttt

SEQ ID NO: 356139 - DNA, 6165 bp, Homo sapiens
ggtaattttttgttcagtagataaatatattgttatcttaaaaagattttttgtatttacttttgagactgggtctcagtctgttgcccaggctggagtgtagcagcctgatcatggctcagtgcagcctctacctccccgggctcaggtgatcctcccccttcagcctcctgagtagctgggactacagaggtgtggcaccatgcccggctaatttttgtattttttgtggagatggggttttgccatgttgcccaggctagtcttgaactcctggatgtgagccactgcgtctggcctattattttaaatatagttctctttactgccagtagctttcatataaccctagcgactagatttagtcaccactgcttaattccaaaaaacaaaagctccatcctatatttactgtaaatcagtctctttgattgtattgcatgttttatttcaagaaaaaagttaacctgaagatttaattttaaataactacacatgttgtcactaatagaaataacaaataattatatgagaataatggtaattctcctaagttttgtggtaaattttttggcaattttattgaagtataataaaattcaacaattcaatacgtctttataaatgttcattgtgatataggacagctctatcacagtactggggtaaattttaattatatttattaattacagatgtgaatttcttcggagtaagaaatcctcagaggaaattacccagtatattcaaagctacaagggatttgttgacataacgggagaacattttgtgaattcctgggtccagagagaattacctatggcatcagcttattgcaatgacagcatctttgcttacgaagaactacggctggactcttttaaggactggccccgggaatcagctgtgggagttgcagcactggccaaagcaggtcttttctacacaggtataaaggacatcgtccagtgcttttcctgtggagggtgtttagagaaatggcaggaaggtgatgacccattagacgatcacaccagatgttttcccaattgtccatttctccaaaatatgaagtcctctgcggaagtgactccagaccttcagagccgtggtgaactttgtgaattactggaaaccacaagtgaaagcaatcttgaagattcaatagcagttggtcctatagtgccagaaatggcacagggtgaagcccagtggtttcaagaggcaaagaatctgaatgagcagctgagagcagcttataccagcgccagtttccgccacatgtctttgcttgatatctcttccgatctggccacggaccacttgctgggctgtgatctgtctattgcttcaaaacacatcagcaaacctgtgcaagaacctctggtgctgcctgaggtctttggcaacttgaactctgtcatgtgtgtggagggtgaagctggaagtggaaagacggtcctcctgaagaaaatagcttttctgtgggcatctggatgctgtcccctgttaaacaggttccagctggttttctacctctcccttagttccaccagaccagacgaggggctggccagtatcatctgtgaccagctcctagagaaagaaggatctgttactgaaatgtgcatgaggaacattatccagcagttaaagaatcaggtcttattccttttagatgactacaaagaaatatgttcaatccctcaagtcataggaaaactgattcaaaaaaaccacttatcccggacctgcctattgattgctgtccgtacaaacagggccagggacatccgccgatacctagagaccattctagagatcaaagcatttcccttttataatactgtctgtatattacggaagctcttttcacataatatgactcgtctgcgaaagtttatggtttactttggaaagaaccaaagtttgcagaagatacagaaaactcctctctttgtggcggcgatctgtgctcattggtttcagtatccttttgacccatcctttgatgatgtggctgttttcaagtcctatatggaacgcctttccttaaggaacaaagcgacagctgaaattctcaaagcaactgtgtcctcctgtggtgagctggccttgaaagggtttttttcatgttgctttgagtttaatgatgatgatctcgcagaagcaggggttgatgaagatgaagatctaaccatgtgcttgatgagcaaatttacagcccagagactaagaccattctaccggtttttaagtcctgccttccaagaatttcttgcggggatgaggctgattgaactcctggattcagataggcaggaacatcaagatttgggactgtatcatttgaaacaaatcaactcacccatgatgactgtaagcgcctacaacaattttttgaactatgtctccagcctcccttcaacaaaagcagggcccaaaattgtgtctcatttgctccatttagtggataacaaagagtcattggagaatatatctgaaaatgatgactacttaaagcaccagccagaaatttcactgcagatgcagttacttaggggattgtggcaaatttgtccacaagcttacttttcaatggtttcagaacatttactggttcttgccctgaaaactgcttatcaaagcaacactgttgctgcgtgttctccatttgttttgcaattccttcaagggagaacactgactttgggtgcgcttaacttacagtactttttcgaccacccagaaagcttgtcattgttgaggagcatccacttcccaatacgaggaaataagacatcacccagagcacatttttcagttctggaaacatgttttgacaaatcacaggtgccaactatagatcaggactatgcttctgcctttgaacctatgaatgaatgggagcgaaatttagctgaaaaagaggataatgtaaagagctatatggatatgcagcgcagggcatcaccagaccttagtactggctattggaaactttctccaaagcagtacaagattccctgtctagaagtcgatgtgaatgatattgatgttgtaggccaggatatgcttgagattctaatgacagttttctcagcttcacagcgcatcgaactccatttaaaccacagcagaggctttatagaaagcatccgcccagctcttgagctgtctaaggcctctgtcaccaagtgctccataagcaagttggaactcagcgcagccgaacaggaactgcttctcaccctgccttccctggaatctcttgaagtctcagggacaatccagtcacaagaccaaatctttcctaatctggataagttcctgtgcctgaaagaactgtctgtggatctggagggcaatataaatgttttttcagtcattcctgaagaatttccaaacttccaccatatggagaaattattgatccaaatttcagctgagtatgatccttccaaactagtaaaattaattcaaaattctccaaaccttcatgttttccatctgaagtgtaacttcttttcggattttgggtctctcatgactatgcttgtttcctgtaagaaactcacagaaattaagttttcggattcattttttcaagccgtcccatttgttgccagtttgccaaattttatttctctgaagatattaaatcttgaaggccagcaatttcctgatgaggaaacatcagaaaaatttgcctacattttaggttctcttagtaacctggaagaattgatccttcctactggggatggaatttatcgagtggccaaactgatcatccagcagtgtcagcagcttcattgtctccgagtcctctcatttttcaagactttgaatgatgacagcgtggtggaaattgccaaagtagcaatcagtggaggtttccagaaacttgagaacctaaagctttcaatcaatcacaagattacagaggaaggatacagaaatttctttcaagcactggacaacatgccaaacttgcaggagttggacatctccaggcatttcacagagtgtatcaaagctcaggccacaacagtcaagtctttgagtcaatgtgtgttacgactaccaaggctcattagactgaacatgttaagttggctcttggatgcagatgatattgcattgcttaatgtcatgaaagaaagacatcctcaatctaagtacttaactattctccagaaatggatactgccgttctctccaatcattcagaaataaaagattcagctaaaaactgctgaatcaataatttgtcttggggcatattgaggatgtaaaaaaagttgttgattaatgctaaaaaccaaattatccaaaattattttattaaatattgcatacaaaagaaaatgtgtaaggcttgctaaaaaacaaaacaaaacaaaacacagtcctgcatactcaccaccaagctcaagaaataaatcatcaccaatacctttgaggtccctgagtaatccaccccagctaaaggcaaacccttcaatcaagtttatacagcaaaccctccattgtccatggtcaacagggaaggggttggggacaggtctgccaatctatctaaaagccacaatatggaagaagtattcaatttatataataaatggctaacttaacggttgaatcactttcatacatggatgaaacgggtttaacacaggatccacatgaatcttctgtgggccaagagatgttccttaatccttgtagaacctgttttctatattgaactagctttggtacagtagagttaacttactttccatttatccactgccaatataaagaggaaacaggggttagggaaaaatgacttcattccagaggcttctcagagttcaacatatgctataatttagaattttcttatgaatccactctacttgggtagaaaatattttatctctagtgattgcatattatttccatatcatagtatttcatagtattatatttgatatgagtgtctatatcaatgtcagtgtccagaatttcgttcctaccagttaagtagttttctgaacggccagaagaccattcgaaattcatgatactactataagttggtaaacaaccatacttttatcctcatttttattctcactaagaaaaaagtcaactcccctccccttgcccaagtatgaaatatagggacagtatgtatggtgtggtctcatttgtttagaaaaccacttatgactgggtgcggtggctcacacctgtaatcccagcactttgggaggctgaggcgggcgaatcatttgaggtgaggaattcgagaccagcctggccagcatggtgaaaccccatctctactaaaaatacaaaaattagccaggtgtggtggcacatgcctgtagtcccagccactagggcggctgagacgcaagacttgcttgaacccgggaggcagaggttgcagtgagccaagatggcgccactgcattccagcctgggcaacagagcaagaccctgtctgtctcaaaacaaaaaacaaaaccacttatattgctagctacattaagaatttctgaatatgttactgagcttgcttgtggtaaccatttataatatcagaaagtatatgtacaccaaaacatgttgaacatccatgttgtacaactgaaatataaataattttgtcaattatacctaaataaaactggaaaaaaatttctggaagtttatatctaaaaatgttaatagtgcgtacctctaggaagtgggcctggaagccattcttacttttcagtctctcccattctgtactgttttttgttttactttcgtgcctgcattatttttctatttaaaacaaaaataaatctagtttagcactaaaatattaactggagctacctctggagggcaagagtactagaaggtgggatggattgtcttcttgcttgtctgattttatatgtaatacctttgtaattagaaaggttgttaagcattatatcagaatccagtcaggagacagaaaccacacagaaatttgaatggggaaagtttaatatacagatgctcggcctgacgcagtggctcacgcctgtaattccagcactttgggaggccgaggtgggcagatcacttgaggtcaggagttcgagaccagcctggccaacatggtgaaatcctgtc

SEQ ID NO: 356140 - DNA, 6413 bp, Homo sapiens
aaagcttcatgaatggaggcagatgggtgtctgtcttgttggttgctagatccccaatgtctagcactgtacctgatatatagtaggtgcttagtaaatatttgttgattaagtagatgaatactgatgtttcataattttccaacaatttatcttttgtgttgaaattccaggcattcctttaattcctggtttcttcggaaacagtgggaaatgctcttctaagaaaaatcttactataagggatcaacctgctttattttccttttcagaaaatggccacccagcagaaagcctctgacgagaggatctcccagtttgatcacaatttgctgccagagctgtctgctcttctgggcctagatgcagttcagttggcaaaggaactagaagaagaggagcagaaggagcgagcaaaaatgcagaaaggctacaactctcaaatgcgcagtgaagcaaaaaggttaaagacttttgtgacttatgagccgtacagctcatggataccacaggagatggcggccgctgggttttacttcactggggtaaaatctgggattcagtgcttctgctgtagcctaatcctctttggtgccggcctcacgagactccccatagaagaccacaagaggtttcatccagattgtgggttccttttgaacaaggatgttggtaacattgccaagtacgacataagggtgaagaatctgaagagcaggctgagaggaggtaaaatgaggtaccaagaagaggaggctagacttgcgtccttcaggaactggccattttatgtccaagggatatccccttgtgtgctctcagaggctggctttgtctttacaggtaaacaggacacggtacagtgtttttcctgtggtggatgtttaggaaattgggaagaaggagatgatccttggaaggaacatgccaaatggttccccaaatgtgaatttcttcggagtaagaaatcctcagaggaaattacccagtatattcaaagctacaagggatttgttgacataacgggagaacattttgtgaattcctgggtccagagagaattacctatggcatcagcttattgcaatgacagcatctttgcttacgaagaactacggctggactcttttaaggactggccccgggaatcagctgtgggagttgcagcactggccaaagcaggtcttttctacacaggtataaaggacatcgtccagtgcttttcctgtggagggtgtttagagaaatggcaggaaggtgatgacccattagacgatcacaccagatgttttcccaattgtccatttctccaaaatatgaagtcctctgcggaagtgactccagaccttcagagccgtggtgaactttgtgaattactggaaaccacaagtgaaagcaatcttgaagattcaatagcagttggtcctatagtgccagaaatggcacagggtgaagcccagtggtttcaagaggcaaagaatctgaatgagcagctgagagcagcttataccagcgccagtttccgccacatgtctttgcttgatatctcttccgatctggccacggaccacttgctgggctgtgatctgtctattgcttcaaaacacatcagcaaacctgtgcaagaacctctggtgctgcctgaggtctttggcaacttgaactctgtcatgtgtgtggagggtgaagctggaagtggaaagacggtcctcctgaagaaaatagcttttctgtgggcatctggatgctgtcccctgttaaacaggttccagctggttttctacctctcccttagttccaccagaccagacgaggggctggccagtatcatctgtgaccagctcctagagaaagaaggatctgttactgaaatgtgcatgaggaacattatccagcagttaaagaatcaggtcttattccttttagatgactacaaagaaatatgttcaatccctcaagtcataggaaaactgattcaaaaaaaccacttatcccggacctgcctattgattgctgtccgtacaaacagggccagggacatccgccgatacctagagaccattctagagatcaaagcatttcccttttataatactgtctgtatattacggaagctcttttcacataatatgactcgtctgcgaaagtttatggtttactttggaaagaaccaaagtttgcagaagatacagaaaactcctctctttgtggcggcgatctgtgctcattggtttcagtatccttttgacccatcctttgatgatgtggctgttttcaagtcctatatggaacgcctttccttaaggaacaaagcgacagctgaaattctcaaagcaactgtgtcctcctgtggtgagctggccttgaaagggtttttttcatgttgctttgagtttaatgatgatgatctcgcagaagcaggggttgatgaagatgaagatctaaccatgtgcttgatgagcaaatttacagcccagagactaagaccattctaccggtttttaagtcctgccttccaagaatttcttgcggggatgaggctgattgaactcctggattcagataggcaggaacatcaagatttgggactgtatcatttgaaacaaatcaactcacccatgatgactgtaagcgcctacaacaattttttgaactatgtctccagcctcccttcaacaaaagcagggcccaaaattgtgtctcatttgctccatttagtggataacaaagagtcattggagaatatatctgaaaatgatgactacttaaagcaccagccagaaatttcactgcagatgcagttacttaggggattgtggcaaatttgtccacaagcttacttttcaatggtttcagaacatttactggttcttgccctgaaaactgcttatcaaagcaacactgttgctgcgtgttctccatttgttttgcaattccttcaagggagaacactgactttgggtgcgcttaacttacagtactttttcgaccacccagaaagcttgtcattgttgaggagcatccacttcccaatacgaggaaataagacatcacccagagcacatttttcagttctggaaacatgttttgacaaatcacaggtgccaactatagatcaggactatgcttctgcctttgaacctatgaatgaatgggagcgaaatttagctgaaaaagaggataatgtaaagagctatatggatatgcagcgcagggcatcaccagaccttagtactggctattggaaactttctccaaagcagtacaagattccctgtctagaagtcgatgtgaatgatattgatgttgtaggccaggatatgcttgagattctaatgacagttttctcagcttcacagcgcatcgaactccatttaaaccacagcagaggctttatagaaagcatccgcccagctcttgagctgtctaaggcctctgtcaccaagtgctccataagcaagttggaactcagcgcagccgaacaggaactgcttctcaccctgccttccctggaatctcttgaagtctcagggacaatccagtcacaagaccaaatctttcctaatctggataagttcctgtgcctgaaagaactgtctgtggatctggagggcaatataaatgttttttcagtcattcctgaagaatttccaaacttccaccatatggagaaattattgatccaaatttcagctgagtatgatccttccaaactagtaaaattaattcaaaattctccaaaccttcatgttttccatctgaagtgtaacttcttttcggattttgggtctctcatgactatgcttgtttcctgtaagaaactcacagaaattaagttttcggattcattttttcaagccgtcccatttgttgccagtttgccaaattttatttctctgaagatattaaatcttgaaggccagcaatttcctgatgaggaaacatcagaaaaatttgcctacattttaggttctcttagtaacctggaagaattgatccttcctactggggatggaatttatcgagtggccaaactgatcatccagcagtgtcagcagcttcattgtctccgagtcctctcatttttcaagactttgaatgatgacagcgtggtggaaattgccaaagtagcaatcagtggaggtttccagaaacttgagaacctaaagctttcaatcaatcacaagattacagaggaaggatacagaaatttctttcaagcactggacaacatgccaaacttgcaggagttggacatctccaggcatttcacagagtgtatcaaagctcaggccacaacagtcaagtctttgagtcaatgtgtgttacgactaccaaggctcattagactgaacatgttaagttggctcttggatgcagatgatattgcattgcttaatgtcatgaaagaaagacatcctcaatctaagtacttaactattctccagaaatggatactgccgttctctccaatcattcagaaataaaagattcagctaaaaactgctgaatcaataatttgtcttggggcatattgaggatgtaaaaaaagttgttgattaatgctaaaaaccaaattatccaaaattattttattaaatattgcatacaaaagaaaatgtgtaaggcttgctaaaaaacaaaacaaaacaaaacacagtcctgcatactcaccaccaagctcaagaaataaatcatcaccaatacctttgaggtccctgagtaatccaccccagctaaaggcaaacccttcaatcaagtttatacagcaaaccctccattgtccatggtcaacagggaaggggttggggacaggtctgccaatctatctaaaagccacaatatggaagaagtattcaatttatataataaatggctaacttaacggttgaatcactttcatacatggatgaaacgggtttaacacaggatccacatgaatcttctgtgggccaagagatgttccttaatccttgtagaacctgttttctatattgaactagctttggtacagtagagttaacttactttccatttatccactgccaatataaagaggaaacaggggttagggaaaaatgacttcattccagaggcttctcagagttcaacatatgctataatttagaattttcttatgaatccactctacttgggtagaaaatattttatctctagtgattgcatattatttccatatcatagtatttcatagtattatatttgatatgagtgtctatatcaatgtcagtgtccagaatttcgttcctaccagttaagtagttttctgaacggccagaagaccattcgaaattcatgatactactataagttggtaaacaaccatacttttatcctcatttttattctcactaagaaaaaagtcaactcccctccccttgcccaagtatgaaatatagggacagtatgtatggtgtggtctcatttgtttagaaaaccacttatgactgggtgcggtggctcacacctgtaatcccagcactttgggaggctgaggcgggcgaatcatttgaggtgaggaattcgagaccagcctggccagcatggtgaaaccccatctctactaaaaatacaaaaattagccaggtgtggtggcacatgcctgtagtcccagccactagggcggctgagacgcaagacttgcttgaacccgggaggcagaggttgcagtgagccaagatggcgccactgcattccagcctgggcaacagagcaagaccctgtctgtctcaaaacaaaaaacaaaaccacttatattgctagctacattaagaatttctgaatatgttactgagcttgcttgtggtaaccatttataatatcagaaagtatatgtacaccaaaacatgttgaacatccatgttgtacaactgaaatataaataattttgtcaattatacctaaataaaactggaaaaaaatttctggaagtttatatctaaaaatgttaatagtgcgtacctctaggaagtgggcctggaagccattcttacttttcagtctctcccattctgtactgttttttgttttactttcgtgcctgcattatttttctatttaaaacaaaaataaatctagtttagcactaaaatattaactggagctacctctggagggcaagagtactagaaggtgggatggattgtcttcttgcttgtctgattttatatgtaatacctttgtaattagaaaggttgttaagcattatatcagaatccagtcaggagacagaaaccacacagaaatttgaatggggaaagtttaatatacagatgctcggcctgacgcagtggctcacgcctgtaattccagcactttgggaggccgaggtgggcagatcacttgaggtcaggagttcgagaccagcctggccaacatggtgaaatcctgtc

SEQ ID NO: 356141 - DNA, 5746 bp, Homo sapiens
ggtaattttttgttcagtagataaatatattgttatcttaaaaagattttttgtatttacttttgagactgggtctcagtctgttgcccaggctggagtgtagcagcctgatcatggctcagtgcagcctctacctccccgggctcaggtgatcctcccccttcagcctcctgagtagctgggactacagaggtgtggcaccatgcccggctaatttttgtattttttgtggagatggggttttgccatgttgcccaggctagtcttgaactcctggatgtgagccactgcgtctggcctattattttaaatatagttctctttactgccagtagctttcatataaccctagcgactagatttagtcaccactgcttaattccaaaaaacaaaagctccatcctatatttactgtaaatcagtctctttgattgtattgcatgttttatttcaagaaaaaagttaacctgaagatttaattttaaataactacacatgttgtcactaatagaaataacaaataattatatgagaataatggtaattctcctaagttttgtggtaaattttttggcaattttattgaagtataataaaattcaacaattcaatacgtctttataaatgttcattgtgatataggacagctctatcacagtactggggtaaattttaattatatttattaattacagatgtgaatttcttcggagtaagaaatcctcagaggaaattacccagtatattcaaagctacaagggatttgttgacataacgggagaacattttgtgaattcctgggtccagagagaattacctatggcatcagcttattgcaatgacagcatctttgcttacgaagaactacggctggactcttttaaggactggccccgggaatcagctgtgggagttgcagcactggccaaagcaggtcttttctacacaggtataaaggacatcgtccagtgcttttcctgtggagggtgtttagagaaatggcaggaaggtgatgacccattagacgatcacaccagatgttttcccaattgtccatttctccaaaatatgaagtcctctgcggaagtgactccagaccttcagagccgtggtgaactttgtgaattactggaaaccacaagtgaaagcaatcttgaagattcaatagcagttggtcctatagtgccagaaatggcacagggtgaagcccagtggtttcaagaggcaaagaatctgaatgagcagctgagagcagcttataccagcgccagtttccgccacatgtctttgcttgatatctcttccgatctggccacggaccacttgctgggctgtgatctgtctattgcttcaaaacacatcagcaaacctgtgcaagaacctctggtgctgcctgaggtctttggcaacttgaactctgtcatgtgtgtggagggtgaagctggaagtggaaagacggtcctcctgaagaaaatagcttttctgtgggcatctggatgctgtcccctgttaaacaggttccagctggttttctacctctcccttagttccaccagaccagacgaggggctggccagtatcatctgtgaccagctcctagagaaagaaggatctgttactgaaatgtgcatgaggaacattatccagcagttaaagaatcaggtcttattccttttagatgactacaaagaaatatgttcaatccctcaagtcataggaaaactgattcaaaaaaaccacttatcccggacctgcctattgattgctgtccgtacaaacagggccagggacatccgccgatacctagagaccattctagagatcaaagcatttcccttttataatactgtctgtatattacggaagctcttttcacataatatgactcgtctgcgaaagtttatggtttactttggaaagaaccaaagtttgcagaagatacagaaaactcctctctttgtggcggcgatctgtgctcattggtttcagtatccttttgacccatcctttgatgatgtggctgttttcaagtcctatatggaacgcctttccttaaggaacaaagcgacagctgaaattctcaaagcaactgtgtcctcctgtggtgagctggccttgaaagggtttttttcatgttgctttgagtttaatgatgatgatctcgcagaagcaggggttgatgaagatgaagatctaaccatgtgcttgatgagcaaatttacagcccagagactaagaccattctaccggtttttaagtcctgccttccaagaatttcttgcggggatgaggctgattgaactcctggattcagataggcaggaacatcaagatttgggactgtatcatttgaaacaaatcaactcacccatgatgactgtaagcgcctacaacaattttttgaactatgtctccagcctcccttcaacaaaagcagggcccaaaattgtgtctcatttgctccatttagtggataacaaagagtcattggagaatatatctgaaaatgatgactacttaaagcaccagccagaaatttcactgcagatgcagttacttaggggattgtggcaaatttgtccacaagcttacttttcaatggtttcagaacatttactggttcttgccctgaaaactgcttatcaaagcaacactgttgctgcgtgttctccatttgttttgcaattccttcaagggagaacactgactttgggtgcgcttaacttacagtactttttcgaccacccagaaagcttgtcattgttgaggagcatccacttcccaatacgaggaaataagacatcacccagagcacatttttcagttctggaaacatgttttgacaaatcacaggtgccaactatagatcaggactatgcttctgcctttgaacctatgaatgaatgggagcgaaatttagctgaaaaagaggataatgtaaagagctatatggatatgcagcgcagggcatcaccagaccttagtactggctattggaaactttctccaaagcagtacaagattccctgtctagaagtcgatgtgaatgatattgatgttgtaggccaggatatgcttgagattctaatgacagttttctcagcttcacagcgcatcgaactccatttaaaccacagcagaggctttatagaaagcatccgcccagctcttgagctgtctaaggcctctgtcaccaagtgctccataagcaagttggaactcagcgcagccgaacaggaactgcttctcaccctgccttccctggaatctcttgaagtctcagggacaatccagtcacaagaccaaatctttcctaatctggataagttcctgtgcctgaaagaactgtctgtggatctggagggcaatataaatgttttttcagtcattcctgaagaatttccaaacttccaccatatggagaaattattgatccaaatttcagctgagtatgatccttccaaactagtaaaattaattcaaaattctccaaaccttcatgttttccatctgaagtgtaacttcttttcggattttgggtctctcatgactatgcttgtttcctgtaagaaactcacagaaattaagttttcggattcattttttcaagccgtcccatttgttgccagtttgccaaattttatttctctgaagatattaaatcttgaaggccagcaatttcctgatgaggaaacatcagaaaaatttgcctacattttaggttctcttagtaacctggaagaattgatccttcctactggggatggaatttatcgagtggccaaactgatcatccagcagtgtcagcagcttcattgtctccgagtcctctcatttttcaagactttgaatgatgacagcgtggtggaaattgccaaagtagcaatcagtggaggtttccagaaacttgagaacctaaagctttcaatcaatcacaagattacagaggaaggatacagaaatttctttcaagcactggacaacatgccaaacttgcaggagttggacatctccaggcatttcacagagtgtatcaaagctcaggccacaacagtcaagtctttgagtcaatgtgtgttacgactaccaaggctcattagactgaacatgttaagttggctcttggatgcagatgatattgcattgcttaatgtcatgaaagaaagacatcctcaatctaagtacttaactattctccagaaatggatactgccgttctctccaatcattcagaaataaaagattcagctaaaaactgctgaatcaataatttgtcttggggcatattgaggatgtaaaaaaagttgttgattaatgctaaaaaccaaattatccaaaattattttattaaatattgcatacaaaagaaaatgtgtaaggcttgctaaaaaacaaaacaaaacaaaacacagtcctgcatactcaccaccaagctcaagaaataaatcatcaccaatacctttgaggtccctgagtaatccaccccagctaaaggcaaacccttcaatcaagtttatacagcaaaccctccattgtccatggtcaacagggaaggggttggggacaggtctgccaatctatctaaaagccacaatatggaagaagtattcaatttatataataaatggctaacttaacggttgaatcactttcatacatggatgaaacgggtttaacacaggatccacatgaatcttctgtgggccaagagatgttccttaatccttgtagaacctgttttctatattgaactagctttggtacagtagagttaacttactttccatttatccactgccaatataaagaggaaacaggggttagggaaaaatgacttcattccagaggcttctcagagttcaacatatgctataatttagaattttcttatgaatccactctacttgggtagaaaatattttatctctagtgattgcatattatttccatatcatagtatttcatagtattatatttgatatgagtgtctatatcaatgtcagtgtccagaatttcgttcctaccagttaagtagttttctgaacggccagaagaccattcgaaattcatgatactactataagttggtaaacaaccatacttttatcctcatttttattctcactaagaaaaaagtcaactcccctccccttgcccaagtatgaaatatagggacagtatgtatggtgtggtctcatttgtttagaaaaccacttatgactgggtgcggtggctcacacctgtaatcccagcactttgggaggctgaggcgggcgaatcatttgaggtgaggaattcgagaccagcctggccagcatggtgaaaccccatctctactaaaaatacaaaaattagccaggtgtggtggcacatgcctgtagtcccagccactagggcggctgagacgcaagacttgcttgaacccgggaggcagaggttgcagtgagccaagatggcgccactgcattccagcctgggcaacagagcaagaccctgtctgtctcaaaacaaaaaacaaaaccacttatattgctagctacattaagaatttctgaatatgttactgagcttgcttgtggtaaccatttataatatcagaaagtatatgtacaccaaaacatgttgaacatccatgttgtacaactgaaatataaataattttgtcaattatacctaaataaaactggaaaaatataattcgcgctactctcctactccctgtcggccgcctgggccaatcccattt

SEQ ID NO: 356142 - DNA, 1195 bp, Homo sapiens
tgcatgaagacaaaaggtcctgtgctcacctgggacccttctggacgttgccctgtgtacctcttcgactgcctgttcatctacgacgaaccccgggtattgaccccagacaacaatgccacttcatattggggacttcgtctgggattccaaggtgcattcattgcaaagttccttaaatattttctcactgcttcctactaaaggacggacagagcatttgttcttcagccacatactttccttccactggccagcattctcctctattagactagaactgtggataaacctcagatgtgaatttcttcggagtaagaaatcctcagaggaaattacccagtatattcaaagctacaagggatttgttgacataacggtaatgtataacagcaatttttttctcaagtttttggattacctgtaagtgtctgactcagaagggcataggcattctttttatgtcatgggtttgatttctttcttcctttctcctttcattcccctggctcccatcttcaaagtgaaaaatatcacattcacttgctgacctagagcctttttctttttccagggctggcttctgacgggctctgcttgccttcctgatagtcttcccctttatgaatgaagccacttgccccagcttccctctgctgcccctatctgcaggcttgctaagatctcctgacctaggcgctgtcacccacagtgggctgcagagctggctcttcctagctggctaactatcctgaatcagtaaaaatttcctagtggagagtgatgggaaatcgaatccaaactggcttaaacaaaaatgagaatttattgattaacatgactcaggagaccagaactctatagagaacatggcctgacagtgggggaagagaggtgtttcctcaaaaagaaactgggtgcagctttcccagaagaatcagttgctcaatatataataccctgatgaatttagttaccattctatgtctcttacttcctcattcgtcaaagtacatctgtgatatttaaatgcaggtctgttttcaaggtcagtttccggaaacagtgaccctgagaaggcttcctcctgagtatgcataaacacacacacacacacacacgcacgcacgcacaccccttcatatgccaaaatgacattaagtttcatttaaaaatataaaaatattgaaagagc

SEQ ID NO: 356143 - DNA, 838 bp, Homo sapiens
tgcatgaagacaaaaggtcctgtgctcacctgggacccttctggacgttgccctgtgtacctcttcgactgcctgttcatctacgacgaaccccgggtattgaccccagacaacaatgccacttcatattggggacttcgtctgggattccaaggtgcattcattgcaaagttccttaaatattttctcactgcttcctactaaaggacggacagagcatttgttcttcagccacatactttccttccactggccagcattctcctctattagactagaactgtggataaacctcagatgtgaatttcttcggagtaagaaatcctcagaggaaattacccagtatattcaaagctacaagggatttgttgacataacgggagaacattttgtgaattcctgggtccagagagaattacctatggcatcagcttattgcaatgacagcatctttgcttacgaagaactacggctggactcttttaaggactggccccgggaatcagctgtgggagttgcagcactggccaaagcaggtcttttctacacaggtataaaggacatcgtccagtgcttttcctgtggagggtgtttagagaaatggcaggaaggtgatgacccattagacgatcacaccagatgttttcccaagttctctctcttgcccaggttggagtgcagtggtgcaatcatggctcactgcagccttgacctctctggctcaagcaatcttcctcgctcagcctcccaagtagctgggactacaggcacatgtcttcacacccagctaattttttttttttttttttaagagacagggtctctctatgttgcccag

SEQ ID NO: 356144 - DNA, 471 bp, Homo sapiens
agcctggaagcacgaatggttggaaaggagaaataggcgagggcctgtggtggtaaaaccaatcccagttaaaggagatggatctgaaatgaatcacttagcagctgagtctccaggagaggtccaggcaagtgcggcttcaccagcttccaaaggccgacgcagtccttctcctggcaactccccaaagttcactttcacaatgaaattatatttgctgtgtgactatgattcctaagatttccagggcttaagggctaacttctattagcaccttactgtgtaagcaaatgttacaaaaaaaaaaaaaaaaaaatctctgggttaagaaaatttggcttaaatgtatcctttgttattttaaatatattgagatattttaattaaaatttttaccccattgaaccgattttatagtatttgtacctattttggtgtttttgtctttatagtaaataaaagtttttgaac

SEQ ID NO: 356145 - DNA, 3227 bp, Homo sapiens
caagatgtgggaactggaactttaatggctgttaaacaggtgacttatgtcagaaacacatcttctgagcaagaagaagtagtagaagcactaagagaagagataagaatgatgagccatctgaatcatccaaacatcattaggatgttgggagccacgtgtgagaagagcaattacaatctcttcattgaatggatggcagggggatcggtggctcatttgctgagtaaatatggagccttcaaagaatcagtagttattaactacactgaacagttactccgtggcctttcgtatctccatgaaaaccaaatcattcacagagatgtcaaaggtgccaatttgctaattgacagcactggtcagagactaagaattgcagattttggagctgcagccaggttggcatcaaaaggaactggtgcaggagagtttcagggacaattactggggacaattgcatttatggcacctgaggtactaagaggtcaacagtatggaaggagctgtgatgtatggagtgttggctgtgctattatagaaatggcttgtgcaaaaccaccatggaatgcagaaaaacactccaatcatcttgctttgatatttaagattgctagtgcaactactgctccatcgatcccttcacatttgtctcctggtttacgagatgtggctcttcgttgtttagaacttcaacctcaggacagacctccatcaagagagctactgaagcatccagtctttcgtactacatggtagccaattatgcagatcaactacagtagaaacaggatgctcaacaagagaaaaaaaacttgtggggaaccacattgatattctactggccatgatgccactgaacagctatgaacgaggccagtggggaacccttacctaagtatgtgattgacaaatcatgatctgtacctaagctcagtatgcaaaagcccaaactagtgcagaaactgtaaactgtgcctttcaaagaactggccctaggtgaacaggaaaacaatgaagtttgcatgactaaattgcagaagcataattttatttttttggagcactttttcagcaatattagcggctgaggggctcaggatctattttaatatttcaattattcttccatttcatatagtgatcacaagcagggggttctgcaattccgttcaaattttttgtcactggctataaaatcagtatctgcctcttttaggtcagagtatgctatgagtagcaatacatacatatatttttaaaagttgatacttctttatgacccacagttgacctttattttcttaaataccagggcagttgtggctcattgtgcattttactgttggcccattcatttcgtttttggaaattatggttttgtattttcatgtttatttacattcatttttgtttattcagggaaagctgatctttttttcaaaccagaaaaaaaaaatgaactagatatgaagtagagttcattaaatatcttgctattgtcagagtttttaaaatatagacttaattttgtttttttaaattggaatacaataaagtactacctacatttgagtcagtcaccactcttattgtgcaggttaagtacaagttaactaaaaataaactgtcctctctggtgcaactcacaaccaagatcaagattaccttaaaatttatttgaattttttagatgttttggttgtcaaactgtaggaaacttcacaacatttaagtcttactctgtatgtaacaatccatcattcaccttcactactggtaataacatagagctgccattttccttttaccatgcatcatctctttacagtaggcctggcagatcattttttaaaaagattattcaactaccaatcagtaatgtttttaaacagtacatttgctttgaacttggaaaatgtgttcagaaagaaaaatggaattgaatttcatttatacactaattccttggattttgcacagttacctaacggttttagtctggagttaaattcagatgcatggaatcctgaaggaaaatggtagctttttaatctttttgtgtgtgtgtgagtcttttaaatcaagtactgattaactattaagtacaactttgagattttagttttaactcttcagaagccagtgtgaaatagaattggttattctcaaagactcaggataaactaaataagctatatatagagtacatttaaaatgtacaacacaaattggaagtaaaataagttacaagataagtttacagggatatattgcttacaatttttaaaaggcagtttgttttttatgtgaatatgtttcttagtgaaattttacattcctttgttttggaagattggcgatatttgaagagttaaaaatagtacagaaatgtgaagtttggtatctctaaatgtgttgtacttgactttcttttttatttttttttattttttttgactacttagaattttcacaattctaataagattgtttccaagtctctcatgtgcaagctttaaaggatgcactcttgccattttatgtactggaagatcattggtcagatgaatactgtgtctgacaaaaatgtaaactgtataaactgaggaacctcagctaatcagtattactttgtagatcaccatgcccaccacatttcaaactcaaactatctgtagatttcaaaatccattgtgtttgagtttgtttgcagttccctcagcttgctggtaattgtggtgttttgttttttgttttgttttcaatgcaaatgtgatgtaatattcttattttctttggatcaaagctggactggaaattgtatcgtgtaattatttttgtgttcttaatgttatttggtactcaagttgtaaataacgtctactactgtttattccagtttctactacctcaggtgtcctatagatttttcttctaccaaagttcactttcacaatgaaattatatttgctgtgtgactatgattcctaagatttccagggcttaagggctaacttctattagcaccttactgtgtaagcaaatgttacaaaaaaaaaaaaaaaaaaatctctgggttaagaaaatttggcttaaatgtatcctttgttattttaaatatattgagatattttaattaaaatttttaccccattgaaccgattttatagtatttgtacctattttggtgtttttgtctttatagtaaataaaagtttttgaac

SEQ ID NO: 356146 - DNA, 493 bp, Homo sapiens
gcggccgcctgcccggcgtggggagcgggcgccccgggccgccgccgagagggggagccggaagtcggcgcgggcgcccctcggccccgacgacgccgtgaccttggccggcccgctcacctctcggaatctcgcctgccgggaccgcgaaatgggggcgaccgcggcgtccctctccgtcggcgcagccctcgacggcgcttgggtttgaccccggcgcgcttgctcgccccttctcccgagaaggggtttcggaggtagacatgggatggatactggacatgttcctgtcgcggcccgggtttggtccccttcctgggattcagccgaaagggccgaggaagggaagcaaacatgttgacgaggcgattgggaggtggggttggttagtgggcagtgacagaattcgggccgctctctagtcccttgtaaaagacctgaaaaaatcggacacccagggtctccagtccttactacccagctgtggtggctg

SEQ ID NO: 356147 - DNA, 777 bp, Homo sapiens
tagcaatgtagggtgactatcattaacaagaatttagtttgtatctttaaatatctagaagagaggattttgaatgttcctaacacaaagatgatgaatgtttaaggtgattgatatgccattaccctgatttgattattaaacattctatatatgtattgaaatatcaccgtaccccataaatatagttactaaatgtcaattttttaaaaagctattatttttcaaatgataaaaaagaagtattttgtagaatgttaattatctatattccattttattaaaatatatacaattttgtttttgtttgcttcaagagaaatgtcccagtgtagtttatatattaattatgcatatcttaatgaattcagaatagtactttaaatatattaagtttatttactgctccccccacccattttccaaagtagactgcattaatttcatgtgattgatccaagtagatccaattgattgacttactgttttcctaatttcaggttccagttacagctatatcagagaatgagttaatctcctcagaaatcactaaatactactctgaggggcttagaaattaacaggttgtttatataattggccttaaatgaggtgagagtgaagagactagagccatctctggaaaacatcattatcccattccccgggaagctaccctctggaactcaagatttgaccatatctgttttgaggattcattatgaacaaagaagtctccccaggtaggaattgtagttctatttttaaagagctttg

SEQ ID NO: 356148 - DNA, 301 bp, Homo sapiens
aacatggcggccgcggagagcggctgaaatgcctgttcttcaggccgggcgagcgggagtctgacgcgatttgctgagctctgtcctccgacggctgcctcgcggccttgagggcctccgccgcctgttcgctgctgctccctcgagcggagcctgcgtcaggttccctctgcatccccctgcggggggacccctgctccggaggagggggccggagagccgcggcggcggcggcggcaggcgcctgggcccagggggccgggctccgggcccgaggagcggcggaggccggggcggcgcc

SEQ ID NO: 356149 - DNA, 7112 bp, Homo sapiens
gcggccgcctgcccggcgtggggagcgggcgccccgggccgccgccgagagggggagccggaagtcggcgcgggcgcccctcggccccgacgacgccgtgaccttggccggcccgctcacctctcggaatctcgcctgccgggaccgcgaaatgggggcgaccgcggcgtccctctccgtcggcgcagccctcgacggcgcttgggtttgaccccggcgcgcttgctcgccccttctcccgagaaggggtttcggagatctatccatactaatggaaatgtaactggaactgactctgatgataaaatcaaggaccatcaagcaagatcatgcagtaggcaactttgcttccaaaagaagttaccaacatttagaatttctacttattctgaggttccagttacagctatatcagagaatgagttaatctcctcagaaatcactaaatactactctgaggggcttagaaattaacaggttgtttatataattggccttaaatgaggtgagagtgaagagactagagccatctctggaaaacatcattatcccattccccgggaagctaccctctggaactcaagatttgaccatatctgttttgaggattcattatgaacaaagaagtctccccaggtgtgaagtttttcaacatgagtggcctcggggacagttcatccgaccctgctaacccagactcacataagaggaaaggatcgccatgtgacacactggcatcaagcacggaaaagaggcgcagggagcaagaaaataaatatttagaagaactagctgagttactgtctgccaacattagtgacattgacagcttgagtgtaaaaccagacaaatgcaagattttgaagaaaacagtcgatcagatacagctaatgaagagaatggaacaagagaaatcaacaactgatgacgatgtacagaaatcagacatctcatcaagtagtcaaggagtgatagaaaaggaatccttgggacctcttcttttggaggctttggatggatttttctttgttgtgaactgtgaagggagaattgtatttgtgtcagagaatgtaaccagctacttaggttacaatcaggaggaattaatgaataccagcgtctacagcatactgcacgtgggggatcatgcagaatttgtgaagaatctgctaccaaaatcactagtaaatggagttccttggcctcaagaggcaacacgacgaaatagccatacctttaactgcaggatgctaattcaccctccagatgagccagggaccgagaaccaagaagcttgccagcgttatgaagtaatgcagtgtttcactgtgtcacagccaaaatcaattcaagaggatggagaagatttccagtcatgtctgatttgtattgcacggcgattacctcggcctccagctattacgggtgtagaatcctttatgaccaagcaagatactacaggtaaaatcatctctattgatactagttccctgagagctgctggcagaactggttgggaagatttagtgaggaagtgcatttatgcttttttccaacctcagggcagagaaccatcttatgccagacagctgttccaagaagtgatgactcgtggcactgcctccagcccctcctatagattcatattgaatgatgggacaatgcttagcgcccacaccaagtgtaaactttgctaccctcaaagtccagacatgcaacctttcatcatgggaattcatatcatcgacagggagcacagtgggctttctcctcaagatgacactaattctggaatgtcaattccccgagtaaatccctcggtcaatcctagtatctctccagctcatggtgtggctcgttcatccacattgccaccatccaacagcaacatggtatccaccagaataaaccgccagcagagctcagaccttcatagcagcagtcatagtaattctagcaacagccaaggaagtttcggatgctcacccggaagtcagattgtagccaatgttgccttaaaccaaggacaggccagttcacagagcagtaatccctctttaaacctcaataattctcctatggaaggtacaggaatatccctagcacagttcatgtctccaaggagacaggttacttctggattggcaacaaggcccaggatgccaaacaattcctttcctcctaatatttcgacattaagctctcccgttggcatgacaagtagtgcctgtaataataataaccgatcttattcaaacatcccagtaacatctttacagggtatgaatgaaggacccaataactccgttggcttctctgccagttctccagtcctcaggcagatgagctcacagaattcacctagcagattaaatatacaaccagcaaaagctgagtccaaagataacaaagagattgcctcaattttaaatgaaatgattcaatctgacaacagctctagtgatggcaaacctctggattcagggcttctgcataacaatgacagactttcagatggagacagtaaatactctcaaaccagtcacaaactagtgcagcttttgacaacaactgccgaacagcagttacggcatgctgatatagacacaagctgcaaagatgtcctgtcttgcacaggcacttccaactctgcctctgctaactcttcaggaggttcttgtccctcttctcatagctcattgacagaacggcataaaattctacaccggctcttacaggagggtagcccctcagatatcaccactttgtctgtcgagcctgataaaaaggacagtgcatctacttctgtgtcagtgactggacaggtacaaggaaactccagtataaaactagaactggatgcttcaaagaaaaaagaatcaaaagaccatcagctcctacgctatcttttagataaagatgagaaagatttaagatcaactccaaacctgagcctggatgatgtaaaggtgaaagtggaaaagaaagaacagatggatccatgtaatacaaacccaaccccaatgaccaaacccactcctgaggaaataaaactggaggcccagagccagtttacagctgaccttgaccagtttgatcagttactgcccacgctggagaaggcagcacagttgccaggcttatgtgagacagacaggatggatggtgcggtcaccagtgtaaccatcaaatcggagatcctgccagcttcacttcagtccgccactgccagacccacttccaggctaaatagattacctgagctggaattggaagcaattgataaccaatttggacaaccaggaacaggcgatcagattccatggacaaataatacagtgacagctataaatcagagtaaatcagaagaccagtgtattagctcacaattagatgagcttctctgtccacccacaacagtagaagggagaaatgatgagaaggctcttcttgaacagctggtatccttccttagtggcaaagatgaaactgagctagctgaactagacagagctctgggaattgacaaacttgttcaggggggtggattagatgtattatcagagagatttccaccacaacaagcaacgccacctttgatcatggaagaaagacccaacctttattcccagccttactcttctccttctcctactgccaatctccctagccctttccaaggcatggtcaggcaaaaaccttcactggggacgatgcctgttcaagtaacacctccccgaggtgctttttcacctggcatgggcatgcagcccaggcaaactctaaacagacctccggctgcacctaaccagcttcgacttcaactacagcagcgattacagggacaacagcagttgatacaccaaaatcggcaagctatcttaaaccagtttgcagcaactgctcctgttggcatcaatatgagatcaggcatgcaacagcaaattacacctcagccacccctgaatgctcaaatgttggcacaacgtcagcgggaactgtacagtcaacagcaccgacagaggcagctaatacagcagcaaagagccatgcttatgaggcagcaaagctttgggaacaacctccctccctcatctggactaccagttcaaatggggaacccccgtcttcctcagggtgctccacagcaattcccctatccaccaaactatggtacaaatccaggaaccccacctgcttctaccagcccgttttcacaactagcagcaaatcctgaagcatccttggccaaccgcaacagcatggtgagcagaggcatgacaggaaacataggaggacagtttggcactggaatcaatcctcagatgcagcagaatgtcttccagtatccaggagcaggaatggttccccaaggtgaggccaactttgctccatctctaagccctgggagctccatggtgccgatgccaatccctcctcctcagagttctctgctccagcaaactccacctgcctccgggtatcagtcaccagacatgaaggcctggcagcaaggagcgataggaaacaacaatgtgttcagtcaagctgtccagaaccagcccacgcctgcacagccaggagtatacaacaacatgagcatcaccgtttccatggcaggtggaaatacgaatgttcagaacatgaacccaatgatggcccagatgcagatgagctctttgcagatgccaggaatgaacactgtgtgccctgagcagataaatgatcccgcactgagacacacaggcctctactgcaaccagctctcatccactgaccttctcaaaacagaagcagatggaacccagcaggtgcaacaggttcaggtgtttgctgacgtccagtgtacagtgaatctggtaggcggggacccttacctgaaccagcctggtccactgggaactcaaaagcccacgtcaggaccacagaccccccaggcccagcagaagagcctccttcagcagctactgactgaataaccacttttaaaggaatgtgaaatttaaataatagacatacagagatatacaaatatattatatatttttctgagatttttgatatctcaatctgcagccattcttcaggtcgtagcatttggagcaaaaaaaaaaaaaaaaaaaaaaaaaaaggagtttgcttttgtcgggagattgaaagatgtttttgtttctttctttgtaaaggccttggatattgaaaaaataccaaggcagaacagttggacaatctatttcttgagccaaatttaattattcttatttttgtaatcagtcattggcttcttatctggatgaaggcttttggaggagaaccaaaacgacaagttccaagaagaagatgaagctccgcctccgccgcttagtcccaaccctgcccaggaagaagggcccgtggggctttgcctgtgcccgtccaccaaaggctgtcatgtgtctcgaaatcagcagccctccccatcccaatcccaggcagcttgtgtgtacaatcagcttctctagcaactctgtatctgttggcttcaagagaatattttgcctccacatatgtaccccttctcctttttttaaagatggatttaaaccaagatgcctccaggaaagaggacgaaatgagtatattcacagaggaatccaaaaaatacagtttgggggaaaatgcaataatttttgatgagatgggtgaaggacaagaagtgagttgtgtcaattattgtagatacaattttctgattaaatctggaaaaataaaaggcagcctgttttttctgcttttattgtattaacagctgaggtagctaaagttatttaaaataaaattaaatttatgatccaagtagcttatttttccctttaaatctcattgtaaatatatttgatttcttgtagaaattgatttccttctgtttaattttatgcttttattatactcttgatttttctaaatttgtgtgtgaaatataacattgattgaattgcagttacatttggttagtaatatttcattattttaataactgtgatgtcatgtatggatttactttggggttcaaatcaaaatgtcactgccagaaagagctgttccagctgatctagagcatactgccctagagtgtccctgggatcatctgaacagaagtgcacaggctacttgtacagagaaaaaattaatactcaaaggaaatcttcattttttagattgactttgggaatttgaattttcatcagtgcaaatataaatttctctatcctgctctgaggctaattggtaccatattttccctttgtgtcttgtgactctgccacatcccatctcatcctggcctctgagtcaagaacccagtgaactgactttctagttctagaagttccgctgcaaggccaggaaagcttgagaaaggtattgtggaagaagcaaaggtagacccccatcactcacctttgtctgcatccctgggcctgtgaatgatgacagcacctgacattctgcaccagctacctctgcctccatggcagagaaaaggccataagaacagtggaagaggagcatggactcagacttcaaggaagaagccatttccccaggtccttccttctgcatctcaccacccctagttacaaataactccattgaacagcatctattcagaaactatgccgaataaaaagattggtggaagggctcatgtggttagcaactatgaaacagaaataggacactcagttacaaacattatctcctttagtttttcagaaaatgcatccctgatttcattcatttccagcttgaaagccagccatattactctagtccctaccaaactgctctagaaggtcatttccattttgtttgtgatatttagacgcgcagacttcaggaagttcacctttaacttcagcattccagatgaagtttcctgactcagtgcttttgcataaggaactagaaaaaaaaagtaaggaaaattggagatgctaacatcctcccccatcccaactgcaccttaaaatatgcatgtcaccttcaaggttttataattgcactgtttgttttatgtatgtacagattaaaattattgctacatttgaggaaaataaaattgcttgcttcta

SEQ ID NO: 356150 - DNA, 7235 bp, Homo sapiens
gcggccgcctgcccggcgtggggagcgggcgccccgggccgccgccgagagggggagccggaagtcggcgcgggcgcccctcggccccgacgacgccgtgaccttggccggcccgctcacctctcggaatctcgcctgccgggaccgcgaaatgggggcgaccgcggcgtccctctccgtcggcgcagccctcgacggcgcttgggtttgaccccggcgcgcttgctcgccccttctcccgagaaggggtttcggagatctatccatactaatggaaatgtaactggaactgactctgatgataaaatcaaggaccatcaagcaagatcatgcagtaggcaactttgcttccaaaagaagttaccaacatttagaatttctacttattctgaggttccagttacagctatatcagagaatgagttaatctcctcagaaatcactaaatactactctgaggggcttagaaattaacaggttgtttatataattggccttaaatgaggtgagagtgaagagactagagccatctctggaaaacatcattatcccattccccgggaagctaccctctggaactcaagatttgaccatatctgttttgaggattcattatgaacaaagaagtctccccaggtgtgaagtttttcaacatgagtggcctcggggacagttcatccgaccctgctaacccagactcacataagaggaaaggatcgccatgtgacacactggcatcaagcacggaaaagaggcgcagggagcaagaaaataaatatttagaagaactagctgagttactgtctgccaacattagtgacattgacagcttgagtgtaaaaccagacaaatgcaagattttgaagaaaacagtcgatcagatacagctaatgaagagaatggaacaagagaaatcaacaactgatgacgatgtacagaaatcagacatctcatcaagtagtcaaggagtgatagaaaaggaatccttgggacctcttcttttggaggctttggatggatttttctttgttgtgaactgtgaagggagaattgtatttgtgtcagagaatgtaaccagctacttaggttacaatcaggaggaattaatgaataccagcgtctacagcatactgcacgtgggggatcatgcagaatttgtgaagaatctgctaccaaaatcactagtaaatggagttccttggcctcaagaggcaacacgacgaaatagccatacctttaactgcaggatgctaattcaccctccagatgagccagggaccgagaaccaagaagcttgccagcgttatgaagtaatgcagtgtttcactgtgtcacagccaaaatcaattcaagaggatggagaagatttccagtcatgtctgatttgtattgcacggcgattacctcggcctccagctattacgggtgtagaatcctttatgaccaagcaagatactacaggtaaaatcatctctattgatactagttccctgagagctgctggcagaactggttgggaagatttagtgaggaagtgcatttatgcttttttccaacctcagggcagagaaccatcttatgccagacagctgttccaagaagtgatgactcgtggcactgcctccagcccctcctatagattcatattgaatgatgggacaatgcttagcgcccacaccaagtgtaaactttgctaccctcaaagtccagacatgcaacctttcatcatgggaattcatatcatcgacagggagcacagtgggctttctcctcaagatgacactaattctggaatgtcaattccccgagtaaatccctcggtcaatcctagtatctctccagctcatggtgtggctcgttcatccacattgccaccatccaacagcaacatggtatccaccagaataaaccgccagcagagctcagaccttcatagcagcagtcatagtaattctagcaacagccaaggaagtttcggatgctcacccggaagtcagattgtagccaatgttgccttaaaccaaggacaggccagttcacagagcagtaatccctctttaaacctcaataattctcctatggaaggtacaggaatatccctagcacagttcatgtctccaaggagacaggttacttctggattggcaacaaggcccaggatgccaaacaattcctttcctcctaatatttcgacattaagctctcccgttggcatgacaagtagtgcctgtaataataataaccgatcttattcaaacatcccagtaacatctttacagggtatgaatgaaggacccaataactccgttggcttctctgccagttctccagtcctcaggcagatgagctcacagaattcacctagcagattaaatatacaaccagcaaaagctgagtccaaagataacaaagagattgcctcaattttaaatgaaatgattcaatctgacaacagctctagtgatggcaaacctctggattcagggcttctgcataacaatgacagactttcagatggagacagtaaatactctcaaaccagtcacaaactagtgcagcttttgacaacaactgccgaacagcagttacggcatgctgatatagacacaagctgcaaagatgtcctgtcttgcacaggcacttccaactctgcctctgctaactcttcaggaggttcttgtccctcttctcatagctcattgacagaacggcataaaattctacaccggctcttacaggagggtagcccctcagatatcaccactttgtctgtcgagcctgataaaaaggacagtgcatctacttctgtgtcagtgactggacaggtacaaggaaactccagtataaaactagaactggatgcttcaaagaaaaaagaatcaaaagaccatcagctcctacgctatcttttagataaagatgagaaagatttaagatcaactccaaacctgagcctggatgatgtaaaggtgaaagtggaaaagaaagaacagatggatccatgtaatacaaacccaaccccaatgaccaaacccactcctgaggaaataaaactggaggcccagagccagtttacagctgaccttgaccagtttgatcagttactgcccacgctggagaaggcagcacagttgccaggcttatgtgagacagacaggatggatggtgcggtcaccagtgtaaccatcaaatcggagatcctgccagcttcacttcagtccgccactgccagacccacttccaggctaaatagattacctgagctggaattggaagcaattgataaccaatttggacaaccaggaacaggcgatcagattccatggacaaataatacagtgacagctataaatcagagtaaatcagaagaccagtgtattagctcacaattagatgagcttctctgtccacccacaacagtagaagggagaaatgatgagaaggctcttcttgaacagctggtatccttccttagtggcaaagatgaaactgagctagctgaactagacagagctctgggaattgacaaacttgttcaggggggtggattagatgtattatcagagagatttccaccacaacaagcaacgccacctttgatcatggaagaaagacccaacctttattcccagccttactcttctccttctcctactgccaatctccctagccctttccaaggcatggtcaggcaaaaaccttcactggggacgatgcctgttcaagtaacacctccccgaggtgctttttcacctggcatgggcatgcagcccaggcaaactctaaacagacctccggctgcacctaaccagcttcgacttcaactacagcagcgattacagggacaacagcagttgatacaccaaaatcggcaagctatcttaaaccagtttgcagcaactgctcctgttggcatcaatatgagatcaggcatgcaacagcaaattacacctcagccacccctgaatgctcaaatgttggcacaacgtcagcgggaactgtacagtcaacagcaccgacagaggcagctaatacagcagcaaagagccatgcttatgaggcagcaaagctttgggaacaacctccctccctcatctggactaccagttcaaatggggaacccccgtcttcctcagggtgctccacagcaattcccctatccaccaaactatggtacaaatccaggaaccccacctgcttctaccagcccgttttcacaactagcagcaaatcctgaagcatccttggccaaccgcaacagcatggtgagcagaggcatgacaggaaacataggaggacagtttggcactggaatcaatcctcagatgcagcagaatgtcttccagtatccaggagcaggaatggttccccaaggtgaggccaactttgctccatctctaagccctgggagctccatggtgccgatgccaatccctcctcctcagagttctctgctccagcaaactccacctgcctccgggtatcagtcaccagacatgaaggcctggcagcaaggagcgataggaaacaacaatgtgttcagtcaagctgtccagaaccagcccacgcctgcacagccaggagtatacaacaacatgagcatcaccgtttccatggcaggtggaaatacgaatgttcagaacatgaacccaatgatggcccagatgcagatgagctctttgcagatgccaggaatgaacactgtgtgccctgagcagataaatgatcccgcactgagacacacaggcctctactgcaaccagctctcatccactgaccttctcaaaacagaagcagatggaacccagcaggtgcaacaggttcaggtgtttgctgacgtccagtgtacagtgaatctggtaggcggggacccttacctgaaccagcctggtccactgggaactcaaaagcccacgtcaggaccacagaccccccaggcccagcagaagagcctccttcagcagctactgactgaataaccacttttaaaggaatgtgaaatttaaataatagacatacagagatatacaaatatattatatatttttctgagatttttgatatctcaatctgcagccattcttcaggtcgtagcatttggagcaaaaaaaaaaaaaaaaaaaaaaaaaaaggagtttgcttttgtcgggagattgaaagatgtttttgtttctttctttgtaaaggccttggatattgaaaaaataccaaggcagaacagttggacaatctatttcttgagccaaatttaattattcttatttttgtaatcagtcattggcttcttatctggatgaaggcttttggaggagaaccacctgcccaggaagaagggcccgtggggctttgcctgtgcccgtccaccaaaggctgtcatgtgtctcgaaatcagcagccctccccatcccaatcccaggcagcttgtgtgtacaatcagcttctctagcaactctgtatctgttggcttcaagagaatattttgcctccacatatgtaccccttctcctttttttaaagatggatttaaaccaagatgcctccaggaaagaggacgaaatgagtatattcacagaggaatccaaaaaatacagtttgggggaaaatgcaataatttttgatgagatgggtgaaggacaagaagtgagttgtgtcaattattgtagatacaattttctgattaaatctggaaaaataaaaggcagcctgttttttctgcttttattgtattaacagctgaggtagctaaagttatttaaaataaaattaaatttatgatccaagtagcttatttttccctttaaatctcattgtaaatatatttgatttcttgtagaaattgatttccttctgtttaattttatgcttttattatactcttgatttttctaaatttgtgtgtgaaatataacattgattgaattgcagttacatttggttagtaatatttcattattttaataactgtgatgtcatgtatggatttactttggggttcaaatcaaaatgtcactgccagaaagagctgttccagctgatctagagcatactgccctagagtgtccctgggatcatctgaacagaagtgcacaggctacttgtacagagaaaaaattaatactcaaaggaaatcttcattttttagattgactttgggaatttgaattttcatcagtgcaaatataaatttctctatcctgctctgaggctaattggtaccatattttccctttgtgtcttgtgactctgccacatcccatctcatcctggcctctgagtcaagaacccagtgaactgactttctagttctagaagttccgctgcaaggccaggaaagcttgagaaaggtattgtggaagaagcaaaggtagacccccatcactcacctttgtctgcatccctgggcctgtgaatgatgacagcacctgacattctgcaccagctacctctgcctccatggcagagaaaaggccataagaacagtggaagaggagcatggactcagacttcaaggaagaagccatttccccaggtccttccttctgcatctcaccacccctagttacaaataactccattgaacagcatctattcagaaactatgccgaataaaaagattggtggaagggctcatgtggttagcaactatgaaacagaaataggacactcagttacaaacattatctcctttagtttttcagaaaatgcatccctgatttcattcatttccagcttgaaagccagccatattactctagtccctaccaaactgctctagaaggtcatttccattttgtttgtgatatttagacgcgcagacttcaggaagttcacctttaacttcagcattccagatgaagtttcctgactcagtgcttttgcataaggaactagaaaaaaaaagtaaggaaaattggagatgctaacatcctcccccatcccaactgcaccttaaaatatgcatgtcaccttcaaggttttataattgcactgtttgttttatgtatgtacagattaaaattattgctacatttgaggaaaataaaattgcttgcttctatgtaattcctgtcattccacaggaaattcacttttccagctactgaatagaatttgtttaacaacctcatgggttgcctcttcatttacagggaagaaatgaaatgtacatctgcagaaattgccaaagcccaaattaacgagtattataaaaggataataaagcatccctgaagcca

SEQ ID NO: 356151 - DNA, 7347 bp, Homo sapiens
gcggccgcctgcccggcgtggggagcgggcgccccgggccgccgccgagagggggagccggaagtcggcgcgggcgcccctcggccccgacgacgccgtgaccttggccggcccgctcacctctcggaatctcgcctgccgggaccgcgaaatgggggcgaccgcggcgtccctctccgtcggcgcagccctcgacggcgcttgggtttgaccccggcgcgcttgctcgccccttctcccgagaaggggtttcggagatctatccatactaatggaaatgtaactggaactgactctgatgataaaatcaaggaccatcaagcaagatcatgcagtaggcaactttgcttccaaaagaagttaccaacatttagaatttctacttattctgaggttccagttacagctatatcagagaatgagttaatctcctcagaaatcactaaatactactctgaggggcttagaaattaacaggttgtttatataattggccttaaatgaggtgagagtgaagagactagagccatctctggaaaacatcattatcccattccccgggaagctaccctctggaactcaagatttgaccatatctgttttgaggattcattatgaacaaagaagtctccccaggtgtgaagtttttcaacatgagtggcctcggggacagttcatccgaccctgctaacccagactcacataagaggaaaggatcgccatgtgacacactggcatcaagcacggaaaagaggcgcagggagcaagaaaataaatatttagaagaactagctgagttactgtctgccaacattagtgacattgacagcttgagtgtaaaaccagacaaatgcaagattttgaagaaaacagtcgatcagatacagctaatgaagagaatggaacaagagaaatcaacaactgatgacgatgtacagaaatcagacatctcatcaagtagtcaaggagtgatagaaaaggaatccttgggacctcttcttttggaggctttggatggatttttctttgttgtgaactgtgaagggagaattgtatttgtgtcagagaatgtaaccagctacttaggttacaatcaggaggaattaatgaataccagcgtctacagcatactgcacgtgggggatcatgcagaatttgtgaagaatctgctaccaaaatcactagtaaatggagttccttggcctcaagaggcaacacgacgaaatagccatacctttaactgcaggatgctaattcaccctccagatgagccagggaccgagaaccaagaagcttgccagcgttatgaagtaatgcagtgtttcactgtgtcacagccaaaatcaattcaagaggatggagaagatttccagtcatgtctgatttgtattgcacggcgattacctcggcctccagctattacgggtgtagaatcctttatgaccaagcaagatactacaggtaaaatcatctctattgatactagttccctgagagctgctggcagaactggttgggaagatttagtgaggaagtgcatttatgcttttttccaacctcagggcagagaaccatcttatgccagacagctgttccaagaagtgatgactcgtggcactgcctccagcccctcctatagattcatattgaatgatgggacaatgcttagcgcccacaccaagtgtaaactttgctaccctcaaagtccagacatgcaacctttcatcatgggaattcatatcatcgacagggagcacagtgggctttctcctcaagatgacactaattctggaatgtcaattccccgagtaaatccctcggtcaatcctagtatctctccagctcatggtgtggctcgttcatccacattgccaccatccaacagcaacatggtatccaccagaataaaccgccagcagagctcagaccttcatagcagcagtcatagtaattctagcaacagccaaggaagtttcggatgctcacccggaagtcagattgtagccaatgttgccttaaaccaaggacaggccagttcacagagcagtaatccctctttaaacctcaataattctcctatggaaggtacaggaatatccctagcacagttcatgtctccaaggagacaggttacttctggattggcaacaaggcccaggatgccaaacaattcctttcctcctaatatttcgacattaagctctcccgttggcatgacaagtagtgcctgtaataataataaccgatcttattcaaacatcccagtaacatctttacagggtatgaatgaaggacccaataactccgttggcttctctgccagttctccagtcctcaggcagatgagctcacagaattcacctagcagattaaatatacaaccagcaaaagctgagtccaaagataacaaagagattgcctcaattttaaatgaaatgattcaatctgacaacagctctagtgatggcaaacctctggattcagggcttctgcataacaatgacagactttcagatggagacagtaaatactctcaaaccagtcacaaactagtgcagcttttgacaacaactgccgaacagcagttacggcatgctgatatagacacaagctgcaaagatgtcctgtcttgcacaggcacttccaactctgcctctgctaactcttcaggaggttcttgtccctcttctcatagctcattgacagaacggcataaaattctacaccggctcttacaggagggtagcccctcagatatcaccactttgtctgtcgagcctgataaaaaggacagtgcatctacttctgtgtcagtgactggacaggtacaaggaaactccagtataaaactagaactggatgcttcaaagaaaaaagaatcaaaagaccatcagctcctacgctatcttttagataaagatgagaaagatttaagatcaactccaaacctgagcctggatgatgtaaaggtgaaagtggaaaagaaagaacagatggatccatgtaatacaaacccaaccccaatgaccaaacccactcctgaggaaataaaactggaggcccagagccagtttacagctgaccttgaccagtttgatcagttactgcccacgctggagaaggcagcacagttgccaggcttatgtgagacagacaggatggatggtgcggtcaccagtgtaaccatcaaatcggagatcctgccagcttcacttcagtccgccactgccagacccacttccaggctaaatagattacctgagctggaattggaagcaattgataaccaatttggacaaccaggaacaggcgatcagattccatggacaaataatacagtgacagctataaatcagagtaaatcagaagaccagtgtattagctcacaattagatgagcttctctgtccacccacaacagtagaagggagaaatgatgagaaggctcttcttgaacagctggtatccttccttagtggcaaagatgaaactgagctagctgaactagacagagctctgggaattgacaaacttgttcaggggggtggattagatgtattatcagagagatttccaccacaacaagcaacgccacctttgatcatggaagaaagacccaacctttattcccagccttactcttctccttctcctactgccaatctccctagccctttccaaggcatggtcaggcaaaaaccttcactggggacgatgcctgttcaagtaacacctccccgaggtgctttttcacctggcatgggcatgcagcccaggcaaactctaaacagacctccggctgcacctaaccagcttcgacttcaactacagcagcgattacagggacaacagcagttgatacaccaaaatcggcaagctatcttaaaccagtttgcagcaactgctcctgttggcatcaatatgagatcaggcatgcaacagcaaattacacctcagccacccctgaatgctcaaatgttggcacaacgtcagcgggaactgtacagtcaacagcaccgacagaggcagctaatacagcagcaaagagccatgcttatgaggcagcaaagctttgggaacaacctccctccctcatctggactaccagttcaaatggggaacccccgtcttcctcagggtgctccacagcaattcccctatccaccaaactatggtacaaatccaggaaccccacctgcttctaccagcccgttttcacaactagcagcaaatcctgaagcatccttggccaaccgcaacagcatggtgagcagaggcatgacaggaaacataggaggacagtttggcactggaatcaatcctcagatgcagcagaatgtcttccagtatccaggagcaggaatggttccccaaggtgaggccaactttgctccatctctaagccctgggagctccatggtgccgatgccaatccctcctcctcagagttctctgctccagcaaactccacctgcctccgggtatcagtcaccagacatgaaggcctggcagcaaggagcgataggaaacaacaatgtgttcagtcaagctgtccagaaccagcccacgcctgcacagccaggagtatacaacaacatgagcatcaccgtttccatggcaggtggaaatacgaatgttcagaacatgaacccaatgatggcccagatgcagatgagctctttgcagatgccaggaatgaacactgtgtgccctgagcagataaatgatcccgcactgagacacacaggcctctactgcaaccagctctcatccactgaccttctcaaaacagaagcagatggaacccaggacaagaagacagaagagttcttctctgtggtgactacagactagaggaatgctctacaggtgcaacaggttcaggtgtttgctgacgtccagtgtacagtgaatctggtaggcggggacccttacctgaaccagcctggtccactgggaactcaaaagcccacgtcaggaccacagaccccccaggcccagcagaagagcctccttcagcagctactgactgaataaccacttttaaaggaatgtgaaatttaaataatagacatacagagatatacaaatatattatatatttttctgagatttttgatatctcaatctgcagccattcttcaggtcgtagcatttggagcaaaaaaaaaaaaaaaaaaaaaaaaaaaggagtttgcttttgtcgggagattgaaagatgtttttgtttctttctttgtaaaggccttggatattgaaaaaataccaaggcagaacagttggacaatctatttcttgagccaaatttaattattcttatttttgtaatcagtcattggcttcttatctggatgaaggcttttggaggagaaccaaaacgacaagttccaagaagaagatgaagctccgcctccgccgcttagtcccaaccctgcccaggaagaagggcccgtggggctttgcctgtgcccgtccaccaaaggctgtcatgtgtctcgaaatcagcagccctccccatcccaatcccaggcagcttgtgtgtacaatcagcttctctagcaactctgtatctgttggcttcaagagaatattttgcctccacatatgtaccccttctcctttttttaaagatggatttaaaccaagatgcctccaggaaagaggacgaaatgagtatattcacagaggaatccaaaaaatacagtttgggggaaaatgcaataatttttgatgagatgggtgaaggacaagaagtgagttgtgtcaattattgtagatacaattttctgattaaatctggaaaaataaaaggcagcctgttttttctgcttttattgtattaacagctgaggtagctaaagttatttaaaataaaattaaatttatgatccaagtagcttatttttccctttaaatctcattgtaaatatatttgatttcttgtagaaattgatttccttctgtttaattttatgcttttattatactcttgatttttctaaatttgtgtgtgaaatataacattgattgaattgcagttacatttggttagtaatatttcattattttaataactgtgatgtcatgtatggatttactttggggttcaaatcaaaatgtcactgccagaaagagctgttccagctgatctagagcatactgccctagagtgtccctgggatcatctgaacagaagtgcacaggctacttgtacagagaaaaaattaatactcaaaggaaatcttcattttttagattgactttgggaatttgaattttcatcagtgcaaatataaatttctctatcctgctctgaggctaattggtaccatattttccctttgtgtcttgtgactctgccacatcccatctcatcctggcctctgagtcaagaacccagtgaactgactttctagttctagaagttccgctgcaaggccaggaaagcttgagaaaggtattgtggaagaagcaaaggtagacccccatcactcacctttgtctgcatccctgggcctgtgaatgatgacagcacctgacattctgcaccagctacctctgcctccatggcagagaaaaggccataagaacagtggaagaggagcatggactcagacttcaaggaagaagccatttccccaggtccttccttctgcatctcaccacccctagttacaaataactccattgaacagcatctattcagaaactatgccgaataaaaagattggtggaagggctcatgtggttagcaactatgaaacagaaataggacactcagttacaaacattatctcctttagtttttcagaaaatgcatccctgatttcattcatttccagcttgaaagccagccatattactctagtccctaccaaactgctctagaaggtcatttccattttgtttgtgatatttagacgcgcagacttcaggaagttcacctttaacttcagcattccagatgaagtttcctgactcagtgcttttgcataaggaactagaaaaaaaaagtaaggaaaattggagatgctaacatcctcccccatcccaactgcaccttaaaatatgcatgtcaccttcaaggttttataattgcactgtttgttttatgtatgtacagattaaaattattgctacatttgaggaaaataaaattgcttgcttctatgtaattcctgtcattccacaggaaattcacttttccagctactgaatagaatttgtttaacaacctcatgggttgcctcttcatttacagggaagaaatgaaatgtacatctgcagaaattgccaaagcccaaattaacgagtattataaaaggataataaagcatccctgaagcca

SEQ ID NO: 356152 - DNA, 5830 bp, Homo sapiens
tttttctatttcaagaagttattcataatataaagtagttccaaatgtaactgctgtgtttattacttgtttgcttttactatctagtaattgttatttgaaaatattcaagatgtatatatgattggggaaatacatctgttatagcagtcaatttactttatatattttagccagaattgttttctaaattttggtattttgtaatgtccactttttagatgtgaatttatatcactttctaaatctggttttatattttcgataaaaataaagatctcactaaatgtgtaagcatagatacttgatcagagaaggaaatatggtgatacaaatgtacactaactggattttctttgtgtaacagcacggaaaagaggcgcagggagcaagaaaataaatatttagaagaactagctgagttactgtctgccaacattagtgacattgacagcttgagtgtaaaaccagacaaatgcaagattttgaagaaaacagtcgatcagatacagctaatgaagagaatggaacaagagaaatcaacaactgatgacgatgtacagaaatcagacatctcatcaagtagtcaaggagtgatagaaaaggagacaggttacttctggattggcaacaaggcccaggatgccaaacaattcctttcctcctaatatttcgacattaagctctcccgttggcatgacaagtagtgcctgtaataataataaccgatcttattcaaacatcccagtaacatctttacagggtatgaatgaaggacccaataactccgttggcttctctgccagttctccagtcctcaggcagatgagctcacagaattcacctagcagattaaatatacaaccagcaaaagctgagtccaaagataacaaagagattgcctcaattttaaatgaaatgattcaatctgacaacagctctagtgatggcaaacctctggattcagggcttctgcataacaatgacagactttcagatggagacagtaaatactctcaaaccagtcacaaactagtgcagcttttgacaacaactgccgaacagcagttacggcatgctgatatagacacaagctgcaaagatgtcctgtcttgcacaggcacttccaactctgcctctgctaactcttcaggaggttcttgtccctcttctcatagctcattgacagaacggcataaaattctacaccggctcttacaggagggtagcccctcagatatcaccactttgtctgtcgagcctgataaaaaggacagtgcatctacttctgtgtcagtgactggacaggtacaaggaaactccagtataaaactagaactggatgcttcaaagaaaaaagaatcaaaagaccatcagctcctacgctatcttttagataaagatgagaaagatttaagatcaactccaaacctgagcctggatgatgtaaaggtgaaagtggaaaagaaagaacagatggatccatgtaatacaaacccaaccccaatgaccaaacccactcctgaggaaataaaactggaggcccagagccagtttacagctgaccttgaccagtttgatcagttactgcccacgctggagaaggcagcacagttgccaggcttatgtgagacagacaggatggatggtgcggtcaccagtgtaaccatcaaatcggagatcctgccagcttcacttcagtccgccactgccagacccacttccaggctaaatagattacctgagctggaattggaagcaattgataaccaatttggacaaccaggaacaggcgatcagattccatggacaaataatacagtgacagctataaatcagagtaaatcagaagaccagtgtattagctcacaattagatgagcttctctgtccacccacaacagtagaagggagaaatgatgagaaggctcttcttgaacagctggtatccttccttagtggcaaagatgaaactgagctagctgaactagacagagctctgggaattgacaaacttgttcaggggggtggattagatgtattatcagagagatttccaccacaacaagcaacgccacctttgatcatggaagaaagacccaacctttattcccagccttactcttctccttctcctactgccaatctccctagccctttccaaggcatggtcaggcaaaaaccttcactggggacgatgcctgttcaagtaacacctccccgaggtgctttttcacctggcatgggcatgcagcccaggcaaactctaaacagacctccggctgcacctaaccagcttcgacttcaactacagcagcgattacagggacaacagcagttgatacaccaaaatcggcaagctatcttaaaccagtttgcagcaactgctcctgttggcatcaatatgagatcaggcatgcaacagcaaattacacctcagccacccctgaatgctcaaatgttggcacaacgtcagcgggaactgtacagtcaacagcaccgacagaggcagctaatacagcagcaaagagccatgcttatgaggcagcaaagctttgggaacaacctccctccctcatctggactaccagttcaaatggggaacccccgtcttcctcagggtgctccacagcaattcccctatccaccaaactatggtacaaatccaggaaccccacctgcttctaccagcccgttttcacaactagcagcaaatcctgaagcatccttggccaaccgcaacagcatggtgagcagaggcatgacaggaaacataggaggacagtttggcactggaatcaatcctcagatgcagcagaatgtcttccagtatccaggagcaggaatggttccccaaggtgaggccaactttgctccatctctaagccctgggagctccatggtgccgatgccaatccctcctcctcagagttctctgctccagcaaactccacctgcctccgggtatcagtcaccagacatgaaggcctggcagcaaggagcgataggaaacaacaatgtgttcagtcaagctgtccagaaccagcccacgcctgcacagccaggagtatacaacaacatgagcatcaccgtttccatggcaggtggaaatacgaatgttcagaacatgaacccaatgatggcccagatgcagatgagctctttgcagatgccaggaatgaacactgtgtgccctgagcagataaatgatcccgcactgagacacacaggcctctactgcaaccagctctcatccactgaccttctcaaaacagaagcagatggaacccaggacaagaagacagaagagttcttctctgtggtgactacagactagaggaatgctctacaggtgcaacaggttcaggtgtttgctgacgtccagtgtacagtgaatctggtaggcggggacccttacctgaaccagcctggtccactgggaactcaaaagcccacgtcaggaccacagaccccccaggcccagcagaagagcctccttcagcagctactgactgaataaccacttttaaaggaatgtgaaatttaaataatagacatacagagatatacaaatatattatatatttttctgagatttttgatatctcaatctgcagccattcttcaggtcgtagcatttggagcaaaaaaaaaaaaaaaaaaaaaaaaaaaggagtttgcttttgtcgggagattgaaagatgtttttgtttctttctttgtaaaggccttggatattgaaaaaataccaaggcagaacagttggacaatctatttcttgagccaaatttaattattcttatttttgtaatcagtcattggcttcttatctggatgaaggcttttggaggagaaccaaaacgacaagttccaagaagaagatgaagctccgcctccgccgcttagtcccaaccctgcccaggaagaagggcccgtggggctttgcctgtgcccgtccaccaaaggctgtcatgtgtctcgaaatcagcagccctccccatcccaatcccaggcagcttgtgtgtacaatcagcttctctagcaactctgtatctgttggcttcaagagaatattttgcctccacatatgtaccccttctcctttttttaaagatggatttaaaccaagatgcctccaggaaagaggacgaaatgagtatattcacagaggaatccaaaaaatacagtttgggggaaaatgcaataatttttgatgagatgggtgaaggacaagaagtgagttgtgtcaattattgtagatacaattttctgattaaatctggaaaaataaaaggcagcctgttttttctgcttttattgtattaacagctgaggtagctaaagttatttaaaataaaattaaatttatgatccaagtagcttatttttccctttaaatctcattgtaaatatatttgatttcttgtagaaattgatttccttctgtttaattttatgcttttattatactcttgatttttctaaatttgtgtgtgaaatataacattgattgaattgcagttacatttggttagtaatatttcattattttaataactgtgatgtcatgtatggatttactttggggttcaaatcaaaatgtcactgccagaaagagctgttccagctgatctagagcatactgccctagagtgtccctgggatcatctgaacagaagtgcacaggctacttgtacagagaaaaaattaatactcaaaggaaatcttcattttttagattgactttgggaatttgaattttcatcagtgcaaatataaatttctctatcctgctctgaggctaattggtaccatattttccctttgtgtcttgtgactctgccacatcccatctcatcctggcctctgagtcaagaacccagtgaactgactttctagttctagaagttccgctgcaaggccaggaaagcttgagaaaggtattgtggaagaagcaaaggtagacccccatcactcacctttgtctgcatccctgggcctgtgaatgatgacagcacctgacattctgcaccagctacctctgcctccatggcagagaaaaggccataagaacagtggaagaggagcatggactcagacttcaaggaagaagccatttccccaggtccttccttctgcatctcaccacccctagttacaaataactccattgaacagcatctattcagaaactatgccgaataaaaagattggtggaagggctcatgtggttagcaactatgaaacagaaataggacactcagttacaaacattatctcctttagtttttcagaaaatgcatccctgatttcattcatttccagcttgaaagccagccatattactctagtccctaccaaactgctctagaaggtcatttccattttgtttgtgatatttagacgcgcagacttcaggaagttcacctttaacttcagcattccagatgaagtttcctgactcagtgcttttgcataaggaactagaaaaaaaaagtaaggaaaattggagatgctaacatcctcccccatcccaactgcaccttaaaatatgcatgtcaccttcaaggttttataattgcactgtttgttttatgtatgtacagattaaaattattgctacatttgaggaaaataaaattgcttgcttctatgtaattcctgtcattccacaggaaattcacttttccagctactgaatagaatttgtttaacaacctcatgggttgcctcttcatttacagggaagaaatgaaatgtacatctgcagaaattgccaaagcccaaattaacgagtattataaaaggataataaagcatccctgaagcca

SEQ ID NO: 356153 - DNA, 4329 bp, Homo sapiens
taagccaagcttgaatctactcaagggaaataaaactggaggcccagagccagtttacagctgaccttgaccagtttgatcagttactgcccacgctggagaaggcagcacagttgccaggcttatgtgagacagacaggatggatggtgcggtcaccagtgtaaccatcaaatcggagatcctgccagcttcacttcagtccgccactgccagacccacttccaggctaaatagattacctgagctggaattggaagcaattgataaccaatttggacaaccaggaacaggcgatcagattccatggacaaataatacagtgacagctataaatcagagtaaatcagaagaccagtgtattagctcacaattagatgagcttctctgtccacccacaacagtagaagggagaaatgatgagaaggctcttcttgaacagctggtatccttccttagtggcaaagatgaaactgagctagctgaactagacagagctctgggaattgacaaacttgttcaggggggtggattagatgtattatcagagagatttccaccacaacaagcaacgccacctttgatcatggaagaaagacccaacctttattcccagccttactcttctccttctcctactgccaatctccctagccctttccaaggcatggtcaggcaaaaaccttcactggggacgatgcctgttcaagtaacacctccccgaggtgctttttcacctggcatgggcatgcagcccaggcaaactctaaacagacctccggctgcacctaaccagcttcgacttcaactacagcagcgattacagggacaacagcagttgatacaccaaaatcggcaagctatcttaaaccagtttgcagcaactgctcctgttggcatcaatatgagatcaggcatgcaacagcaaattacacctcagccacccctgaatgctcaaatgttggcacaacgtcagcgggaactgtacagtcaacagcaccgacagaggcagctaatacagcagcaaagagccatgcttatgaggcagcaaagctttgggaacaacctccctccctcatctggactaccagttcaaatggggaacccccgtcttcctcagggtgctccacagcaattcccctatccaccaaactatggtacaaatccaggaaccccacctgcttctaccagcccgttttcacaactagcagcaaatcctgaagcatccttggccaaccgcaacagcatggtgagcagaggcatgacaggaaacataggaggacagtttggcactggaatcaatcctcagatgcagcagaatgtcttccagtatccaggagcaggaatggttccccaaggtgaggccaactttgctccatctctaagccctgggagctccatggtgccgatgccaatccctcctcctcagagttctctgctccagcaaactccacctgcctccgggtatcagtcaccagacatgaaggcctggcagcaaggagcgataggaaacaacaatgtgttcagtcaagctgtccagaaccagcccacgcctgcacagccaggagtatacaacaacatgagcatcaccgtttccatggcaggtggaaatacgaatgttcagaacatgaacccaatgatggcccagatgcagatgagctctttgcagatgccaggaatgaacactgtgtgccctgagcagataaatgatcccgcactgagacacacaggcctctactgcaaccagctctcatccactgaccttctcaaaacagaagcagatggaacccaggacaagaagacagaagagttcttctctgtggtgactacagactagaggaatgctctacaggtgcaacaggttcaggtgtttgctgacgtccagtgtacagtgaatctggtaggcggggacccttacctgaaccagcctggtccactgggaactcaaaagcccacgtcaggaccacagaccccccaggcccagcagaagagcctccttcagcagctactgactgaataaccacttttaaaggaatgtgaaatttaaataatagacatacagagatatacaaatatattatatatttttctgagatttttgatatctcaatctgcagccattcttcaggtcgtagcatttggagcaaaaaaaaaaaaaaaaaaaaaaaaaaaggagtttgcttttgtcgggagattgaaagatgtttttgtttctttctttgtaaaggccttggatattgaaaaaataccaaggcagaacagttggacaatctatttcttgagccaaatttaattattcttatttttgtaatcagtcattggcttcttatctggatgaaggcttttggaggagaaccaaaacgacaagttccaagaagaagatgaagctccgcctccgccgcttagtcccaaccctgcccaggaagaagggcccgtggggctttgcctgtgcccgtccaccaaaggctgtcatgtgtctcgaaatcagcagccctccccatcccaatcccaggcagcttgtgtgtacaatcagcttctctagcaactctgtatctgttggcttcaagagaatattttgcctccacatatgtaccccttctcctttttttaaagatggatttaaaccaagatgcctccaggaaagaggacgaaatgagtatattcacagaggaatccaaaaaatacagtttgggggaaaatgcaataatttttgatgagatgggtgaaggacaagaagtgagttgtgtcaattattgtagatacaattttctgattaaatctggaaaaataaaaggcagcctgttttttctgcttttattgtattaacagctgaggtagctaaagttatttaaaataaaattaaatttatgatccaagtagcttatttttccctttaaatctcattgtaaatatatttgatttcttgtagaaattgatttccttctgtttaattttatgcttttattatactcttgatttttctaaatttgtgtgtgaaatataacattgattgaattgcagttacatttggttagtaatatttcattattttaataactgtgatgtcatgtatggatttactttggggttcaaatcaaaatgtcactgccagaaagagctgttccagctgatctagagcatactgccctagagtgtccctgggatcatctgaacagaagtgcacaggctacttgtacagagaaaaaattaatactcaaaggaaatcttcattttttagattgactttgggaatttgaattttcatcagtgcaaatataaatttctctatcctgctctgaggctaattggtaccatattttccctttgtgtcttgtgactctgccacatcccatctcatcctggcctctgagtcaagaacccagtgaactgactttctagttctagaagttccgctgcaaggccaggaaagcttgagaaaggtattgtggaagaagcaaaggtagacccccatcactcacctttgtctgcatccctgggcctgtgaatgatgacagcacctgacattctgcaccagctacctctgcctccatggcagagaaaaggccataagaacagtggaagaggagcatggactcagacttcaaggaagaagccatttccccaggtccttccttctgcatctcaccacccctagttacaaataactccattgaacagcatctattcagaaactatgccgaataaaaagattggtggaagggctcatgtggttagcaactatgaaacagaaataggacactcagttacaaacattatctcctttagtttttcagaaaatgcatccctgatttcattcatttccagcttgaaagccagccatattactctagtccctaccaaactgctctagaaggtcatttccattttgtttgtgatatttagacgcgcagacttcaggaagttcacctttaacttcagcattccagatgaagtttcctgactcagtgcttttgcataaggaactagaaaaaaaaagtaaggaaaattggagatgctaacatcctcccccatcccaactgcaccttaaaatatgcatgtcaccttcaaggttttataattgcactgtttgttttatgtatgtacagattaaaattattgctacatttgaggaaaataaaattgcttgcttctatgtaattcctgtcattccacaggaaattcacttttccagctactgaatagaatttgtttaacaacctcatgggttgcctcttcatttacagggaagaaatgaaatgtacatctgcagaaattgccaaagcccaaattaacgagtattataaaaggataataaagcatccctgaagcca

SEQ ID NO: 356154 - DNA, 6882 bp, Homo sapiens
tttttctatttcaagaagttattcataatataaagtagttccaaatgtaactgctgtgtttattacttgtttgcttttactatctagtaattgttatttgaaaatattcaagatgtatatatgattggggaaatacatctgttatagcagtcaatttactttatatattttagccagaattgttttctaaattttggtattttgtaatgtccactttttagatgtgaatttatatcactttctaaatctggttttatattttcgataaaaataaagatctcactaaatgtgtaagcatagatacttgatcagagaaggaaatatggtgatacaaatgtacactaactggattttctttgtgtaacagcacggaaaagaggcgcagggagcaagaaaataaatatttagaagaactagctgagttactgtctgccaacattagtgacattgacagcttgagtgtaaaaccagacaaatgcaagattttgaagaaaacagtcgatcagatacagctaatgaagagaatggaacaagagaaatcaacaactgatgacgatgtacagaaatcagacatctcatcaagtagtcaaggagtgatagaaaaggaatccttgggacctcttcttttggaggctttggatggatttttctttgttgtgaactgtgaagggagaattgtatttgtgtcagagaatgtaaccagctacttaggttacaatcaggaggaattaatgaataccagcgtctacagcatactgcacgtgggggatcatgcagaatttgtgaagaatctgctaccaaaatcactagtaaatggagttccttggcctcaagaggcaacacgacgaaatagccatacctttaactgcaggatgctaattcaccctccagatgagccagggaccgagaaccaagaagcttgccagcgttatgaagtaatgcagtgtttcactgtgtcacagccaaaatcaattcaagaggatggagaagatttccagtcatgtctgatttgtattgcacggcgattacctcggcctccagctattacgggtgtagaatcctttatgaccaagcaagatactacaggtaaaatcatctctattgatactagttccctgagagctgctggcagaactggttgggaagatttagtgaggaagtgcatttatgcttttttccaacctcagggcagagaaccatcttatgccagacagctgttccaagaagtgatgactcgtggcactgcctccagcccctcctatagattcatattgaatgatgggacaatgcttagcgcccacaccaagtgtaaactttgctaccctcaaagtccagacatgcaacctttcatcatgggaattcatatcatcgacagggagcacagtgggctttctcctcaagatgacactaattctggaatgtcaattccccgagtaaatccctcggtcaatcctagtatctctccagctcatggtgtggctcgttcatccacattgccaccatccaacagcaacatggtatccaccagaataaaccgccagcagagctcagaccttcatagcagcagtcatagtaattctagcaacagccaaggaagtttcggatgctcacccggaagtcagattgtagccaatgttgccttaaaccaaggacaggccagttcacagagcagtaatccctctttaaacctcaataattctcctatggaaggtacaggaatatccctagcacagttcatgtctccaaggagacaggttacttctggattggcaacaaggcccaggatgccaaacaattcctttcctcctaatatttcgacattaagctctcccgttggcatgacaagtagtgcctgtaataataataaccgatcttattcaaacatcccagtaacatctttacagggtatgaatgaaggacccaataactccgttggcttctctgccagttctccagtcctcaggcagatgagctcacagaattcacctagcagattaaatatacaaccagcaaaagctgagtccaaagataacaaagagattgcctcaattttaaatgaaatgattcaatctgacaacagctctagtgatggcaaacctctggattcagggcttctgcataacaatgacagactttcagatggagacagtaaatactctcaaaccagtcacaaactagtgcagcttttgacaacaactgccgaacagcagttacggcatgctgatatagacacaagctgcaaagatgtcctgtcttgcacaggcacttccaactctgcctctgctaactcttcaggaggttcttgtccctcttctcatagctcattgacagaacggcataaaattctacaccggctcttacaggagggtagcccctcagatatcaccactttgtctgtcgagcctgataaaaaggacagtgcatctacttctgtgtcagtgactggacaggtacaaggaaactccagtataaaactagaactggatgcttcaaagaaaaaagaatcaaaagaccatcagctcctacgctatcttttagataaagatgagaaagatttaagatcaactccaaacctgagcctggatgatgtaaaggtgaaagtggaaaagaaagaacagatggatccatgtaatacaaacccaaccccaatgaccaaacccactcctgaggaaataaaactggaggcccagagccagtttacagctgaccttgaccagtttgatcagttactgcccacgctggagaaggcagcacagttgccaggcttatgtgagacagacaggatggatggtgcggtcaccagtgtaaccatcaaatcggagatcctgccagcttcacttcagtccgccactgccagacccacttccaggctaaatagattacctgagctggaattggaagcaattgataaccaatttggacaaccaggaacaggcgatcagattccatggacaaataatacagtgacagctataaatcagagtaaatcagaagaccagtgtattagctcacaattagatgagcttctctgtccacccacaacagtagaagggagaaatgatgagaaggctcttcttgaacagctggtatccttccttagtggcaaagatgaaactgagctagctgaactagacagagctctgggaattgacaaacttgttcaggggggtggattagatgtattatcagagagatttccaccacaacaagcaacgccacctttgatcatggaagaaagacccaacctttattcccagccttactcttctccttctcctactgccaatctccctagccctttccaaggcatggtcaggcaaaaaccttcactggggacgatgcctgttcaagtaacacctccccgaggtgctttttcacctggcatgggcatgcagcccaggcaaactctaaacagacctccggctgcacctaaccagcttcgacttcaactacagcagcgattacagggacaacagcagttgatacaccaaaatcggcaagctatcttaaaccagtttgcagcaactgctcctgttggcatcaatatgagatcaggcatgcaacagcaaattacacctcagccacccctgaatgctcaaatgttggcacaacgtcagcgggaactgtacagtcaacagcaccgacagaggcagctaatacagcagcaaagagccatgcttatgaggcagcaaagctttgggaacaacctccctccctcatctggactaccagttcaaatggggaacccccgtcttcctcagggtgctccacagcaattcccctatccaccaaactatggtacaaatccaggaaccccacctgcttctaccagcccgttttcacaactagcagcaaatcctgaagcatccttggccaaccgcaacagcatggtgagcagaggcatgacaggaaacataggaggacagtttggcactggaatcaatcctcagatgcagcagaatgtcttccagtatccaggagcaggaatggttccccaaggtgaggccaactttgctccatctctaagccctgggagctccatggtgccgatgccaatccctcctcctcagagttctctgctccagcaaactccacctgcctccgggtatcagtcaccagacatgaaggcctggcagcaaggagcgataggaaacaacaatgtgttcagtcaagctgtccagaaccagcccacgcctgcacagccaggagtatacaacaacatgagcatcaccgtttccatggcaggtggaaatacgaatgttcagaacatgaacccaatgatggcccagatgcagatgagctctttgcagatgccaggaatgaacactgtgtgccctgagcaggacaagaagacagaagagttcttctctgtggtgactacagactagaggaatgctctacaggtgcaacaggttcaggtgtttgctgacgtccagtgtacagtgaatctggtaggcggggacccttacctgaaccagcctggtccactgggaactcaaaagcccacgtcaggaccacagaccccccaggcccagcagaagagcctccttcagcagctactgactgaataaccacttttaaaggaatgtgaaatttaaataatagacatacagagatatacaaatatattatatatttttctgagatttttgatatctcaatctgcagccattcttcaggtcgtagcatttggagcaaaaaaaaaaaaaaaaaaaaaaaaaaaggagtttgcttttgtcgggagattgaaagatgtttttgtttctttctttgtaaaggccttggatattgaaaaaataccaaggcagaacagttggacaatctatttcttgagccaaatttaattattcttatttttgtaatcagtcattggcttcttatctggatgaaggcttttggaggagaaccaaaacgacaagttccaagaagaagatgaagctccgcctccgccgcttagtcccaaccctgcccaggaagaagggcccgtggggctttgcctgtgcccgtccaccaaaggctgtcatgtgtctcgaaatcagcagccctccccatcccaatcccaggcagcttgtgtgtacaatcagcttctctagcaactctgtatctgttggcttcaagagaatattttgcctccacatatgtaccccttctcctttttttaaagatggatttaaaccaagatgcctccaggaaagaggacgaaatgagtatattcacagaggaatccaaaaaatacagtttgggggaaaatgcaataatttttgatgagatgggtgaaggacaagaagtgagttgtgtcaattattgtagatacaattttctgattaaatctggaaaaataaaaggcagcctgttttttctgcttttattgtattaacagctgaggtagctaaagttatttaaaataaaattaaatttatgatccaagtagcttatttttccctttaaatctcattgtaaatatatttgatttcttgtagaaattgatttccttctgtttaattttatgcttttattatactcttgatttttctaaatttgtgtgtgaaatataacattgattgaattgcagttacatttggttagtaatatttcattattttaataactgtgatgtcatgtatggatttactttggggttcaaatcaaaatgtcactgccagaaagagctgttccagctgatctagagcatactgccctagagtgtccctgggatcatctgaacagaagtgcacaggctacttgtacagagaaaaaattaatactcaaaggaaatcttcattttttagattgactttgggaatttgaattttcatcagtgcaaatataaatttctctatcctgctctgaggctaattggtaccatattttccctttgtgtcttgtgactctgccacatcccatctcatcctggcctctgagtcaagaacccagtgaactgactttctagttctagaagttccgctgcaaggccaggaaagcttgagaaaggtattgtggaagaagcaaaggtagacccccatcactcacctttgtctgcatccctgggcctgtgaatgatgacagcacctgacattctgcaccagctacctctgcctccatggcagagaaaaggccataagaacagtggaagaggagcatggactcagacttcaaggaagaagccatttccccaggtccttccttctgcatctcaccacccctagttacaaataactccattgaacagcatctattcagaaactatgccgaataaaaagattggtggaagggctcatgtggttagcaactatgaaacagaaataggacactcagttacaaacattatctcctttagtttttcagaaaatgcatccctgatttcattcatttccagcttgaaagccagccatattactctagtccctaccaaactgctctagaaggtcatttccattttgtttgtgatatttagacgcgcagacttcaggaagttcacctttaacttcagcattccagatgaagtttcctgactcagtgcttttgcataaggaactagaaaaaaaaagtaaggaaaattggagatgctaacatcctcccccatcccaactgcaccttaaaatatgcatgtcaccttcaaggttttataattgcactgtttgttttatgtatgtacagattaaaattattgctacatttgaggaaaataaaattgcttgcttctatgtaattcctgtcattccacaggaaattcacttttccagctactgaatagaatttgtttaacaacctcatgggttgcctcttcatttacagggaagaaatgaaatgtacatctgcagaaattgccaaagcccaaattaacgagtattataaaaggataataaagcatccctgaagcca

SEQ ID NO: 356155 - DNA, 6825 bp, Homo sapiens
tttttctatttcaagaagttattcataatataaagtagttccaaatgtaactgctgtgtttattacttgtttgcttttactatctagtaattgttatttgaaaatattcaagatgtatatatgattggggaaatacatctgttatagcagtcaatttactttatatattttagccagaattgttttctaaattttggtattttgtaatgtccactttttagatgtgaatttatatcactttctaaatctggttttatattttcgataaaaataaagatctcactaaatgtgtaagcatagatacttgatcagagaaggaaatatggtgatacaaatgtacactaactggattttctttgtgtaacagcacggaaaagaggcgcagggagcaagaaaataaatatttagaagaactagctgagttactgtctgccaacattagtgacattgacagcttgagtgtaaaaccagacaaatgcaagattttgaagaaaacagtcgatcagatacagctaatgaagagaatggaacaagagaaatcaacaactgatgacgatgtacagaaatcagacatctcatcaagtagtcaaggagtgatagaaaaggaatccttgggacctcttcttttggaggctttggatggatttttctttgttgtgaactgtgaagggagaattgtatttgtgtcagagaatgtaaccagctacttaggttacaatcaggaggaattaatgaataccagcgtctacagcatactgcacgtgggggatcatgcagaatttgtgaagaatctgctaccaaaatcactagtaaatggagttccttggcctcaagaggcaacacgacgaaatagccatacctttaactgcaggatgctaattcaccctccagatgagccagggaccgagaaccaagaagcttgccagcgttatgaagtaatgcagtgtttcactgtgtcacagccaaaatcaattcaagaggatggagaagatttccagtcatgtctgatttgtattgcacggcgattacctcggcctccagctattacgggtgtagaatcctttatgaccaagcaagatactacaggtaaaatcatctctattgatactagttccctgagagctgctggcagaactggttgggaagatttagtgaggaagtgcatttatgcttttttccaacctcagggcagagaaccatcttatgccagacagctgttccaagaagtgatgactcgtggcactgcctccagcccctcctatagattcatattgaatgatgggacaatgcttagcgcccacaccaagtgtaaactttgctaccctcaaagtccagacatgcaacctttcatcatgggaattcatatcatcgacagggagcacagtgggctttctcctcaagatgacactaattctggaatgtcaattccccgagtaaatccctcggtcaatcctagtatctctccagctcatggtgtggctcgttcatccacattgccaccatccaacagcaacatggtatccaccagaataaaccgccagcagagctcagaccttcatagcagcagtcatagtaattctagcaacagccaaggaagtttcggatgctcacccggaagtcagattgtagccaatgttgccttaaaccaaggacaggccagttcacagagcagtaatccctctttaaacctcaataattctcctatggaaggtacaggaatatccctagcacagttcatgtctccaaggagacaggttacttctggattggcaacaaggcccaggatgccaaacaattcctttcctcctaatatttcgacattaagctctcccgttggcatgacaagtagtgcctgtaataataataaccgatcttattcaaacatcccagtaacatctttacagggtatgaatgaaggacccaataactccgttggcttctctgccagttctccagtcctcaggcagatgagctcacagaattcacctagcagattaaatatacaaccagcaaaagctgagtccaaagataacaaagagattgcctcaattttaaatgaaatgattcaatctgacaacagctctagtgatggcaaacctctggattcagggcttctgcataacaatgacagactttcagatggagacagtaaatactctcaaaccagtcacaaactagtgcagcttttgacaacaactgccgaacagcagttacggcatgctgatatagacacaagctgcaaagatgtcctgtcttgcacaggcacttccaactctgcctctgctaactcttcaggaggttcttgtccctcttctcatagctcattgacagaacggcataaaattctacaccggctcttacaggagggtagcccctcagatatcaccactttgtctgtcgagcctgataaaaaggacagtgcatctacttctgtgtcagtgactggacaggtacaaggaaactccagtataaaactagaactggatgcttcaaagaaaaaagaatcaaaagaccatcagctcctacgctatcttttagataaagatgagaaagatttaagatcaactccaaacctgagcctggatgatgtaaaggtgaaagtggaaaagaaagaacagatggatccatgtaatacaaacccaaccccaatgaccaaacccactcctgaggaaataaaactggaggcccagagccagtttacagctgaccttgaccagtttgatcagttactgcccacgctggagaaggcagcacagttgccaggcttatgtgagacagacaggatggatggtgcggtcaccagtgtaaccatcaaatcggagatcctgccagcttcacttcagtccgccactgccagacccacttccaggctaaatagattacctgagctggaattggaagcaattgataaccaatttggacaaccaggaacaggcgatcagattccatggacaaataatacagtgacagctataaatcagagtaaatcagaagaccagtgtattagctcacaattagatgagcttctctgtccacccacaacagtagaagggagaaatgatgagaaggctcttcttgaacagctggtatccttccttagtggcaaagatgaaactgagctagctgaactagacagagctctgggaattgacaaacttgttcaggggggtggattagatgtattatcagagagatttccaccacaacaagcaacgccacctttgatcatggaagaaagacccaacctttattcccagccttactcttctccttctcctactgccaatctccctagccctttccaaggcatggtcaggcaaaaaccttcactggggacgatgcctgttcaagtaacacctccccgaggtgctttttcacctggcatgggcatgcagcccaggcaaactctaaacagacctccggctgcacctaaccagcttcgacttcaactacagcagcgattacagggacaacagcagttgatacaccaaaatcggcaagctatcttaaaccagtttgcagcaactgctcctgttggcatcaatatgagatcaggcatgcaacagcaaattacacctcagccacccctgaatgctcaaatgttggcacaacgtcagcgggaactgtacagtcaacagcaccgacagaggcagctaatacagcagcaaagagccatgcttatgaggcagcaaagctttgggaacaacctccctccctcatctggactaccagttcaaatggggaacccccgtcttcctcagggtgctccacagcaattcccctatccaccaaactatggtacaaatccaggaaccccacctgcttctaccagcccgttttcacaactagcagcaaatcctgaagcatccttggccaaccgcaacagcatggtgagcagaggcatgacaggaaacataggaggacagtttggcactggaatcaatcctcagatgcagcagaatgtcttccagtatccaggagcaggaatggttccccaaggtgaggccaactttgctccatctctaagccctgggagctccatggtgccgatgccaatccctcctcctcagagttctctgctccagcaaactccacctgcctccgggtatcagtcaccagacatgaaggcctggcagcaaggagcgataggaaacaacaatgtgttcagtcaagctgtccagaaccagcccacgcctgcacagccaggagtatacaacaacatgagcatcaccgtttccatggcaggtggaaatacgaatgttcagaacatgaacccaatgatggcccagatgcagatgagctctttgcagatgccaggaatgaacactgtgtgccctgagcagcaggtgcaacaggttcaggtgtttgctgacgtccagtgtacagtgaatctggtaggcggggacccttacctgaaccagcctggtccactgggaactcaaaagcccacgtcaggaccacagaccccccaggcccagcagaagagcctccttcagcagctactgactgaataaccacttttaaaggaatgtgaaatttaaataatagacatacagagatatacaaatatattatatatttttctgagatttttgatatctcaatctgcagccattcttcaggtcgtagcatttggagcaaaaaaaaaaaaaaaaaaaaaaaaaaaggagtttgcttttgtcgggagattgaaagatgtttttgtttctttctttgtaaaggccttggatattgaaaaaataccaaggcagaacagttggacaatctatttcttgagccaaatttaattattcttatttttgtaatcagtcattggcttcttatctggatgaaggcttttggaggagaaccaaaacgacaagttccaagaagaagatgaagctccgcctccgccgcttagtcccaaccctgcccaggaagaagggcccgtggggctttgcctgtgcccgtccaccaaaggctgtcatgtgtctcgaaatcagcagccctccccatcccaatcccaggcagcttgtgtgtacaatcagcttctctagcaactctgtatctgttggcttcaagagaatattttgcctccacatatgtaccccttctcctttttttaaagatggatttaaaccaagatgcctccaggaaagaggacgaaatgagtatattcacagaggaatccaaaaaatacagtttgggggaaaatgcaataatttttgatgagatgggtgaaggacaagaagtgagttgtgtcaattattgtagatacaattttctgattaaatctggaaaaataaaaggcagcctgttttttctgcttttattgtattaacagctgaggtagctaaagttatttaaaataaaattaaatttatgatccaagtagcttatttttccctttaaatctcattgtaaatatatttgatttcttgtagaaattgatttccttctgtttaattttatgcttttattatactcttgatttttctaaatttgtgtgtgaaatataacattgattgaattgcagttacatttggttagtaatatttcattattttaataactgtgatgtcatgtatggatttactttggggttcaaatcaaaatgtcactgccagaaagagctgttccagctgatctagagcatactgccctagagtgtccctgggatcatctgaacagaagtgcacaggctacttgtacagagaaaaaattaatactcaaaggaaatcttcattttttagattgactttgggaatttgaattttcatcagtgcaaatataaatttctctatcctgctctgaggctaattggtaccatattttccctttgtgtcttgtgactctgccacatcccatctcatcctggcctctgagtcaagaacccagtgaactgactttctagttctagaagttccgctgcaaggccaggaaagcttgagaaaggtattgtggaagaagcaaaggtagacccccatcactcacctttgtctgcatccctgggcctgtgaatgatgacagcacctgacattctgcaccagctacctctgcctccatggcagagaaaaggccataagaacagtggaagaggagcatggactcagacttcaaggaagaagccatttccccaggtccttccttctgcatctcaccacccctagttacaaataactccattgaacagcatctattcagaaactatgccgaataaaaagattggtggaagggctcatgtggttagcaactatgaaacagaaataggacactcagttacaaacattatctcctttagtttttcagaaaatgcatccctgatttcattcatttccagcttgaaagccagccatattactctagtccctaccaaactgctctagaaggtcatttccattttgtttgtgatatttagacgcgcagacttcaggaagttcacctttaacttcagcattccagatgaagtttcctgactcagtgcttttgcataaggaactagaaaaaaaaagtaaggaaaattggagatgctaacatcctcccccatcccaactgcaccttaaaatatgcatgtcaccttcaaggttttataattgcactgtttgttttatgtatgtacagattaaaattattgctacatttgaggaaaataaaattgcttgcttctatgtaattcctgtcattccacaggaaattcacttttccagctactgaatagaatttgtttaacaacctcatgggttgcctcttcatttacagggaagaaatgaaatgtacatctgcagaaattgccaaagcccaaattaacgagtattataaaaggataataaagcatccctgaagcca

SEQ ID NO: 356156 - DNA, 3893 bp, Homo sapiens
aacatggcggccgcggagagcggctgaaatgcctgttcttcaggccgggcgagcgggagtctgacgcgatttgctgagctctgtcgggggtggattagatgtattatcagagagatttccaccacaacaagcaacgccacctttgatcatggaagaaagacccaacctttattcccagccttactcttctccttctcctactgccaatctccctagccctttccaaggcatggtcaggcaaaaaccttcactggggacgatgcctgttcaagtaacacctccccgaggtgctttttcacctggcatgggcatgcagcccaggcaaactctaaacagacctccggctgcacctaaccagcttcgacttcaactacagcagcgattacagggacaacagcagttgatacaccaaaatcggcaagctatcttaaaccagtttgcagcaactgctcctgttggcatcaatatgagatcaggcatgcaacagcaaattacacctcagccacccctgaatgctcaaatgttggcacaacgtcagcgggaactgtacagtcaacagcaccgacagaggcagctaatacagcagcaaagagccatgcttatgaggcagcaaagctttgggaacaacctccctccctcatctggactaccagttcaaatggggaacccccgtcttcctcagggtgctccacagcaattcccctatccaccaaactatggtacaaatccaggaaccccacctgcttctaccagcccgttttcacaactagcagcaaatcctgaagcatccttggccaaccgcaacagcatggtgagcagaggcatgacaggaaacataggaggacagtttggcactggaatcaatcctcagatgcagcagaatgtcttccagtatccaggagcaggaatggttccccaaggtgaggccaactttgctccatctctaagccctgggagctccatggtgccgatgccaatccctcctcctcagagttctctgctccagcaaactccacctgcctccgggtatcagtcaccagacatgaaggcctggcagcaaggagcgataggaaacaacaatgtgttcagtcaagctgtccagaaccagcccacgcctgcacagccaggagtatacaacaacatgagcatcaccgtttccatggcaggtggaaatacgaatgttcagaacatgaacccaatgatggcccagatgcagatgagctctttgcagatgccaggaatgaacactgtgtgccctgagcagataaatgatcccgcactgagacacacaggcctctactgcaaccagctctcatccactgaccttctcaaaacagaagcagatggaacccaggacaagaagacagaagagttcttctctgtggtgactacagactagaggaatgctctacaggtgcaacaggttcaggtgtttgctgacgtccagtgtacagtgaatctggtaggcggggacccttacctgaaccagcctggtccactgggaactcaaaagcccacgtcaggaccacagaccccccaggcccagcagaagagcctccttcagcagctactgactgaataaccacttttaaaggaatgtgaaatttaaataatagacatacagagatatacaaatatattatatatttttctgagatttttgatatctcaatctgcagccattcttcaggtcgtagcatttggagcaaaaaaaaaaaaaaaaaaaaaaaaaaaggagtttgcttttgtcgggagattgaaagatgtttttgtttctttctttgtaaaggccttggatattgaaaaaataccaaggcagaacagttggacaatctatttcttgagccaaatttaattattcttatttttgtaatcagtcattggcttcttatctggatgaaggcttttggaggagaaccaaaacgacaagttccaagaagaagatgaagctccgcctccgccgcttagtcccaaccctgcccaggaagaagggcccgtggggctttgcctgtgcccgtccaccaaaggctgtcatgtgtctcgaaatcagcagccctccccatcccaatcccaggcagcttgtgtgtacaatcagcttctctagcaactctgtatctgttggcttcaagagaatattttgcctccacatatgtaccccttctcctttttttaaagatggatttaaaccaagatgcctccaggaaagaggacgaaatgagtatattcacagaggaatccaaaaaatacagtttgggggaaaatgcaataatttttgatgagatgggtgaaggacaagaagtgagttgtgtcaattattgtagatacaattttctgattaaatctggaaaaataaaaggcagcctgttttttctgcttttattgtattaacagctgaggtagctaaagttatttaaaataaaattaaatttatgatccaagtagcttatttttccctttaaatctcattgtaaatatatttgatttcttgtagaaattgatttccttctgtttaattttatgcttttattatactcttgatttttctaaatttgtgtgtgaaatataacattgattgaattgcagttacatttggttagtaatatttcattattttaataactgtgatgtcatgtatggatttactttggggttcaaatcaaaatgtcactgccagaaagagctgttccagctgatctagagcatactgccctagagtgtccctgggatcatctgaacagaagtgcacaggctacttgtacagagaaaaaattaatactcaaaggaaatcttcattttttagattgactttgggaatttgaattttcatcagtgcaaatataaatttctctatcctgctctgaggctaattggtaccatattttccctttgtgtcttgtgactctgccacatcccatctcatcctggcctctgagtcaagaacccagtgaactgactttctagttctagaagttccgctgcaaggccaggaaagcttgagaaaggtattgtggaagaagcaaaggtagacccccatcactcacctttgtctgcatccctgggcctgtgaatgatgacagcacctgacattctgcaccagctacctctgcctccatggcagagaaaaggccataagaacagtggaagaggagcatggactcagacttcaaggaagaagccatttccccaggtccttccttctgcatctcaccacccctagttacaaataactccattgaacagcatctattcagaaactatgccgaataaaaagattggtggaagggctcatgtggttagcaactatgaaacagaaataggacactcagttacaaacattatctcctttagtttttcagaaaatgcatccctgatttcattcatttccagcttgaaagccagccatattactctagtccctaccaaactgctctagaaggtcatttccattttgtttgtgatatttagacgcgcagacttcaggaagttcacctttaacttcagcattccagatgaagtttcctgactcagtgcttttgcataaggaactagaaaaaaaaagtaaggaaaattggagatgctaacatcctcccccatcccaactgcaccttaaaatatgcatgtcaccttcaaggttttataattgcactgtttgttttatgtatgtacagattaaaattattgctacatttgaggaaaataaaattgcttgcttctatgtaattcctgtcattccacaggaaattcacttttccagctactgaatagaatttgtttaacaacctcatgggttgcctcttcatttacagggaagaaatgaaatgtacatctgcagaaattgccaaagcccaaattaacgagtattataaaaggataataaagcatccctgaagcca

SEQ ID NO: 356157 - DNA, 2847 bp, Homo sapiens
ctaatactggttgaaagccctttaatttttcagtgacatcataaagattttttatcctactgaaatcatccatagaatggttttaaaccagttttctaaatatcatgtattttttaaaacctaccactggatacccagactctgaaactgggcttctcccaatcttggcaacattagcaatgatactcactttcagtattgatggcaaccctataggaggcgtgaccattccaattttgattttatttttaaagtgtgaactttccagaaccctgagcaaaatgagtgcagcgattttctttttgtaggacaagaagacagaagagttcttctctgtggtgactacagactagaggaatgctctacaggtgcaacaggttcaggtgtttgctgacgtccagtgtacagtgaatctggtaggcggggacccttacctgaaccagcctggtccactgggaactcaaaagcccacgtcaggaccacagaccccccaggcccagcagaagagcctccttcagcagctactgactgaataaccacttttaaaggaatgtgaaatttaaataatagacatacagagatatacaaatatattatatatttttctgagatttttgatatctcaatctgcagccattcttcaggtcgtagcatttggagcaaaaaaaaaaaaaaaaaaaaaaaaaaaggagtttgcttttgtcgggagattgaaagatgtttttgtttctttctttgtaaaggccttggatattgaaaaaataccaaggcagaacagttggacaatctatttcttgagccaaatttaattattcttatttttgtaatcagtcattggcttcttatctggatgaaggcttttggaggagaaccaaaacgacaagttccaagaagaagatgaagctccgcctccgccgcttagtcccaaccctgcccaggaagaagggcccgtggggctttgcctgtgcccgtccaccaaaggctgtcatgtgtctcgaaatcagcagccctccccatcccaatcccaggcagcttgtgtgtacaatcagcttctctagcaactctgtatctgttggcttcaagagaatattttgcctccacatatgtaccccttctcctttttttaaagatggatttaaaccaagatgcctccaggaaagaggacgaaatgagtatattcacagaggaatccaaaaaatacagtttgggggaaaatgcaataatttttgatgagatgggtgaaggacaagaagtgagttgtgtcaattattgtagatacaattttctgattaaatctggaaaaataaaaggcagcctgttttttctgcttttattgtattaacagctgaggtagctaaagttatttaaaataaaattaaatttatgatccaagtagcttatttttccctttaaatctcattgtaaatatatttgatttcttgtagaaattgatttccttctgtttaattttatgcttttattatactcttgatttttctaaatttgtgtgtgaaatataacattgattgaattgcagttacatttggttagtaatatttcattattttaataactgtgatgtcatgtatggatttactttggggttcaaatcaaaatgtcactgccagaaagagctgttccagctgatctagagcatactgccctagagtgtccctgggatcatctgaacagaagtgcacaggctacttgtacagagaaaaaattaatactcaaaggaaatcttcattttttagattgactttgggaatttgaattttcatcagtgcaaatataaatttctctatcctgctctgaggctaattggtaccatattttccctttgtgtcttgtgactctgccacatcccatctcatcctggcctctgagtcaagaacccagtgaactgactttctagttctagaagttccgctgcaaggccaggaaagcttgagaaaggtattgtggaagaagcaaaggtagacccccatcactcacctttgtctgcatccctgggcctgtgaatgatgacagcacctgacattctgcaccagctacctctgcctccatggcagagaaaaggccataagaacagtggaagaggagcatggactcagacttcaaggaagaagccatttccccaggtccttccttctgcatctcaccacccctagttacaaataactccattgaacagcatctattcagaaactatgccgaataaaaagattggtggaagggctcatgtggttagcaactatgaaacagaaataggacactcagttacaaacattatctcctttagtttttcagaaaatgcatccctgatttcattcatttccagcttgaaagccagccatattactctagtccctaccaaactgctctagaaggtcatttccattttgtttgtgatatttagacgcgcagacttcaggaagttcacctttaacttcagcattccagatgaagtttcctgactcagtgcttttgcataaggaactagaaaaaaaaagtaaggaaaattggagatgctaacatcctcccccatcccaactgcaccttaaaatatgcatgtcaccttcaaggttttataattgcactgtttgttttatgtatgtacagattaaaattattgctacatttgaggaaaataaaattgcttgcttctatgtaattcctgtcattccacaggaaattcacttttccagctactgaatagaatttgtttaacaacctcatgggttgcctcttcatttacagggaagaaatgaaatgtacatctgcagaaattgccaaagcccaaattaacgagtattataaaaggataataaagcatccctgaagcca

SEQ ID NO: 356158 - DNA, 2932 bp, Homo sapiens
ctaatactggttgaaagccctttaatttttcagtgacatcataaagattttttatcctactgaaatcatccatagaatggttttaaaccagttttctaaatatcatgtattttttaaaacctaccactggatacccagactctgaaactgggcttctcccaatcttggcaacattagcaatgatactcactttcagtattgatggcaaccctataggaggcgtgaccattccaattttgattttatttttaaagtgtgaactttccagaaccctgagcaaaatgagtgcagcgattttctttttgtaggacaagaagacagaagagttcttctctgtggtgactacagactagaggaatgctctagtgagtttccacttcaagtagtacccactcataagccgggggggcagacccttctgtctaaacacatcttttatttgtgttccagcaggtgcaacaggttcaggtgtttgctgacgtccagtgtacagtgaatctggtaggcggggacccttacctgaaccagcctggtccactgggaactcaaaagcccacgtcaggaccacagaccccccaggcccagcagaagagcctccttcagcagctactgactgaataaccacttttaaaggaatgtgaaatttaaataatagacatacagagatatacaaatatattatatatttttctgagatttttgatatctcaatctgcagccattcttcaggtcgtagcatttggagcaaaaaaaaaaaaaaaaaaaaaaaaaaaggagtttgcttttgtcgggagattgaaagatgtttttgtttctttctttgtaaaggccttggatattgaaaaaataccaaggcagaacagttggacaatctatttcttgagccaaatttaattattcttatttttgtaatcagtcattggcttcttatctggatgaaggcttttggaggagaaccaaaacgacaagttccaagaagaagatgaagctccgcctccgccgcttagtcccaaccctgcccaggaagaagggcccgtggggctttgcctgtgcccgtccaccaaaggctgtcatgtgtctcgaaatcagcagccctccccatcccaatcccaggcagcttgtgtgtacaatcagcttctctagcaactctgtatctgttggcttcaagagaatattttgcctccacatatgtaccccttctcctttttttaaagatggatttaaaccaagatgcctccaggaaagaggacgaaatgagtatattcacagaggaatccaaaaaatacagtttgggggaaaatgcaataatttttgatgagatgggtgaaggacaagaagtgagttgtgtcaattattgtagatacaattttctgattaaatctggaaaaataaaaggcagcctgttttttctgcttttattgtattaacagctgaggtagctaaagttatttaaaataaaattaaatttatgatccaagtagcttatttttccctttaaatctcattgtaaatatatttgatttcttgtagaaattgatttccttctgtttaattttatgcttttattatactcttgatttttctaaatttgtgtgtgaaatataacattgattgaattgcagttacatttggttagtaatatttcattattttaataactgtgatgtcatgtatggatttactttggggttcaaatcaaaatgtcactgccagaaagagctgttccagctgatctagagcatactgccctagagtgtccctgggatcatctgaacagaagtgcacaggctacttgtacagagaaaaaattaatactcaaaggaaatcttcattttttagattgactttgggaatttgaattttcatcagtgcaaatataaatttctctatcctgctctgaggctaattggtaccatattttccctttgtgtcttgtgactctgccacatcccatctcatcctggcctctgagtcaagaacccagtgaactgactttctagttctagaagttccgctgcaaggccaggaaagcttgagaaaggtattgtggaagaagcaaaggtagacccccatcactcacctttgtctgcatccctgggcctgtgaatgatgacagcacctgacattctgcaccagctacctctgcctccatggcagagaaaaggccataagaacagtggaagaggagcatggactcagacttcaaggaagaagccatttccccaggtccttccttctgcatctcaccacccctagttacaaataactccattgaacagcatctattcagaaactatgccgaataaaaagattggtggaagggctcatgtggttagcaactatgaaacagaaataggacactcagttacaaacattatctcctttagtttttcagaaaatgcatccctgatttcattcatttccagcttgaaagccagccatattactctagtccctaccaaactgctctagaaggtcatttccattttgtttgtgatatttagacgcgcagacttcaggaagttcacctttaacttcagcattccagatgaagtttcctgactcagtgcttttgcataaggaactagaaaaaaaaagtaaggaaaattggagatgctaacatcctcccccatcccaactgcaccttaaaatatgcatgtcaccttcaaggttttataattgcactgtttgttttatgtatgtacagattaaaattattgctacatttgaggaaaataaaattgcttgcttctatgtaattcctgtcattccacaggaaattcacttttccagctactgaatagaatttgtttaacaacctcatgggttgcctcttcatttacagggaagaaatgaaatgtacatctgcagaaattgccaaagcccaaattaacgagtattataaaaggataataaagcatccctgaagcca

SEQ ID NO: 356159 - DNA, 805 bp, Homo sapiens
aacagcatctattcaatggagttatttgtaactaggggtggtgagatgcagaaggaaggacctggggaaatggcttcttccttgaagtctgagtccatgctcctcttccactgttcttatggcccctagttacaaataactccattgaacagcatctattcagaaactatgccgaataaaaagattggtggaagggctcatgtggttagcaactatgaaacagaaataggacactcagttacaaacattatctcctttagtttttcagaaaatgcatccctgatttcattcatttccagcttgaaagccagccatattactctagtccctaccaaactgctctagaaggtcatttccattttgtttgtgatatttagacgcgcagacttcaggaagttcacctttaacttcagcattccagatgaagtttcctgactcagtgcttttgcataaggaactagaaaaaaaaagtaaggaaaattggagatgctaacatcctcccccatcccaactgcaccttaaaatatgcatgtcaccttcaaggttttataattgcactgtttgttttatgtatgtacagattaaaattattgctacatttgaggaaaataaaattgcttgcttctatgtaattcctgtcattccacaggaaattcacttttccagctactgaatagaatttgtttaacaacctcatgggttgcctcttcatttacagggaagaaatgaaatgtacatctgcagaaattgccaaagcccaaattaacgagtattataaaaggataataaagcatccctgaagcca

SEQ ID NO: 356160 - DNA, 505 bp, Homo sapiens
aagttttaatttttaatttttgcctttgattatagtatttgaggggaagatcatacgtattttcttggaaatgttacagttttctaattggtagacatttagatttgctagggagataagtattctattgcctcaggataatgttagatctgaagaggtcagtctgtcttttaatctgagtatctaattaagcagatggcttaaagtacatcttttgtatcttcagagtttgtgctttttcaccatattcgcaagcacataatcaatttttcttcctcagtaaatggagttccttggcctcaagaggcaacacgacgaaatagccatacctttaactgcaggatgctaattcaccctccagatgagccagggaccgagaaccaagaagcttgccagcgttatgaagtaatgcagtgtttcactgtgtcacagccaaaatcaattcaagaggatggagaaggtaaagccaaacggtctttttaaagtgtttatttcttctgtgact

SEQ ID NO: 356161 - DNA, 7290 bp, Homo sapiens
gcggccgcctgcccggcgtggggagcgggcgccccgggccgccgccgagagggggagccggaagtcggcgcgggcgcccctcggccccgacgacgccgtgaccttggccggcccgctcacctctcggaatctcgcctgccgggaccgcgaaatgggggcgaccgcggcgtccctctccgtcggcgcagccctcgacggcgcttgggtttgaccccggcgcgcttgctcgccccttctcccgagaaggggtttcggagatctatccatactaatggaaatgtaactggaactgactctgatgataaaatcaaggaccatcaagcaagatcatgcagtaggcaactttgcttccaaaagaagttaccaacatttagaatttctacttattctgaggttccagttacagctatatcagagaatgagttaatctcctcagaaatcactaaatactactctgaggggcttagaaattaacaggttgtttatataattggccttaaatgaggtgagagtgaagagactagagccatctctggaaaacatcattatcccattccccgggaagctaccctctggaactcaagatttgaccatatctgttttgaggattcattatgaacaaagaagtctccccaggtgtgaagtttttcaacatgagtggcctcggggacagttcatccgaccctgctaacccagactcacataagaggaaaggatcgccatgtgacacactggcatcaagcacggaaaagaggcgcagggagcaagaaaataaatatttagaagaactagctgagttactgtctgccaacattagtgacattgacagcttgagtgtaaaaccagacaaatgcaagattttgaagaaaacagtcgatcagatacagctaatgaagagaatggaacaagagaaatcaacaactgatgacgatgtacagaaatcagacatctcatcaagtagtcaaggagtgatagaaaaggaatccttgggacctcttcttttggaggctttggatggatttttctttgttgtgaactgtgaagggagaattgtatttgtgtcagagaatgtaaccagctacttaggttacaatcaggaggaattaatgaataccagcgtctacagcatactgcacgtgggggatcatgcagaatttgtgaagaatctgctaccaaaatcactagtaaatggagttccttggcctcaagaggcaacacgacgaaatagccatacctttaactgcaggatgctaattcaccctccagatgagccagggaccgagaaccaagaagcttgccagcgttatgaagtaatgcagtgtttcactgtgtcacagccaaaatcaattcaagaggatggagaagatttccagtcatgtctgatttgtattgcacggcgattacctcggcctccagctattacgggtgtagaatcctttatgaccaagcaagatactacaggtaaaatcatctctattgatactagttccctgagagctgctggcagaactggttgggaagatttagtgaggaagtgcatttatgcttttttccaacctcagggcagagaaccatcttatgccagacagctgttccaagaagtgatgactcgtggcactgcctccagcccctcctatagattcatattgaatgatgggacaatgcttagcgcccacaccaagtgtaaactttgctaccctcaaagtccagacatgcaacctttcatcatgggaattcatatcatcgacagggagcacagtgggctttctcctcaagatgacactaattctggaatgtcaattccccgagtaaatccctcggtcaatcctagtatctctccagctcatggtgtggctcgttcatccacattgccaccatccaacagcaacatggtatccaccagaataaaccgccagcagagctcagaccttcatagcagcagtcatagtaattctagcaacagccaaggaagtttcggatgctcacccggaagtcagattgtagccaatgttgccttaaaccaaggacaggccagttcacagagcagtaatccctctttaaacctcaataattctcctatggaaggtacaggaatatccctagcacagttcatgtctccaaggagacaggttacttctggattggcaacaaggcccaggatgccaaacaattcctttcctcctaatatttcgacattaagctctcccgttggcatgacaagtagtgcctgtaataataataaccgatcttattcaaacatcccagtaacatctttacagggtatgaatgaaggacccaataactccgttggcttctctgccagttctccagtcctcaggcagatgagctcacagaattcacctagcagattaaatatacaaccagcaaaagctgagtccaaagataacaaagagattgcctcaattttaaatgaaatgattcaatctgacaacagctctagtgatggcaaacctctggattcagggcttctgcataacaatgacagactttcagatggagacagtaaatactctcaaaccagtcacaaactagtgcagcttttgacaacaactgccgaacagcagttacggcatgctgatatagacacaagctgcaaagatgtcctgtcttgcacaggcacttccaactctgcctctgctaactcttcaggaggttcttgtccctcttctcatagctcattgacagaacggcataaaattctacaccggctcttacaggagggtagcccctcagatatcaccactttgtctgtcgagcctgataaaaaggacagtgcatctacttctgtgtcagtgactggacaggtacaaggaaactccagtataaaactagaactggatgcttcaaagaaaaaagaatcaaaagaccatcagctcctacgctatcttttagataaagatgagaaagatttaagatcaactccaaacctgagcctggatgatgtaaaggtgaaagtggaaaagaaagaacagatggatccatgtaatacaaacccaaccccaatgaccaaacccactcctgaggaaataaaactggaggcccagagccagtttacagctgaccttgaccagtttgatcagttactgcccacgctggagaaggcagcacagttgccaggcttatgtgagacagacaggatggatggtgcggtcaccagtgtaaccatcaaatcggagatcctgccagcttcacttcagtccgccactgccagacccacttccaggctaaatagattacctgagctggaattggaagcaattgataaccaatttggacaaccaggaacaggcgatcagattccatggacaaataatacagtgacagctataaatcagagtaaatcagaagaccagtgtattagctcacaattagatgagcttctctgtccacccacaacagtagaagggagaaatgatgagaaggctcttcttgaacagctggtatccttccttagtggcaaagatgaaactgagctagctgaactagacagagctctgggaattgacaaacttgttcaggggggtggattagatgtattatcagagagatttccaccacaacaagcaacgccacctttgatcatggaagaaagacccaacctttattcccagccttactcttctccttctcctactgccaatctccctagccctttccaaggcatggtcaggcaaaaaccttcactggggacgatgcctgttcaagtaacacctccccgaggtgctttttcacctggcatgggcatgcagcccaggcaaactctaaacagacctccggctgcacctaaccagcttcgacttcaactacagcagcgattacagggacaacagcagttgatacaccaaaatcggcaagctatcttaaaccagtttgcagcaactgctcctgttggcatcaatatgagatcaggcatgcaacagcaaattacacctcagccacccctgaatgctcaaatgttggcacaacgtcagcgggaactgtacagtcaacagcaccgacagaggcagctaatacagcagcaaagagccatgcttatgaggcagcaaagctttgggaacaacctccctccctcatctggactaccagttcaaatggggaacccccgtcttcctcagggtgctccacagcaattcccctatccaccaaactatggtacaaatccaggaaccccacctgcttctaccagcccgttttcacaactagcagcaaatcctgaagcatccttggccaaccgcaacagcatggtgagcagaggcatgacaggaaacataggaggacagtttggcactggaatcaatcctcagatgcagcagaatgtcttccagtatccaggagcaggaatggttccccaaggtgaggccaactttgctccatctctaagccctgggagctccatggtgccgatgccaatccctcctcctcagagttctctgctccagcaaactccacctgcctccgggtatcagtcaccagacatgaaggcctggcagcaaggagcgataggaaacaacaatgtgttcagtcaagctgtccagaaccagcccacgcctgcacagccaggagtatacaacaacatgagcatcaccgtttccatggcaggtggaaatacgaatgttcagaacatgaacccaatgatggcccagatgcagatgagctctttgcagatgccaggaatgaacactgtgtgccctgagcagataaatgatcccgcactgagacacacaggcctctactgcaaccagctctcatccactgaccttctcaaaacagaagcagatggaacccagcaggtgcaacaggttcaggtgtttgctgacgtccagtgtacagtgaatctggtaggcggggacccttacctgaaccagcctggtccactgggaactcaaaagcccacgtcaggaccacagaccccccaggcccagcagaagagcctccttcagcagctactgactgaataaccacttttaaaggaatgtgaaatttaaataatagacatacagagatatacaaatatattatatatttttctgagatttttgatatctcaatctgcagccattcttcaggtcgtagcatttggagcaaaaaaaaaaaaaaaaaaaaaaaaaaaggagtttgcttttgtcgggagattgaaagatgtttttgtttctttctttgtaaaggccttggatattgaaaaaataccaaggcagaacagttggacaatctatttcttgagccaaatttaattattcttatttttgtaatcagtcattggcttcttatctggatgaaggcttttggaggagaaccaaaacgacaagttccaagaagaagatgaagctccgcctccgccgcttagtcccaaccctgcccaggaagaagggcccgtggggctttgcctgtgcccgtccaccaaaggctgtcatgtgtctcgaaatcagcagccctccccatcccaatcccaggcagcttgtgtgtacaatcagcttctctagcaactctgtatctgttggcttcaagagaatattttgcctccacatatgtaccccttctcctttttttaaagatggatttaaaccaagatgcctccaggaaagaggacgaaatgagtatattcacagaggaatccaaaaaatacagtttgggggaaaatgcaataatttttgatgagatgggtgaaggacaagaagtgagttgtgtcaattattgtagatacaattttctgattaaatctggaaaaataaaaggcagcctgttttttctgcttttattgtattaacagctgaggtagctaaagttatttaaaataaaattaaatttatgatccaagtagcttatttttccctttaaatctcattgtaaatatatttgatttcttgtagaaattgatttccttctgtttaattttatgcttttattatactcttgatttttctaaatttgtgtgtgaaatataacattgattgaattgcagttacatttggttagtaatatttcattattttaataactgtgatgtcatgtatggatttactttggggttcaaatcaaaatgtcactgccagaaagagctgttccagctgatctagagcatactgccctagagtgtccctgggatcatctgaacagaagtgcacaggctacttgtacagagaaaaaattaatactcaaaggaaatcttcattttttagattgactttgggaatttgaattttcatcagtgcaaatataaatttctctatcctgctctgaggctaattggtaccatattttccctttgtgtcttgtgactctgccacatcccatctcatcctggcctctgagtcaagaacccagtgaactgactttctagttctagaagttccgctgcaaggccaggaaagcttgagaaaggtattgtggaagaagcaaaggtagacccccatcactcacctttgtctgcatccctgggcctgtgaatgatgacagcacctgacattctgcaccagctacctctgcctccatggcagagaaaaggccataagaacagtggaagaggagcatggactcagacttcaaggaagaagccatttccccaggtccttccttctgcatctcaccacccctagttacaaataactccattgaacagcatctattcagaaactatgccgaataaaaagattggtggaagggctcatgtggttagcaactatgaaacagaaataggacactcagttacaaacattatctcctttagtttttcagaaaatgcatccctgatttcattcatttccagcttgaaagccagccatattactctagtccctaccaaactgctctagaaggtcatttccattttgtttgtgatatttagacgcgcagacttcaggaagttcacctttaacttcagcattccagatgaagtttcctgactcagtgcttttgcataaggaactagaaaaaaaaagtaaggaaaattggagatgctaacatcctcccccatcccaactgcaccttaaaatatgcatgtcaccttcaaggttttataattgcactgtttgttttatgtatgtacagattaaaattattgctacatttgaggaaaataaaattgcttgcttctatgtaattcctgtcattccacaggaaattcacttttccagctactgaatagaatttgtttaacaacctcatgggttgcctcttcatttacagggaagaaatgaaatgtacatctgcagaaattgccaaagcccaaattaacgagtattataaaaggataataaagcatccctgaagcca

SEQ ID NO: 356162 - DNA, 6958 bp, Homo sapiens
gcggccgcctgcccggcgtggggagcgggcgccccgggccgccgccgagagggggagccggaagtcggcgcgggcgcccctcggccccgacgacgccgtgaccttggccggcccgctcacctctcggaatctcgcctgccgggaccgcgaaatgggggcgaccgcggcgtccctctccgtcggcgcagccctcgacggcgcttgggtttgaccccggcgcgcttgctcgccccttctcccgagaaggggtttcggagatctatccatactaatggaaatgtaactggaactgactctgatgataaaatcaaggaccatcaagcaagatcatgcagtaggcaactttgcttccaaaagaagttaccaacatttagaatttctacttattctgaggttccagttacagctatatcagagaatgagttaatctcctcagaaatcactaaatactactctgaggggcttagaaattaacaggttgtttatataattggccttaaatgaggtgagagtgaagagactagagccatctctggaaaacatcattatcccattccccgggaagctaccctctggaactcaagatttgaccatatctgttttgaggattcattatgaacaaagaagtctccccaggtgtgaagtttttcaacatgagtggcctcggggacagttcatccgaccctgctaacccagactcacataagaggaaaggatcgccatgtgacacactggcatcaagcacggaaaagaggcgcagggagcaagaaaataaatatttagaagaactagctgagttactgtctgccaacattagtgacattgacagcttgagtgtaaaaccagacaaatgcaagattttgaagaaaacagtcgatcagatacagctaatgaagagaatggaacaagagaaatcaacaactgatgacgatgtacagaaatcagacatctcatcaagtagtcaaggagtgatagaaaaggaatccttgggacctcttcttttggaggctttggatggatttttctttgttgtgaactgtgaagggagaattgtatttgtgtcagagaatgtaaccagctacttaggttacaatcaggaggaattaatgaataccagcgtctacagcatactgcacgtgggggatcatgcagaatttgtgaagaatctgctaccaaaatcactagtaaatggagttccttggcctcaagaggcaacacgacgaaatagccatacctttaactgcaggatgctaattcaccctccagatgagccagggaccgagaaccaagaagcttgccagcgttatgaagtaatgcagtgtttcactgtgtcacagccaaaatcaattcaagaggatggagaagatttccagtcatgtctgatttgtattgcacggcgattacctcggcctccagctattacgggtgtagaatcctttatgaccaagcaagatactacaggtaaaatcatctctattgatactagttccctgagagctgctggcagaactggttgggaagatttagtgaggaagtgcatttatgcttttttccaacctcagggcagagaaccatcttatgccagacagctgttccaagaagtgatgactcgtggcactgcctccagcccctcctatagattcatattgaatgatgggacaatgcttagcgcccacaccaagtgtaaactttgctaccctcaaagtccagacatgcaacctttcatcatgggaattcatatcatcgacagggagcacagtgggctttctcctcaagatgacactaattctggaatgtcaattccccgagtaaatccctcggtcaatcctagtatctctccagctcatggtgtggctcgttcatccacattgccaccatccaacagcaacatggtatccaccagaataaaccgccagcagagctcagaccttcatagcagcagtcatagtaattctagcaacagccaaggaagtttcggatgctcacccggaagtcagattgtagccaatgttgccttaaaccaaggacaggccagttcacagagcagtaatccctctttaaacctcaataattctcctatggaaggtacaggaatatccctagcacagttcatgtctccaaggagacaggttacttctggattggcaacaaggcccaggatgccaaacaattcctttcctcctaatatttcgacattaagctctcccgttggcatgacaagtagtgcctgtaataataataaccgatcttattcaaacatcccagtaacatctttacagggtatgaatgaaggacccaataactccgttggcttctctgccagttctccagtcctcaggcagatgagctcacagaattcacctagcagattaaatatacaaccagcaaaagctgagtccaaagataacaaagagattgcctcaattttaaatgaaatgattcaatctgacaacagctctagtgatggcaaacctctggattcagggcttctgcataacaatgacagactttcagatggagacagtaaatactctcaaaccagtcacaaactagtgcagcttttgacaacaactgccgaacagcagttacggcatgctgatatagacacaagctgcaaagatgtcctgtcttgcacaggcacttccaactctgcctctgctaactcttcaggaggttcttgtccctcttctcatagctcattgacagaacggcataaaattctacaccggctcttacaggagggtagcccctcagatatcaccactttgtctgtcgagcctgataaaaaggacagtgcatctacttctgtgtcagtgactggacaggtacaaggaaactccagtataaaactagaactggatgcttcaaagaaaaaagaatcaaaagaccatcagctcctacgctatcttttagataaagatgagaaagatttaagatcaactccaaacctgagcctggatgatgtaaaggtgaaagtggaaaagaaagaacagatggatccatgtaatacaaacccaaccccaatgaccaaacccactcctgaggaaataaaactggaggcccagagccagtttacagctgaccttgaccagtttgatcagttactgcccacgctggagaaggcagcacagttgccaggcttatgtgagacagacaggatggatggtgcggtcaccagtgtaaccatcaaatcggagatcctgccagcttcacttcagtccgccactgccagacccacttccaggctaaatagattacctgagctggaattggaagcaattgataaccaatttggacaaccaggaacaggcgatcagattccatggacaaataatacagtgacagctataaatcagagtaaatcagaagaccagtgtattagctcacaattagatgagcttctctgtccacccacaacagtagaagggagaaatgatgagaaggctcttcttgaacagctggtatccttccttagtggcaaagatgaaactgagctagctgaactagacagagctctgggaattgacaaacttgttcaggggggtggattagatgtattatcagagagatttccaccacaacaagcaacgccacctttgatcatggaagaaagacccaacctttattcccagccttactcttctccttctcctactgccaatctccctagccctttccaaggcatggtcaggcaaaaaccttcactggggacgatgcctgttcaagtaacacctccccgaggtgctttttcacctggcatgggcatgcagcccaggcaaactctaaacagacctccggctgcacctaaccagcttcgacttcaactacagcagcgattacagggacaacagcagttgatacaccaaaatcggcaagctatcttaaaccagtttgcagcaactgctcctgttggcatcaatatgagatcaggcatgcaacagcaaattacacctcagccacccctgaatgctcaaatgttggcacaacgtcagcgggaactgtacagtcaacagcaccgacagaggcagctaatacagcagcaaagagccatgcttatgaggcagcaaagctttgggaacaacctccctccctcatctggactaccagttcaaatggggaacccccgtcttcctcagggtgctccacagcaattcccctatccaccaaactatggtacaaatccaggaaccccacctgcttctaccagcccgttttcacaactagcagcaaatcctgaagcatccttggccaaccgcaacagcatggtgagcagaggcatgacaggaaacataggaggacagtttggcactggaatcaatcctcagatgcagcagaatgtcttccagtatccaggagcaggaatggttccccaaggtgaggccaactttgctccatctctaagccctgggagctccatggtgccgatgccaatccctcctcctcagagttctctgctccagcaaactccacctgcctccgggtatcagtcaccagacatgaaggcctggcagcaaggagcgataggaaacaacaatgtgttcagtcaagctgtccagaaccagcccacgcctgcacagccaggagtatacaacaacatgagcatcaccgtttccatggcaggtggaaatacgaatgttcagaacatgaacccaatgatggcccagatgcagatgagctctttgcagatgccaggaatgaacactgtgtgccctgagcagataaatgatcccgcactgagacacacaggcctctactgcaaccagctctcatccactgaccttctcaaaacagaagcagatggaacccagcaggtgcaacaggttcaggtgtttgctgacgtccagtgtacagtgaatctggtaggcggggacccttacctgaaccagcctggtccactgggaactcaaaagcccacgtcaggaccacagaccccccaggcccagcagaagagcctccttcagcagctactgactgaataaccacttttaaaggaatgtgaaatttaaataatagacatacagagatatacaaatatattatatatttttctgagatttttgatatctcaatctgcagccattcttcaggtcgtagcatttggagcaaaaaaaaaaaaaaaaaaaaaaaaaaaggagtttgcttttgtcgggagattgaaagatgtttttgtttctttctttgtaaaggccttggatattgaaaaaataccaaggcagaacagttggacaatctatttcttgagccaaatttaattattcttatttttgtaatcagtcattggcttcttatctggatgaaggcttttggaggagaaccaaaacgacaagttccaagaagaagatgaagctccgcctccgccgcttagtcccaaccctgcccaggaagaagggcccgtggggctttgcctgtgcccgtccaccaaaggctgtcatgtgtctcgaaatcagcagccctccccatcccaatcccaggcagcttgtgtgtacaatcagcttctctagcaactctgtatctgttggcttcaagagaatattttgcctccacatatgtaccccttctcctttttttaaagatggatttaaaccaagatgcctccaggaaagaggacgaaatgagtatattcacagaggaatccaaaaaatacagtttgggggaaaatgcaataatttttgatgagatgggtgaaggacaagaagtgagttgtgtcaattattgtagatacaattttctgattaaatctggaaaaataaaaggcagcctgttttttctgcttttattgtattaacagctgaggtagctaaagttatttaaaataaaattaaatttatgatccaagtagcttatttttccctttaaatctcattgtaaatatatttgatttcttgtagaaattgatttccttctgtttaattttatgcttttattatactcttgatttttctaaatttgtgtgtgaaatataacattgattgaattgcagttacatttggttagtaatatttcattattttaataactgtgatgtcatgtatggatttactttggggttcaaatcaaaatgtcactgccagaaagagctgttccagctgatctagagcatactgccctagagtgtccctgggatcatctgaacagaagtgcacaggctacttgtacagagaaaaaattaatactcaaaggaaatcttcattttttagattgactttgggaatttgaattttcatcagtgcaaatataaatttctctatcctgctctgaggctaattggtaccatattttccctttgtgtcttgtgactctgccacatcccatctcatcctggcctctgagtcaagaacccagtgaactgactttctagttctagaagttccgctgcaaggccaggaaagcttgagaaaggtattgtggaagaagcaaaggtagacccccatcactcacctttgtctgcatccctgggcctgtgaatgatgacagcacctgacattctgcaccagctacctctgcctccatggcagagaaaaggccataagaacagtggaagaggagcatggactcagacttcaaggaagaagccatttccccaggtccttccttctgcatctcaccacccctagttacaaataactccattgaacagcatctattcagaaactatgccgaataaaaagattggtggaagggctcatgtggttagcaactatgaaacagaaataggacactcagttacaaacattatctcctttagtttttcagaaaatgcatccctgatttcattcatttccagcttgaaagccagccatattactctagtccctaccaaactgctctagaaggtcatttccattttgtttgtgatatttagacgcgcagacttcaggaagttcacctttaacttcagcattccagatgaagtttcctgactcaggtggtgtgggggatcgtatagagtagacttgcc

SEQ ID NO: 356163 - DNA, 6915 bp, Homo sapiens
tttttctatttcaagaagttattcataatataaagtagttccaaatgtaactgctgtgtttattacttgtttgcttttactatctagtaattgttatttgaaaatattcaagatgtatatatgattggggaaatacatctgttatagcagtcaatttactttatatattttagccagaattgttttctaaattttggtattttgtaatgtccactttttagatgtgaatttatatcactttctaaatctggttttatattttcgataaaaataaagatctcactaaatgtgtaagcatagatacttgatcagagaaggaaatatggtgatacaaatgtacactaactggattttctttgtgtaacagcacggaaaagaggcgcagggagcaagaaaataaatatttagaagaactagctgagttactgtctgccaacattagtgacattgacagcttgagtgtaaaaccagacaaatgcaagattttgaagaaaacagtcgatcagatacagctaatgaagagaatggaacaagagaaatcaacaactgatgacgatgtacagaaatcagacatctcatcaagtagtcaaggagtgatagaaaaggaatccttgggacctcttcttttggaggctttggatggatttttctttgttgtgaactgtgaagggagaattgtatttgtgtcagagaatgtaaccagctacttaggttacaatcaggaggaattaatgaataccagcgtctacagcatactgcacgtgggggatcatgcagaatttgtgaagaatctgctaccaaaatcactagtaaatggagttccttggcctcaagaggcaacacgacgaaatagccatacctttaactgcaggatgctaattcaccctccagatgagccagggaccgagaaccaagaagcttgccagcgttatgaagtaatgcagtgtttcactgtgtcacagccaaaatcaattcaagaggatggagaagatttccagtcatgtctgatttgtattgcacggcgattacctcggcctccagctattacgggtgtagaatcctttatgaccaagcaagatactacaggtaaaatcatctctattgatactagttccctgagagctgctggcagaactggttgggaagatttagtgaggaagtgcatttatgcttttttccaacctcagggcagagaaccatcttatgccagacagctgttccaagaagtgatgactcgtggcactgcctccagcccctcctatagattcatattgaatgatgggacaatgcttagcgcccacaccaagtgtaaactttgctaccctcaaagtccagacatgcaacctttcatcatgggaattcatatcatcgacagggagcacagtgggctttctcctcaagatgacactaattctggaatgtcaattccccgagtaaatccctcggtcaatcctagtatctctccagctcatggtgtggctcgttcatccacattgccaccatccaacagcaacatggtatccaccagaataaaccgccagcagagctcagaccttcatagcagcagtcatagtaattctagcaacagccaaggaagtttcggatgctcacccggaagtcagattgtagccaatgttgccttaaaccaaggacaggccagttcacagagcagtaatccctctttaaacctcaataattctcctatggaaggtacaggaatatccctagcacagttcatgtctccaaggagacaggttacttctggattggcaacaaggcccaggatgccaaacaattcctttcctcctaatatttcgacattaagctctcccgttggcatgacaagtagtgcctgtaataataataaccgatcttattcaaacatcccagtaacatctttacagggtatgaatgaaggacccaataactccgttggcttctctgccagttctccagtcctcaggcagatgagctcacagaattcacctagcagattaaatatacaaccagcaaaagctgagtccaaagataacaaagagattgcctcaattttaaatgaaatgattcaatctgacaacagctctagtgatggcaaacctctggattcagggcttctgcataacaatgacagactttcagatggagacagtaaatactctcaaaccagtcacaaactagtgcagcttttgacaacaactgccgaacagcagttacggcatgctgatatagacacaagctgcaaagatgtcctgtcttgcacaggcacttccaactctgcctctgctaactcttcaggaggttcttgtccctcttctcatagctcattgacagaacggcataaaattctacaccggctcttacaggagggtagcccctcagatatcaccactttgtctgtcgagcctgataaaaaggacagtgcatctacttctgtgtcagtgactggacaggtacaaggaaactccagtataaaactagaactggatgcttcaaagaaaaaagaatcaaaagaccatcagctcctacgctatcttttagataaagatgagaaagatttaagatcaactccaaacctgagcctggatgatgtaaaggtgaaagtggaaaagaaagaacagatggatccatgtaatacaaacccaaccccaatgaccaaacccactcctgaggaaataaaactggaggcccagagccagtttacagctgaccttgaccagtttgatcagttactgcccacgctggagaaggcagcacagttgccaggcttatgtgagacagacaggatggatggtgcggtcaccagtgtaaccatcaaatcggagatcctgccagcttcacttcagtccgccactgccagacccacttccaggctaaatagattacctgagctggaattggaagcaattgataaccaatttggacaaccaggaacaggcgatcagattccatggacaaataatacagtgacagctataaatcagagtaaatcagaagaccagtgtattagctcacaattagatgagcttctctgtccacccacaacagtagaagggagaaatgatgagaaggctcttcttgaacagctggtatccttccttagtggcaaagatgaaactgagctagctgaactagacagagctctgggaattgacaaacttgttcaggggggtggattagatgtattatcagagagatttccaccacaacaagcaacgccacctttgatcatggaagaaagacccaacctttattcccagccttactcttctccttctcctactgccaatctccctagccctttccaaggcatggtcaggcaaaaaccttcactggggacgatgcctgttcaagtaacacctccccgaggtgctttttcacctggcatgggcatgcagcccaggcaaactctaaacagacctccggctgcacctaaccagcttcgacttcaactacagcagcgattacagggacaacagcagttgatacaccaaaatcggcaagctatcttaaaccagtttgcagcaactgctcctgttggcatcaatatgagatcaggcatgcaacagcaaattacacctcagccacccctgaatgctcaaatgttggcacaacgtcagcgggaactgtacagtcaacagcaccgacagaggcagctaatacagcagcaaagagccatgcttatgaggcagcaaagctttgggaacaacctccctccctcatctggactaccagttcaaatggggaacccccgtcttcctcagggtgctccacagcaattcccctatccaccaaactatggtacaaatccaggaaccccacctgcttctaccagcccgttttcacaactagcagcaaatcctgaagcatccttggccaaccgcaacagcatggtgagcagaggcatgacaggaaacataggaggacagtttggcactggaatcaatcctcagatgcagcagaatgtcttccagtatccaggagcaggaatggttccccaaggtgaggccaactttgctccatctctaagccctgggagctccatggtgccgatgccaatccctcctcctcagagttctctgctccagcaaactccacctgcctccgggtatcagtcaccagacatgaaggcctggcagcaaggagcgataggaaacaacaatgtgttcagtcaagctgtccagaaccagcccacgcctgcacagccaggagtatacaacaacatgagcatcaccgtttccatggcaggtggaaatacgaatgttcagaacatgaacccaatgatggcccagatgcagatgagctctttgcagatgccaggaatgaacactgtgtgccctgagcagataaatgatcccgcactgagacacacaggcctctactgcaaccagctctcatccactgaccttctcaaaacagaagcagatggaacccagcaggtgcaacaggttcaggtgtttgctgacgtccagtgtacagtgaatctggtaggcggggacccttacctgaaccagcctggtccactgggaactcaaaagcccacgtcaggaccacagaccccccaggcccagcagaagagcctccttcagcagctactgactgaataaccacttttaaaggaatgtgaaatttaaataatagacatacagagatatacaaatatattatatatttttctgagatttttgatatctcaatctgcagccattcttcaggtcgtagcatttggagcaaaaaaaaaaaaaaaaaaaaaaaaaaaggagtttgcttttgtcgggagattgaaagatgtttttgtttctttctttgtaaaggccttggatattgaaaaaataccaaggcagaacagttggacaatctatttcttgagccaaatttaattattcttatttttgtaatcagtcattggcttcttatctggatgaaggcttttggaggagaaccaaaacgacaagttccaagaagaagatgaagctccgcctccgccgcttagtcccaaccctgcccaggaagaagggcccgtggggctttgcctgtgcccgtccaccaaaggctgtcatgtgtctcgaaatcagcagccctccccatcccaatcccaggcagcttgtgtgtacaatcagcttctctagcaactctgtatctgttggcttcaagagaatattttgcctccacatatgtaccccttctcctttttttaaagatggatttaaaccaagatgcctccaggaaagaggacgaaatgagtatattcacagaggaatccaaaaaatacagtttgggggaaaatgcaataatttttgatgagatgggtgaaggacaagaagtgagttgtgtcaattattgtagatacaattttctgattaaatctggaaaaataaaaggcagcctgttttttctgcttttattgtattaacagctgaggtagctaaagttatttaaaataaaattaaatttatgatccaagtagcttatttttccctttaaatctcattgtaaatatatttgatttcttgtagaaattgatttccttctgtttaattttatgcttttattatactcttgatttttctaaatttgtgtgtgaaatataacattgattgaattgcagttacatttggttagtaatatttcattattttaataactgtgatgtcatgtatggatttactttggggttcaaatcaaaatgtcactgccagaaagagctgttccagctgatctagagcatactgccctagagtgtccctgggatcatctgaacagaagtgcacaggctacttgtacagagaaaaaattaatactcaaaggaaatcttcattttttagattgactttgggaatttgaattttcatcagtgcaaatataaatttctctatcctgctctgaggctaattggtaccatattttccctttgtgtcttgtgactctgccacatcccatctcatcctggcctctgagtcaagaacccagtgaactgactttctagttctagaagttccgctgcaaggccaggaaagcttgagaaaggtattgtggaagaagcaaaggtagacccccatcactcacctttgtctgcatccctgggcctgtgaatgatgacagcacctgacattctgcaccagctacctctgcctccatggcagagaaaaggccataagaacagtggaagaggagcatggactcagacttcaaggaagaagccatttccccaggtccttccttctgcatctcaccacccctagttacaaataactccattgaacagcatctattcagaaactatgccgaataaaaagattggtggaagggctcatgtggttagcaactatgaaacagaaataggacactcagttacaaacattatctcctttagtttttcagaaaatgcatccctgatttcattcatttccagcttgaaagccagccatattactctagtccctaccaaactgctctagaaggtcatttccattttgtttgtgatatttagacgcgcagacttcaggaagttcacctttaacttcagcattccagatgaagtttcctgactcagtgcttttgcataaggaactagaaaaaaaaagtaaggaaaattggagatgctaacatcctcccccatcccaactgcaccttaaaatatgcatgtcaccttcaaggttttataattgcactgtttgttttatgtatgtacagattaaaattattgctacatttgaggaaaataaaattgcttgcttctatgtaattcctgtcattccacaggaaattcacttttccagctactgaatagaatttgtttaacaacctcatgggttgcctcttcatttacagggaagaaatgaaatgtacatctgcagaaattgccaaagcccaaattaacgagtattataaaaggataataaagcatccctgaagcca

SEQ ID NO: 356164 - DNA, 5591 bp, Homo sapiens
gcggccgcctgcccggcgtggggagcgggcgccccgggccgccgccgagagggggagccggaagtcggcgcgggcgcccctcggccccgacgacgccgtgaccttggccggcccgctcacctctcggaatctcgcctgccgggaccgcgaaatgggggcgaccgcggcgtccctctccgtcggcgcagccctcgacggcgcttgggtttgaccccggcgcgcttgctcgccccttctcccgagaaggggtttcggagatctatccatactaatggaaatgtaactggaactgactctgatgataaaatcaaggaccatcaagcaagatcatgcagtaggcaactttgcttccaaaagaagttaccaacatttagaatttctacttattctgaggttccagttacagctatatcagagaatgagttaatctcctcagaaatcactaaatactactctgaggggcttagaaattaacaggttgtttatataattggccttaaatgaggtgagagtgaagagactagagccatctctggaaaacatcattatcccattccccgggaagctaccctctggaactcaagatttgaccatatctgttttgaggattcattatgaacaaagaagtctccccaggtgtgaagtttttcaacatgagtggcctcggggacagttcatccgaccctgctaacccagactcacataagaggaaaggatcgccatgtgacacactggcatcaagcacggaaaagaggcgcagggagcaagaaaataaatatttagaagaactagctgagttactgtctgccaacattagtgacattgacagcttgagtgtaaaaccagacaaatgcaagattttgaagaaaacagtcgatcaggcacttccaactctgcctctgctaactcttcaggaggttcttgtccctcttctcatagctcattgacagaacggcataaaattctacaccggctcttacaggagggtagcccctcagatatcaccactttgtctgtcgagcctgataaaaaggacagtgcatctacttctgtgtcagtgactggacaggtacaaggaaactccagtataaaactagaactggatgcttcaaagaaaaaagaatcaaaagaccatcagctcctacgctatcttttagataaagatgagaaagatttaagatcaactccaaacctgagcctggatgatgtaaaggtgaaagtggaaaagaaagaacagatggatccatgtaatacaaacccaaccccaatgaccaaacccactcctgaggaaataaaactggaggcccagagccagtttacagctgaccttgaccagtttgatcagttactgcccacgctggagaaggcagcacagttgccaggcttatgtgagacagacaggatggatggtgcggtcaccagtgtaaccatcaaatcggagatcctgccagcttcacttcagtccgccactgccagacccacttccaggctaaatagattacctgagctggaattggaagcaattgataaccaatttggacaaccaggaacaggcgatcagattccatggacaaataatacagtgacagctataaatcagagtaaatcagaagaccagtgtattagctcacaattagatgagcttctctgtccacccacaacagtagaagggagaaatgatgagaaggctcttcttgaacagctggtatccttccttagtggcaaagatgaaactgagctagctgaactagacagagctctgggaattgacaaacttgttcaggggggtggattagatgtattatcagagagatttccaccacaacaagcaacgccacctttgatcatggaagaaagacccaacctttattcccagccttactcttctccttctcctactgccaatctccctagccctttccaaggcatggtcaggcaaaaaccttcactggggacgatgcctgttcaagtaacacctccccgaggtgctttttcacctggcatgggcatgcagcccaggcaaactctaaacagacctccggctgcacctaaccagcttcgacttcaactacagcagcgattacagggacaacagcagttgatacaccaaaatcggcaagctatcttaaaccagtttgcagcaactgctcctgttggcatcaatatgagatcaggcatgcaacagcaaattacacctcagccacccctgaatgctcaaatgttggcacaacgtcagcgggaactgtacagtcaacagcaccgacagaggcagctaatacagcagcaaagagccatgcttatgaggcagcaaagctttgggaacaacctccctccctcatctggactaccagttcaaatggggaacccccgtcttcctcagggtgctccacagcaattcccctatccaccaaactatggtacaaatccaggaaccccacctgcttctaccagcccgttttcacaactagcagcaaatcctgaagcatccttggccaaccgcaacagcatggtgagcagaggcatgacaggaaacataggaggacagtttggcactggaatcaatcctcagatgcagcagaatgtcttccagtatccaggagcaggaatggttccccaaggtgaggccaactttgctccatctctaagccctgggagctccatggtgccgatgccaatccctcctcctcagagttctctgctccagcaaactccacctgcctccgggtatcagtcaccagacatgaaggcctggcagcaaggagcgataggaaacaacaatgtgttcagtcaagctgtccagaaccagcccacgcctgcacagccaggagtatacaacaacatgagcatcaccgtttccatggcaggtggaaatacgaatgttcagaacatgaacccaatgatggcccagatgcagatgagctctttgcagatgccaggaatgaacactgtgtgccctgagcagataaatgatcccgcactgagacacacaggcctctactgcaaccagctctcatccactgaccttctcaaaacagaagcagatggaacccaggacaagaagacagaagagttcttctctgtggtgactacagactagaggaatgctctacaggtgcaacaggttcaggtgtttgctgacgtccagtgtacagtgaatctggtaggcggggacccttacctgaaccagcctggtccactgggaactcaaaagcccacgtcaggaccacagaccccccaggcccagcagaagagcctccttcagcagctactgactgaataaccacttttaaaggaatgtgaaatttaaataatagacatacagagatatacaaatatattatatatttttctgagatttttgatatctcaatctgcagccattcttcaggtcgtagcatttggagcaaaaaaaaaaaaaaaaaaaaaaaaaaaggagtttgcttttgtcgggagattgaaagatgtttttgtttctttctttgtaaaggccttggatattgaaaaaataccaaggcagaacagttggacaatctatttcttgagccaaatttaattattcttatttttgtaatcagtcattggcttcttatctggatgaaggcttttggaggagaaccaaaacgacaagttccaagaagaagatgaagctccgcctccgccgcttagtcccaaccctgcccaggaagaagggcccgtggggctttgcctgtgcccgtccaccaaaggctgtcatgtgtctcgaaatcagcagccctccccatcccaatcccaggcagcttgtgtgtacaatcagcttctctagcaactctgtatctgttggcttcaagagaatattttgcctccacatatgtaccccttctcctttttttaaagatggatttaaaccaagatgcctccaggaaagaggacgaaatgagtatattcacagaggaatccaaaaaatacagtttgggggaaaatgcaataatttttgatgagatgggtgaaggacaagaagtgagttgtgtcaattattgtagatacaattttctgattaaatctggaaaaataaaaggcagcctgttttttctgcttttattgtattaacagctgaggtagctaaagttatttaaaataaaattaaatttatgatccaagtagcttatttttccctttaaatctcattgtaaatatatttgatttcttgtagaaattgatttccttctgtttaattttatgcttttattatactcttgatttttctaaatttgtgtgtgaaatataacattgattgaattgcagttacatttggttagtaatatttcattattttaataactgtgatgtcatgtatggatttactttggggttcaaatcaaaatgtcactgccagaaagagctgttccagctgatctagagcatactgccctagagtgtccctgggatcatctgaacagaagtgcacaggctacttgtacagagaaaaaattaatactcaaaggaaatcttcattttttagattgactttgggaatttgaattttcatcagtgcaaatataaatttctctatcctgctctgaggctaattggtaccatattttccctttgtgtcttgtgactctgccacatcccatctcatcctggcctctgagtcaagaacccagtgaactgactttctagttctagaagttccgctgcaaggccaggaaagcttgagaaaggtattgtggaagaagcaaaggtagacccccatcactcacctttgtctgcatccctgggcctgtgaatgatgacagcacctgacattctgcaccagctacctctgcctccatggcagagaaaaggccataagaacagtggaagaggagcatggactcagacttcaaggaagaagccatttccccaggtccttccttctgcatctcaccacccctagttacaaataactccattgaacagcatctattcagaaactatgccgaataaaaagattggtggaagggctcatgtggttagcaactatgaaacagaaataggacactcagttacaaacattatctcctttagtttttcagaaaatgcatccctgatttcattcatttccagcttgaaagccagccatattactctagtccctaccaaactgctctagaaggtcatttccattttgtttgtgatatttagacgcgcagacttcaggaagttcacctttaacttcagcattccagatgaagtttcctgactcagtgcttttgcataaggaactagaaaaaaaaagtaaggaaaattggagatgctaacatcctcccccatcccaactgcaccttaaaatatgcatgtcaccttcaaggttttataattgcactgtttgttttatgtatgtacagattaaaattattgctacatttgaggaaaataaaattgcttgcttctatgtaattcctgtcattccacaggaaattcacttttccagctactgaatagaatttgtttaacaacctcatgggttgcctcttcatttacagggaagaaatgaaatgtacatctgcagaaattgccaaagcccaaattaacgagtattataaaaggataataaagcatccctgaagcca

SEQ ID NO: 356165 - DNA, 4300 bp, Homo sapiens
gcgcccgctccaacatcagaatggtaactgtgctgccttctccagcgtgggcagtaactgatcaagctggagaaggcagcacagttgccaggcttatgtgagacagacaggatggatggtgcggtcaccagtgtaaccatcaaatcggagatcctgccagcttcacttcagtccgccactgccagacccacttccaggctaaatagattacctgagctggaattggaagcaattgataaccaatttggacaaccaggaacaggcgatcagattccatggacaaataatacagtgacagctataaatcagagtaaatcagaagaccagtgtattagctcacaattagatgagcttctctgtccacccacaacagtagaagggagaaatgatgagaaggctcttcttgaacagctggtatccttccttagtggcaaagatgaaactgagctagctgaactagacagagctctgggaattgacaaacttgttcaggggggtggattagatgtattatcagagagatttccaccacaacaagcaacgccacctttgatcatggaagaaagacccaacctttattcccagccttactcttctccttctcctactgccaatctccctagccctttccaaggcatggtcaggcaaaaaccttcactggggacgatgcctgttcaagtaacacctccccgaggtgctttttcacctggcatgggcatgcagcccaggcaaactctaaacagacctccggctgcacctaaccagcttcgacttcaactacagcagcgattacagggacaacagcagttgatacaccaaaatcggcaagctatcttaaaccagtttgcagcaactgctcctgttggcatcaatatgagatcaggcatgcaacagcaaattacacctcagccacccctgaatgctcaaatgttggcacaacgtcagcgggaactgtacagtcaacagcaccgacagaggcagctaatacagcagcaaagagccatgcttatgaggcagcaaagctttgggaacaacctccctccctcatctggactaccagttcaaatggggaacccccgtcttcctcagggtgctccacagcaattcccctatccaccaaactatggtacaaatccaggaaccccacctgcttctaccagcccgttttcacaactagcagcaaatcctgaagcatccttggccaaccgcaacagcatggtgagcagaggcatgacaggaaacataggaggacagtttggcactggaatcaatcctcagatgcagcagaatgtcttccagtatccaggagcaggaatggttccccaaggtgaggccaactttgctccatctctaagccctgggagctccatggtgccgatgccaatccctcctcctcagagttctctgctccagcaaactccacctgcctccgggtatcagtcaccagacatgaaggcctggcagcaaggagcgataggaaacaacaatgtgttcagtcaagctgtccagaaccagcccacgcctgcacagccaggagtatacaacaacatgagcatcaccgtttccatggcaggtggaaatacgaatgttcagaacatgaacccaatgatggcccagatgcagatgagctctttgcagatgccaggaatgaacactgtgtgccctgagcagataaatgatcccgcactgagacacacaggcctctactgcaaccagctctcatccactgaccttctcaaaacagaagcagatggaacccaggacaagaagacagaagagttcttctctgtggtgactacagactagaggaatgctctacaggtgcaacaggttcaggtgtttgctgacgtccagtgtacagtgaatctggtaggcggggacccttacctgaaccagcctggtccactgggaactcaaaagcccacgtcaggaccacagaccccccaggcccagcagaagagcctccttcagcagctactgactgaataaccacttttaaaggaatgtgaaatttaaataatagacatacagagatatacaaatatattatatatttttctgagatttttgatatctcaatctgcagccattcttcaggtcgtagcatttggagcaaaaaaaaaaaaaaaaaaaaaaaaaaaggagtttgcttttgtcgggagattgaaagatgtttttgtttctttctttgtaaaggccttggatattgaaaaaataccaaggcagaacagttggacaatctatttcttgagccaaatttaattattcttatttttgtaatcagtcattggcttcttatctggatgaaggcttttggaggagaaccaaaacgacaagttccaagaagaagatgaagctccgcctccgccgcttagtcccaaccctgcccaggaagaagggcccgtggggctttgcctgtgcccgtccaccaaaggctgtcatgtgtctcgaaatcagcagccctccccatcccaatcccaggcagcttgtgtgtacaatcagcttctctagcaactctgtatctgttggcttcaagagaatattttgcctccacatatgtaccccttctcctttttttaaagatggatttaaaccaagatgcctccaggaaagaggacgaaatgagtatattcacagaggaatccaaaaaatacagtttgggggaaaatgcaataatttttgatgagatgggtgaaggacaagaagtgagttgtgtcaattattgtagatacaattttctgattaaatctggaaaaataaaaggcagcctgttttttctgcttttattgtattaacagctgaggtagctaaagttatttaaaataaaattaaatttatgatccaagtagcttatttttccctttaaatctcattgtaaatatatttgatttcttgtagaaattgatttccttctgtttaattttatgcttttattatactcttgatttttctaaatttgtgtgtgaaatataacattgattgaattgcagttacatttggttagtaatatttcattattttaataactgtgatgtcatgtatggatttactttggggttcaaatcaaaatgtcactgccagaaagagctgttccagctgatctagagcatactgccctagagtgtccctgggatcatctgaacagaagtgcacaggctacttgtacagagaaaaaattaatactcaaaggaaatcttcattttttagattgactttgggaatttgaattttcatcagtgcaaatataaatttctctatcctgctctgaggctaattggtaccatattttccctttgtgtcttgtgactctgccacatcccatctcatcctggcctctgagtcaagaacccagtgaactgactttctagttctagaagttccgctgcaaggccaggaaagcttgagaaaggtattgtggaagaagcaaaggtagacccccatcactcacctttgtctgcatccctgggcctgtgaatgatgacagcacctgacattctgcaccagctacctctgcctccatggcagagaaaaggccataagaacagtggaagaggagcatggactcagacttcaaggaagaagccatttccccaggtccttccttctgcatctcaccacccctagttacaaataactccattgaacagcatctattcagaaactatgccgaataaaaagattggtggaagggctcatgtggttagcaactatgaaacagaaataggacactcagttacaaacattatctcctttagtttttcagaaaatgcatccctgatttcattcatttccagcttgaaagccagccatattactctagtccctaccaaactgctctagaaggtcatttccattttgtttgtgatatttagacgcgcagacttcaggaagttcacctttaacttcagcattccagatgaagtttcctgactcagtgcttttgcataaggaactagaaaaaaaaagtaaggaaaattggagatgctaacatcctcccccatcccaactgcaccttaaaatatgcatgtcaccttcaaggttttataattgcactgtttgttttatgtatgtacagattaaaattattgctacatttgaggaaaataaaattgcttgcttctatgtaattcctgtcattccacaggaaattcacttttccagctactgaatagaatttgtttaacaacctcatgggttgcctcttcatttacagggaagaaatgaaatgtacatctgcagaaattgccaaagcccaaattaacgagtattataaaaggataataaagcatccctgaagcca

SEQ ID NO: 356166 - DNA, 6998 bp, Homo sapiens
tttttctatttcaagaagttattcataatataaagtagttccaaatgtaactgctgtgtttattacttgtttgcttttactatctagtaattgttatttgaaaatattcaagatgtatatatgattggggaaatacatctgttatagcagtcaatttactttatatattttagccagaattgttttctaaattttggtattttgtaatgtccactttttagatgtgaatttatatcactttctaaatctggttttatattttcgataaaaataaagatctcactaaatgtgtaagcatagatacttgatcagagaaggaaatatggtgatacaaatgtacactaactggattttctttgtgtaacagcacggaaaagaggcgcagggagcaagaaaataaatatttagaagaactagctgagttactgtctgccaacattagtgacattgacagcttgagtgtaaaaccagacaaatgcaagattttgaagaaaacagtcgatcagatacagctaatgaagagaatggaacaagagaaatcaacaactgatgacgatgtacagaaatcagacatctcatcaagtagtcaaggagtgatagaaaaggaatccttgggacctcttcttttggaggctttggatggatttttctttgttgtgaactgtgaagggagaattgtatttgtgtcagagaatgtaaccagctacttaggttacaatcaggaggaattaatgaataccagcgtctacagcatactgcacgtgggggatcatgcagaatttgtgaagaatctgctaccaaaatcactagtaaatggagttccttggcctcaagaggcaacacgacgaaatagccatacctttaactgcaggatgctaattcaccctccagatgagccagggaccgagaaccaagaagcttgccagcgttatgaagtaatgcagtgtttcactgtgtcacagccaaaatcaattcaagaggatggagaagatttccagtcatgtctgatttgtattgcacggcgattacctcggcctccagctattacgggtgtagaatcctttatgaccaagcaagatactacaggtaaaatcatctctattgatactagttccctgagagctgctggcagaactggttgggaagatttagtgaggaagtgcatttatgcttttttccaacctcagggcagagaaccatcttatgccagacagctgttccaagaagtgatgactcgtggcactgcctccagcccctcctatagattcatattgaatgatgggacaatgcttagcgcccacaccaagtgtaaactttgctaccctcaaagtccagacatgcaacctttcatcatgggaattcatatcatcgacagggagcacagtgggctttctcctcaagatgacactaattctggaatgtcaattccccgagtaaatccctcggtcaatcctagtatctctccagctcatggtgtggctcgttcatccacattgccaccatccaacagcaacatggtatccaccagaataaaccgccagcagagctcagaccttcatagcagcagtcatagtaattctagcaacagccaaggaagtttcggatgctcacccggaagtcagattgtagccaatgttgccttaaaccaaggacaggccagttcacagagcagtaatccctctttaaacctcaataattctcctatggaaggtacaggaatatccctagcacagttcatgtctccaaggagacaggttacttctggattggcaacaaggcccaggatgccaaacaattcctttcctcctaatatttcgacattaagctctcccgttggcatgacaagtagtgcctgtaataataataaccgatcttattcaaacatcccagtaacatctttacagggtatgaatgaaggacccaataactccgttggcttctctgccagttctccagtcctcaggcagatgagctcacagaattcacctagcagattaaatatacaaccagcaaaagctgagtccaaagataacaaagagattgcctcaattttaaatgaaatgattcaatctgacaacagctctagtgatggcaaacctctggattcagggcttctgcataacaatgacagactttcagatggagacagtaaatactctcaaaccagtcacaaactagtgcagcttttgacaacaactgccgaacagcagttacggcatgctgatatagacacaagctgcaaagatgtcctgtcttgcacaggcacttccaactctgcctctgctaactcttcaggaggttcttgtccctcttctcatagctcattgacagaacggcataaaattctacaccggctcttacaggagggtagcccctcagatatcaccactttgtctgtcgagcctgataaaaaggacagtgcatctacttctgtgtcagtgactggacaggtacaaggaaactccagtataaaactagaactggatgcttcaaagaaaaaagaatcaaaagaccatcagctcctacgctatcttttagataaagatgagaaagatttaagatcaactccaaacctgagcctggatgatgtaaaggtgaaagtggaaaagaaagaacagatggatccatgtaatacaaacccaaccccaatgaccaaacccactcctgaggaaataaaactggaggcccagagccagtttacagctgaccttgaccagtttgatcagttactgcccacgctggagaaggcagcacagttgccaggcttatgtgagacagacaggatggatggtgcggtcaccagtgtaaccatcaaatcggagatcctgccagcttcacttcagtccgccactgccagacccacttccaggctaaatagattacctgagctggaattggaagcaattgataaccaatttggacaaccaggaacaggcgatcagattccatggacaaataatacagtgacagctataaatcagagtaaatcagaagaccagtgtattagctcacaattagatgagcttctctgtccacccacaacagtagaagggagaaatgatgagaaggctcttcttgaacagctggtatccttccttagtggcaaagatgaaactgagctagctgaactagacagagctctgggaattgacaaacttgttcaggggggtggattagatgtattatcagagagatttccaccacaacaagcaacgccacctttgatcatggaagaaagacccaacctttattcccagccttactcttctccttctcctactgccaatctccctagccctttccaaggcatggtcaggcaaaaaccttcactggggacgatgcctgttcaagtaacacctccccgaggtgctttttcacctggcatgggcatgcagcccaggcaaactctaaacagacctccggctgcacctaaccagcttcgacttcaactacagcagcgattacagggacaacagcagttgatacaccaaaatcggcaagctatcttaaaccagtttgcagcaactgctcctgttggcatcaatatgagatcaggcatgcaacagcaaattacacctcagccacccctgaatgctcaaatgttggcacaacgtcagcgggaactgtacagtcaacagcaccgacagaggcagctaatacagcagcaaagagccatgcttatgaggcagcaaagctttgggaacaacctccctccctcatctggactaccagttcaaatggggaacccccgtcttcctcagggtgctccacagcaattcccctatccaccaaactatggtacaaatccaggaaccccacctgcttctaccagcccgttttcacaactagcagcaaatcctgaagcatccttggccaaccgcaacagcatggtgagcagaggcatgacaggaaacataggaggacagtttggcactggaatcaatcctcagatgcagcagaatgtcttccagtatccaggagcaggaatggttccccaaggtgaggccaactttgctccatctctaagccctgggagctccatggtgccgatgccaatccctcctcctcagagttctctgctccagcaaactccacctgcctccgggtatcagtcaccagacatgaaggcctggcagcaaggagcgataggaaacaacaatgtgttcagtcaagctgtccagaaccagcccacgcctgcacagccaggagtatacaacaacatgagcatcaccgtttccatggcaggtggaaatacgaatgttcagaacatgaacccaatgatggcccagatgcagatgagctctttgcagatgccaggaatgaacactgtgtgccctgagcagataaatgatcccgcactgagacacacaggcctctactgcaaccagctctcatccactgaccttctcaaaacagaagcagatggaacccaggacaagaagacagaagagttcttctctgtggtgactacagactagaggaatgctctagtgagtttccacttcaagtagtacccactcataagccgggggggcagacccttctgtctaaacacatcttttatttgtgttccagcaggtgcaacaggttcaggtgtttgctgacgtccagtgtacagtgaatctggtaggcggggacccttacctgaaccagcctggtccactgggaactcaaaagcccacgtcaggaccacagaccccccaggcccagcagaagagcctccttcagcagctactgactgaataaccacttttaaaggaatgtgaaatttaaataatagacatacagagatatacaaatatattatatatttttctgagatttttgatatctcaatctgcagccattcttcaggtcgtagcatttggagcaaaaaaaaaaaaaaaaaataaaggccttggatattgaaaaaataccaaggcagaacagttggacaatctatttcttgagccaaatttaattattcttatttttgtaatcagtcattggcttcttatctggatgaaggcttttggaggagaaccaaaacgacaagttccaagaagaagatgaagctccgcctccgccgcttagtcccaaccctgcccaggaagaagggcccgtggggctttgcctgtgcccgtccaccaaaggctgtcatgtgtctcgaaatcagcagccctccccatcccaatcccaggcagcttgtgtgtacaatcagcttctctagcaactctgtatctgttggcttcaagagaatattttgcctccacatatgtaccccttctcctttttttaaagatggatttaaaccaagatgcctccaggaaagaggacgaaatgagtatattcacagaggaatccaaaaaatacagtttgggggaaaatgcaataatttttgatgagatgggtgaaggacaagaagtgagttgtgtcaattattgtagatacaattttctgattaaatctggaaaaataaaaggcagcctgttttttctgcttttattgtattaacagctgaggtagctaaagttatttaaaataaaattaaatttatgatccaagtagcttatttttccctttaaatctcattgtaaatatatttgatttcttgtagaaattgatttccttctgtttaattttatgcttttattatactcttgatttttctaaatttgtgtgtgaaatataacattgattgaattgcagttacatttggttagtaatatttcattattttaataactgtgatgtcatgtatggatttactttggggttcaaatcaaaatgtcactgccagaaagagctgttccagctgatctagagcatactgccctagagtgtccctgggatcatctgaacagaagtgcacaggctacttgtacagagaaaaaattaatactcaaaggaaatcttcattttttagattgactttgggaatttgaattttcatcagtgcaaatataaatttctctatcctgctctgaggctaattggtaccatattttccctttgtgtcttgtgactctgccacatcccatctcatcctggcctctgagtcaagaacccagtgaactgactttctagttctagaagttccgctgcaaggccaggaaagcttgagaaaggtattgtggaagaagcaaaggtagacccccatcactcacctttgtctgcatccctgggcctgtgaatgatgacagcacctgacattctgcaccagctacctctgcctccatggcagagaaaaggccataagaacagtggaagaggagcatggactcagacttcaaggaagaagccatttccccaggtccttccttctgcatctcaccacccctagttacaaataactccattgaacagcatctattcagaaactatgccgaataaaaagattggtggaagggctcatgtggttagcaactatgaaacagaaataggacactcagttacaaacattatctcctttagtttttcagaaaatgcatccctgatttcattcatttccagcttgaaagccagccatattactctagtccctaccaaactgctctagaaggtcatttccattttgtttgtgatatttagacgcgcagacttcaggaagttcacctttaacttcagcattccagatgaagtttcctgactcagtgcttttgcataaggaactagaaaaaaaaagtaaggaaaattggagatgctaacatcctcccccatcccaactgcaccttaaaatatgcatgtcaccttcaaggttttataattgcactgtttgttttatgtatgtacagattaaaattattgctacatttgaggaaaataaaattgcttgcttctatgtaattcctgtcattccacaggaaattcacttttccagctactgaatagaatttgtttaacaacctcatgggttgcctcttcatttacagggaagaaatgaaatgtacatctgcagaaattgccaaagcccaaattaacgagtattataaaaggataataaagcatccctgaagcca

SEQ ID NO: 356167 - DNA, 3249 bp, Homo sapiens
tttttctatttcaagaagttattcataatataaagtagttccaaatgtaactgctgtgtttattacttgtttgcttttactatctagtaattgttatttgaaaatattcaagatgtatatatgattggggaaatacatctgttatagcagtcaatttactttatatattttagccagaattgttttctaaattttggtattttgtaatgtccactttttagatgtgaatttatatcactttctaaatctggttttatattttcgataaaaataaagatctcactaaatgtgtaagcatagatacttgatcagagaaggaaatatggtgatacaaatgtacactaactggattttctttgtgtaacagcacggaaaagaggcgcagggagcaagaaaataaatatttagaagaactagctgagttactgtctgccaacattagtgacattgacagcttgagtgtaaaaccagacaaatgcaagattttgaagaaaacagtcgatcagatacagctaatgaagagaatggaacaagagaaatcaacaactgatgacgatgtacagaaatcagacatctcatcaagtagtcaaggagtgatagaaaaggaatccttgggacctcttcttttggaggctttggatggatttttctttgttgtgaactgtgaagggagaattgtatttgtgtcagagaatgtaaccagctacttaggttacaatcaggaggaattaatgaataccagcgtctacagcatactgcacgtgggggatcatgcagaatttgtgaagaatctgctaccaaaatcactagtaaatggagttccttggcctcaagaggcaacacgacgaaatagccatacctttaactgcaggatgctaattcaccctccagatgagccagggaccgagaaccaagaagcttgccagcgttatgaagtaatgcagtgtttcactgtgtcacagccaaaatcaattcaagaggatggagaagatttccagtcatgtctgatttgtattgcacggcgattacctcggcctccagctattacgggtgtagaatcctttatgaccaagcaagatactacaggtaaaatcatctctattgatactagttccctgagagctgctggcagaactggttgggaagatttagtgaggaagtgcatttatgcttttttccaacctcagggcagagaaccatcttatgccagacagctgttccaagaagtgatgactcgtggcactgcctccagcccctcctatagattcatattgaatgatgggacaatgcttagcgcccacaccaagtgtaaactttgctaccctcaaagtccagacatgcaacctttcatcatgggaattcatatcatcgacagggagcacagtgggctttctcctcaagatgacactaattctggaatgtcaattccccgagtaaatccctcggtcaatcctagtatctctccagctcatggtgtggctcgttcatccacattgccaccatccaacagcaacatggtatccaccagaataaaccgccagcagagctcagaccttcatagcagcagtcatagtaattctagcaacagccaaggaagtttcggatgctcacccggaagtcagattgtagccaatgttgccttaaaccaaggacaggccagttcacagagcagtaatccctctttaaacctcaataattctcctatggaaggtacaggaatatccctagcacagttcatgtctccaaggagacaggttacttctggattggcaacaaggcccaggatgccaaacaattcctttcctcctaatatttcgacattaagctctcccgttggcatgacaagtagtgcctgtaataataataaccgatcttattcaaacatcccagtaacatctttacagggtatgaatgaaggacccaataactccgttggcttctctgccagttctccagtcctcaggcagatgagctcacagaattcacctagcagattaaatatacaaccagcaaaagctgagtccaaagataacaaagagattgcctcaattttaaatgaaatgattcaatctgacaacagctctagtgatggcaaacctctggattcagggcttctgcataacaatgacagactttcagatggagacagtaaatactctcaaaccagtcacaaactagtgcagcttttgacaacaactgccgaacagcagttacggcatgctgatatagacacaagctgcaaagatgtcctgtcttgcacaggcacttccaactctgcctctgctaactcttcaggaggttcttgtccctcttctcatagctcattgacagaacggcataaaattctacaccggctcttacaggagggtagcccctcagatatcaccactttgtctgtcgagcctgataaaaaggacagtgcatctacttctgtgtcagtgactggacaggtacaaggaaactccagtataaaactagaactggatgcttcaaagaaaaaagaatcaaaagaccatcagctcctacgctatcttttagataaagatgagaaagatttaagatcaactccaaacctgagcctggatgatgtaaaggtgaaagtggaaaagaaagaacagatggatccatgtaatacaaacccaaccccaatgaccaaacccactcctgaggaaataaaactggaggcccagagccagtttacagctgaccttgaccagtttgatcagttactgcccacgctggagaaggcagcacagttgccaggcttatgtgagacagacaggatggatggtgcggtcaccagtgtaaccatcaaatcggagatcctgccagcttcacttcagtccgccactgccagacccacttccaggctaaatagtatgttctggggacaacacctcattttaaacgtttagtgataatgtggattagcattttgtctctcaccagtattacacagatcctttgcttaagagtgaaatatctttttattaatgccactataaataataaaacagttatatttaggcatgtgaacatcattcatcatgtgtattttaaattatgacctctatccttttgtaattaatgttaaggtgagcaattgatgttaaggagaacaattttgtcgtctcacccaaaacaccccataacaggactttcagaaatacagtattgggtcagattgtttccagatatcttccttgaaaactaatcctgtgagttgcagaaataaaagattctgtacta

SEQ ID NO: 356168 - DNA, 484 bp, Homo sapiens
gctttgattctctgctggataagaagatcacctctgtggcaccagctgccggcaaagctgcttgtcgatgtccccacagaagctgcacagaggaaacgacttggcaagtggctgcaagaccagcagaatccctggttgcccagtgtctcctgccatgcatgttttactctaagcaggctgccttccgcaacaaccacgtggagtggcccctgaatgacacctggagtgaaaacttcatggaaagcaacgtccaccctcccttcttctctcattgcttctttctatttgacgtggccttaaggaagctcacgttatcccataacagaaggcagtggtgatggtaggggtgagggtagggatacgcatgagaatcaatatttgtaaatgaaacagcgttgtcctcttagtattctcagtaatagaatccgcctgttcacccgagctcctacgcaaatataggatcatctgagcgtggtttctctgt

SEQ ID NO: 356169 - DNA, 554 bp, Homo sapiens
aggtgcagttcccacttccgcctctttcttccctttcctgttaggcgagagctgcgaaaggcgagagctgcgaagggccaggtgtcgggcgctgtttctcgttttcatcatatagacaaaacagccctgctgcaaagatggtcaacgtacctaaaacccgaagaaccttctgtaagaagtgtggcaagcatcagcctcacaaagtgacacagtataagaagggcaaggattctttgtatgcccagggaaggaggcgctatgatcggaagcagagtggctatggtgggcagacaaagccaattttccggaagaaggctaagaccacaaagaagattgtgctaaggctggaatgtgttgagcctaactgcagatccaagaggatgctggccattaagagatgcaagcattttgaactgggaggagataagaagagaaagggccaagtgatccagttctaaactttgggatatttttcttcaattttgaagagaaaatggtgaagccatagaaaagttacccgagggaaaataaatacagtgatattcttacgcaaa

SEQ ID NO: 356170 - DNA, 546 bp, Homo sapiens
aaactagttagtacgaggctgggtgtgaattcggccgcgagagctgcgaaaggcgagagctgcgaagggccaggtgtcgggcgctgtttctcgttttcatcatatagacaaaacagccctgctgcaaagatggtcaacgtacctaaaacccgaagaaccttctgtaagaagtgtggcaagcatcagcctcacaaagtgacacagtataagaagggcaaggattctttgtatgcccagggaaggaggcgctatgatcggaagcagagtggctatggtgggcagacaaagccaattttccggaagaaggctaagaccacaaagaagattgtgctaaggctggaatgtgttgagcctaactgcagatccaagaggatgctggccattaagagatgcaagcattttgaactgggaggagataagaagagaaagggccaagtgatccagttctaaactttgggatatttttcttcaattttgaagagaaaatggtgaagccatagaaaagttacccgagggaaaataaatacagtgatattcttacgcaaa

SEQ ID NO: 356171 - DNA, 590 bp, Homo sapiens
aggtgcagttcccacttccgcctctttcttccctttcctgttaggcgagagctgcgaaaggcgagagctgcgaagggccaggtgtcgggcgctgtttctcgttttcatcatatagacaaaacagccctgctgcaaagatggtcaacgtacctaaaacccgaagaaccttctgtaagaagtgtggcaagcatcagcctcacaaagtgacacagtataagaagggcaaggattctttgtatgcccagggaaggaggcgctatgatcggaagcagagtggctatggtgggcagacaaagccaattttccggaagaaggctaagaccacaaagaagattgtgctaaggctggaatgtgttgagcctaactgcagatccaagaggatgctggccattaagagatgcaagcattttgaactgggaggagataagaagagaaagggccaagtgatccagttctaaactttgggatatttttcttcaattttgaagagaaaatggtgaagccatagaaaagttacccgagggaaaataaatacagtgatattcttacgcaaaaaaaaaacagacaacaactaaacactaccacaaaaa

SEQ ID NO: 356172 - DNA, 500 bp, Homo sapiens
gactagttctagatcgcgagcggccaggtgtcgggcgctgtttctcgttttcatcatatagacaaaacagccctgctgcaaagatggtcaacgtacctaaaacccgaagaaccttctgtaagaagtgtggcaagcatcagcctcacaaagtgacacagtataagaagggcaaggattctttgtatgcccagggaaggaggcgctatgatcggaagcagagtggctatggtgggcagacaaagccaattttccggaagaaggctaagaccacaaagaagattgtgctaaggctggaatgtgttgagcctaactgcagatccaagaggatgctggccattaagagatgcaagcattttgaactgggaggagataagaagagaaagggccaagtgatccagttctaaactttgggatatttttcttcaattttgaagagaaaatggtgaagccatagaaaagttacccgagggaaaataaatacagtgatattcttacgcaaa

SEQ ID NO: 356173 - DNA, 672 bp, Homo sapiens
aggtgcagttcccacttccgcctctttcttccctttcctgttaggcgagagctgcgaaaggcgagagctgcgaagggccaggtgtcgggcgctgtttctcgttttcatcatatagacaaaacagccctgctgcaaagatggtcaacgtacctaaaacccgaagaaccttctgtaagaagtgtggcaagcatcagcctcacaaagtgacacagtataagaagggcaaggattctttgtatgcccagggaaggaggcgctatgatcggaagcagagtggctatggtgggcagacaaagccaattttccggaagaaggctaagaccacaaagaagattgtgctaaggctggaatgtgttgagcctaactgcagatccaagaggatgctggccattaagagatgcaagcattttgaactgggaggagataagaagagaaagggccaagtgatccagttctaaactttgggatatttttcttcaattttgaagagaaaatggtgaagccatagaaaagttacccgagggaaaataaatacagtgatattcttacgcaaaaaatatattattttttttattatttatatattaatttttaatttataattattttttttttttatttttttattaataattattttaatatatttttttattaatttatttccttttc

SEQ ID NO: 356174 - DNA, 813 bp, Homo sapiens
  misc_feature (557)..(557): n is a, c, g, or t
aggtgcagttcccacttccgcctctttcttccctttcctgttaggcgagagctgcgaaaggcgagagctgcgaagggccaggtgtcgggcgctgtttctcgttttcatcatatagacaaaacagccctgctgcaaagatggtcaacgtacctaaaacccgaagaaccttctgtaagaagtgtggcaagcatcagcctcacaaagtgacacagtataagaagggcaaggattctttgtatgcccagggaaggaggcgctatgatcggaagcagagtggctatggtgggcagacaaagccaattttccggaagaaggctaagaccacaaagaagattgtgctaaggctggaatgtgttgagcctaactgcagatccaagaggatgctggccattaagagatgcaagcattttgaactgggaggagataagaagagaaagggccaagtgatccagttctaaactttgggatatttttcttcaattttgaagagaaaatggtgaagccatagaaaagttacccgagggaaaataaatacagtgatattcttacgcaaaaangaaaagcaccactcatgtacattacacctatttcttccgcgcgtcctcctatgcacataaaaccttggcatcaccaccggtttggcctcgagcccacagtaggtacgtgaaacctgcgccatcgttggccaagaagacctggggcaaagacaagggggggattccaccgattagaaaccgcggggcaaccggttttggacaaccagaggagtccgggcatacggtccttacggagcaagagctgaacggcgcggag

SEQ ID NO: 356175 - DNA, 1193 bp, Homo sapiens
aggtgcagttcccacttccgcctctttcttccctttcctgttaggcgagagctgcgaaaggcgagagctgcgaagggccaggtgtcgggcgctgtttctcgttttcatcatatagacaaaacagccctgctgcaaagatggtcaacgtacctaaaacccgaagaaccttctgtaagaagtgtggcaagcatcagcctcacaaagtgacacagtataagaagggcaaggattctttgtatgcccagggaaggaggcgctatgatcggaagcagagtggctatggtgggcagacaaagccaattttccggaagaaggctaagaccacaaagaagattgtgctaaggctggaatgtgttgagcctaactgcagatccaagaggatgctggccattaagagatgcaagcattttgaactgggaggagataagaagagaaagggccaagtgatccagttctaaactttgggatatttttcttcaattttgaagagaaaatggtgaagccatagaaaagttacccgagggaaaataaatacagtgatattcttacgcaaaaaaacaaaaaaacaacgaacaaacaacacaacctgttgtggcgccggcatcggagcactcggaaaaacggtccaagaacacaccacgtagggagcagggcccacaagagggacaggctaaccacgggggcaaaagagcggaacccaaaggaacccagggggcgagaaaaccgagggcatggggaatctcagacccacaataaaccaaaacgaccaggggggggaacacacaagaaggcgttctggaaaaacaacaccacaaaagagggactccgaggagggaaacaccagaggggaaaccataaccacagggcaagtacaaagaggagaacagacaaaaaataacaaaaatagaaaccccacaaacacgatggagacacacaaacagaacacgaagaaaaacaacacaccaaccaccgaacaaagcagaagcacaaggagaggaaaggacaggaggaaacaacagaatgacacgaagagaacgagaacgaaacagcacgaacaaagagcaacccaagagaaacgaccgagacaaacacggggcgaggaagacaacaggccacgccgaacagagaagagagcagaccccaaccaacgacgcgacgagaggaaacaagaacgagaaacaagacgacgcgga

SEQ ID NO: 356176 - DNA, 758 bp, Homo sapiens
  misc_feature (637)..(637): n is a, c, g, or t
  misc_feature (691)..(691): n is a, c, g, or t
  misc_feature (712)..(712): n is a, c, g, or t
aggtgcagttcccacttccgcctctttcttccctttcctgttaggcgagagctgcgaaaggcgagagctgcgaagggccaggtgtcgggcgctgtttctcgttttcatcatatagacaaaacagccctgctgcaaagatggtcaacgtacctaaaacccgaagaaccttctgtaagaagtgtggcaagcatcagcctcacaaagtgacacagtataagaagggcaaggattctttgtatgcccagggaaggaggcgctatgatcggaagcagagtggctatggtgggcagacaaagccaattttccggaagaaggctaagaccacaaagaagattgtgctaaggctggaatgtgttgagcctaactgcagatccaagaggatgctggccattaagagatgcaagcattttgaactgggaggagataagaagagaaagggccaagtgatccagttctaaactttgggatatttttcttcaattttgaagagaaaatggtgaagccatagaaaagttacccgagggaaaataaatacagtgatattcttacgcaaactcgtgccgaatttcgcacgagggcatggcgttcacgcttctctgagtaccgagcgtacaggtcaattatcaaagactacttncaccgtggcgccaagtggacaacagctcctaaagccacaatggctgatgagctntataaccaagattattccatncactctgtagaagacagacacaaattggttgtcaaggaactgggag

SEQ ID NO: 356177 - DNA, 647 bp, Homo sapiens
  misc_feature (619)..(619): n is a, c, g, or t
  misc_feature (628)..(628): n is a, c, g, or t
  misc_feature (634)..(634): n is a, c, g, or t
aggtgcagttcccacttccgcctctttcttccctttcctgttaggcgagagctgcgaaaggcgagagctgcgaagggccaggtgtcgggcgctgtttctcgttttcatcatatagacaaaacagccctgctgcaaagatggtcaacgtacctaaaacccgaagaaccttctgtaagaagtgtggcaagcatcagcctcacaaagtgacacagtataagaagggcaaggattctttgtatgcccagggaaggaggcgctatgatcggaagcagagtggctatggtgggcagacaaagccaattttccggaagaaggctaagaccacaaagaagattgtgctaaggctggaatgtgttgagcctaactgcagatccaagaggatgctggccattaagagatgcaagcattttgaactgggaggagataagaagagaaagggccaagtgatccagttctaaactttgggatatttttcttcaattttgaagagaaaatggtgaagccatagaaaagttacccgagggaaaataaatacagtgatattcttacgcaaaaaaaaaaaaaaaagaaaaaaaaaaaaactttgttgggggcgcttgggccctggaaaaggtttttnaaacccttncggttngggcgcggggccc

SEQ ID NO: 356178 - DNA, 593 bp, Homo sapiens
  misc_feature (565)..(565): n is a, c, g, or t
  misc_feature (574)..(574): n is a, c, g, or t
  misc_feature (580)..(580): n is a, c, g, or t
gactagttctagatcgcgagcggccaggtgtcgggcgctgtttctcgttttcatcatatagacaaaacagccctgctgcaaagatggtcaacgtacctaaaacccgaagaaccttctgtaagaagtgtggcaagcatcagcctcacaaagtgacacagtataagaagggcaaggattctttgtatgcccagggaaggaggcgctatgatcggaagcagagtggctatggtgggcagacaaagccaattttccggaagaaggctaagaccacaaagaagattgtgctaaggctggaatgtgttgagcctaactgcagatccaagaggatgctggccattaagagatgcaagcattttgaactgggaggagataagaagagaaagggccaagtgatccagttctaaactttgggatatttttcttcaattttgaagagaaaatggtgaagccatagaaaagttacccgagggaaaataaatacagtgatattcttacgcaaaaaaaaaaaaaaaagaaaaaaaaaaaaactttgttgggggcgcttgggccctggaaaaggtttttnaaacccttncggttngggcgcggggccc

SEQ ID NO: 356179 - DNA, 488 bp, Homo sapiens
aaactagttagtacgaggctgggtgtgaattcggccgcgagagctgcgaaaggcgagagctgcgaagggccaggtgtcgggcgctgtttctcgttttcatcatatagacaaaacagccctgctgcaaagatggtcaacgtacctaaaacccgaagaaccttctgtaagaagtgtggcaagcatcagcctcacaaagtgacacagtataagaagggcaaggattctttgtatgcccagggaaggaggcgctatgatcggaagcagagtggctatggtgggcagacaaagccaattttccggaagaaggctaagaccacaaagaagattgtgctaaggctggaatgtgttgagcctaactgcagatccaagaggatgctggccattaagagatgcaagcattttgaactgggaggagataagaagagaaagggccaagtgatccagttctaaactttgggaaaataaatacagtgatattcttacgcaaa

SEQ ID NO: 356180 - DNA, 192 bp, Homo sapiens
gtaagctaagaacgaggctgtagcggctccaataggagcctcccttgctcagaatcctgggtaggactaggccttcttaggaaagggaaggcgagacctatggccctcgccggccttagttcgagagcaggcttctcccttcaggaaaaaggtctcaggcatggcggctatagaatcgcggggcgcgccggc

SEQ ID NO: 356181 - DNA, 896 bp, Homo sapiens
tgctgagcactcgcccacctgtccactagcgggtctctatgtctggagctcttagagataagacatagaggtgtctggttctgagaaaaggaagtttgctaagtgagagacacaactgactcaactgactcagaaaactgattatattcctggtccctgaacgatcctatagagacatccagtccctgactccacctgcctccaggtgcccagaacagcccatcgtggggacttcaccctcagcaagtggacgccgtttgtcctgccagggcaggatggagatggatggggacccgtataacctgcctgcccaggggcaaggcaatatcatcattactaagtatgagcagggacaccgagctggggcagcagtggacttggggcatgagcaggttgatgtcagaaaatacaccaataacctcgggattgtgcatgagatggagctgccccgcgtcagtgccctggaggtgaagcaaagacgcaaggaaagtaaacgtaccaacaagtggcaaaagatgcttgcagactggacaaaatataggagcaccaagaagctgtctcaaagagtatacaaagtcattcccctggcggtacggggccgggcgtggtcacttttgctagatattgacagaatcaagtcccagaacccaggcaaatataaggtaagtccctcccacactcagctaggagtacaaacaagctagactgtatcaggagcccaggactccagctggagggaacgttgagcctgggttgggagtgggggctgtggtcagacgcacatcctgggcatagatggtaactcaggcaccacaggtgcgctgggctctgctgaccctccctggtgtcagaaacaaggtaaaaaggagctttctgcagaaggaaaccttccttcc

SEQ ID NO: 356182 - DNA, 4247 bp, Homo sapiens
  misc_feature (2722)..(2722): n is a, c, g, or t
gctggccaaagaagttcgtcccctttgtgaggcccgggatgggaggtgcccggttcccccagggacagcttcaagcggtagggacagacatctgaggacccagcctcagggatgctgtccccgggcttccaggctccagcgccgtaggactgaggcagactccacggtgagaaagagacccgatctaacccaggcctttcatcagagcccaggagggaaggcaggaagtgggaccacgaggcccggggggcttctaactcgtctggccagggagatctgaattggggtgaagagcagaatctccagaacaaggaggaggtggtgatcatggagacagatttggctgaaatgcctgagaaaggagctctgtcttcccaggattctccccatttccaagagaagagcacagaagagggagaagtggctgctctgcgcctcacggccagatcccaggaaacagtgacattcaaggatgtggccatggactttacaccagaggagtgggggaagctggatcctgcacaaagggatgtgatgctggagaactataggaacctagtctcactttggcttccagtttccaaacctgagagctacaacttggagaatggaaaagaaccattgaagcttgagagaaaagcccccaaaagcagctattcagaactgcctttttgttgagcacagaaaacgaaggaaatttgcatttccaatgtctttcagacatggagactagaccacagagcaaggattcaacttcagtgcaagatttttccaaagcagaatcatgcaaagttgcaataatagacagactgacacggaatagtgtctatgactctaacttggaagcagcccttgaatgtgaaaattggttagagaatcagcaaggaaatcaggagagacatttgagagaaatgttcactcacatgaattcactctctgaggaaacagaccataagcatgatgtatactggaaaagcttcaatcagaaatctgtccttatcactgaagacagagttcccaaaggatcttatgccttccatacacttgaaaaaagcttgaaacaaaaatcaaacttaatgaaaaagcagagaacttataaagagaaaaaacctcataaatgtaatgattgtggtgaactcttcacctaccattcagtgcttattcgacaccagagagtccatactggagagaaaccctatacctgcaatgaatgtgggaaatcttttagccacagagctaatttaactaaacaccagagaactcatactagaattctctttgaatgcagtgaatgcaagaaaaccttcacagaaagctcatcccttgcaacacatcagagaattcacgttggagagagaccttatgaatgcaatgaatgtgggaaaggttttaatcgaagtacacatcttgtgcagcatcagttgattcatactggagtgaagccttatgaatgtaatgaatgtgataaagcttttattcattcatcagcactcattaaacatcaaagaactcatactggagagaaaccttataaatgtcaagaatgtgggaaagcctttagccattgctcatccctaactaagcatcagagagttcatactggagaaaagccatatgaatgcagtgaatgtggaaaaacttttagtcagagcacacatcttgttcaacatcagagaattcacactggagagaaaccctatgagtgtaatgaatgtgggaaaaccttcagccggagctccaattttgctaaacatcaaagaattcatattggaaagaaaccgtacaaatgtagcgagtgtggaaaagccttcattcattcatcagctctcattcaacatcagagaactcataccggagagaaaccctttagatgtaatgagtgtgggaaaagctttaagtgcagttcatctctcatcagacatcaaagagttcacactgaagagcaaccctgaaaaattactgaatgtgaagaaatgtaagttggttttatcactgtattaaatacttgagtgtttaggtggaaggcgcatccataatatgcatgtgaggaccaattctgtatgcatctaatttcatttgcgtaatacatagttttgagccataagcaggttctttatgtccgttaatttgataattatgaaatctagccagcgatttcaaaattttaatctccaacgtcccaaatagctatctgtggaaattcaagaagtccctgagagtaggtagcagtacgaacattgtgaaatccagttttcccctctcttgtttatgtcagagctttgttgtaagcctctcactttgtaaggaaattcttattgggtaggttaggctgagggcttacatccttatcatcaggaagacacaatgttgttatttattactccttgagatctagatacacatatggtataattcatctagagtgtaatttcttttatattagccttaaaaaccaaaaatgctgggttcaaagtccttagaattcccttcctccctcaacaagctgctgtctatgttgatgaccataactgggatgtataatatttacagacaactctaagttacgttcacatggattatgtacatcattgattttttttttttttttttttttgagacagagtcttgctctgttgcccgggctggagtgcagtggcgcgatctcggctcactgcaacctccacctcccaggttcatgccattctcttgtctcagcctcccnagtagctgggactacaggcacctgccagtacgcctggctaattttttttgtatttttagtagagatggggtttcaccatgttagccaggatggtcttgatctcctgacctcgtgatctgcctgcctcggcctcccaaagtgctgggattacaggcatgagccaccatgcctggcatcattattgatttatgtcattgttatccctctaccgcagagaccttctttcactttccatttccctgggagttcacgtgaagtagtgaatgggtcaaaatcttaacagtggttgttgatcaagtccctcctttcttatccttggcactgaataaatctttggttttccataatcaaagggtgagggagacttcttttgtctacattattcagctttctgtaagctatgctgtgtccatttgagaaaaagccccagggatattgaaggtctgagaagttgggtggttcagtgtgttattatatttagggtcccagtaaagaagaactgaagcaactgtgagacaccagggcatacttccctgtatgagtggaaaacaaggcacggaaaatagctcacaggatagtcctcaactgacttgcttgaggataagcagcttcccttcgtgaagaagttgccatttctctggccttcatatttatctactttttgttattgttgtctgtatcggttcaatctcacactgctataaagaaatgcctgagactgggtaacttataaagaaaaaaggtttaattggctcatggttccatgggctgtacaggaagtatgactggggaggtctcagggagcttttactcatggcaaaaggcaaagccagagcaggtatcttcacagggctagagcaagaggaaaagagagaggggaggtgctacacactttttatgcaaccaaatctcatgagaactctatcacgagacagcagtagggggacagtgctaaatcattcatgagaaactacctgcgtggtccagtcaccttgcaccaggccccacctcccacattggggattacaattaaacatgagatttgggtggggatacagatctaaactgtatcattactcaaaaaaaaaaaaaaaaagaaagaaaagaaaaaaaaaaaagggggggggggtaaaaattttcccgggggggccaattaaagggttacccggttttttggaaaagggggccctaaaaggagggggtttaaaaaagagggaggggcgggttaaaagggggggggggacaccccgccgtggggacttctgggggaggaaacctgacttgcggcgggcgcgactgcggccgcactcaccgaggattaagattcggggaataaaacttcggggtgagggcaaccccacgcatagcgcggcggaatggctcggatgtattgaaaatgacgggggcgagcaaataaaaacaggagcaagaagaactaaaacaaacaagatcgacagaaatgcaccactgggcacacatcactgaaacgaggcaaaaacgagcaacaagaaatgtaagcacaaca

SEQ ID NO: 356183 - DNA, 2353 bp, Homo sapiens
gctggccaaagaagttcgtcccctttgtgaggcccgggatgggaggctccagcgccgtaggactgaggcagactccacggtgagaaagagacccgatctaacccaggcctttcatcagagcccaggagggaaggcaggaagtgggaccacgaggcccggggggcttctaactcgtctggccagggagatctgaattggggtgaagagcagaatctccagaacaaggaggaggtggtgatcatggagacagatttggctgaaatgcctgagaaaggagctctgtcttcccaggattctccccatttccaagagaagagcacagaagagggagaagtggctgctctgcgcctcacggccagatcccaggtgagtgagtgctgattattggaattacaccttgtttcttagagtacagatgcactcccttctttgtgatgtggagtttctttatccactaaagcccatctgcagagctgagttctaaatctaagagactagtcaggagactaatggactcagaagaaaatgttttctacttataacactggatggatttcttccctatttagtgtttattgtccctcaacagataggtaagcagcatttccctttcttagcctcctatgctcatttctgtgcttggtaatgtgagaaactattttaaatataatgtggtacatacctcttaaaacttgtttctctagaggaaacagcatgtatgtgaccttaagtggcaatctaagaaagcacttaaatgctgaagtgattgtaaaaataataaatactcacatagttcaaagaaatactggaaaaggaaagcctatgaaggcgtaatttaaagagttacagttagaatccagccctctgagatgatgaaagctaaggtatgatcatgtctgcaacttacttttatattgttggcccctctctcccaaaaggtaaatatgacaaatattacgaatgtttgtgctgggattacaggcatgagccaccatgcctggcatcattattgatttatgtcattgttatccctctaccgcagagaccttctttcactttccatttccctgggagttcacgtgaagtagtgaatgggtcaaaatcttaacagtggttgttgatcaagtccctcctttcttatccttggcactgaataaatctttggttttccataatcaaagggtgagggagacttcttttgtctacattattcagctttctgtaagctatgctgtgtccatttgagaaaaagccccagggatattgaaggtctgagaagttgggtggttcagtgtgttattatatttagggtcccagtaaagaagaactgaagcaactgtgagacaccagggcatacttccctgtatgagtggaaaacaaggcacggaaaatagctcacaggatagtcctcaactgacttgcttgaggataagcagcttcccttcgtgaagaagttgccatttctctggccttcatatttatctactttttgttattgttgtctgtatcggttcaatctcacactgctataaagaaatgcctgagactgggtaacttataaagaaaaaaggtttaattggctcatggttccatgggctgtacaggaagtatgactggggaggtctcagggagcttttactcatggcaaaaggcaaagccagagcaggtatcttcacagggctagagcaagaggaaaagagagaggggaggtgctacacactttttatgcaaccaaatctcatgagaactctatcacgagacagcagtagggggacagtgctaaatcattcatgagaaactacctgcgtggtccagtcaccttgcaccaggccccacctcccacattggggattacaattaaacatgagatttgggtggggatacagatctaaactgtatcattactcaaaaaaaaaaaaaaaaagaaagaaaagaaaaaaaaaaaagggggggggggtaaaaattttcccgggggggccaattaaagggttacccggttttttggaaaagggggccctaaaaggagggggtttaaaaaagagggaggggcgggttaaaagggggggggggacaccccgccgtggggacttctgggggaggaaacctgacttgcggcgggcgcgactgcggccgcactcaccgaggattaagattcggggaataaaacttcggggtgagggcaaccccacgcatagcgcggcggaatggctcggatgtattgaaaatgacgggggcgagcaaataaaaacaggagcaagaagaactaaaacaaacaagatcgacagaaatgcaccactgggcacacatcactgaaacgaggcaaaaacgagcaacaagaaatgtaagcacaaca

SEQ ID NO: 356184 - DNA, 854 bp, Homo sapiens
gctggccaaagaagttcgtcccctttgtgaggcccgggatgggaggtgcccggttcccccagggacagcttcaagcggtagggacagacatctgaggacccagcctcagggatgctgtccccgggcttccaggctccagcgccgtaggactgaggcagactccacggtgagaaagagacccgatctaacccaggcctttcatcagagcccaggagggaaggcaggaagtgggaccacgaggcccggggggcttctaactcgtctggccagggagatctgaattggggtgaagagcagaatctccagaacaaggaggaggtggtgatcatggagacagatttggctgaaatgcctgagaaaggagctctgtcttcccaggattctccccatttccaagagaagagcacagaagagggagaagtggctgctctgcgcctcacggccagatcccaggaaacagtgacattcaaggatgtggccatggactttacaccagaggagtgggggaagctggatcctgcacaaagggatgtgatgctggagaactataggaacctagtctcactttggcttccagtttccaaacctgagagctacaacttggagaatggaaaagaaccattgaagcttgagagaaaagcccccaaaagcagctattcaggtgagccagatagatgggagtcttcataaatgatagcccagcaggacaatgaagaaatacttttcagtgcttaagaaagtgcctgtgtgcccttatttttaaatttttttaaaattctaaagcatttaaaatatatacagaagtccagaaaataaaataacattcatgtatccatcactgagattagacacgt

SEQ ID NO: 356185 - DNA, 1908 bp, Homo sapiens
  misc_feature (892)..(892): n is a, c, g, or t
  misc_feature (975)..(975): n is a, c, g, or t
tgctgagcactcgcccacctgtccactagcgggtctctatgtctggagctcttagagataagacatagaggtgtctggttctgagaaaaggaagtttgctaagtgagagacacaactgactcaactgactcagaaaactgattatattcctggtccctgaacgatcctatagagacatccagtccctgactccacctgcctccaggtgcccagaacagcccatcgtggggacttcaccctcagcaagtggacgccgtttgtcctgccagggcaggatggagatggatggggacccgtataacctgcctgcccaggggcaaggcaatatcatcattactaagtatgagcagggacaccgagctggggcagcagtggacttggggcatgagcaggttgatgtcagaaaatacaccaataacctcgggattgtgcatgagatggagctgccccgcgtcagtgccctggaggtgaagcaaagacgcaaggaaagtaaacgtaccaacaagtggcaaaagatgcttgcagactggacaaaatataggagcaccaagaagctgtctcaaagagtatacaaagtcattcccctggcggtacggggccgggcgtggtcacttttgctagatattgacagaatcaagtcccagaacccaggcaaatataaggtcatgaaggagaagggcaagaggtcctccagaatcatccactgcatccagctagatgtcagccacaccctgcagaaacacatgatgttcatacaaagattcggagtcaagcagcaggaattatgtgacatcctcgtggcctattctgcatataaccctgaggtgggctaccacagggacctgagccgcatcactgccatcctcctcctgtgtctgccagaggaagatgntttctgggcgcttacccagttgctcgctggtgagaggcactccctgtggtattctacagcccaaatactgcctggctcgagangctcctatcgcaccaggagcaggtgctgcacaagtccttcccaaagatcatgagacacctgggcaaggaagggctgtgcattgagggttccatgctgacgaggctcctccggtgtttccttgatgggaaatccttcgggctcaccctgagactgtgggatgtgttcatcttggagggcgcgcgggtactgacagccatggtgcatgcatcattcaaaatacacaggaagcacctcatgaagctttcctggagcactgtctgggagtttcaggagcgactctctcagagctgggccctggaggacaacgcggtcctcaggaaccttcaaacctctatgaaggaactcacaaaaaaacactgggacctgccacccccagggagcttgctacaaaatgcacattgctataccatagcctggggcttgcaatccaaggctggcaaggattcctgcacgtcaagggcctcaggtgactttcatgcacacccaagtcagaaggctctcctgaatcctggatgtcaccttcctgcccaaaaaaggaggaacgagggtcaaccagcagcagaccagtcacaaaaagagatgaaatgtgagtgcatggccttcctgacacccagacaaaactttgggcacaaagccaggctgcagctctggccactgacttggaccagggatgcccccatgcaggccggtgtgccctggctgctcttgacaccctctggctcctgacaccctctcttcggctgcctgcgttaggaagggagaacctgccagttttcagaagaaaatgtagctttattataacataggaaagactgcaagttattacgggaggaggaggaggcctgaaacagctcctgaaaatgagagggaaaaggaaggtgtaaatatgttggtaataaaatctccaaccacaaaatagtcatgggaatgtt

SEQ ID NO: 356186 - DNA, 2762 bp, Homo sapiens
  misc_feature (1746)..(1746): n is a, c, g, or t
  misc_feature (1829)..(1829): n is a, c, g, or t
tgctgagcactcgcccacctgtccactagcgggtctctatgtctggagctcttagagataagacatagaggtgtctggttctgagaaaaggaagtttgctaagtgagagacacaactgactcaactgactcagaaactctgtggcgatgggtgctgtccccaaatgtagccattccacaggaaaacaaagtcccctcctgtattgacagctgggaattgtggtgtccaccgtcctcgacctgcgacggggtctccatgagcacagaggctgctctggagtcaatagatcatcttttccccaaaccaaactgcttggctggcgttgttcctgaagcggcttcactggccagaagacatccagtccctgactccacctgcctccaggtgcccagaacagcccatcgtggggacttcaccctcagcaagtggacgccgtttgtcctgccagggcaggatggagatggatggggacccgtataacctgcctgcccaggggcaaggcaatatcatcattactaagtatgagcagggacaccgagctggggcagcagtggacttggggcatgagcaggttgatgtcagaaaatacaccaataacctcgggattgtgcatgagatggagctgccccgcgtcagtgccctggaggtgaaggtaagagcctgtgcctgctgcgtgggaggctgcttcagggactgggaatcgggtggtcggtaaggcagagggggtggcctgtgggcctgtgtggtggtgagtgggccacggctgtcactgggaggggtggcctttcctgctggactctgttcccatgaggacttgaccaaaacccaaaccaagaactgcagtcctggctcagagtccactgcctgtttgaaccaagaccccagctgaaggctggacctgaccaaaacttggggcatttatggcctgaggatggcatgtcatggcatcaccattccagactaccagctccagttccttcagagggtctcagcccctggggcctgccctttcctggcttcttcaagttgggtcccttcagggccccaaagccctggacccagcatccacgggccactgtcagacgcctggcagctccgctaactccatcatggctcatttgacagcaaagacgcaaggaaagtaaacgtaccaacaagtggcaaaagatgcttgcagactggacaaaatataggagcaccaagaaggtaacatggggaggaagtggcccgcgtgactgctctctgcagagccaggagacaggcacccatggttgtgacctggcaccgtctgcctctcagtgggtgggtggtaccccatccttgccataggactgcaggcctgttcgccagctttgctctgcggggtcgccccatgtcctttctcactggagtgttcttctgtctgtagctgtctcaaagagtatacaaagtcattcccctggcggtacggggccgggcgtggtcacttttgctagatattgacagaatcaagtcccagaacccaggcaaatataaggtcatgaaggagaagggcaagaggtcctccagaatcatccactgcatccagctagatgtcagccacaccctgcagaaacacatgatgttcatacaaagattcggagtcaagcagcaggaattatgtgacatcctcgtggcctattctgcatataaccctgaggtgggctaccacagggacctgagccgcatcactgccatcctcctcctgtgtctgccagaggaagatgntttctgggcgcttacccagttgctcgctggtgagaggcactccctgtggtattctacagcccaaatactgcctggctcgagangctcctatcgcaccaggagcaggtgctgcacaagtccttcccaaagatcatgagacacctgggcaaggaagggctgtgcattgagggttccatgctgacgaggctcctccggtgtttccttgatgggaaatccttcgggctcaccctgagactgtgggatgtgttcatcttggagggcgcgcgggtactgacagccatggtgcatgcatcattcaaaatacacaggaagcacctcatgaagctttcctggagcactgtctgggagtttcaggagcgactctctcagagctgggccctggaggacaacgcggtcctcaggaaccttcaaacctctatgaaggaactcacaaaaaaacactgggacctgccacccccagggagcttgctacaaaatgcacattgctataccatagcctggggcttgcaatccaaggctggcaaggattcctgcacgtcaagggcctcaggtgactttcatgcacacccaagtcagaaggctctcctgaatcctggatgtcaccttcctgcccaaaaaaggaggaacgagggtcaaccagcagcagaccagtcacaaaaagagatgaaatgtgagtgcatggccttcctgacacccagacaaaactttgggcacaaagccaggctgcagctctggccactgacttggaccagggatgcccccatgcaggccggtgtgccctggctgctcttgacaccctctggctcctgacaccctctcttcggctgcctgcgttaggaagggagaacctgccagttttcagaagaaaatgtagctttattataacataggaaagactgcaagttattacgggaggaggaggaggcctgaaacagctcctgaaaatgagagggaaaaggaaggtgtaaatatgttggtaataaaatctccaaccacaaaatagtcatgggaatgtt

SEQ ID NO: 356187 - DNA, 566 bp, Homo sapiens
gctggccaaagaagttcgtcccctttgtgaggcccgggatgggaggtgcccggttcccccagggacagcttcaagcggtagggacagacatctgaggacccagcctcagggatgctgtccccgggcttccaggctccagcgccgtaggactgaggcagactccacgctctgtcttcccaggattctccccatttccaagagaagagcacagaagagggagaagtggctgctctgcgcctcacggccagatcccaggaaacagtgacattcaaggatgtggccatggactttacaccagaggagtgggggaagctggatcctgcacaaagggatgtgatgctggagaactataggaacctagtctcactttggcttccagtttccaaacctgagagctacaacttggagaatggaaaagaaccattgaagcttgagagaaaagcccccaaaagcagctattcagattcttaatccatttggaattgcttcttacttctctgagtgtatcttcttagccttcttttttgaacaattaaatattctaattactcaaaatttgattttaa

SEQ ID NO: 356188 - DNA, 526 bp, Homo sapiens
gctggccaaagaagttcgtcccctttgtgaggcccgggatgggaggtgcccggttcccccagggacagcttcaagcggtagggacagacatctgaggacccagcctcagggatgctgtccccgggcttccaggctccagcgccgtaggactgaggcagactccacggtgagaaagagacccgatctaacccaggcctttcatcagagcccaggagggaaggcaggaagtgggaccacgaggcccggggggcttctaactcgtctggccagggagatctgaattggggtgaagagcagaatctccagaacaaggaggaggtggtgatcatggaggtgagccagatagatgggagtcttcataaatgatagcccagcaggacaatgaagaaatacttttcagtgcttaagaaagtgcctgtgtgcccttatttttaaatttttttaaaattctaaagcatttaaaatatatacagaagtccagaaaataaaataacattcatgtatccatcactgagattagacacgt

SEQ ID NO: 356189 - DNA, 3971 bp, Homo sapiens
  misc_feature (2955)..(2955): n is a, c, g, or t
  misc_feature (3038)..(3038): n is a, c, g, or t
gctggccaaagaagttcgtcccctttgtgaggcccgggatgggagctctgtcttcccaggattctccccatttccaagagaagagcacagaagagggagaagtggctgctctgcgcctcacggccagatcccaggaaacagtgacattcaaggatgtggccatggactttacaccagaggagtgggggaagctggatcctgcacaaagggatgtgatgctggagaactataggaacctagtctcactttggcttccagtttccaaacctgagagctacaacttggagaatggaaaagaaccattgaagcttgagagaaaagcccccaaaagcagctattcagacatggagactagaccacagagcaaggattcaacttcagtgcaagatttttccaaagcagaatcatgcaaagttgcaataatagacagactgacacggaatagtgtctatgactctaacttggaagcagcccttgaatgtgaaaattggttagagaatcagcaaggaaatcaggagagacatttgagagaaatgttcactcacatgaattcactctctgaggaaacagaccataagcatgatgtatactggaaaagcttcaatcagaaatctgtccttatcactgaagacagagttcccaaaggatcttatgccttccatacacttgaaaaaagcttgaaacaaaaatcaaacttaatgaaaaagcagagaacttataaagagaaaaaacctcataaatgtaatgattgtggtgaactcttcacctaccattcagtgcttattcgacaccagagagtccatactggagagaaaccctatacctgcaatgaatgtgggaaatcttttagccacagagctaatttaactaaacaccagagaactcatactagaattctctttgaatgcagtgaatgcaagaaaaccttcacagaaagctcatcccttgcaacacatcagagaattcacgttggagagagaccttatgaatgcaatgaatgtgggaaaggttttaatcgaagtacacatcttgtgcagcatcagttgattcatactggagtgaagccttatgaatgtaatgaatgtgataaagcttttattcattcatcagcactcattaaacatcaaagaactcatactggagagaaaccttataaatgtcaagaatgtgggaaagcctttagccattgctcatccctaactaagcatcagagagttcatactggagaaaagccatatgaatgcagtgaatgtggaaaaacttttagtcagagcacacatcttgttcaacatcagagaattcacactggagagaaaccctatgagtgtaatgaatgtgggaaaaccttcagccggagctccaattttgctaaacatcaaagaattcatattggaaagaaaccgtacaaatgtagcgagtgtggaaaagccttcattcattcatcagctctcattcaacatcagagaactcataccggagagaaaccctttagatgtaatgagtgtgggaaaagctttaagtgcagttcatctctcatcagacatcaaagagttcacactgaagagcaaccctgaaaaattactgaatgtgaagaaataaaactgattatattcctggtccctgaacgatcctatagagacatccagtccctgactccacctgcctccaggtgcccagaacagcccatcgtggggacttcaccctcagcaagtggacgccgtttgtcctgccagggcagggacaccgagctggggcagcagtggacttggggcatgagcaggttgatgtcagaaaatacaccaataacctcgggattgtgcatgagatggagctgccccgcgtcagtgccctggaggtgaaggtaagagcctgtgcctgctgcgtgggaggctgcttcagggactgggaatcgggtggtcggtaaggcagagggggtggcctgtgggcctgtgtggtggtgagtgggccacggctgtcactgggaggggtggcctttcctgctggactctgttcccatgaggacttgaccaaaacccaaaccaagaactgcagtcctggctcagagtccactgcctgtttgaaccaagaccccagctgaaggctggacctgaccaaaacttggggcatttatggcctgaggatggcatgtcatggcatcaccattccagactaccagctccagttccttcagagggtctcagcccctggggcctgccctttcctggcttcttcaagttgggtcccttcagggccccaaagccctggacccagcatccacgggccactgtcagacgcctggcagctccgctaactccatcatggctcatttgacagcaaagacgcaaggaaagtaaacgtaccaacaagtggcaaaagatgcttgcagactggacaaaatataggagcaccaagaaggtaacatggggaggaagtggcccgcgtgactgctctctgcagagccaggagacaggcacccatggttgtgacctggcaccgtctgcctctcagtgggtgggtggtaccccatccttgccataggactgcaggcctgttcgccagctttgctctgcggggtcgccccatgtcctttctcactggagtgttcttctgtctgtagctgtctcaaagagtatacaaagtcattcccctggcggtacggggccgggcgtggtcacttttgctagatattgacagaatcaagtcccagaacccaggcaaatataaggtcatgaaggagaagggcaagaggtcctccagaatcatccactgcatccagctagatgtcagccacaccctgcagaaacacatgatgttcatacaaagattcggagtcaagcagcaggaattatgtgacatcctcgtggcctattctgcatataaccctgaggtgggctaccacagggacctgagccgcatcactgccatcctcctcctgtgtctgccagaggaagatgntttctgggcgcttacccagttgctcgctggtgagaggcactccctgtggtattctacagcccaaatactgcctggctcgagangctcctatcgcaccaggagcaggtgctgcacaagtccttcccaaagatcatgagacacctgggcaaggaagggctgtgcattgagggttccatgctgacgaggctcctccggtgtttccttgatgggaaatccttcgggctcaccctgagactgtgggatgtgttcatcttggagggcgcgcgggtactgacagccatggtgcatgcatcattcaaaatacacaggaagcacctcatgaagctttcctggagcactgtctgggagtttcaggagcgactctctcagagctgggccctggaggacaacgcggtcctcaggaaccttcaaacctctatgaaggaactcacaaaaaaacactgggacctgccacccccagggagcttgctacaaaatgcacattgctataccatagcctggggcttgcaatccaaggctggcaaggattcctgcacgtcaagggcctcaggtgactttcatgcacacccaagtcagaaggctctcctgaatcctggatgtcaccttcctgcccaaaaaaggaggaacgagggtcaaccagcagcagaccagtcacaaaaagagatgaaatgtgagtgcatggccttcctgacacccagacaaaactttgggcacaaagccaggctgcagctctggccactgacttggaccagggatgcccccatgcaggccggtgtgccctggctgctcttgacaccctctggctcctgacaccctctcttcggctgcctgcgttaggaagggagaacctgccagttttcagaagaaaatgtagctttattataacataggaaagactgcaagttattacgggaggaggaggaggcctgaaacagctcctgaaaatgagagggaaaaggaaggtgtaaatatgttggtaataaaatctccaaccacaaaatagtcatgggaatgtt

SEQ ID NO: 356190 - DNA, 4176 bp, Homo sapiens
  misc_feature (2651)..(2651): n is a, c, g, or t
aaactcctgatgccccagcgtcacctcttccaggtgcccggttcccccagggacagcttcaagcggtagggacagacatctgaggacccagcctcagggatgctgtccccgggcttccaggctccagcgccgtaggactgaggcagactccacggtgagaaagagacccgatctaacccaggcctttcatcagagcccaggagggaaggcaggaagtgggaccacgaggcccggggggcttctaactcgtctggccagggagatctgaattggggtgaagagcagaatctccagaacaaggaggaggtggtgatcatggagacagatttggctgaaatgcctgagaaaggagctctgtcttcccaggattctccccatttccaagagaagagcacagaagagggagaagtggctgctctgcgcctcacggccagatcccaggaaacagtgacattcaaggatgtggccatggactttacaccagaggagtgggggaagctggatcctgcacaaagggatgtgatgctggagaactataggaacctagtctcactttggcttccagtttccaaacctgagagctacaacttggagaatggaaaagaaccattgaagcttgagagaaaagcccccaaaagcagctattcagacatggagactagaccacagagcaaggattcaacttcagtgcaagatttttccaaagcagaatcatgcaaagttgcaataatagacagactgacacggaatagtgtctatgactctaacttggaagcagcccttgaatgtgaaaattggttagagaatcagcaaggaaatcaggagagacatttgagagaaatgttcactcacatgaattcactctctgaggaaacagaccataagcatgatgtatactggaaaagcttcaatcagaaatctgtccttatcactgaagacagagttcccaaaggatcttatgccttccatacacttgaaaaaagcttgaaacaaaaatcaaacttaatgaaaaagcagagaacttataaagagaaaaaacctcataaatgtaatgattgtggtgaactcttcacctaccattcagtgcttattcgacaccagagagtccatactggagagaaaccctatacctgcaatgaatgtgggaaatcttttagccacagagctaatttaactaaacaccagagaactcatactagaattctctttgaatgcagtgaatgcaagaaaaccttcacagaaagctcatcccttgcaacacatcagagaattcacgttggagagagaccttatgaatgcaatgaatgtgggaaaggttttaatcgaagtacacatcttgtgcagcatcagttgattcatactggagtgaagccttatgaatgtaatgaatgtgataaagcttttattcattcatcagcactcattaaacatcaaagaactcatactggagagaaaccttataaatgtcaagaatgtgggaaagcctttagccattgctcatccctaactaagcatcagagagttcatactggagaaaagccatatgaatgcagtgaatgtggaaaaacttttagtcagagcacacatcttgttcaacatcagagaattcacactggagagaaaccctatgagtgtaatgaatgtgggaaaaccttcagccggagctccaattttgctaaacatcaaagaattcatattggaaagaaaccgtacaaatgtagcgagtgtggaaaagccttcattcattcatcagctctcattcaacatcagagaactcataccggagagaaaccctttagatgtaatgagtgtgggaaaagctttaagtgcagttcatctctcatcagacatcaaagagttcacactgaagagcaaccctgaaaaattactgaatgtgaagaaatgtaagttggttttatcactgtattaaatacttgagtgtttaggtggaaggcgcatccataatatgcatgtgaggaccaattctgtatgcatctaatttcatttgcgtaatacatagttttgagccataagcaggttctttatgtccgttaatttgataattatgaaatctagccagcgatttcaaaattttaatctccaacgtcccaaatagctatctgtggaaattcaagaagtccctgagagtaggtagcagtacgaacattgtgaaatccagttttcccctctcttgtttatgtcagagctttgttgtaagcctctcactttgtaaggaaattcttattgggtaggttaggctgagggcttacatccttatcatcaggaagacacaatgttgttatttattactccttgagatctagatacacatatggtataattcatctagagtgtaatttcttttatattagccttaaaaaccaaaaatgctgggttcaaagtccttagaattcccttcctccctcaacaagctgctgtctatgttgatgaccataactgggatgtataatatttacagacaactctaagttacgttcacatggattatgtacatcattgattttttttttttttttttttttgagacagagtcttgctctgttgcccgggctggagtgcagtggcgcgatctcggctcactgcaacctccacctcccaggttcatgccattctcttgtctcagcctcccnagtagctgggactacaggcacctgccagtacgcctggctaattttttttgtatttttagtagagatggggtttcaccatgttagccaggatggtcttgatctcctgacctcgtgatctgcctgcctcggcctcccaaagtgctgggattacaggcatgagccaccatgcctggcatcattattgatttatgtcattgttatccctctaccgcagagaccttctttcactttccatttccctgggagttcacgtgaagtagtgaatgggtcaaaatcttaacagtggttgttgatcaagtccctcctttcttatccttggcactgaataaatctttggttttccataatcaaagggtgagggagacttcttttgtctacattattcagctttctgtaagctatgctgtgtccatttgagaaaaagccccagggatattgaaggtctgagaagttgggtggttcagtgtgttattatatttagggtcccagtaaagaagaactgaagcaactgtgagacaccagggcatacttccctgtatgagtggaaaacaaggcacggaaaatagctcacaggatagtcctcaactgacttgcttgaggataagcagcttcccttcgtgaagaagttgccatttctctggccttcatatttatctactttttgttattgttgtctgtatcggttcaatctcacactgctataaagaaatgcctgagactgggtaacttataaagaaaaaaggtttaattggctcatggttccatgggctgtacaggaagtatgactggggaggtctcagggagcttttactcatggcaaaaggcaaagccagagcaggtatcttcacagggctagagcaagaggaaaagagagaggggaggtgctacacactttttatgcaaccaaatctcatgagaactctatcacgagacagcagtagggggacagtgctaaatcattcatgagaaactacctgcgtggtccagtcaccttgcaccaggccccacctcccacattggggattacaattaaacatgagatttgggtggggatacagatctaaactgtatcattactcaaaaaaaaaaaaaaaaagaaagaaaagaaaaaaaaaaaagggggggggggtaaaaattttcccgggggggccaattaaagggttacccggttttttggaaaagggggccctaaaaggagggggtttaaaaaagagggaggggcgggttaaaagggggggggggacaccccgccgtggggacttctgggggaggaaacctgacttgcggcgggcgcgactgcggccgcactcaccgaggattaagattcggggaataaaacttcggggtgagggcaaccccacgcatagcgcggcggaatggctcggatgtattgaaaatgacgggggcgagcaaataaaaacaggagcaagaagaactaaaacaaacaagatcgacagaaatgcaccactgggcacacatcactgaaacgaggcaaaaacgagcaacaagaaatgtaagcacaaca

SEQ ID NO: 356191 - DNA, 3658 bp, Homo sapiens
  misc_feature (2651)..(2651): n is a, c, g, or t
aaactcctgatgccccagcgtcacctcttccaggtgcccggttcccccagggacagcttcaagcggtagggacagacatctgaggacccagcctcagggatgctgtccccgggcttccaggctccagcgccgtaggactgaggcagactccacggtgagaaagagacccgatctaacccaggcctttcatcagagcccaggagggaaggcaggaagtgggaccacgaggcccggggggcttctaactcgtctggccagggagatctgaattggggtgaagagcagaatctccagaacaaggaggaggtggtgatcatggagacagatttggctgaaatgcctgagaaaggagctctgtcttcccaggattctccccatttccaagagaagagcacagaagagggagaagtggctgctctgcgcctcacggccagatcccaggaaacagtgacattcaaggatgtggccatggactttacaccagaggagtgggggaagctggatcctgcacaaagggatgtgatgctggagaactataggaacctagtctcactttggcttccagtttccaaacctgagagctacaacttggagaatggaaaagaaccattgaagcttgagagaaaagcccccaaaagcagctattcagacatggagactagaccacagagcaaggattcaacttcagtgcaagatttttccaaagcagaatcatgcaaagttgcaataatagacagactgacacggaatagtgtctatgactctaacttggaagcagcccttgaatgtgaaaattggttagagaatcagcaaggaaatcaggagagacatttgagagaaatgttcactcacatgaattcactctctgaggaaacagaccataagcatgatgtatactggaaaagcttcaatcagaaatctgtccttatcactgaagacagagttcccaaaggatcttatgccttccatacacttgaaaaaagcttgaaacaaaaatcaaacttaatgaaaaagcagagaacttataaagagaaaaaacctcataaatgtaatgattgtggtgaactcttcacctaccattcagtgcttattcgacaccagagagtccatactggagagaaaccctatacctgcaatgaatgtgggaaatcttttagccacagagctaatttaactaaacaccagagaactcatactagaattctctttgaatgcagtgaatgcaagaaaaccttcacagaaagctcatcccttgcaacacatcagagaattcacgttggagagagaccttatgaatgcaatgaatgtgggaaaggttttaatcgaagtacacatcttgtgcagcatcagttgattcatactggagtgaagccttatgaatgtaatgaatgtgataaagcttttattcattcatcagcactcattaaacatcaaagaactcatactggagagaaaccttataaatgtcaagaatgtgggaaagcctttagccattgctcatccctaactaagcatcagagagttcatactggagaaaagccatatgaatgcagtgaatgtggaaaaacttttagtcagagcacacatcttgttcaacatcagagaattcacactggagagaaaccctatgagtgtaatgaatgtgggaaaaccttcagccggagctccaattttgctaaacatcaaagaattcatattggaaagaaaccgtacaaatgtagcgagtgtggaaaagccttcattcattcatcagctctcattcaacatcagagaactcataccggagagaaaccctttagatgtaatgagtgtgggaaaagctttaagtgcagttcatctctcatcagacatcaaagagttcacactgaagagcaaccctgaaaaattactgaatgtgaagaaatgtaagttggttttatcactgtattaaatacttgagtgtttaggtggaaggcgcatccataatatgcatgtgaggaccaattctgtatgcatctaatttcatttgcgtaatacatagttttgagccataagcaggttctttatgtccgttaatttgataattatgaaatctagccagcgatttcaaaattttaatctccaacgtcccaaatagctatctgtggaaattcaagaagtccctgagagtaggtagcagtacgaacattgtgaaatccagttttcccctctcttgtttatgtcagagctttgttgtaagcctctcactttgtaaggaaattcttattgggtaggttaggctgagggcttacatccttatcatcaggaagacacaatgttgttatttattactccttgagatctagatacacatatggtataattcatctagagtgtaatttcttttatattagccttaaaaaccaaaaatgctgggttcaaagtccttagaattcccttcctccctcaacaagctgctgtctatgttgatgaccataactgggatgtataatatttacagacaactctaagttacgttcacatggattatgtacatcattgattttttttttttttttttttttgagacagagtcttgctctgttgcccgggctggagtgcagtggcgcgatctcggctcactgcaacctccacctcccaggttcatgccattctcttgtctcagcctcccnagtagctgggactacaggcacctgccagtacgcctggctaattttttttgtatttttagtagagatggggtttcaccatgttagccaggatggtcttgatctcctgacctcgtgatctgcctgcctcggcctcccaaagtgctgggattacaggcatgagccaccatgcctggcatcattattgatttatgtcattgttatccctctaccgcagagaccttctttcactttccatttccctgggagttcacgtgaagtagtgaatgggtcaaaatcttaacagtggttgttgatcaagtccctcctttcttatccttggcactgaataaatctttggttttccataatcaaagggtgagggagacttcttttgtctacattattcagctttctgtaagctatgctgtgtccatttgagaaaaagccccagggatattgaaggtctgagaagttgggtggttcagtgtgttattatatttagggtcccagtaaagaagaactgaagcaactgtgagacaccagggcatacttccctgtatgagtggaaaacaaggcacggaaaatagctcacaggatagtcctcaactgacttgcttgaggataagcagcttcccttcgtgaagaagttgccatttctctggccttcatatttatctactttttgttattgttgtctgtatcggttcaatctcacactgctataaagaaatgcctgagactgggtaacttataaagaaaaaaggtttaattggctcatggttccatgggctgtacaggaagtatgactggggaggtctcagggagcttttactcatggcaaaaggcaaagccagagcaggtatcttcacagggctagagcaagaggaaaagagagaggggaggtgctacacactttttatgcaaccaaatctcatgagaactctatcacgagacagcagtagggggacagtgctaaatcattcatgagaaactacctgccctgcgaaactatgagggtaccgagctcg

SEQ ID NO: 356192 - DNA, 3076 bp, Homo sapiens
gctggccaaagaagttcgtcccctttgtgaggcccgggatgggaggtgcccggttcccccagggacagcttcaagcggtagggacagacatctgaggacccagcctcagggatgctgtccccgggcttccaggctccagcgccgtaggactgaggcagactccacggtgagaaagagacccgatctaacccaggcctttcatcagagcccaggagggaaggcaggaagtgggaccacgaggcccggggggcttctaactcgtctggccagggagatctgaattggggtgaagagcagaatctccagaacaaggaggaggtggtgatcatggagacagatttggctgaaatgcctgagaaaggagctctgtcttcccaggattctccccatttccaagagaagagcacagaagagggagaagtggctgctctgcgcctcacggccagatcccaggaaacagtgacattcaaggatgtggccatggactttacaccagaggagtgggggaagctggatcctgcacaaagggatgtgatgctggagaactataggaacctagtctcactttggcttccagtttccaaacctgagagctacaacttggagaatggaaaagaaccattgaagcttgagagaaaagcccccaaaagcagctattcagacatggagactagaccacagagcaaggattcaacttcagtgcaagatttttccaaagcagaatcatgcaaagttgcaataatagacagactgacacggaatagtgtctatgactctaacttggaagcagcccttgaatgtgaaaattggttagagaatcagcaaggaaatcaggagagacatttgagagaaatgttcactcacatgaattcactctctgaggaaacagaccataagcatgatgtatactggaaaagcttcaatcagaaatctgtccttatcactgaagacagagttcccaaaggatcttatgccttccatacacttgaaaaaagcttgaaacaaaaatcaaacttaatgaaaaagcagagaacttataaagagaaaaaacctcataaatgtaatgattgtggtgaactcttcacctaccattcagtgcttattcgacaccagagagtccatactggagagaaaccctatacctgcaatgaatgtgggaaatcttttagccacagagctaatttaactaaacaccagagaactcatactagaattctctttgaatgcagtgaatgcaagaaaaccttcacagaaagctcatcccttgcaacacatcagagaattcacgttggagagagaccttatgaatgcaatgaatgtgggaaaggttttaatcgaagtacacatcttgtgcagcatcagttgattcatactggagtgaagccttatgaatgtaatgaatgtgataaagcttttattcattcatcagcactcattaaacatcaaagaactcatactggagagaaaccttataaatgtcaagaatgtgggaaagcctttagccattgctcatccctaactaagcatcagagagttcatactggagaaaagccatatgaatgcagtgaatgtggaaaaacttttagtcagagcacacatcttgttcaacatcagagaattcacactggagagaaaccctatgagtgtaatgaatgtgggaaaaccttcagccggagctccaattttgctaaacatcaaagaattcatattggaaagaaaccgtacaaatgtagcgagtgtggaaaagccttcattcattcatcagctctcattcaacatcagagaactcataccggagagaaaccctttagatgtaatgagtgtgggaaaagctttaagtgcagttcatctctcatcagacatcaaagagttcacactgaagagcaaccctgaaaaattactgaatgtgaagaaataaaactgattatattcctggtccctgaacgatcctatagagacatccagtccctgactccacctgcctccaggtgcccagaacagcccatcgtggggacttcaccctcagcaagtggacgccgtttgtcctgccagggcagggacaccgagctggggcagcagtggacttggggcatgagcaggttgatgtcagaaaatacaccaataacctcgggattgtgcatgagatggagctgccccgcgtcagtgccctggaggtgaaggtaagagcctgtgcctgctgcgtgggaggctgcttcagggactgggaatcgggtggtcggtaaggcagagggggtggcctgtgggcctgtgtggtggtgagtgggccacggctgtcactgggaggggtggcctttcctgctggactctgttcccatgaggacttgaccaaaacccaaaccaagaactgcagtcctggctcagagtccactgcctgtttgaaccaagaccccagctgaaggctggacctgaccaaaacttggggcatttatggcctgaggatggcatgtcatggcatcaccattccagactaccagctccagttccttcagagggtctcagcccctggggcctgccctttcctggcttcttcaagttgggtcccttcagggccccaaagccctggacccagcatccacgggccactgtcagacgcctggcagctccgctaactccatcatggctcatttgacagcaaagacgcaaggaaagtaaacgtaccaacaagtggcaaaagatgcttgcagactggacaaaatataggagcaccaagaagctgtctcaaagagtatacaaagtcattcccctggcggtacggggccgggcgtggtcacttttgctagatattgacagaatcaagtcccagaacccaggcaaatataaggtaagtccctcccacactcagctaggagtacaaacaagctagactgtatcaggagcccaggactccagctggagggaacgttgagcctgggttgggagtgggggctgtggtcagacgcacatcctgggcatagatggtaactcaggcaccacaggtgcgctgggctctgctgaccctccctggtgtcagaaacaaggtaaaaaggagctttctgcagaaggaaaccttccttcc

SEQ ID NO: 356193 - DNA, 2583 bp, Homo sapiens
  misc_feature (1567)..(1567): n is a, c, g, or t
  misc_feature (1650)..(1650): n is a, c, g, or t
tgctgagcactcgcccacctgtccactagcgggtctctatgtctggagctcttagagataagacatagaggtgtctggttctgagaaaaggaagtttgctaagtgagagacacaactgactcaactgactcagaaaactgattatattcctggtccctgaacgatcctatagagacatccagtccctgactccacctgcctccaggtgcccagaacagcccatcgtggggacttcaccctcagcaagtggacgccgtttgtcctgccagggcaggatggagatggatggggacccgtataacctgcctgcccaggggcaaggcaatatcatcattactaagtatgagcagggacaccgagctggggcagcagtggacttggggcatgagcaggttgatgtcagaaaatacaccaataacctcgggattgtgcatgagatggagctgccccgcgtcagtgccctggaggtgaaggtaagagcctgtgcctgctgcgtgggaggctgcttcagggactgggaatcgggtggtcggtaaggcagagggggtggcctgtgggcctgtgtggtggtgagtgggccacggctgtcactgggaggggtggcctttcctgctggactctgttcccatgaggacttgaccaaaacccaaaccaagaactgcagtcctggctcagagtccactgcctgtttgaaccaagaccccagctgaaggctggacctgaccaaaacttggggcatttatggcctgaggatggcatgtcatggcatcaccattccagactaccagctccagttccttcagagggtctcagcccctggggcctgccctttcctggcttcttcaagttgggtcccttcagggccccaaagccctggacccagcatccacgggccactgtcagacgcctggcagctccgctaactccatcatggctcatttgacagcaaagacgcaaggaaagtaaacgtaccaacaagtggcaaaagatgcttgcagactggacaaaatataggagcaccaagaaggtaacatggggaggaagtggcccgcgtgactgctctctgcagagccaggagacaggcacccatggttgtgacctggcaccgtctgcctctcagtgggtgggtggtaccccatccttgccataggactgcaggcctgttcgccagctttgctctgcggggtcgccccatgtcctttctcactggagtgttcttctgtctgtagctgtctcaaagagtatacaaagtcattcccctggcggtacggggccgggcgtggtcacttttgctagatattgacagaatcaagtcccagaacccaggcaaatataaggtcatgaaggagaagggcaagaggtcctccagaatcatccactgcatccagctagatgtcagccacaccctgcagaaacacatgatgttcatacaaagattcggagtcaagcagcaggaattatgtgacatcctcgtggcctattctgcatataaccctgaggtgggctaccacagggacctgagccgcatcactgccatcctcctcctgtgtctgccagaggaagatgntttctgggcgcttacccagttgctcgctggtgagaggcactccctgtggtattctacagcccaaatactgcctggctcgagangctcctatcgcaccaggagcaggtgctgcacaagtccttcccaaagatcatgagacacctgggcaaggaagggctgtgcattgagggttccatgctgacgaggctcctccggtgtttccttgatgggaaatccttcgggctcaccctgagactgtgggatgtgttcatcttggagggcgcgcgggtactgacagccatggtgcatgcatcattcaaaatacacaggaagcacctcatgaagctttcctggagcactgtctgggagtttcaggagcgactctctcagagctgggccctggaggacaacgcggtcctcaggaaccttcaaacctctatgaaggaactcacaaaaaaacactgggacctgccacccccagggagcttgctacaaaatgcacattgctataccatagcctggggcttgcaatccaaggctggcaaggattcctgcacgtcaagggcctcaggtgactttcatgcacacccaagtcagaaggctctcctgaatcctggatgtcaccttcctgcccaaaaaaggaggaacgagggtcaaccagcagcagaccagtcacaaaaagagatgaaatgtgagtgcatggccttcctgacacccagacaaaactttgggcacaaagccaggctgcagctctggccactgacttggaccagggatgcccccatgcaggccggtgtgccctggctgctcttgacaccctctggctcctgacaccctctcttcggctgcctgcgttaggaagggagaacctgccagttttcagaagaaaatgtagctttattataacataggaaagactgcaagttattacgggaggaggaggaggcctgaaacagctcctgaaaatgagagggaaaaggaaggtgtaaatatgttggtaataaaatctccaaccacaaaatagtcatgggaatgtt

SEQ ID NO: 356194 - DNA, 463 bp, Homo sapiens
gaagccaccatgcctggcacatttatgatttttaagctttctaaaaacttttgtagaattctgtttataaactatattagtccattctcaagctgctatgaagaaatacccaagactgggtaatttataaggaaaaagaggtttaatggactcacagttccacatagctggggaggcctcaataatggcagaaggcaaaggaggagcaaaggcacatcttacatagtggcagcaggcaagagagcatgtgtaggggaattgccctttataaaaccatcagatctcatgagacttagtcactatcatgagaacagcacaggaaaacccgcccccatcattcagttacctcccaccggttcccctcccatgacatgaggggattatgggagctataattcaagataagatttgggtggagacagagccaaaccatatcactatatgttactcaaaagctcagtag

SEQ ID NO: 356195 - DNA, 1514 bp, Homo sapiens
ctggccctggcccgccgaggcccggacagccccgcaggccatgaccgcaaccctcgggtcccgaggcgccgctccaggcgggagcgccaactcccacggcccttccgacccccgcgtcccattgttccgaatctcactcacctcggaggatgccggcgcaggcctggctggggcgctcgccgcgagctcccggcagcccagaaagctaggtcggtgtcggcaggatccgcgaaggcgtacccggcgacttctccgcctaccctccgaagcgggagcaggcgggggcgcttcaccctcctcgcgagacagcggagaccccagcggcggctgcgacccctgtgacgcaaagggctcatcaccaatggcagctcggaagcagggcagagagcgagacccaccccccagctcccgcgcatcaaaacacaacacccgccttcctcacgcatgcgcagcagatggacgccggcctcgggggcggggctcagcgcaccggcccaaatgcggcccctcccccgccgctccagaccccggaggagggcagcgcgaccctccccatcttgttactggtactcagccactggggacactgactgaatgttcgcccctaacttacccggaaaacacgagaactagttcgatgtcgtttcaaccttaccaaactctgcggaaacttaggaaattatctttagtgtctagataggggaattgttagatggacttgaagtctctcacctcctgttgtacgcctcccggaagcaacaccaggagtccaacgggatcccaaaccagagcccaaccagtatcctataaagtcttcagagagggatcccctccaggctggggagaaacaggacaacctaacaaaacagggcctggactcctccctaaacagaccacgtttttctccgctcttccccttcccactccctgaaatctagactaaaactcttttaagataactgcgaggtataaagaacgtctagagcctaagcggcccgttgccagattctactcctcaggcctcaaatgtgagcgccccaaacattctagagctgaacctggcgggcaaggcccccgatcacgtgataccgccccccaactccgggcggaagaggccagcgacagcgctgcacgaagcgagtgggcgggcgctcgtgcccggctaaaagatggctgctggcgcctggcagccaccgcctgggaggttactgtaaggcccgcagctcccgccagctcccgcggactgctgccgcctccttaccatgaagccagtaagtcgtcgcacgctggactggatttattcagtgttgctgcttgccatcgttttaatctcctggggctgcatcatctatgcttcgatggtgtctgcaagacgacagctaaggaagaaatacccagacaaaatctttgggacgaatgaaaatttgtaactcttctggatttaattatctgaaaatacagttctttccctcatgcttatgtagatataaaaataaaattcataatgcaaagtt

SEQ ID NO: 356196 - DNA, 1927 bp, Homo sapiens
ctggccctggcccgccgaggcccggacagccccgcaggccatgaccgcaaccctcgggtcccgaggcgccgctccaggcgggagcgccaactcccacggcccttccgacccccgcgtcccattgttccgaatctcactcacctcggaggatgccggcgcaggcctggctggggcgctcgccgcgagctcccggcagcccagaaagctaggtcggtgtcggcaggatccgcgaaggcgtacccggcgacttctccgcctaccctccgaagcgggagcaggcgggggcgcttcaccctcctcgcgagacagcggagaccccagcggcggctgcgacccctgtgacgcaaagggctcatcaccaatggcagctcggaagcagggcagagagcgagacccaccccccagctcccgcgcatcaaaacacaacacccgccttcctcacgcatgcgcagcagatggacgccggcctcgggggcggggctcagcgcaccggcccaaatgcggcccctcccccgccgctccagaccccggaggagggcagcgcgaccctccccatcttgttactggtactcagccactggggacactgactgaatgttcgcccctaacttacccggaaaacacgagaactagttcgatgtcgtttcaaccttaccaaactctgcggaaacttaggaaattatctttagtgtctagataggggaattgttagatggacttgaagtctctcacctcctgttgtacgcctcccggaagcaacaccaggagtccaacgggatcccaaaccagagcccaaccagtatcctataaagtcttcagagagggatcccctccaggctggggagaaacaggacaacctaacaaaacagggcctggactcctccctaaacagaccacgtttttctccgctcttccccttcccactccctgaaatctagactaaaactcttttaagataactgcgaggtataaagaacgtctagagcctaagcggcccgttgccagattctactcctcaggcctcaaatgtgagcgccccaaacattctagagctgaacctggcgggcaaggcccccgatcacgtgataccgccccccaactccgggcggaagaggccagcgacagcgctgcacgaagcgagtgggcgggcgctcgtgcccggctaaaagatggctgctggcgcctggcagccaccgcctgggaggttactgtaaggcccgcagctcccgccagctcccgcggactgctgccgcctccttaccatgaagccagtaagtcgtcgcacgctggactggatttattcagtggttccaggtccagaagaggagcctgctctccctgttactgtaggggttgatggagtatcttgacaagcagccgtccatgtcgaagggaccctggcaggagaactagccttccggtgtgcagagacggctgccacccttggctcctctgttgtatagctgccgtcgtactgcacagactggagcttctggcacatggagcggaggacccgcaggaattcctcctgagcctctgcacccaccatggaggagcaggagctcacctctctcaggtaactccggatccggctttcacagctgtatctcagatagccagacttattccaaaatcgggactccaagccttcaaaccacagcgggtcctcagcccgggtgtcggctgcgacgttctggctgacgttgtacaggaggtcggccagcagtctctgcctctgtgggggcctgctcatcacacagtagctgccgggcggcctggatgagccacgcgtgcggctggcgaaaagcactgaggaagcacccgatgtcactcacatagccctgccaggcctggcgtgaggtgagcagcaccagctcggcatcgtcgaggacgcttcggtcagctccatgccatcctcgtacgaggg

SEQ ID NO: 356197 - DNA, 488 bp, Homo sapiens
caaacacttgttgcttgactgatacattatggcgggcgggcaaggcccccgatcacgtgataccgccccccaactccgggcggaagaggccagcgacagcgctgcacgaagcgagtgggcgggcgctcgtgcccggctaaaagatggctgctggcgcctggcagccaccgcctgggaggttactgtaaggcccgcagctcccgccagctcccgcggactgctgccgcctccttaccatgaagccagtaagtcgtcgcacgctggactggatttattcagtgttgctgcttgccatcgttttaatctcctggggctgcatcatctatgcttcgatggtgtctgcaagacgacagctaaggaagaaatacccagacaaaatctttgggacgaatgaaaatttgtaactcttctggatttaattatctgaaaatacagttctttccctcatgcttatgtagatataaaaataaaattcataatgcaaagtt

SEQ ID NO: 356198 - DNA, 1835 bp, Homo sapiens
ctggccctggcccgccgaggcccggacagccccgcaggccatgaccgcaaccctcgggtcccgaggcgccgctccaggcgggagcgccaactcccacggcccttccgacccccgcgtcccattgttccgaatctcactcacctcggaggatgccggcgcaggcctggctggggcgctcgccgcgagctcccggcagcccagaaagctaggtcggtgtcggcaggatccgcgaaggcgtacccggcgacttctccgcctaccctccgaagcgggagcaggcgggggcgcttcaccctcctcgcgagacagcggagaccccagcggcggctgcgacccctgtgacgcaaagggctcatcaccaatggcagctcggaagcagggcagagagcgagacccaccccccagctcccgcgcatcaaaacacaacacccgccttcctcacgcatgcgcagcagatggacgccggcctcgggggcggggctcagcgcaccggcccaaatgcggcccctcccccgccgctccagaccccggaggagggcagcgcgaccctccccatcttgttactggtactcagccactggggacactgactgaatgttcgcccctaacttacccggaaaacacgagaactagttcgatgtcgtttcaaccttaccaaactctgcggaaacttaggaaattatctttagtgtctagataggggaattgttagatggacttgaagtctctcacctcctgttgtacgcctcccggaagcaacaccaggagtccaacgggatcccaaaccagagcccaaccagtatcctataaagtcttcagagagggatcccctccaggctggggagaaacaggacaacctaacaaaacagggcctggactcctccctaaacagaccacgtttttctccgctcttccccttcccactccctgaaatctagactaaaactcttttaagataactgcgaggtataaagaacgtctagagcctaagcggcccgttgccagattctactcctcaggcctcaaatgtgagcgccccaaacattctagagctgaacctggcgggcaaggcccccgatcacgtgataccgccccccaactccgggcggaagaggccagcgacagcgctgcacgaagcgagtgggcgggcgctcgtgcccggctaaaagatggctgctggcgcctggcagccaccgcctgggaggttactgtaaggcccgcagctcccgccagctcccgcggactgctgccgcctccttaccatgaagccagtaagtcgtcgcacgctggactggatttattcagtggtaagtcccggggatcgcgggcccccaccgtgtcgactcactgggcccgcaggcggaaaggccctatttcttcagcacccagaaactccaaaatccattcctgaattaagcatttcactccctcacctcgactccgcctcttcctggaggatacgatcttccgcttcttacgtaagggctgctgggtgtacccgccactggaaccccatttattcgactttgttactttaattcccaccttagcaatggcaacggtaacctgacgggggcgaggggaaatatcaggtagatttcacacctcctttgcgatttttggtttagttgctgcttgccatcgttttaatctcctggggctgcatcatctatgcttcgatggtgtctgcaagacgacagctaaggaagaaatacccagacaaaatctttgggacgaatgaaaatttgtaactcttctggatttaattatctgaaaatacagttctttccctcatgcttatgtagatataaaaataaaattcataatgcaaagtt

SEQ ID NO: 356199 - DNA, 1840 bp, Homo sapiens
gaatcttagctgattgcattatgaactgtcaaactgtgaagatgacccatatgtaaacagttataacagctacagattattgctagtagcattctatacaattccatattaatgttcttaggagctaatatttgataaaggggaaagctagttaaaaactaattaatttgtcaaatgtagcattcttattatgagtgtaatatctcatggagatttaaatatgaacgaaaggacttatccttctgctttttaaaagccccagcattactagatagtgtttttcttgaaggccaaagctgtaaaatgacaaagttggtgattttcagcagcactcacctgagctgtgagcgcctgcacctgttcggtagaacccactagaatcacttctctgtaggataagtgatgcctttgaatccagcagcataaaaatctgttctttttagtcatcaagtttttgtttccaggatatttctagcattgcaaaaaaaaatttcttcaccaaacactaattcctaaacacccatccaaaccacaaaaattctcttgttagtaggcgagagtgctaggacttcctgtgttcacctcccatgcacccagcattgtcttttatgcatgagatattccattagattttcctagagtggccaggacacccttcatagtaagttatatctcttaactggattctatagttttatcctcgagcaacttggaaaagctaagacatcctccacccacactggtatctacgcgcctggaagctgcaccttctctcattgctgtgctctgctttaaggaaaacctgatatgacagaatcaagactattaaaagataaatgaggggaaatcttcatttaagaaagttgccttgctccccaagagtgcctttaattgctattcccctaggcatctgggtgcatatcattaatgaaatcattaacctttgtctctggtccttcctttctaaaaacagcagattatagaaggtggtctggcaaagggattttcaaagggcaaaagtctcatcatcatctttccactcaaaatcctattattctacatttcactttgcaggggtcctagggacaggattgcagggacaggggacatgggaggaagacagaaaaattcaaaaccagcagatgccactacctggcaatgaattgaaaattaggggaaagcatctttggcgtgaccttttattaagacaacagaaatttagaacattttacatgcttctttgttaaatggtgaagcaagggaatgaaagtatttatttttagagctcatagttaactccatcaagacatggctacccacccctccagttatgaacttgtattacagctccacttggtgacttcctttctgtgtatcaggagcagagcagaggacaacttgtagaagacatgaccattaagagacatcaacttcgcaacaaatataagacaaggatacaaggattcctatgtgatgcagctaggtttttatatccttctaacaaatggtgagcaggagacttttttggaaataattagttgtgaaattccatttttctgacagccccttaaatttgaagttatttcatttgtagttaaggttatcacatccctgccaattttactagattttttcagagacaagcattcagcatggcattagtaatgatggtttaaactaggtgcagaactgtcccatgaagagaagaatgatatcagtatttaaataataaaagaagagacaatgtatggtttatagtgattcattttaagattgctgtattttgattttgtggtttaaaataaatgcattaaggatcttttaagttactacaaaaaac

SEQ ID NO: 356200 - DNA, 3031 bp, Homo sapiens
ggacctgccgggacccttgcccgccgcgcacccgcagtcaccgccgagcgggcggccgggccgggacccgcgagtgtgcaccggcggccgggctggcgccgagcccagagcggaccagcagcagctcaagcgctgcggccgccgcctccccgctgaccccgcgatctgaggctgtcagagatgactctggttctgtccatgaatagattctgcgagcccattgtctcggaaggagctgctgaaattgctgggtaccaaacactatgggaggctgacagctacggaggcccaagccccccagggccagcacaagctcctttgcagggagaccggggagctggtcccccactggcaggatcacattacaggggaatttcaaatcctataacaacatccaagatcacatactttaagaggaagtatgtggaagaagaggattttcacccaccactcagcagctgtagccataaaaccatctcaatttttgaggaacgagcccacatcctttatatgtccttagaaaagctaaagtttatcgatgatcctgaagtgtacctccgaagatctgtccttataaacaatttgatgaaaaggatccatggagaaattatcatgcagaataactggtgcttccctgcctgctctttcaatggcacctctgcccaagagtggtttatggctcaagactgcccttaccgaaaacgaccacggatggccaaagaggaatgtgaaaagtttcatgcctgctgcttttaccaagaatgtggtggccactacctaaatttacccctttctgtcaatgctaatgttggaagtgcctccactgctgcctcctctccctccgcctcttcttcctcctcatcttcctcttcctctccccctttgcctttaccgagttgttcccgccaggtggattttgatgtaggtagtgcatctatttacaagagtgatggccagatacctgccaatgaaatctttgtcactaatgtcagatcacttggtgttcaggaaaaggccaaattaaatgatgagaaagcaaatgatgacaccaacagagatggtggccccctcagccacgaacctgtgggaaatgaccttgcttttgagtgcaaaggccaattttatgattattttgagaccggatataatgaaagaaacaatgtaaatgaatcttggaaaaagtccttacggaaaaaggaggcttcaccaccaagtaacaaactgtgctgcagcaaaggaagtaaaatatgagccatcttctcaccgaactttgaagcatgcacagcatgatcagttagctctcgtaaattttattttgaatggattttgtagttttgtacaacagataaaattatgccatgaacatgccatgtcgttttaatgcctggagagcagattgcgtaaaacatctgtatagcaggcatcagcgagcttcttataaatgtggtgatttttaccaaggaaacgattgacttaatgcttaaaagtatatcatagttttcttacggaaaagatcagtagatgagattgggggacaatgtgcccttgcaatatttccattgccccccaaggagcctgtcactagctaagaaatttctacatgtttgccagttaattagggagttatttggtaagcaaatcaatataaccagcaaagatacctgcttcttctatatgatacaatattttttttaaataaaagactaaagacagggagctagatgaaatggcttaatggtgctgttaagtatttgtacctaacagtcttgtgtgacagatgaaaataggatgtaacataatgaaacacacctgtctaggggcggcaatcaacagtcttacacagagagggtattccctgcaagtttctggcttgcctgtgatgggtgatgaggcttttagagaggtgttatacagggcgatttttggtgccttacttttatcttaatttttgccaatgtgaaaattaaggataaatcagagttacagcagggatttaacaaacaggacaaaaaaaaaaaaaaaaaaaaaccacagggtggatcaatatggtttggaaactgttaactttgaactattgtgttcagcttttgattcgacatctctattctttatttttgatgcccaattgcttttggattcgccgttttttcaatagggatggaggaaatgagagagagagctgttagaaagcagcacgggctgctcgagcttttctatggcaactgtgtgttgctggggttggggttttctgggttttgggttgttttgttttgttttcttgtccaatgaagttcacgaaccagtggcatgcattatacttttctctgttttgcatcatttcacttgtttagattataaaagcatgtgggtttttatatatgaactttgctgttgattaagaagcacaatgttaataaatgatgtggtgatcaataaggtttatcttaaagaatgtaaagactttaggtttttgaaagttattttggagaaatgggacttaatctataatagttactatgtatttggtctacattttccaaataatatctttaacttgtacatttgaaaagtgttcagagtggccctcctaccatccttccttccactccagccaactcttcctgctaaactgtattccagtttccaagtttactaattgacttgggcctgttcaaataatacttcacagaaaccaaatgccaaacggaggaaataagtaagccctcccagtttctccaagataaagctttttttattattgctattaatattaaatataggtctcattcatacagtgtatgagtaggatcatttggacaattgtccacaaagaccaatttttaaaacattttcttgtgttatagttaaatagtctagtaatgttttgtcctttattttcaatatttgataaacatttgatgttcaaaacttagctaatagatgcttgtatatgaatgtgttgtaataaagtgaggttttcttgatatatatttattaagatgataaaaattcattaagttttttaaatttt

SEQ ID NO: 356201 - DNA, 1661 bp, Homo sapiens
gaatcttagctgattgcattatgaactgtcaaactgtgaagatgacccatatgtaaacagttataacagctacagattattgctagtagcattctatacaattccatattaatgttcttaggagctaatatttgataaaggggaaagctagttaaaaactaattaatttgtcaaatgtagcattcttattatgagtgtaatatctcatggagatttaaatatgaacgaaaggacttatccttctgctttttaaaagccccagcattactagatagtgtttttcttgaaggccaaagctgtaaaatgacaaagttggtgattttcagcagcactcacctgagctgtgagcgcctgcacctgttcggtagaacccactagaatcacttctctgtaggataagtgatgcctttgaatccagcagcataaaaatctgttctttttagtcatcaagtttttgtttccaggatatttctagcattgcaaaaaaaaatttcttcaccaaacactaattcctaaacacccatccaaaccacaaaaattctcttgttagtaggcgagagtgctaggacttcctgtgttcacctcccatgcacccagcattgtcttttatgcatgagatattccattagattttcctagagtggccaggacacccttcatagtaagttatatctcttaactggattctatagttttatcctcgagcaacttggaaaagctaagacatcctccacccacactggtatctacgcgcctggaagctgcaccttctctcattgctgtgctctgctttaaggaaaacctgatatgacagaatcaagactattaaaagataaatgaggggaaatcttcatttaagaaagttgccttgctccccaagagtgcctttaattgctattcccctaggcatctgggtgcatatcattaatgaaatcattaacctttgtctctggtccttcctttctaaaaacagcagattatagaaggtggtctggcaaagggattttcaaagggcaaaagtctcatcatcatctttccactcaaaatcctattattctacatttcactttgcaggggtcctagggacaggattgcagggacaggggacatgggaggaagacagaaaaattcaaaaccagcagatgccactacctggcaatgaattgaaaattaggggaaagcatctttggcgtgaccttttattaaagcagaggacaacttgtagaagacatgaccattaagagacatcaacttcgcaacaaatataagacaaggatacaaggattcctatgtgatgcagctaggtttttatatccttctaacaaatggtgagcaggagacttttttggaaataattagttgtgaaattccatttttctgacagccccttaaatttgaagttatttcatttgtagttaaggttatcacatccctgccaattttactagattttttcagagacaagcattcagcatggcattagtaatgatggtttaaactaggtgcagaactgtcccatgaagagaagaatgatatcagtatttaaataataaaagaagagacaatgtatggtttatagtgattcattttaagattgctgtattttgattttgtggtttaaaataaatgcattaaggatcttttaagttactacaaaaaac

SEQ ID NO: 356202 - DNA, 299 bp, Homo sapiens
  misc_feature (112)..(112): n is a, c, g, or t
  misc_feature (115)..(117): n is a, c, g, or t
  misc_feature (120)..(124): n is a, c, g, or t
  misc_feature (127)..(127): n is a, c, g, or t
  misc_feature (131)..(131): n is a, c, g, or t
  misc_feature (137)..(137): n is a, c, g, or t
  misc_feature (144)..(144): n is a, c, g, or t
  misc_feature (156)..(156): n is a, c, g, or t
ttcggcacgaggagaagaatgatatcagtatttaaataataaaatgaatcactataaaccatacattgtctcttcttttattatttaaatactgatatcattcttctcttcntgnnncannnnngcncctngtttanaccatcnttactaatgccntgctgagaagaatgatatcagtatttaaataataaaagaagagacaatgtatggtttatagtgattcattttaagattgctgtattttgattttgtggtttaaaataaatgcattaaggatcttttaagttactacaaaaaac

SEQ ID NO: 356203 - DNA, 1868 bp, Homo sapiens
gaatcttagctgattgcattatgaactgtcaaactgtgaagatgacccatatgtaaacagttataacagctacagattattgctagtagcattctatacaattccatattaatgttcttaggagctaatatttgataaaggggaaagctagttaaaaactaattaatttgtcaaatgtagcattcttattatgagtgtaatatctcatggagatttaaatatgaacgaaaggacttatccttctgctttttaaaagccccagcattactagatagtgtttttcttgaaggccaaagctgtaaaatgacaaagttggtgattttcagcagcactcacctgagctgtgagcgcctgcacctgttcggtagaacccactagaatcacttctctgtaggataagtgatgcctttgaatccagcagcataaaaatctgttctttttagtcatcaagtttttgtttccaggatatttctagcattgcaaaaaaaaatttcttcaccaaacactaattcctaaacacccatccaaaccacaaaaattctcttgttagtaggcgagagtgctaggacttcctgtgttcacctcccatgcacccagcattgtcttttatgcatgagatattccattagattttcctagagtggccaggacacccttcatagtaagttatatctcttaactggattctatagttttatcctcgagcaacttggaaaagctaagacatcctccacccacactggtatctacgcgcctggaagctgcaccttctctcattgctgtgctctgctttaaggaaaacctgatatgacagaatcaagactattaaaagataaatgaggggaaatcttcatttaagaaagttgccttgctccccaagagtgcctttaattgctattcccctaggcatctgggtgcatatcattaatgaaatcattaacctttgtctctggtccttcctttctaaaaacagcagattatagaaggtggtctggcaaagggattttcaaagggcaaaagtctcatcatcatctttccactcaaaatcctattattctacatttcactttgcaggggtcctagggacaggattgcagggacaggggacatgggaggaagacagaaaaattcaaaaccagcagatgccactacctggcaatgaattgaaaattaggggaaagcatctttggcgtgaccttttattaagacaacagaaatttagaacattttacatgcttctttgttaaatggtgaagcaagggaatgaaagtatttatttttagagctcatagttaactccatcaagacatggctacccacccctccagttatgaacttgtattacagctccacttggtgacttcctttctgtgtatcaggagcagagcagaggacaacttgtagaagacatgaccattaagagacatcaacttcgcaacaaatataagacaaggatacaaggattcctatgtgatgcagctaggtttttatatccttctaacaaatgtatctgtgacaggctgaagaacgatgactaaacgaagggaatttacacaagctagtctggtggtgtttgcaaaccatcgccatgagcttcatcttctttggtaaacaatccgctggtgggctgtctatggttggtttcttttctttgttgttgatccaatttgttaactttgaaaatgcaaactacttattcacagtgtggaaacacctgcttttgaccacaatgaaactgatagaatgtatggcgatgtattagttgtttctcatgaaatttcttatatttctcaaccccatttctatgactcttctcttgatttaaaaatatgaaaatcgaataaaatcttgtggggaggacctacata

SEQ ID NO: 356204 - DNA, 926 bp, Homo sapiens
ggacctgccgggacccttgcccgccgcgcacccgcagtcaccgccgagcgggcggccgggccgggacccgcgagtgtgcaccggcggccgggctggcgccgagcccagagcggaccagcagcagctcaagcgctgcggccgccgcctccccgctgaccccgcgatctgaggctgtcagagatgactctggttctgtccatgaatagattctgcgagcccattgtctcggaaggagctgctgaaattgctgggtaccaaacactatgggaggctgacagctacggaggcccaagccccccagggccagcacaagctcctttgcagggagaccggggagctggtcccccactggcaggatcacattacaggggaatttcaaatcctataacaacatccaagatcacatactttaagaggaagtatgtggaagaagaggattttcacccaccactcagcagctgtagccataaaagcagaggacaacttgtagaagacatgaccattaagagacatcaacttcgcaacaaatataagacaaggatacaaggattcctatgtgatgcagctaggtttttatatccttctaacaaatggtgagcaggagacttttttggaaataattagttgtgaaattccatttttctgacagccccttaaatttgaagttatttcatttgtagttaaggttatcacatccctgccaattttactagattttttcagagacaagcattcagcatggcattagtaatgatggtttaaactaggtgcagaactgtcccatgaagagaagaatgatatcagtatttaaataataaaagaagagacaatgtatggtttatagtgattcattttaagattgctgtattttgattttgtggtttaaaataaatgcattaaggatcttttaagttactacaaaaaac

SEQ ID NO: 356205 - DNA, 876 bp, Homo sapiens
ggacctgccgggacccttgcccgccgcgcacccgcagtcaccgccgagcgggcggccgggccgggacccgcgagtgtgcaccggcggccgggctggcgccgagcccagagcggaccagcagcagctcaagcgctgcggccgccgcctccccgctgaccccgcgatctgaggctgtcagagatgactctggttctgtccatgaatagattctgcgagcccattgtctcggaaggagctgctgaaattgctgggtaccaaacactatgggaggctgacagctacggaggcccaagccccccagggccagcacaagctcctttgcagggagaccggggagctggtcccccactggcagctccacttggtgacttcctttctgtgtatcaggagcagagcagaggacaacttgtagaagacatgaccattaagagacatcaacttcgcaacaaatataagacaaggatacaaggattcctatgtgatgcagctaggtttttatatccttctaacaaatgtatctgtgacaggctgaagaacgatgactaaacgaagggaatttacacaagctagtctggtggtgtttgcaaaccatcgccatgagcttcatcttctttggtaaacaatccgctggtgggctgtctatggttggtttcttttctttgttgttgatccaatttgttaactttgaaaatgcaaactacttattcacagtgtggaaacacctgcttttgaccacaatgaaactgatagaatgtatggcgatgtattagttgtttctcatgaaatttcttatatttctcaaccccatttctatgactcttctcttgatttaaaaatatgaaaatcgaataaaatcttgtggggaggacctacata

SEQ ID NO: 356206 - DNA, 954 bp, Homo sapiens
ggacctgccgggacccttgcccgccgcgcacccgcagtcaccgccgagcgggcggccgggccgggacccgcgagtgtgcaccggcggccgggctggcgccgagcccagagcggaccagcagcagctcaagcgctgcggccgccgcctccccgctgaccccgcgatctgaggctgtcagagatgactctggttctgtccatgaatagattctgcgagcccattgtctcggaaggagctgctgaaattgctgggtaccaaacactatgggaggctgacagctacggaggcccaagccccccagggccagcacaagctcctttgcagggagaccggggagctggtcccccactggcaggatcacattacaggggaatttcaaatcctataacaacatccaagatcacatactttaagaggaagtatgtggaagaagaggattttcacccaccactcagcagctgtagccataaaagcagaggacaacttgtagaagacatgaccattaagagacatcaacttcgcaacaaatataagacaaggatacaaggattcctatgtgatgcagctaggtttttatatccttctaacaaatgtatctgtgacaggctgaagaacgatgactaaacgaagggaatttacacaagctagtctggtggtgtttgcaaaccatcgccatgagcttcatcttctttggtaaacaatccgctggtgggctgtctatggttggtttcttttctttgttgttgatccaatttgttaactttgaaaatgcaaactacttattcacagtgtggaaacacctgcttttgaccacaatgaaactgatagaatgtatggcgatgtattagttgtttctcatgaaatttcttatatttctcaaccccatttctatgactcttctcttgatttaaaaatatgaaaatcgaataaaatcttgtggggaggacctacata

SEQ ID NO: 356207 - DNA, 946 bp, Homo sapiens
agtgaaccaatcatgccaccatactccagcttggatgacagagcgagaatctgtctaaaaaaaaaaaaaagcagttactggaaggagttaccttcatcatagatcactattcctatttctcaagtttccaccgactccacctctctcctcaaggccagtcttgggcatgccttgcctttagatggcactttagggcaatctaatgtgcccaacaggagagcctggtttgttaaacgggagagccttatcctgtgaatatcagtgctctatccagaacaggttctctgtggtctcagaggcagtccccagctacctaagaagtttggcaaagcgaatgcacttctcaaggtgccaaagccactcggtggaccccagtcttaggagacaccagacaaggctgtagggacaggtgctggctccgcaatgacacgggttcagttcctaactcggtatttcctgtgtggccttgacgggtctcttaatctcttaaatttcttggtcataaaaaaatcaaaagaaaagtgaaccttgaggccattatgccaggggaaatacgccagtcacaaaaaaagacaaatactgaatgattccacctgtatgaagtatctagaggagccaacttcagagagacagaaagtgccacggtgactgccagggacgaggagaggagggaaatacgaagttgttgttaaatgggtacagagttttggttttgcaagatgaaaacattctggggattcattgcacaaccacgtaaacgtccttgacgctactgaaaagtacgctaatggttaagatggtaaattttatgctttgcgtagtttgccacgatttaaaatatgttaaaaaattttttgaaagaaaggaagggaatttagctaatgcttcctttgcaagattgtttcgaggatttgaggtaaaatgccagagtaaaaagtagatggtg

SEQ ID NO: 356208 - DNA, 557 bp, Homo sapiens
  misc_feature (243)..(243): n is a, c, g, or t
  misc_feature (375)..(375): n is a, c, g, or t
accaggtgatatagtatcctggagcagtgtacttaaggtatgatatctgggctggtgccagtccacacactggtatactgctcgtcctgctcttccaccaagtaagtaaagaaatggagagggccctttgaaaaactttagagcaatttggcagagtgattttatgtttattgaatctactaatgaaaactgtagccttataatttatatacctctagtttatttttccatttcacttctcangtttttgtatttaaaaaaagaactggtacggccgggcacagtggctcatgcctgtcccagtactttgggaggccaaggcgggcggatcacaaggtcaggaattcaagaccaatctggccaacatggtgaaanccccttctctactaaaaatacaaaaattagcggggcgtggtgtcgtgcacctgtaatcccagcttctcgggaggctgaggcagaagaattgcttgaacccgggaggtggaggttgcagtgagccgagatcacgccactgcactccggcctgggcgacagagtgagactccatctccaaaaaa

SEQ ID NO: 356209 - DNA, 326 bp, Homo sapiens
ttttttttcagttttggaggtttctactgggatatcctcaaggccagagattctttcctcagctatgcccaatctcctaataagcccagtaacaacgtttttcatttctgttacagtgtttttgatctctagcatttcatttggtttctttttttagaatttccatctctctacttacatagcccaactgttcttgcatgctactttatgcatcagacttcttggcatagttgttttacattcttagcctgatcattccaacatccctgccatatctgaatttagttctgatgcttactctgtctcttcaactgtgtgtggtcgac

SEQ ID NO: 356210 - DNA, 1856 bp, Homo sapiens
ctagcgcaggggcggtgcctccaagtgactgccgtgcagatccaggggagttggaaggtcacaggagttcagcctcagaagactggactttatgagtataaagtctttggtgttctggaggactgctcaccaactctactggcagacatctatatggactcagattacagaaaacaatgggaccagtatgttaaagaactctatgaacaagaatgcaacggagagactgtggtctactgggaagtgaagtacccttttcccatgtccaacagagactatgtctaccttcggcagcggcgagacctggacatggaagggaggaagatccatgtgatcctggcccggagcacctccatgcctcagcttggcgagaggtctggggtgatccgggtgaagcaatacaagcagagcctggcgattgagagtgacggcaagaaggggagcaaagttttcatgtattacttcgataacccgggtggccaaattccgtcctggctcattaactgggccgccaagaatggagttcctaacttcttgaaagacatggcaagagcctgtcagaactacctcaagaaaacctaagaaagagaactgggaacattgcatccatgggttgatgtctctggaagtgcaaccacccaatgtctctggaagtgccacctggaagtgccacctggaagtgtctctggaagagcacccaccactgttcagccttcccctgctgtttctgtcttcagaggcctacacactaccacatcctttctaagcatgtttgcctgacatccagctcactcgtctgcttcctttctcgctccccccatcctgggctgggctgccttcttctacagttcaatatggggcagactagggaaacctttgcttgcttactattaggaggggaagtcttcagtagggaacacgatcattccattgtgcaattttacggggatgggtgggcggagggacacaacaaaatttaagaatgactatttgggcgggctggctcttttgcagcttgtgatttcttccagcttgggaggggctgctggaagtggcatttcgttcagagctgactttcagtgcacccaaactggatgacgtgccaatgtccatttgccttatgctttgtggagctgattaggctgggatttgaggtgataatccagtaagtctttcctcgttcctacttgtggaggatcagtagctgttatgatgccagaccatttggagaagtatcagaggcctgaccggacacataatacgacaaccacatttttcctcatcatccatgaggaaatggatgatttctcttttccatatgtcactgggggaaaggctgcctgtacctctcaagctttgcattttactggaaactgaggcgtcaagatggctgtggcagctagcaaaagcaaagatgctttgtgcatagccttgtgaaaaagtatctttctatgcaataagatgaattttcctcccagaatatttagaaatgtagaagggataacagttcacagccaggtaaaatttaactggtggcttaatgactctgcacctttttctcaggaattctgcctaagttgtctgccttttctaccaccaaaaagacttttagttttctatgctttctcctgaattttggtagggtaaggtatttctatgtcaaaggcacagccttgatgatctcagggaaaaattttaatcactgtgtataatgatactgaaccttgattaataacagaaattcaggatgtaaagccacagaatgggatttattaatgtgggatacctcagactgtttgttttctttctgggaagaaaagtgtgttctataatgaataaatatagagtggttttta

SEQ ID NO: 356211 - DNA, 1122 bp, Homo sapiens
cagtttcctgccaatgacgctggggcagccggggcagccggggcagcccggtcaccccgcccccaggcccacactaagggtgtccgcggcctgccctccaggcggaggagcccggactgcggaaggatggagctggccgccggaagcttctcggaggagcagttctgggaggcctgcgccgagctccagcagcccgctctggccggggccgactggcagctcctagtggagacctcgggcatcagcatctaccggctgctggacaagaagactggactttatgagtataaagtctttggtgttctggaggactgctcaccaactctactggcagacatctatatggactcagattacagaaaacaatgggaccagtatgttaaagaactctatgaacaagaatgcaacggagagactgtggtctactgggaagtgaagtacccttttcccatgtccaacagagactatgtctaccttcggcagcggcgagacctggacatggaagggaggaagatccatgtgatcctggcccggagcacctccatgcctcagcttggcgagaggtctggggtgatccgggtgaagcaatacaagcagagcctggcgattgagagtgacggcaagaaggggagcaaagttttcatgtattacttcgataacccgggtggccaaattccgtcctggctcattaactgggccgccaagggagggaactgcagtggtagtttgtatcactagagactgcccaggagcctggcattatggggaccatcagcctgctttgcacaagatctactactagagagctcaacagattccttggaagagtgaaaaagcacatcaactttggagtcaaacagacgcaatttcaaatcctggctctgctgctgactgtcttgttttatttaaggaagccatgcatttcttcctttttaaaaatgaagatagttgtcttctactgcatagagggggagtaaataagacaatatttaggaaaagtcttgcccagtgctcaacattaactaaataataatatatcctgctccttgatccccaatccttaccattttctaattcaataaagcaagtgctttcatttctttggaagaatgtaacaatcca

SEQ ID NO: 356212 - DNA, 1889 bp, Homo sapiens
cagtttcctgccaatgacgctggggcagccggggcagccggggcagcccggtcaccccgcccccaggcccacactaagggtgtccgcggcctgccctccaggcggaggagcccggactgcggaaggatggagctggccgccggaagcttctcggaggagcagttctgggaggcctgcgccgagctccagcagcccgctctggccggggccgactggcagctcctagtggagacctcgggcatcagcatctaccggctgctggacaagaagactggactttatgagtataaagtctttggtgttctggaggactgctcaccaactctactggcagacatctatatggactcagattacagaaaacaatgggaccagtatgttaaagaactctatgaacaagaatgcaacggagagactgtggtctactgggaagtgaagtacccttttcccatgtccaacagagactatgtctaccttcggcagcggcgagacctggacatggaagggaggaagatccatgtgatcctggcccggagcacctccatgcctcagcttggcgagaggtctggggtgatccgggtgaagcaatacaagcagagcctggcgattgagagtgacggcaagaaggggagcaaagttttcatgtattacttcgataacccgggtggccaaattccgtcctggctcattaactgggccgccaagaatggagttcctaacttcttgaaagacatggcaagagcctgtcagaactacctcaagaaaacctaagaaagagaactgggaacattgcatccatgggttgatgtctctggaagtgcaaccacccaatgtctctggaagtgccacctggaagtgccacctggaagtgtctctggaagagcacccaccactgttcagccttcccctgctgtttctgtcttcagaggcctacacactaccacatcctttctaagcatgtttgcctgacatccagctcactcgtctgcttcctttctcgctccccccatcctgggctgggctgccttcttctacagttcaatatggggcagactagggaaacctttgcttgcttactattaggaggggaagtcttcagtagggaacacgatcattccattgtgcaattttacggggatgggtgggcggagggacacaacaaaatttaagaatgactatttgggcgggctggctcttttgcagcttgtgatttcttccagcttgggaggggctgctggaagtggcatttcgttcagagctgactttcagtgcacccaaactggatgacgtgccaatgtccatttgccttatgctttgtggagctgattaggctgggatttgaggtgataatccagtaagtctttcctcgttcctacttgtggaggatcagtagctgttatgatgccagaccatttggagaagtatcagaggcctgaccggacacataatacgacaaccacatttttcctcatcatccatgaggaaatggatgatttctattttcctcccagaatatttagaaatgtagaagggataacagttcacagccaggtaaaatttaactggtggcttaatgactctgcacctttttctcaggaattctgcctaagttgtctgccttttctaccaccaaaaagacttttagttttctatgctttctcctgaattttggtagggtaaggtatttctatgtcaaaggcacagccttgatgatctcagggaaaaattttaatcactgtgtataatgatactgaaccttgattaataacagaaattcaggatgtaaagccacagaatgggatttattaatgtgggatacctcagactgtttgttttctttctgggaagaaaagtgtgttctataatgaataaatatagagtggttttta

SEQ ID NO: 356213 - DNA, 1605 bp, Homo sapiens
gtttcagaaacatcttcgctttttcctagaaaaagctaacatataaggcctttttgcaacagaagttcctgttgactggtcttacttttgtcctcagtcctactttttgtcatcatctgcaacaacattctgttgaaatccagttagggagcctattcatttttgttcgtcctaaagccaacattgtttaccttctgccacatcccaaagaatcaagagtgaccactgtgaagacatagaaatgacagtctcatttcctttgcagaatggagttcctaacttcttgaaagacatggcaagagcctgtcagaactacctcaagaaaacctaagaaagagaactgggaacattgcatccatgggttgatgtctctggaagtgcaaccacccaatgtctctggaagtgccacctggaagtgccacctggaagtgtctctggaagagcacccaccactgttcagccttcccctgctgtttctgtcttcagaggcctacacactaccacatcctttctaagcatgtttgcctgacatccagctcactcgtctgcttcctttctcgctccccccatcctgggctgggctgccttcttctacagttcaatatggggcagactagggaaacctttgcttgcttactattaggaggggaagtcttcagtagggaacacgatcattccattgtgcaattttacggggatgggtgggcggagggacacaacaaaatttaagaatgactatttgggcgggctggctcttttgcagcttgtgatttcttccagcttgggaggggctgctggaagtggcatttcgttcagagctgactttcagtgcacccaaactggatgacgtgccaatgtccatttgccttatgctttgtggagctgattaggctgggatttgaggtgataatccagtaagtctttcctcgttcctacttgtggaggatcagtagctgttatgatgccagaccatttggagaagtatcagaggcctgaccggacacataatacgacaaccacatttttcctcatcatccatgaggaaatggatgatttctcttttccatatgtcactgggggaaaggctgcctgtacctctcaagctttgcattttactggaaactgaggcgtcaagatggctgtggcagctagcaaaagcaaagatgctttgtgcatagccttgtgaaaaagtatctttctatgcaataagatgaattttcctcccagaatatttagaaatgtagaagggataacagttcacagccaggtaaaatttaactggtggcttaatgactctgcacctttttctcaggaattctgcctaagttgtctgccttttctaccaccaaaaagacttttagttttctatgctttctcctgaattttggtagggtaaggtatttctatgtcaaaggcacagccttgatgatctcagggaaaaattttaatcactgtgtataatgatactgaaccttgattaataacagaaattcaggatgtaaagccacagaatgggatttattaatgtgggatacctcagactgtttgttttctttctgggaagaaaagtgtgttctataatgaataaatatagagtggttttta

SEQ ID NO: 356214 - DNA, 1125 bp, Homo sapiens
cagtttcctgccaatgacgctggggcagccggggcagccggggcagcccggtcaccccgcccccaggcccacactaagggtgtccgcggcctgccctccaggcggaggagcccggactgcggaaggatggagctggccgccggaagcttctcggaggagcagttctgggaggcctgcgccgagctccagcagcccgctctggccggggccgactggcagctcctagtggagacctcgggcatcagcatctaccggctgctggacaagaagactggactttatgagtataaagtctttggtgttctggaggactgctcaccaactctactggcagacatctatatggactcagattacagaaaacaatgggaccagtatgttaaagaactctatgaacaagaatgcaacggagagactgtggtctactgggaagtgaagtacccttttcccatgtccaacagagactatgtctaccttcggcagcggcgagacctggacatggaagggaggaagatccatgtgatcctggcccggagcacctccatgcctcagcttggcgagaggtctggggtgatccgggtgaagcaatacaagcagagcctggcgattgagagtgacggcaagaaggggagcaaagttttcatgtattacttcgataacccgggtggccaaattccgtcctggctcattaactgggccgccaaggctggccttgagctcctgacctcaagcaatccactggcctcggcctctcaaagtgctgggattacaggcatgagccaccacacccggccaatcagagcagaaccaagcgggaagctcagaatcagagagacctcatcaagtttttggcaaacccaaacattctgcaatagattgagtggaaggaagaggaaggacataaagataaagacatgagaaaagaagctgagtctttgttgaaacactgaaatgggtgcaggtatcatttcttatctcattgttttttctcataagccctgaattaattcatttattcacagtattttcgcagatgtgaaattcacatattattcacagatgtgttcactatcatctatgtactggaaagatagcagtgaataaaatggacaaaattacctgcca

SEQ ID NO: 356215 - DNA, 1089 bp, Homo sapiens
cagtttcctgccaatgacgctggggcagccggggcagccggggcagcccggtcaccccgcccccaggcccacactaagggtgtccgcggcctgccctccaggcggaggagcccggactgcggaaggatggagctggccgccggaagcttctcggaggagcagttctgggaggcctgcgccgagctccagcagcccgctctggccggggccgactggcagctcctagtggagacctcgggcatcagcatctaccggctgctggacaagaagactggactttatgagtataaagtctttggtgttctggaggactgctcaccaactctactggcagacatctatatggactcagattacagaaaacaatgggaccagtatgttaaagaactctatgaacaagaatgcaacggagagactgtggtctactgggaagtgaagtacccttttcccatgtccaacagagactatgtctaccttcggcagcggcgagacctggacatggaagggaggaagatccatgtgatcctggcccggagcacctccatgcctcagcttggcgagaggtctggggtgatccgggtgaagcaatacaagcagagcctggcgattgagagtgacggcaagaaggggagcaaagttttcatgtattacttcgataacccgggtggccaaattccgtcctggctcattaactgggccgccaagaatcagagcagaaccaagcgggaagctcagaatcagagagacctcatcaagtttttggcaaacccaaacattctgcaatagattgagtggaaggaagaggaaggacataaagataaagacatgagaaaagaagctgagtctttgttgaaacactgaaatgggtgcaggtatcatttcttatctcattgttttttctcataagccctgaattaattcatttattcacagtattttcgcagatgtgaaattcacatattattcacagatgtgttcactatcatctatgaataagatgtgaaattcacatattattcacagatgtgttcactatcatctatgtactggaaagatagcagtgaataaaatggacaaaattacctgcca

SEQ ID NO: 356216 - DNA, 1051 bp, Homo sapiens
gtgttgtcgtagtgcatgtcaacagagactatgtctaccttcggcagcggcgagacctggacatggaagggaggaagatccatgtgatcctggcccggagcacctccatgcctcagcttggcgagaggtctggggtgatccgggtgaagcaatacaagcagagcctggcgattgagagtgacggcaagaaggggagcaaagttttcatgtattacttcgataacccgggtggccaaattccgtcctggctcattaactgggccgccaaggctggccttgagctcctgacctcaagcaatccactggcctcggcctctcaaagtgctgggattacaggcatgagccaccacacccggccaatcagagcagaaccaagcgggaagctcagaatcagagagacctcatcaagtttttggcaaacccaaacattctgcaatagattgagtggaaggaagaggaaggacataaagataaagacatgagaaaagaagctgagtctttgttgaaacactgaaatgggtgcagactcttcaaaatactcttcagtggctttgtttccaaatgaaaaccagaaaaatgatgctggaatttcatagaggcagcggcggatggaagagggctcctcctgtctataaccatgggaatattgtttttgattgtagaccaactaactgcaaagagagaagacacataaataagacaagccctggaaagcacatgtggtgtgacggtgtcctgccaaagctgagaagacacaaataaaaagtttgagtatttctctagagaattcatctaggagtgaaactgttgaataaacagctctgcagatctcctccaagtgattgtactaatttattctctaaccagccattatgggctgattatctgtgccctcctcaaactcatatgttgaagcctcaatccctagtatgatagtatctggagatgggaccattgggaggtaattaggtttagactagatcacaagggtggagcctttatgatgggattagtgtccttataagaagaggaagtgaaatgagagctctct

SEQ ID NO: 356217 - DNA, 389 bp, Homo sapiens
cctgtctataaccatgggaatattgtttttgattgtagaccaactaactgcaaagagagaagacacataaataagacaagccctggaaagcacatgtggtgtgacggtgtcctgccaaagctgagaagacacaaataaaaagtaattatttactctttgtaagagagtgttctaaacccaagacactgattcatagatgctatcatggccctgtaaacacattaaaaatcaaatacaggttatattacatgtacccagttcatcttacaatggtaaagtccagaaattgtcaacagtctaaaaaaattctaactacttgtcatattaatgatgtgtaataaggtataatattgataatattttatattataataatgttatattatctt

SEQ ID NO: 356218 - DNA, 821 bp, Homo sapiens
gggggagtgtgtttgacaaatgttgacttagcccgcggggctgtcaggctgaagagacacattgtctcaggcgtaatgaggctcttttatgaagagtttggttgagtgactctggttagggctggggctgccaacatccaagacggaggctgggacaagagacaaagaattgtcagcttggaatgccagcctctccctgcttgtgccccaggaccccgccagaatcactctctggaacttctggacaatagtctgctcttagtaggaacaatagtgcctttggagcctatattcctctgcttactggggaataagacagactgacctggcttggagacaaccagatgtgtccaagcctgaggaaagcttccacttttgttgttgttgcccttttttttttttctttttctctataagggagggaactgcagtggtagtttgtatcactagagactgcccaggagcctggcattatggggaccatcagcctgctttgcacaagatctactactagagagctcaacagattccttggaagagtgaaaaagcacatcaactttggagtcaaacagacgcaatttcaaatcctggctctgctgctgactgtcttgttttatttaaggaagccatgcatttcttcctttttaaaaatgaagatagttgtcttctactgcatagagggggagtaaataagacaatatttaggaaaagtcttgcccagtgctcaacattaactaaataataatatatcctgctccttgatccccaatccttaccattttctaattcaataaagcaagtgctttcatttctttggaaga

SEQ ID NO: 356219 - DNA, 2045 bp, Homo sapiens
cagtttcctgccaatgacgctggggcagccggggcagccggggcagcccggtcaccccgcccccaggcccacactaagggtgtccgcggcctgccctccaggcggaggagcccggactgcggaaggatggagctggccgccggaagcttctcggaggagcagttctgggaggcctgcgccgagctccagcagcccgctctggccggggccgactggcagctcctagtggagacctcgggcatcagcatctaccggctgctggacaagaagactggactttatgagtataaagtctttggtgttctggaggactgctcaccaactctactggcagacatctatatggactcagattacagaaaacaatgggaccagtatgttaaagaactctatgaacaagaatgcaacggagagactgtggtctactgggaagtgaagtacccttttcccatgtccaacagagactatgtctaccttcggcagcggcgagacctggacatggaagggaggaagatccatgtgatcctggcccggagcacctccatgcctcagcttggcgagaggtctggggtgatccgggtgaagcaatacaagcagagcctggcgattgagagtgacggcaagaaggggagcaaagttttcatgtattacttcgataacccgggtggccaaattccgtcctggctcattaactgggccgccaagaatggagttcctaacttcttgaaagacatggcaagagcctgtcagaactacctcaagaaaacctaagaaagagaactgggaacattgcatccatgggttgatgtctctggaagtgcaaccacccaatgtctctggaagtgccacctggaagtgccacctggaagtgtctctggaagagcacccaccactgttcagccttcccctgctgtttctgtcttcagaggcctacacactaccacatcctttctaagcatgtttgcctgacatccagctcactcgtctgcttcctttctcgctccccccatcctgggctgggctgccttcttctacagttcaatatggggcagactagggaaacctttgcttgcttactattaggaggggaagtcttcagtagggaacacgatcattccattgtgcaattttacggggatgggtgggcggagggacacaacaaaatttaagaatgactatttgggcgggctggctcttttgcagcttgtgatttcttccagcttgggaggggctgctggaagtggcatttcgttcagagctgactttcagtgcacccaaactggatgacgtgccaatgtccatttgccttatgctttgtggagctgattaggctgggatttgaggtgataatccagtaagtctttcctcgttcctacttgtggaggatcagtagctgttatgatgccagaccatttggagaagtatcagaggcctgaccggacacataatacgacaaccacatttttcctcatcatccatgaggaaatggatgatttctcttttccatatgtcactgggggaaaggctgcctgtacctctcaagctttgcattttactggaaactgaggcgtcaagatggctgtggcagctagcaaaagcaaagatgctttgtgcatagccttgtgaaaaagtatctttctatgcaataagatgaattttcctcccagaatatttagaaatgtagaagggataacagttcacagccaggtaaaatttaactggtggcttaatgactctgcacctttttctcaggaattctgcctaagttgtctgccttttctaccaccaaaaagacttttagttttctatgctttctcctgaattttggtagggtaaggtatttctatgtcaaaggcacagccttgatgatctcagggaaaaattttaatcactgtgtataatgatactgaaccttgattaataacagaaattcaggatgtaaagccacagaatgggatttattaatgtgggatacctcagactgtttgttttctttctgggaagaaaagtgtgttctataatgaataaatatagagtggttttta

SEQ ID NO: 356220 - DNA, 2067 bp, Homo sapiens
cagtttcctgccaatgacgctggggcagccggggcagccggggcagcccggtcaccccgcccccaggcccacactaagggtgtccgcggcctgccctccaggcggaggagcccggactgcggaaggatggagctggccgccggaagcttctcggaggagcagttctgggaggcctgcgccgagctccagcagcccgctctggccggggccgactggcagctcctagtggagacctcgggcatcagcatctaccggctgctggacaagaagactggactttatgagtataaagtctttggtgttctggaggactgctcaccaactctactggcagacatctatatggactcagattacagaaaacaatgggaccagtatgttaaagaactctatgaacaagaatgcaacggagagactgtggtctactgggaagtgaagtacccttttcccatgtccaacagagactatgtctaccttcggcagcggcgagacctggacatggaagggaggaagatccatgtgatcctggcccggagcacctccatgcctcagcttggcgagaggtctggggtgatccgggtgaagcaatacaagcagagcctggcgattgagagtgacggcaagaaggggagcaaagttttcatgtattacttcgataacccgggtggccaaattccgtcctggctcattaactgggccgccaagaatggagttcctaacttcttgaaagacatggcaagagcctgtcagaactacctcaagaaaacctaagaaagagaactgggaacattgcatccatgggttgatgtctctggaagtgcaaccacccaatgtctctggaagtgccacctggaagtgccacctggaagtgtctctggaagagcacccaccactgttcagccttcccctgctgtttctgtcttcagaggcctacacactaccacatcctttctaagcatgtttgcctgacatccagctcactcgtctgcttcctttctcgctccccccatcctgggctgggctgccttcttctacagttcaatatggggcagactagggaaacctttgcttgcttactattaggaggggaagtcttcagtagggaacacgatcattccattgtgcaattttacggggatgggtgggcggagggacacaacaaaatttaagaatgactatttgggcgggctggctcttttgcagcttgtgatttcttccagcttgggaggggctgctggaagtggcatttcgttcagagctgactttcagtgcacccaaactggatgacgtgccaatgtccatttgccttatgctttgtggagctgattaggctgggatttgaggtgataatccagtaagtctttcctcgttcctacttgtggaggatcagtagctgttatgatgccagaccatttggagaagtatcagaggcctgaccggacacataatacgacaaccacatttttcctcatcatccatgaggaaatggatgatttctcttttccatatgtcactgggggaaaggctgcctgtacctctcaagctttgcattttactggaaactgaggcgtcaagatggctgtggcagctagcaaaagcaaagatgctttgtgcatagccttgtgaaaaagtatctttctatgcaataagatgaattttcctcccagaatatttagaaatgtagaagggataacagttcacagccaggtaaaatttaactggtggcttaatgactctgcacctttttctcaggaattctgcctaagttgtctgccttttctaccaccaaaaagacttttagttttctatgctttctcctgaattttggtagggtaaggtatttctatgtcaaaggcacagccttgatgatctcagggaaaaattttaatcactgtgtataatgatactgaaccttgattaataacagaaattcaggatgtaaagccacagaatgggatttattaatgtgggatacctcagactgtttgttttctttctgggaagaaaagtgtgttctataatgaataaatatagagtggtttttaagacaaatatcaacaaaaggcg

SEQ ID NO: 356221 - DNA, 1036 bp, Homo sapiens
cagtttcctgccaatgacgctggggcagccggggcagccggggcagcccggtcaccccgcccccaggcccacactaagggtgtccgcggcctgccctccaggcggaggagcccggactgcggaaggatggagctggccgccggaagcttctcggaggagcagttctgggaggcctgcgccgagctccagcagcccgctctggccggggccgactggcagctcctagtggagacctcgggcatcagcatctaccggctgctggacaagaagactggactttatgagtataaagtctttggtgttctggaggactgctcaccaactctactggcagacatctatatggactcagattacagaaaacaatgggaccagtatgttaaagaactctatgaacaagaatgcaacggagagactgtggtctactgggaagtgaagtacccttttcccatgtccaacagagactatgtctaccttcggcagcggcgagacctggacatggaagggaggaagatccatgtgatcctggcccggagcacctccatgcctcagcttggcgagaggtctggggtgatccgggtgaagcaatacaagcagagcctggcgattgagagtgacggcaagaaggggagcaaagttttcatgtattacttcgataacccgggtggccaaattccgtcctggctcattaactgggccgccaagaatcagagcagaaccaagcgggaagctcagaatcagagagacctcatcaagtttttggcaaacccaaacattctgcaatagattgagtggaaggaagaggaaggacataaagataaagacatgagaaaagaagctgagtctttgttgaaacactgaaatgggtgcaggtatcatttcttatctcattgttttttctcataagccctgaattaattcatttattcacagtattttcgcagatgtgaaattcacatattattcacagatgtgttcactatcatctatgtactggaaagatagcagtgaataaaatggacaaaattacctgcca

SEQ ID NO: 356222 - DNA, 1398 bp, Homo sapiens
cagtttcctgccaatgacgctggggcagccggggcagccggggcagcccggtcaccccgcccccaggcccacactaagggtgtccgcggcctgccctccaggcggaggagcccggactgcggaaggatggagctggccgccggaagcttctcggaggagcagttctgggaggcctgcgccgagctccagcagcccgctctggccggggccgactggcagctcctagtggagacctcgggcatcagcatctaccggctgctggacaagaagactggactttatgagtataaagtctttggtgttctggaggactgctcaccaactctactggcagacatctatatggactcagattacagaaaacaatgggaccagtatgttaaagaactctatgaacaagaatgcaacggagagactgtggtctactgggaagtgaagtacccttttcccatgtccaacagagactatgtctaccttcggcagcggcgagacctggacatggaagggaggaagatccatgtgatcctggcccggagcacctccatgcctcagcttggcgagaggtctggggtgatccgggtgaagcaatacaagcagagcctggcgattgagagtgacggcaagaaggggagcaaagttttcatgtattacttcgataacccgggtggccaaattccgtcctggctcattaactgggccgccaagaatcagagcagaaccaagcgggaagctcagaatcagagagacctcatcaagtttttggcaaacccaaacattctgcaatagattgagtggaaggaagaggaaggacataaagataaagacatgagaaaagaagctgagtctttgttgaaacactgaaatgggtgcagactcttcaaaatactcttcagtggctttgtttccaaatgaaaaccagaaaaatgatgctggaatttcatagaggcagcggcggatggaagagggctcctcctgtctataaccatgggaatattgtttttgattgtagaccaactaactgcaaagagagaagacacataaataagacaagccctggaaagcacatgtggtgtgacggtgtcctgccaaagctgagaagacacaaataaaaagtttgagtatttctctagagaattcatctaggagtgaaactgttgaataaacagctctgcagatctcctccaagtgattgtactaatttattctctaaccagccattatgggctgattatctgtgccctcctcaaactcatatgttgaagcctcaatccctagtatgatagtatctggagatgggaccattgggaggtaattaggtttagactagatcacaagggtggagcctttatgatgggattagtgtccttataagaagaggaagtgaaatgagagctctct

SEQ ID NO: 356223 - DNA, 497 bp, Homo sapiens
ctttccctacccattctcagaacaatccctagctctgagaaaactccactgtacttcctgttgctctttaaccccctctgcacgccctgggagcctaagtgtaagctcccgaaaatgccagaatcatctcccttgcctaaatggccgagtgttttcattgcggagcctgtgaagctggtagtagctatgtttagtggaagccctaagcactctcctcctagcctaccttggaaaagtcgctcggggcaccaagcaagacaaattttccccttgtcgttagtcctcctagtcccgaggcagtccaatattctggagagtatttagcttttgtatgggagcaaggtattggagaaaagaaaattattaccctgggggatgaagagtttgtgtctggggggaagggagttggggaggaagaagtgagggtggagcttccacctcttaacaacttaaatacttcaggaagtgtttctaaagattggccaagagggtcgctg

SEQ ID NO: 356224 - DNA, 2037 bp, Homo sapiens
gactagttctagatcgcgatctagaactagccgcgggagacgctgctgaggcggcttcggttgcgggtcggaacggcgctgctctgcggggccggtccaggctggcagctgccggcgcttggcggtgagggcgggctcccgagtggccccccaccgaaggcggtgggaccagcggctgaggccaggatgccgtccaggcggcgcggcggctcctcactcatcccagatgttggttatctttctgaagtagactgtccatggcctgaacattttccgaaaatcattttgagcaaaatatctgtttaataacaagataaccacatcaagatggttggaaagctgaagcagaacttactattggcatgtctggtgattagttctgtgactgtgttttacctgggccagcatgccatggaatgccatcaccggatagaggaacgtagccagccagtcaaattggagagcacaaggaccactgtgagaactggcctggacctcaaagccaacaaaacctttgcctatcacaaagatatgcctttaatatttattggaggtgtgcctcggagtggaaccacactcatgagggccatgctggacgcacatcctgacattcgctgtggagaggaaaccagggtcattccccgaatcctggccctgaagcagatgtggtcacggtcaagtaaagagaagatccgcctggatgaggctggtgttactgatgaagtgctggattctgccatgcaagccttcttactagaaattatcgttaagcatggggagccagccccttatttatgtaataaagatccttttgccctgaaatctttaacttacctttctaggttattccccaatgccaaatttctcctgatggtccgagatggccgggcatcagtacattcaatgatttctcgaaaagttactatagctggatttgatctgaacagctatagggactgtttgacaaagtggaatcgtgctatagagaccatgtataaccagtgtatggaggttggttataaaaagtgcatgttggttcactatgaacaacttgtcttacatcctgaacggtggatgagaacactcttaaagttcctccagattccatggaaccactcagtattgcaccatgaagagatgattgggaaagctgggggagtgtctctgtcaaaagtggagagatctacagaccaagtaatcaagccagtcaatgtaggagctctatcaaaatgggttgggaagataccgccagatgttttacaagacatggcagtgattgctcctatgcttgccaagcttggatatgacccatatgccaacccacctaactacggaaaacctgatcccaaaattattgaaaacactcgaagggtctataagggagaattccaactacctgactttcttaaagaaaaaccacagactgagcaagtggagtagcagaaccaggagcctcttccatacatgaggaaagattgctgccttttcagcagaagggaaattcctaggattggctgtcccctgccaagcttggtggagcgtctgcaccttggctgcgccgcctgtgcatttgccagtttcctcccactgagaggatggaggtgtccgcacagctttgggcctcgtgagggatctgcctcctgagcaaagagctcttgatcccgatttcatgcacagccctgcagtaaggagcccagaaggaacatgtgtttcctgttaaaactcctcttgttctcttttcttacattatgacgtttgttttcaaggagagggtttaaaaatgggatcctgtaagcagacttgggcagtctccttttgaaataggttgtctgtacatgttctaatgttttgtagaacacgtgtgcctgtttaagtgtattgatgtgaataatattaaatatcctaattatttaattcattgtattgtttctgagaagttgggaaattaccattatacatttacaacctaatgacttttgtattttatttttcaaaataaaagctttcaatgtgaagcattctggtaaaaaaatgttt

SEQ ID NO: 356225 - DNA, 711 bp, Homo sapiens
agcctgcgggccacccctcatgtttcagtggggacggtcacttctcatgctgaccaacttcaaggacattaaaacatcttttctttccttcaacagactgagcaagtggagtagcagaaccaggagcctcttccatacatgaggaaagattgctgccttttcagcagaagggaaattcctaggattggctgtcccctgccaagcttggtggagcgtctgcaccttggctgcgccgcctgtgcatttgccagtttcctcccactgagaggatggaggtgtccgcacagctttgggcctcgtgagggatctgcctcctgagcaaagagctcttgatcccgatttcatgcacagccctgcagtaaggagcccagaaggaacatgtgtttcctgttaaaactcctcttgttctcttttcttacattatgacgtttgttttcaaggagagggtttaaaaatgggatcctgtaagcagacttgggcagtctccttttgaaataggttgtctgtacatgttctaatgttttgtagaacacgtgtgcctgtttaagtgtattgatgtgaataatattaaatatcctaattatttaattcattgtattgtttctgagaagttgggaaattaccattatacatttacaacctaatgacttttgtattttatttttcaaaataaaagctttcaatgtgaagcattctggtaaaaaaatgttt

SEQ ID NO: 356226 - DNA, 516 bp, Homo sapiens
cgcccggtctcaattttgttttaagaatatcaaagaatccaagactgtttcagcttctttctacctaaaatgcagtggtgataactggtgactgatttgtaagcaatctcaatgtaatgataaataaccttttcctttctctactagatgttggttatctttctgaagtagactgtccatggcctgaacattttccgaaaatcattttgagcaaaatatctgtttaataacaagataaccacatcaagatggttggaaagctgaagcagaacttactattggcatgtctggtgattagttctgtgactgtgttttacctgggccagcatgccatggaatgccatcaccggatagaggaacgtagccagccagtcaaattggagagcagtggcgtgatctctgaattgccaaagaattcagaaggctgattattaagctactcaaggagataccaaaggtgaaaatcaacttcaagaaattttaaaatatataggatatggatgatgctccaggtcg

SEQ ID NO: 356227 - DNA, 2120 bp, Homo sapiens
ggctgtgggggcgctggccggctgcgacgtcagacccccgcccctcggcgcctgccggacccagctccattcccagccgcgcctccttcggtgggcagccggccggaactcacgaatcagagcagccgacacatcgtccgctcagccaatcgtagcagatgtgtgatcccgccacctccccggaccctggcggttgtcgctgagttggcgaccgcgggagacgctgctgaggcggcttcggttgcgggtcggaacggcgctgctctgcggggccggtccaggctggcagctgccggcgcttggcggtgagggcgggctcccgagtggccccccaccgaaggcggtgggaccagcggctgaggccaggatgccgtccaggcggcgcggcggctcctcactcatcccagatgttggttatctttctgaagtagactgtccatggcctgaacattttccgaaaatcattttgagcaaaatatctgtttaataacaagataaccacatcaagatggttggaaagctgaagcagaacttactattggcatgtctggtgattagttctgtgactgtgttttacctgggccagcatgccatggaatgccatcaccggatagaggaacgtagccagccagtcaaattggagagcacaaggaccactgtgagaactggcctggacctcaaagccaacaaaacctttgcctatcacaaagatatgcctttaatatttattggaggtgtgcctcggagtggaaccacactcatgagggccatgctggacgcacatcctgacattcgctgtggagaggaaaccagggtcattccccgaatcctggccctgaagcagatgtggtcacggtcaagtaaagagaagatccgcctggatgaggctggtgttactgatgaagtgctggattctgccatgcaagccttcttactagaaattatcgttaagcatggggagccagccccttatttatgtaataaagatccttttgccctgaaatctttaacttacctttctaggttattccccaatgccaaatttctcctgatggtccgagatggccgggcatcagtacattcaatgatttctcgaaaagttactatagctggatttgatctgaacagctatagggactgtttgacaaagtggaatcgtgctatagagaccatgtataaccagtgtatggaggttggttataaaaagtgcatgttggttcactatgaacaacttgtcttacatcctgaacggtggatgagaacactcttaaagttcctccagattccatggaaccactcagtattgcaccatgaagagatgattgggaaagctgggggagtgtctctgtcaaaagtggagagatctacagaccaagtaatcaagccagtcaatgtaggagctctatcaaaatgggttgggaagataccgccagatgttttacaagacatggcagtgattgctcctatgcttgccaagcttggatatgacccatatgccaacccacctaactacggaaaacctgatcccaaaattattgaaaacactcgaagggaaagattgctgccttttcagcagaagggaaattcctaggattggctgtcccctgccaagcttggtggagcgtctgcaccttggctgcgccgcctgtgcatttgccagtttcctcccactgagaggatggaggtgtccgcacagctttgggcctcgtgagggatctgcctcctgagcaaagagctcttgatcccgatttcatgcacagccctgcagtaaggagcccagaaggaacatgtgtttcctgttaaaactcctcttgttctcttttcttacattatgacgtttgttttcaaggagagggtttaaaaatgggatcctgtaagcagacttgggcagtctccttttgaaataggttgtctgtacatgttctaatgttttgtagaacacgtgtgcctgtttaagtgtattgatgtgaataatattaaatatcctaattatttaattcattgtattgtttctgagaagttgggaaattaccattatacatttacaacctaatgacttttgtattttatttttcaaaataaaagctttcaatgtgaagcattctggtaaaaaaatgttt

SEQ ID NO: 356228 - DNA, 1968 bp, Homo sapiens
ggctgtgggggcgctggccggctgcgacgtcagacccccgcccctcggcgcctgccggacccagctccattcccagccgcgcctccttcggtgggcagccggccggaactcacgaatcagagcagccgacacatcgtccgctcagccaatcgtagcagatgtgtgatcccgccacctccccggaccctggcggttgtcgctgagttggcgaccgcgggagacgctgctgaggcggcttcggttgcgggtcggaacggcgctgctctgcggggccggtccaggctggcagctgccggcgcttggcggtgagggcgggctcccgagtggccccccaccgaaggcggtgggaccagcggctgaggccaggatgccgtccaggcggcgcggcggctcctcactcatcccagatgttggttatctttctgaagtagactgtccatggcctgaacattttccgaaaatcattttgagcaaaatatctgtttaataacaagataaccacatcaagatggttggaaagctgaagcagaacttactattggcatgtctggtgattagttctgtgactgtgttttacctgggccagcatgccatggaatgccatcaccggatagaggaacgtagccagccagtcaaattggagagcacaaggaccactgtgagaactggcctggacctcaaagccaacaaaacctttgcctatcacaaagatatgcctttaatatttattggaggtgtgcctcggagtggaaccacactcatgagggccatgctggacgcacatcctgacattcgctgtggagaggaaaccagggtcattccccgaatcctggccctgaagcagatgtggtcacggtcaagtaaagagaagatccgcctggatgaggctggtgttactgatgaagtgctggattctgccatgcaagccttcttactagaaattatcgttaagcatggggagccagccccttatttatgtaataaagatccttttgccctgaaatctttaacttacctttctaggttattccccaatgccaaatttctcctgatggtccgagatggccgggcatcagtacattcaatgatttctcgaaaagttactatagctggatttgatctgaacagctatagggactgtttgacaaagtggaatcgtgctatagagaccatgtataaccagtgtatggaggttggttataaaaagtgcatgttggttcactatgaacaacttgtcttacatcctgaacggtggatgagaacactcttaaagttcctccagattccatggaaccactcagtattgcaccatgaagagatgattgggaaagctgggggagtgtctctgtcaaaactgagcaagtggagtagcagaaccaggagcctcttccatacatgaggaaagattgctgccttttcagcagaagggaaattcctaggattggctgtcccctgccaagcttggtggagcgtctgcaccttggctgcgccgcctgtgcatttgccagtttcctcccactgagaggatggaggtgtccgcacagctttgggcctcgtgagggatctgcctcctgagcaaagagctcttgatcccgatttcatgcacagccctgcagtaaggagcccagaaggaacatgtgtttcctgttaaaactcctcttgttctcttttcttacattatgacgtttgttttcaaggagagggtttaaaaatgggatcctgtaagcagacttgggcagtctccttttgaaataggttgtctgtacatgttctaatgttttgtagaacacgtgtgcctgtttaagtgtattgatgtgaataatattaaatatcctaattatttaattcattgtattgtttctgagaagttgggaaattaccattatacatttacaacctaatgacttttgtattttatttttcaaaataaaagctttcaatgtgaagcattctggtaaaaaaatgttt

SEQ ID NO: 356229 - DNA, 2164 bp, Homo sapiens
ggctgtgggggcgctggccggctgcgacgtcagacccccgcccctcggcgcctgccggacccagctccattcccagccgcgcctccttcggtgggcagccggccggaactcacgaatcagagcagccgacacatcgtccgctcagccaatcgtagcagatgtgtgatcccgccacctccccggaccctggcggttgtcgctgagttggcgaccgcgggagacgctgctgaggcggcttcggttgcgggtcggaacggcgctgctctgcggggccggtccaggctggcagctgccggcgcttggcggtgagggcgggctcccgagtggccccccaccgaaggcggtgggaccagcggctgaggccaggatgccgtccaggcggcgcggcggctcctcactcatcccagatgttggttatctttctgaagtagactgtccatggcctgaacattttccgaaaatcattttgagccagaacttactattggcatgtctggtgattagttctgtgactgtgttttacctgggccagcatgccatggaatgccatcaccggatagaggaacgtagccagccagtcaaattggagagcacaaggaccactgtgagaactggcctggacctcaaagccaacaaaacctttgcctatcacaaagatatgcctttaatatttattggaggtgtgcctcggagtggaaccacactcatgagggccatgctggacgcacatcctgacattcgctgtggagaggaaaccagggtcattccccgaatcctggccctgaagcagatgtggtcacggtcaagtaaagagaagatccgcctggatgaggctggtgttactgatgaagtgctggattctgccatgcaagccttcttactagaaattatcgttaagcatggggagccagccccttatttatgtaataaagatccttttgccctgaaatctttaacttacctttctaggttattccccaatgccaaatttctcctgatggtccgagatggccgggcatcagtacattcaatgatttctcgaaaagttactatagctggatttgatctgaacagctatagggactgtttgacaaagtggaatcgtgctatagagaccatgtataaccagtgtatggaggttggttataaaaagtgcatgttggttcactatgaacaacttgtcttacatcctgaacggtggatgagaacactcttaaagttcctccagattccatggaaccactcagtattgcaccatgaagagatgattgggaaagctgggggagtgtctctgtcaaaagtggagagatctacagaccaagtaatcaagccagtcaatgtaggagctctatcaaaatgggttgggaagataccgccagatgttttacaagacatggcagtgattgctcctatgcttgccaagcttggatatgacccatatgccaacccacctaactacggaaaacctgatcccaaaattattgaaaacactcgaagggtctataagggagaattccaactacctgactttcttaaagaaaaaccacagactgagcaagtggagtagcagaaccaggagcctcttccatacatgaggaaagattgctgccttttcagcagaagggaaattcctaggattggctgtcccctgccaagcttggtggagcgtctgcaccttggctgcgccgcctgtgcatttgccagtttcctcccactgagaggatggaggtgtccgcacagctttgggcctcgtgagggatctgcctcctgagcaaagagctcttgatcccgatttcatgcacagccctgcagtaaggagcccagaaggaacatgtgtttcctgttaaaactcctcttgttctcttttcttacattatgacgtttgttttcaaggagagggtttaaaaatgggatcctgtaagcagacttgggcagtctccttttgaaataggttgtctgtacatgttctaatgttttgtagaacacgtgtgcctgtttaagtgtattgatgtgaataatattaaatatcctaattatttaattcattgtattgtttctgagaagttgggaaattaccattatacatttacaacctaatgacttttgtattttatttttcaaaataaaagctttcaatgtgaagcattctggtaaaaaaatgttt

SEQ ID NO: 356230 - DNA, 1835 bp, Homo sapiens
ggctgtgggggcgctggccggctgcgacgtcagacccccgcccctcggcgcctgccggacccagctccattcccagccgcgcctccttcggtgggcagccggccggaactcacgaatcagagcagccgacacatcgtccgctcagccaatcgtagcagatgtgtgatcccgccacctccccggaccctggcggttgtcgctgagttggcgaccgcgggagacgctgctgaggcggcttcggttgcgggtcggaacggcgctgctctgcggggccggtccaggctggcagctgccggcgcttggcggtgagggcgggctcccgagtggccccccaccgaaggcggtgggaccagcggctgaggccaggatgccgtccaggcggcgcggcggctcctcactcatcccagatgttggttatctttctgaagtagactgtccatggcctgaacattttccgaaaatcattttgagcaaaatatctgtttaataacaagataaccacatcaagatggttggaaagctgaagcagaacttactattggcatgtctggtgattagttctgtgactgtgttttacctgggccagcatgccatggaatgccatcaccggatagaggaacgtagccagccagtcaaattggagagcacaaggaccactgtgagaactggcctggacctcaaagccaacaaaacctttgcctatcacaaagatatgcctttaatatttattggaggtgtgcctcggagtggaaccacactcatgagggccatgctggacgcacatcctgacattcgctgtggagaggaaaccagggtcattccccgaatcctggccctgaagcagatgtggtcacggtcaagtaaagagaagatccgcctggatgaggctggtgttactgatgaagtgctggattctgccatgcaagccttcttactagaaattatcgttaagcatggggagccagccccttatttatgtaataaagatccttttgccctgaaatctttaacttacctttctaggttattccccaatgccaaatttctcctgatggtccgagatggccgggcatcagtacattcaatgatttctcgaaaagttactatagctggatttgatctgaacagctatagggactgtttgacaaagtggaatcgtgctatagagaccatgtataaccagtgtatggaggttggttataaaaagtgcatgttggttcactatgaacaacttgtcttacatcctgaacggtggatgagaacactcttaaagttcctccagattccatggaaccactcagtattgcaccatgaagagatgattgggaaagctgggggagtgtctctgtcaaaagtggagagatctacagaccaagtaatcaagccagtcaatgtaggagctctatcaaaatgggttgggaagataccgccagatgttttacaagacatggcagtgattgctcctatgcttgccaagcttggatatgacccatatgccaacccacctaactacggaaaacctgatcccaaaattattgaaaacactcgaagggtctataagggagaattccaactacctgactttcttaaagaaaaaccacagactgagcaagtggagtagcagaaccaggagcctcttccatacatgagcagagacaagatcttatcatgtttcccaggctgcttttgaacttctgggctcaagcaatcctcctgcttcagcgtcccaaagtgccgggattacaggtgtgggccactgctcccagcctggcaccatgctacttgtatagtctgcaggactgtgagccaaataaactgtttttctttataaacta

SEQ ID NO: 356231 - DNA, 1875 bp, Homo sapiens
gttttgctagtgagaaaacaggttgaatgtgacttgcggtgcgttgatggattatagacataagaagcacatggacgctggtccgtcatgtcaaaatcccagatggcagcaagctgctaatattgacaggttctaggattcaggtttcctttttgctgaggagcaaatgctgaatgttagtcttatgccctgtgggtctgcatatttaacagcagttatcaggccttggctaattttgtttataccaaggcctcatttctttaccagcgtgttgtaggatggaccgcatcagcagttgcctctgcagcatttcaccctggcttgtgtgtggaggttgggaggggccaacctgtgctgaggaggactcaggagaactggggacacagcaaagcccttaggatggatactatctttcttatcttttgggtccctttggcatttcaataacagtatctgtgttctctggagcttcctttaaagaaccttaggatccatttcttcacgtgaggaggaatcagggtgctgacccctggacacttaaagaaccttaggacccatttcttcacatgaggaggaatcagggtgctgacccctgggacacttaaagaaccttaggacccatttcttcacatgaggaggaatcagggtcttgacccctggacacttaaccttaggacccatttcttcacatgaggaggaatcagggtgctgccccctggacacttaaagaaccttaggacccatttcttcacatgaggaatcagggtgctgccccctggacacttaaagaaccttaggacccatttcttcacgaggaggaatcagggtgctgccccctggacacctgaagaaccttaggacccatttcttcacataaggaggaatcagggtcttgacccctggacactttaagaaccttaggacccatttcttcacacgaggaatcatggtgctgacccctggacatctggtgcccctgacagtgcccccacagtagcaacaatagcagatgacagtcagttatttagaaatgggcaggagcagccctggttttggccatctgcttgctttgcacccagcagctacttgcatgcatctgaaagcaccagagtgagggtgtgtgtgcctcccaggcagtcttcctgaggcagctgttctcaacatccatcctcctggcccctgatctgcaggaacctccccaaccgcctggcttgtctaggcctgtagctgggaaggaagagacgaagacacagggagaacacaccgggactccacacctgtaaccacattctgtttgttcgccctaggaaagattgctgccttttcagcagaagggaaattcctaggattggctgtcccctgccaagcttggtggagcgtctgcaccttggctgcgccgcctgtgcatttgccagtttcctcccactgagaggatggaggtgtccgcacagctttgggcctcgtgagggatctgcctcctgagcaaagagctcttgatcccgatttcatgcacagccctgcagtaaggagcccagaaggaacatgtgtttcctgttaaaactcctcttgttctcttttcttacattatgacgtttgttttcaaggagagggtttaaaaatgggatcctgtaagcagacttgggcagtctccttttgaaataggttgtctgtacatgttctaatgttttgtagaacacgtgtgcctgtttaagtgtattgatgtgaataatattaaatatcctaattatttaattcattgtattgtttctgagaagttgggaaattaccattatacatttacaacctaatgacttttgtattttatttttcaaaataaaagctttcaatgtgaagcattctggtaaaaaaatgttt

SEQ ID NO: 356232 - DNA, 1018 bp, Homo sapiens
gttttgctagtgagaaaacaggttgaatgtgacttgcggtgcgttgatggattatagacataagaagcacatggacgctggtccgtcatgtcaaaatcccagatggcagcaagctgctaatattgacaggttctaggattcaggtttcctttttgctgaggagcaaatgctgaatgttagtcttatgccctgtgggtctgcatatttaacagcagttatcaggccttggctaattttgtttataccaaggcctcatttctttaccagcgtgttgtaggatggaccgcatcagcagttgcctctgcagcatttcaccctggccctgatctgcaggaacctccccaaccgcctggcttgtctaggcctgtagctgggaaggaagagacgaagacacagggagaacacaccgggactccacacctgtaaccacattctgtttgttcgccctaggaaagattgctgccttttcagcagaagggaaattcctaggattggctgtcccctgccaagcttggtggagcgtctgcaccttggctgcgccgcctgtgcatttgccagtttcctcccactgagaggatggaggtgtccgcacagctttgggcctcgtgagggatctgcctcctgagcaaagagctcttgatcccgatttcatgcacagccctgcagtaaggagcccagaaggaacatgtgtttcctgttaaaactcctcttgttctcttttcttacattatgacgtttgttttcaaggagagggtttaaaaatgggatcctgtaagcagacttgggcagtctccttttgaaataggttgtctgtacatgttctaatgttttgtagaacacgtgtgcctgtttaagtgtattgatgtgaataatattaaatatcctaattatttaattcattgtattgtttctgagaagttgggaaattaccattatacatttacaacctaatgacttttgtattttatttttcaaaataaaagctttcaatgtgaagcattctggtaaaaaaatgttt

SEQ ID NO: 356233 - DNA, 1249 bp, Homo sapiens
ggctgtgggggcgctggccggctgcgacgtcagacccccgcccctcggcgcctgccggacccagctccattcccagccgcgcctccttcggtgggcagccggccggaactcacgaatcagagcagccgacacatcgtccgctcagccaatcgtagcagatgtgtgatcccgccacctccccggaccctggcggttgtcgctgagttggcgaccgcgggagacgctgctgaggcggcttcggttgcgggtcggaacggcgctgctctgcggggccggtccaggctggcagctgccggcgcttggcggtgagggcgggctcccgagtggccccccaccgaaggcggtgggaccagcggctgaggccaggatgccgtccaggcggcgcggcggctcctcactcatcccagatgttggttatctttctgaagtagactgtccatggcctgaacattttccgaaaatcattttgagcaaaatatctgtttaataacaagataaccacatcaagatggttggaaagctgaagcagaacttactattggcatgtctggtgattagttctgtgactgtgttttacctgggccagcatgccatggaatgccatcaccggatagaggaacgtagccagccagtcaaattggagagcacaaggaccactgtgagaactggcctggacctcaaagccaacaaaacctttgcctatcacaaagatatgcctttaatatttattggaggtgtgcctcggagtggaaccacactcatgagggccatgctggacgcacatcctgacattcgctgtggagaggaaaccagggtcattccccgaatcctggccctgaagcagatgtggtcacggtcaagtaaagagaagatccgcctggatgaggctggtgttactgatgaagtgctggattctgccatgcaagccttcttactagaaattatcgttaagcatggggagccagccccttatttatgtaataaagatccttttgccctgaaatctttaacttacctttctaggttattccccaatgccgtccagcggcgcggcggctcctcactcatcccagatgttggttatctttctgaagtagactgtccatggcctgaacattttccgaaaatcattttgagcaaaatatctgtttaataacaagataaccacatcaagatggttggaaagctgaagcagaacttactattggcatgtctggtgattagttctgtgactgtgttttacctgggc

SEQ ID NO: 356234 - DNA, 281 bp, Homo sapiens
atggcagcaagctgctaatattgacaggttctaggattcaggtttcctttttgctgaggagcaaatgctgaatgttagtcttatgccctgtgggtctgcatatttaacagcagttatcaggccttggctaattttgtttatacaaaatgctttcaaacttcataggtaatctccctgcccgccccaccaaacacacacaaggcctcatttctttaccagcgtgttgtaggatggaccgcatcagcagttgcctctgcagcatttcaccctggcttgtgtgt

SEQ ID NO: 356235 - DNA, 2218 bp, Homo sapiens
ggctgtgggggcgctggccggctgcgacgtcagacccccgcccctcggcgcctgccggacccagctccattcccagccgcgcctccttcggtgggcagccggccggaactcacgaatcagagcagccgacacatcgtccgctcagccaatcgtagcagatgtgtgatcccgccacctccccggaccctggcggttgtcgctgagttggcgaccgcgggagacgctgctgaggcggcttcggttgcgggtcggaacggcgctgctctgcggggccggtccaggctggcagctgccggcgcttggcggtgagggcgggctcccgagtggccccccaccgaaggcggtgggaccagcggctgaggccaggatgccgtccaggcggcgcggcggctcctcactcatcccagatgttggttatctttctgaagtagactgtccatggcctgaacattttccgaaaatcattttgagcaaaatatctgtttaataacaagataaccacatcaagatggttggaaagctgaagcagaacttactattggcatgtctggtgattagttctgtgactgtgttttacctgggccagcatgccatggaatgccatcaccggatagaggaacgtagccagccagtcaaattggagagcacaaggaccactgtgagaactggcctggacctcaaagccaacaaaacctttgcctatcacaaagatatgcctttaatatttattggaggtgtgcctcggagtggaaccacactcatgagggccatgctggacgcacatcctgacattcgctgtggagaggaaaccagggtcattccccgaatcctggccctgaagcagatgtggtcacggtcaagtaaagagaagatccgcctggatgaggctggtgttactgatgaagtgctggattctgccatgcaagccttcttactagaaattatcgttaagcatggggagccagccccttatttatgtaataaagatccttttgccctgaaatctttaacttacctttctaggttattccccaatgccaaatttctcctgatggtccgagatggccgggcatcagtacattcaatgatttctcgaaaagttactatagctggatttgatctgaacagctatagggactgtttgacaaagtggaatcgtgctatagagaccatgtataaccagtgtatggaggttggttataaaaagtgcatgttggttcactatgaacaacttgtcttacatcctgaacggtggatgagaacactcttaaagttcctccagattccatggaaccactcagtattgcaccatgaagagatgattgggaaagctgggggagtgtctctgtcaaaagtggagagatctacagaccaagtaatcaagccagtcaatgtaggagctctatcaaaatgggttgggaagataccgccagatgttttacaagacatggcagtgattgctcctatgcttgccaagcttggatatgacccatatgccaacccacctaactacggaaaacctgatcccaaaattattgaaaacactcgaagggtctataagggagaattccaactacctgactttcttaaagaaaaaccacagactgagcaagtggagtagcagaaccaggagcctcttccatacatgaggaaagattgctgccttttcagcagaagggaaattcctaggattggctgtcccctgccaagcttggtggagcgtctgcaccttggctgcgccgcctgtgcatttgccagtttcctcccactgagaggatggaggtgtccgcacagctttgggcctcgtgagggatctgcctcctgagcaaagagctcttgatcccgatttcatgcacagccctgcagtaaggagcccagaaggaacatgtgtttcctgttaaaactcctcttgttctcttttcttacattatgacgtttgttttcaaggagagggtttaaaaatgggatcctgtaagcagacttgggcagtctccttttgaaataggttgtctgtacatgttctaatgttttgtagaacacgtgtgcctgtttaagtgtattgatgtgaataatattaaatatcctaattatttaattcattgtattgtttctgagaagttgggaaattaccattatacatttacaacctaatgacttttgtattttatttttcaaaataaaagctttcaatgtgaagcattctggtaaaaaaatgttt

SEQ ID NO: 356236 - DNA, 2019 bp, Homo sapiens
ggctgtgggggcgctggccggctgcgacgtcagacccccgcccctcggcgcctgccggacccagctccattcccagccgcgcctccttcggtgggcagccggccggaactcacgaatcagagcagccgacacatcgtccgctcagccaatcgtagcagatgtgtgatcccgccacctccccggaccctggcggttgtcgctgagttggcgaccgcgggagacgctgctgaggcggcttcggttgcgggtcggaacggcgctgctctgcggggccggtccaggctggcagctgccggcgcttggcggtgagggcgggctcccgagtggccccccaccgaaggcggtgggaccagcggctgaggccaggatgccgtccaggcggcgcggcggctcctcactcatcccagatgttggttatctttctgaagtagactgtccatggcctgaacattttccgaaaatcattttgagcaaaatatctgtttaataacaagataaccacatcaagatggttggaaagctgaagcagaacttactattggcatgtctggtgattagttctgtgactgtgttttacctgggccagcatgccatggaatgccatcaccggatagaggaacgtagccagccagtcaaattggagagcacaaggaccactgtgagaactggcctggacctcaaagccaacaaaacctttgcctatcacaaagatatgcctttaatatttattggaggtgtgcctcggagtggaaccacactcatgagggccatgctggacgcacatcctgacattcgctgtggagaggaaaccagggtcattccccgaatcctggccctgaagcagatgtggtcacggtcaagtaaagagaagatccgcctggatgaggctggtgttactgatgaagtgctggattctgccatgcaagccttcttactagaaattatcgttaagcatggggagccagccccttatttatgtaataaagatccttttgccctgaaatctttaacttacctttctaggttattccccaatgccaaatttctcctgatggtccgagatggccgggcatcagtacattcaatgatttctcgaaaagttactatagctggatttgatctgaacagctatagggactgtttgacaaagtggaatcgtgctatagagaccatgtataaccagtgtatggaggttggttataaaaagtgcatgttggttcactatgaacaacttgtcttacatcctgaacggtggatgagaacactcttaaagttcctccagattccatggaaccactcagtattgcaccatgaagagatgattgggaaagctgggggagtgtctctgtcaaagtctataagggagaattccaactacctgactttcttaaagaaaaaccacagactgagcaagtggagtagcagaaccaggagcctcttccatacatgaggaaagattgctgccttttcagcagaagggaaattcctaggattggctgtcccctgccaagcttggtggagcgtctgcaccttggctgcgccgcctgtgcatttgccagtttcctcccactgagaggatggaggtgtccgcacagctttgggcctcgtgagggatctgcctcctgagcaaagagctcttgatcccgatttcatgcacagccctgcagtaaggagcccagaaggaacatgtgtttcctgttaaaactcctcttgttctcttttcttacattatgacgtttgttttcaaggagagggtttaaaaatgggatcctgtaagcagacttgggcagtctccttttgaaataggttgtctgtacatgttctaatgttttgtagaacacgtgtgcctgtttaagtgtattgatgtgaataatattaaatatcctaattatttaattcattgtattgtttctgagaagttgggaaattaccattatacatttacaacctaatgacttttgtattttatttttcaaaataaaagctttcaatgtgaagcattctggtaaaaaaatgttt

SEQ ID NO: 356237 - DNA, 1989 bp, Homo sapiens
ggctgtgggggcgctggccggctgcgacgtcagacccccgcccctcggcgcctgccggacccagctccattcccagccgcgcctccttcggtgggcagccggccggaactcacgaatcagagcagccgacacatcgtccgctcagccaatcgtagcagatgtgtgatcccgccacctccccggaccctggcggttgtcgctgagttggcgaccgcgggagacgctgctgaggcggcttcggttgcgggtcggaacggcgctgctctgcggggccggtccaggctggcagctgccggcgcttggcggtgagggcgggctcccgagtggccccccaccgaaggcggtgggaccagcggctgaggccaggatgccgtccaggcggcgcggcggctcctcactcatcccagatgttggttatctttctgaagtagactgtccatggcctgaacattttccgaaaatcattttgagcaaaatatctgtttaataacaagataaccacatcaagatggttggaaagctgaagcagaacttactattggcatgtctggtgattagttctgtgactgtgttttacctgggccagcatgccatggaatgccatcaccggatagaggaacgtagccagccagtcaaattggagagcacaaggaccactgtgagaactggcctggacctcaaagccaacaaaacctttgcctatcacaaagatatgcctttaatatttattggaggtgtgcctcggagtggaaccacactcatgagggccatgctggacgcacatcctgacattcgctgtggagaggaaaccagggtcattccccgaatcctggccctgaagcagatgtggtcacggtcaagtaaagagaagatccgcctggatgaggctggtgttactgatgaagtgctggattctgccatgcaagccttcttactagaaattatcgttaagcatggggagccagccccttatttatgtaataaagatccttttgccctgaaatctttaacttacctttctaggttattccccaatgccaaatttctcctgatggtccgagatggccgggcatcagtacattcaatgatttctcgaaaagttactatagctggatttgatctgaacagctatagggactgtttgacaaagtggaatcgtgctatagagaccatgtataaccagtgtatggaggttggttataaaaagtgcatgttggttcactatgaacaacttgtcttacatcctgaacggtggatgagaacactcttaaagttcctccagattccatggaaccactcagtattgcaccatgaagagatgattgggaaagctgggggagtgtctctgtcaaaagtggagagatctacagaccaagtaatcaagccagtcaatgtaggagctctatcaaaatgggttgggaagataccgccagatgttttacaagacatggcagtgattgctcctatgcttgccaagcttggatatgacccatatgccaacccacctaactacggaaaacctgatcccaaaattattgaaaacactcgaagggtctataagggagaattccaactacctgactttcttaaagaaaaaccacagtgtctactatggtgaggaattagagtaagtcctcaggagtcacgggggaaagaaagacctcaaggagctcctgatttatccagaagaatccgaccacctcgtgcagacaaggggacacagagctctgggcccaggctgggcatgatgtcccagaaacctgggcagattcatgaacagactgacaccggctgtggaaattggagccagagaatattccaagaggctgtcttgaaggaatataaaatccaaaagcgcccaggtgcggtggttcacgcctgtaatcccagcactttgggaggcccaggtgggtggattgcctgaggtcaggagttcaagatctgtttagccaacacagtgacaccccgtctctactaaaaatataaaat

SEQ ID NO: 356238 - DNA, 853 bp, Homo sapiens
  misc_feature (4)..(4): n is a, c, g, or t
tagngtatcccctccccgtacgctcaatgtaggagctctatcaaaatgggttgggaagataccgccagatgttttacaagacatggcagtgattgctcctatgcttgccaagcttggatatgacccatatgccaacccacctaactacggaaaacctgatcccaaaattattgaaaacactcgaagggtctataagggagaattccaactacctgactttcttaaagaaaaaccacagactgagcaagtggagtagcagaaccaggagcctcttccatacatgaggaaagattgctgccttttcagcagaagggaaattcctaggattggctgtcccctgccaagcttggtggagcgtctgcaccttggctgcgccgcctgtgcatttgccagtttcctcccactgagaggatggaggtgtccgcacagctttgggcctcgtgagggatctgcctcctgagcaaagagctcttgatcccgatttcatgcacagccctgcagtaaggagcccagaaggaacatgtgtttcctgttaaaactcctcttgttctcttttcttacattatgacgtttgttttcaaggagagggtttaaaaatgggatcctgtaagcagacttgggcagtctccttttgaaataggttgtctgtacatgttctaatgttttgtagaacacgtgtgcctgtttaagtgtattgatgtgaataatattaaatatcctaattatttaattcattgtattgtttctgagaagttgggaaattaccattatacatttacaacctaatgacttttgtattttatttttcaaaataaaagctttcaatgtgaagcattctggtaaaaaaatgttt

SEQ ID NO: 356239 - DNA, 624 bp, Homo sapiens
actgcatacaacgccgctgactgcatcaacgccgctgactgcatccaacgccgctgactgcatccaacgccgctgactgcatccaacgccgctgactgcatccaacgccgctgactgcatccaacgccgctgactgcatccaacgccgcctgtgcatttgccagtttcctcccactgagaggatggaggtgtccgcacagctttgggcctcgtgagggatctgcctcctgagcaaagagctcttgatcccgatttcatgcacagccctgcagtaaggagcccagaaggaacatgtgtttcctgttaaaactcctcttgttctcttttcttacattatgacgtttgttttcaaggagagggtttaaaaatgggatcctgtaagcagacttgggcagtctccttttgaaataggttgtctgtacatgttctaatgttttgtagaacacgtgtgcctgtttaagtgtattgatgtgaataatattaaatatcctaattatttaattcattgtattgtttctgagaagttgggaaattaccattatacatttacaacctaatgacttttgtattttatttttcaaaataaaagctttcaatgtgaagcattctggtaaaaaaatgttt

SEQ ID NO: 356240 - DNA, 313 bp, Homo sapiens
aaaatctctaaatattgttaaatttattaaatccactgtcattagtagaccttagaacttaagcctataatctatataaatatataacactgtcaatcatattacaatgtttaatttgcattaaaatgtaagaatttgcttttcttattttattttattattattatactttaagttttagggaacatgtgcacaatgtgcaggttagttacatatgtatacacgtgccatgctggtgcgctgcacccattaactcgtcatttagcattaggtatatctcctaatgctatccctcccccctccccccacccca

SEQ ID NO: 356241 - DNA, 224 bp, Homo sapiens
ggtctagtgcatccggctgcagagggaaattgaggaccttacacagcagctagcggccatgcagttcttcaacgacaagttccagggcctttgaagttggagccagcgtccggagctgcagccaagcgagtttcctccttatcctccttagccagggctttttctcttccgctgcatttgcccccttcccaacgcagttcaaagcagtgtgaaataaagtcgtt

SEQ ID NO: 356242 - DNA, 3074 bp, Homo sapiens
ggatttccgggcggcggaaggagacgcggccgcgtgaggacgaggctatttgaaaacacgctccgggagctagagcctgaggtcggcggcgcacgctgttgccccgtgggcttctgctccctcgcttgtcttctcgggcttctcgccccggccgcggccgggtcctcagtagtcgagaatgactaaaaaaagaaaacgccaacatgattttcaaaaagtaaaattgaaagttggtaaaaagaagcccaagttacaaaatgctactcctacaaactttaaaacaaagactatacatctgcctgagcaactcaaagaggatggaacacttccaacaaacaatagaaaacttaacataaaggatttgctgtcacagatgcatcactacaatgctggggttaaacaaagtgctcttcttggacttaaagaccttttgtctcaatacccatttataattgatgcacacctttcaaacatattaagtgaagtgactgctgtgtttacagataaagatgctaatgtacgattagcagcagttcaacttcttcaattcctggcccccaaaatacgagctgaacaaatttctccattttttcctttggtaagtgcccatctctctagtgccatgactcacattactgaaggaattcaggaggactctttaaaagttttggacattctgctggaacagtacccagctctaattactggccgtagcagcatattgcttaagaattttgtagaacttatttctcatcagcagctgtccaaaggactgataaatagagacagatcccagtcctggatactttctgtaaatcctaatcggagactcacttctcagcaatggaggctgaaagtcttagtgagactcagtaaattccttcaggccttggcagatggatccagtaggttgagagaaagtgaaggacttcaggaacagaaagaaaatccccatgccactagcaactccatttttatcaactggaaggaacatgccaacgaccagcaacacatccaggtttatgaaaatgggggttcacagccaaatgtcagttcacagttcaggctacggtatctggttggaggactgagtggtgtggatgaaggcctgtcatctactgaaaacctgaaaggatttattgagataataattccattgctaattgaatgctgggttgaagctgtacctccacaactagctactcctgttgggaatggtatagaacgagaacctctacaggttatgcagcaagttcttaatattatttcccttctgtggaaactctctaaacaacaggatgaaacccataaattggagtcatggcttcgaaagaactaccttattgattttaaacaccattttatgagtcgttttccatatgtcttaaaagaaataaccaagcacaaaaggaaagagccaaataaaagcatcaagcattgcacagttctctccaataacatagatcatctcttactgaatttaacactgtctgatatcatggtctccctggcaaatgcgtcaactttgcagaaggattgcagttggatagaaatgataaggaaatttgtaacagagacccttgaagatggctctaggctaaatagtaagcaactgaacagattgctgggagtatcctggaggttaatgcaaatacagccaaacagagaggacacagagactcttattaaggcagtttatacattatatcagcagaggggccttatccttccagttcggactttgttattgaagtttttcagtaaaatctatcagacagaagaactgagatcttgtagattcagatatcgtagtaaagtgttatcccgttggctggctggcttaccattgcaacttgctcatcttggctcccgaaatcctgagctctctacacagcttatcgatatcattcataccgctgcagcacgagcaaataaagaattactaaaaagtttacaagctactgccctccgaatttatgatccacaagaaggtgctgtggtggttctccctgcagactctcagcagcgtttggttcagcttgtatatttcctacccagtctgccggctgatttgctttctcggttaagtcgttgctgtattatgggaagactcagttcaagtttggctgccatgcttatcgggatactgcacatgagatcatcattttctgggtggaagtattcagctaaagactggttgatgagtgatgtagactatttcagcttcttattttccacacttacagggttttcgaaagaggagttgacttggcttcagagccttcgaggagttcctcatgtcatccagacacagctttcccctgtgcttctctaccttacagatttggatcaatttttacaccactgggatgtaacagaggcagtttttcacagtttattggttattcctgcccgaagtcagaactttgacatcttgcaaagtgccatcagtaagcatttggttgggttgactgtaattcctgacagcacggctggctgtgtttttggtgttatctgtaagctcctggatcatacttgtgtagttagtgagactctactgccatttctggcttcttgttgctacagtcttctttattttctgctcactatagagaaaggggaagcagaacatctaagaaagagggacaagctgtggggggtctgtgtctccatcctggctctcttgcctcgagtcctcaggttgatgctgcagagcctgcgggtgaacagagttgggcctgaggagctgcctgttgtgggccagctgcttcgactgctgcttcagcatgcacccctcaggactcatatgttgaccaatgcgatcttggtgcagcagatcatcaagaatatcacgacattgaagagtggaagtgttcaggaacagtggctcacagacttacattactgcttcaacgtgtatatcactgggcatccccaagggcccagtgcactggctacagtgtattgaagaggccatagtacctcctgtttgaagttgtttattcacatctatcttatttgaagaaaaagactgatgtaatagatctttgtcattaaagctgaacttttaaaga

SEQ ID NO: 356243 - DNA, 3011 bp, Homo sapiens
ctcaaaataaataaacatttattaagcactcattggtgtccggcgcccggaagctcactaaattggcttgaaggacttatcaccccggtcgcggacgggtcctcagtagtcgagaatgactaaaaaaagaaaacgccaacatgattttcaaaaagtaaaattgaaagttggtaaaaagaagcccaagttacaaaatgctactcctacaaactttaaaacaaagactatacatctgcctgagcaactcaaagaggatggaacacttccaacaaacaatagaaaacttaacataaaggatttgctgtcacagatgcatcactacaatgctggggttaaacaaagtgctcttcttggacttaaagaccttttgtctcaatacccatttataattgatgcacacctttcaaacatattaagtgaagtgactgctgtgtttacagataaagatgctaatgtacgattagcagcagttcaacttcttcaattcctggcccccaaaatacgagctgaacaaatttctccattttttcctttggtaagtgcccatctctctagtgccatgactcacattactgaaggaattcaggaggactctttaaaagttttggacattctgctggaacagtacccagctctaattactggccgtagcagcatattgcttaagaattttgtagaacttatttctcatcagcagctgtccaaaggactgataaatagagacagatcccagtcctggatactttctgtaaatcctaatcggagactcacttctcagcaatggaggctgaaagtcttagtgagactcagtaaattccttcaggccttggcagatggatccagtaggttgagagaaagtgaaggacttcaggaacagaaagaaaatccccatgccactagcaactccatttttatcaactggaaggaacatgccaacgaccagcaacacatccaggtttatgaaaatgggggttcacagccaaatgtcagttcacagttcaggctacggtatctggttggaggactgagtggtgtggatgaaggcctgtcatctactgaaaacctgaaaggatttattgagataataattccattgctaattgaatgctgggttgaagctgtacctccacaactagctactcctgttgggaatggtatagaacgagaacctctacaggttatgcagcaagttcttaatattatttcccttctgtggaaactctctaaacaacaggatgaaacccataaattggagtcatggcttcgaaagaactaccttattgattttaaacaccattttatgagtcgttttccatatgtcttaaaagaaataaccaagcacaaaaggaaagagccaaataaaagcatcaagcattgcacagttctctccaataacatagatcatctcttactgaatttaacactgtctgatatcatggtctccctggcaaatgcgtcaactttgcagaaggattgcagttggatagaaatgataaggaaatttgtaacagagacccttgaagatggctctaggctaaatagtaagcaactgaacagattgctgggagtatcctggaggttaatgcaaatacagccaaacagagaggacacagagactcttattaaggcagtttatacattatatcagcagaggggccttatccttccagttcggactttgttattgaagtttttcagtaaaatctatcagacagaagaactgagatcttgtagattcagatatcgtagtaaagtgttatcccgttggctggctggcttaccattgcaacttgctcatcttggctcccgaaatcctgagctctctacacagcttatcgatatcattcataccgctgcagcacgagcaaataaagaattactaaaaagtttacaagctactgccctccgaatttatgatccacaagaaggtgctgtggtggttctccctgcagactctcagcagcgtttggttcagcttgtatatttcctacccagtctgccggctgatttgctttctcggttaagtcgttgctgtattatgggaagactcagttcaagtttggctgccatgcttatcgggatactgcacatgagatcatcattttctgggtggaagtattcagctaaagactggttgatgagtgatgtagactatttcagcttcttattttccacacttacagggttttcgaaagaggagttgacttggcttcagagccttcgaggagttcctcatgtcatccagacacagctttcccctgtgcttctctaccttacagatttggatcaatttttacaccactgggatgtaacagaggcagtttttcacagtttattggttattcctgcccgaagtcagaactttgacatcttgcaaagtgccatcagtaagcatttggttgggttgactgtaattcctgacagcacggctggctgtgtttttggtgttatctgtaagctcctggatcatacttgtgtagttagtgagactctactgccatttctggcttcttgttgctacagtcttctttattttctgctcactatagagaaaggggaagcagaacatctaagaaagagggacaagctgtggggggtctgtgtctccatcctggctctcttgcctcgagtcctcaggttgatgctgcagagcctgcgggtgaacagagttgggcctgaggagctgcctgttgtgggccagctgcttcgactgctgcttcagcatgcacccctcaggactcatatgttgaccaatgcgatcttggtgcagcagatcatcaagaatatcacgacattgaagagtggaagtgttcaggaacagtggctcacagacttacattactgcttcaacgtgtatatcactgggcatccccaagggcccagtgcactggctacagtgtattgaagaggccatagtacctcctgtttgaagttgtttattcacatctatcttatttgaagaaaaagactgatgtaatagatctttgtcattaaagctgaacttttaaaga

SEQ ID NO: 356244 - DNA, 3020 bp, Homo sapiens
ggatttccgggcggcggaaggagacgcggccgcgtgaggacgaggctatttgaaaacacgctccgggagctagagcctgaggtcggcggcgcacgctgttgccccgtgggcttctgctccctcgcttgtcttctcgggcttctcgccccggccgcggccgggtcctcagtagtcgagaatgactaaaaaaagaaaacgccaacatgattttcaaaaagtaaaattgaaagttggtaaaaagaagcccaagttacaaaatgctactcctacaaactttaaaacaaagactatacatctgcctgagcaactcaaagaggatggaacacttccaacaaacaatagaaaacttaacataaaggatttgctgtcacagatgcatcactacaatgctggggttaaacaaagtgctcttcttggacttaaagaccttttgtctcaatacccatttataattgatgcacacctttcaaacatattaagtgaagtgactgctgtgtttacagataaagatgctaatgtacgattagcagcagttcaacttcttcaattcctggcccccaaaatacgagctgaacaaatttctccattttttcctttggtaagtgcccatctctctagtgccatgactcacattactgaaggaattcaggaggactctttaaaagttttggacattctgctggaacagtacccagctctaattactggccgtagcagcatattgcttaagaattttgtagaacttatttctcatcagcagctgtccaaaggactgataaatagagacagatcccagtcctggatactttctgtaaatcctaatcggagactcacttctcagcaatggaggctgaaagtcttagtgagactcagtaaattccttcaggccttggcagatggatccagtaggttgagagaaagtgaaggacttcaggaacagaaagaaaatccccatgccactagcaactccatttttatcaactggaaggaacatgccaacgaccagcaacacatccaggtttatgaaaatgggggttcacagccaaatgtcagttcacagttcaggctacggtatctggttggaggactgagtggtgtggatgaaggcctgtcatctactgaaaacctgaaaggatttattgagataataattccattgctaattgaatgctgggttgaagctgtacctccacaactagctactcctgttgggaatggtatagaacgagaacctctacaggttatgcagcaagttcttaatattatttcccttctgtggaaactctctaaacaacaggatgaaacccataaattggagtcatggcttcgaaagaactaccttattgattttaaacaccattttatgagtcgttttccatatgtcttaaaagaaataaccaagcacaaaaggaaagagccaaataaaagcatcaagcattgcacagttctctccaataacatagatcatctcttactgaatttaacactgtctgatatcatggtctccctggcaaatgcgtcaactttgcagaaggattgcagttggatagaaatgataaggaaatttgtaacagagacccttgaagatggctctaggctaaatagtaagcaactgaacagattgctgggagtatcctggaggttaatgcaaatacagccaaacagagaggacacagagactcttattaaggcagtttatacattatatcagcagaggggccttatccttccagttcggactttgttattgaagtttttcagtaaaatctatcagacagaagaactgagatcttgtagattcagatatcgtagtaaagtgttatcccgttggctggctggcttaccattgcaacttgctcatcttggctcccgaaatcctgagctctctacacagcttatcgatatcattcataccgctgcagcacgagcaaataaagaattactagtggttctccctgcagactctcagcagcgtttggttcagcttgtatatttcctacccagtctgccggctgatttgctttctcggttaagtcgttgctgtattatgggaagactcagttcaagtttggctgccatgcttatcgggatactgcacatgagatcatcattttctgggtggaagtattcagctaaagactggttgatgagtgatgtagactatttcagcttcttattttccacacttacagggttttcgaaagaggagttgacttggcttcagagccttcgaggagttcctcatgtcatccagacacagctttcccctgtgcttctctaccttacagatttggatcaatttttacaccactgggatgtaacagaggcagtttttcacagtttattggttattcctgcccgaagtcagaactttgacatcttgcaaagtgccatcagtaagcatttggttgggttgactgtaattcctgacagcacggctggctgtgtttttggtgttatctgtaagctcctggatcatacttgtgtagttagtgagactctactgccatttctggcttcttgttgctacagtcttctttattttctgctcactatagagaaaggggaagcagaacatctaagaaagagggacaagctgtggggggtctgtgtctccatcctggctctcttgcctcgagtcctcaggttgatgctgcagagcctgcgggtgaacagagttgggcctgaggagctgcctgttgtgggccagctgcttcgactgctgcttcagcatgcacccctcaggactcatatgttgaccaatgcgatcttggtgcagcagatcatcaagaatatcacgacattgaagagtggaagtgttcaggaacagtggctcacagacttacattactgcttcaacgtgtatatcactgggcatccccaagggcccagtgcactggctacagtgtattgaagaggccatagtacctcctgtttgaagttgtttattcacatctatcttatttgaagaaaaagactgatgtaatagatctttgtcattaaagctgaacttttaaaga

SEQ ID NO: 356245 - DNA, 2478 bp, Homo sapiens
ggatttccgggcggcggaaggagacgcggccgcgtgaggacgaggctatttgaaaacacgctccgggagctagagcctgaggtcggcggcgcacgctgttgccccgtgggcttctgctccctcgcttgtcttctcgggcttctcgccccggccgcggccgggtcctcagtagtcgagaatgactaaaaaaagaaaacgccaacatgattttcaaaaagtaaaattgaaagttggtaaaaagaagcccaagttacaaaatgctactcctacaaactttaaaacaaagactatacatctgcctgagcaactcaaagaggatggaacacttccaacaaacaatagaaaacttaacataaaggatttgctgtcacagatgcatcactacaatgctggggttaaacaaagtgctcttcttggacttaaagaccttttgtctcaatacccatttataattgatgcacacctttcaaacatattaagtgaagtgactgctgtgtttacagataaagatgctaatgtacgattagcagcagttcaacttcttcaattcctggcccccaaaatacgagctgaacaaatttctccattttttcctttggtaagtgcccatctctctagtgccatgactcacattactgaaggaattcaggaggactctttaaaagttttggacattctgctggaacagtacccagctctaattactggccgtagcagcatattgcttaagaattttgtagaacttatttctcatcagcagctgtccaaaggactgataaatagagacagatcccagtcctggatactttctgtaaatcctaatcggagactcacttctcagcaatggaggctgaaagtcttagtgagactcagtaaattccttcaggccttggcagatggatccagtaggttgagagaaagtgaaggacttcaggaacagaaagaaaatccccatgccactagcaactccatttttatcaactggaaggaacatgccaacgaccagcaacacatccaggtttatgaaaatgggggttcacagccaaatgtcagttcacagttcaggctacgaggacacagagactcttattaaggcagtttatacattatatcagcagaggggccttatccttccagttcggactttgttattgaagtttttcagtaaaatctatcagacagaagaactgagatcttgtagattcagatatcgtagtaaagtgttatcccgttggctggctggcttaccattgcaacttgctcatcttggctcccgaaatcctgagctctctacacagcttatcgatatcattcataccgctgcagcacgagcaaataaagaattactaaaaagtttacaagctactgccctccgaatttatgatccacaagaaggtgctgtggtggttctccctgcagactctcagcagcgtttggttcagcttgtatatttcctacccagtctgccggctgatttgctttctcggttaagtcgttgctgtattatgggaagactcagttcaagtttggctgccatgcttatcgggatactgcacatgagatcatcattttctgggtggaagtattcagctaaagactggttgatgagtgatgtagactatttcagcttcttattttccacacttacagggttttcgaaagaggagttgacttggcttcagagccttcgaggagttcctcatgtcatccagacacagctttcccctgtgcttctctaccttacagatttggatcaatttttacaccactgggatgtaacagaggcagtttttcacagtttattggttattcctgcccgaagtcagaactttgacatcttgcaaagtgccatcagtaagcatttggttgggttgactgtaattcctgacagcacggctggctgtgtttttggtgttatctgtaagctcctggatcatacttgtgtagttagtgagactctactgccatttctggcttcttgttgctacagtcttctttattttctgctcactatagagaaaggggaagcagaacatctaagaaagagggacaagctgtggggggtctgtgtctccatcctggctctcttgcctcgagtcctcaggttgatgctgcagagcctgcgggtgaacagagttgggcctgaggagctgcctgttgtgggccagctgcttcgactgctgcttcagcatgcacccctcaggactcatatgttgaccaatgcgatcttggtgcagcagatcatcaagaatatcacgacattgaagagtggaagtgttcaggaacagtggctcacagacttacattactgcttcaacgtgtatatcactgggcatccccaagggcccagtgcactggctacagtgtattgaagaggccatagtacctcctgtttgaagttgtttattcacatctatcttatttgaagaaaaagactgatgtaatagatctttgtcattaaagctgaacttttaaaga

SEQ ID NO: 356246 - DNA, 2601 bp, Homo sapiens
ggatttccgggcggcggaaggagacgcggccgcgtgaggacgaggctatttgaaaacacgctccgggagctagagcctgaggtcggcggcgcacgctgttgccccgtgggcttctgctccctcgcttgtcttctcgggcttctcgccccggccgcggccgggtcctcagtagtcgagaatgactaaaaaaagaaaacgccaacatgattttcaaaaagtaaaattgaaagttggtaaaaagaagcccaagttacaaaatgctactcctacaaactttaaaacaaagactatacatctgcctgagcaactcaaagaggatggaacacttccaacaaacaatagaaaacttaacataaaggatttgctgtcacagatgcatcactacaatgctggggttaaacaaagtgctcttcttggacttaaagaccttttgtctcaatacccatttataattgatgcacacctttcaaacatattaagtgaagtgactgctgtgtttacagataaagatgctaatgtacgattagcagcagttcaacttcttcaattcctggcccccaaaatacgagctgaacaaatttctccattttttcctttggtatctggttggaggactgagtggtgtggatgaaggcctgtcatctactgaaaacctgaaaggatttattgagataataattccattgctaattgaatgctgggttgaagctgtacctccacaactagctactcctgttgggaatggtatagaacgagaacctctacaggttatgcagcaagttcttaatattatttcccttctgtggaaactctctaaacaacaggatgaaacccataaattggagtcatggcttcgaaagaactaccttattgattttaaacaccattttatgagtcgttttccatatgtcttaaaagaaataaccaagcacaaaaggaaagagccaaataaaagcatcaagcattgcacagttctctccaataacatagatcatctcttactgaatttaacactgtctgatatcatggtctccctggcaaatgcgtcaactttgcagaaggattgcagttggatagaaatgataaggaaatttgtaacagagacccttgaagatggctctaggctaaatagtaagcaactgaacagattgctgggagtatcctggaggttaatgcaaatacagccaaacagagaggacacagagactcttattaaggcagtttatacattatatcagcagaggggccttatccttccagttcggactttgttattgaagtttttcagtaaaatctatcagacagaagaactgagatcttgtagattcagatatcgtagtaaagtgttatcccgttggctggctggcttaccattgcaacttgctcatcttggctcccgaaatcctgagctctctacacagcttatcgatatcattcataccgctgcagcacgagcaaataaagaattactaaaaagtttacaagctactgccctccgaatttatgatccacaagaaggtgctgtggtggttctccctgcagactctcagcagcgtttggttcagcttgtatatttcctacccagtctgccggctgatttgctttctcggttaagtcgttgctgtattatgggaagactcagttcaagtttggctgccatgcttatcgggatactgcacatgagatcatcattttctgggtggaagtattcagctaaagactggttgatgagtgatgtagactatttcagcttcttattttccacacttacagggttttcgaaagaggagttgacttggcttcagagccttcgaggagttcctcatgtcatccagacacagctttcccctgtgcttctctaccttacagatttggatcaatttttacaccactgggatgtaacagaggcagtttttcacagtttattggttattcctgcccgaagtcagaactttgacatcttgcaaagtgccatcagtaagcatttggttgggttgactgtaattcctgacagcacggctggctgtgtttttggtgttatctgtaagctcctggatcatacttgtgtagttagtgagactctactgccatttctggcttcttgttgctacagtcttctttattttctgctcactatagagaaaggggaagcagaacatctaagaaagagggacaagctgtggggggtctgtgtctccatcctggctctcttgcctcgagtcctcaggttgatgctgcagagcctgcgggtgaacagagttgggcctgaggagctgcctgttgtgggccagctgcttcgactgctgcttcagcatgcacccctcaggactcatatgttgaccaatgcgatcttggtgcagcagatcatcaagaatatcacgacattgaagagtggaagtgttcaggaacagtggctcacagacttacattactgcttcaacgtgtatatcactgggcatccccaagggcccagtgcactggctacagtgtattgaagaggccatagtacctcctgtttgaagttgtttattcacatctatcttatttgaagaaaaagactgatgtaatagatctttgtcattaaagctgaacttttaaaga

SEQ ID NO: 356247 - DNA, 2892 bp, Homo sapiens
ggatttccgggcggcggaaggagacgcggccgcgtgaggacgaggctatttgaaaacacgctccgggagctagagcctgaggtcggcggcgcacgctgttgccccgtgggcttctgctccctcgcttgtcttctcgggcttctcgccccggccgcggccgggtcctcagtagtcgagaatgactaaaaaaagaaaacgccaacatgattttcaaaaagtaaaattgaaagttggtaaaaagaagcccaagttacaaaatgctactcctacaaactttaaaacaaagactatacatctgcctgagcaactcaaagaggatggaacacttccaacaaacaatagaaaacttaacataaaggatttgctgtcacagatgcatcactacaatgctggggttaaacaaagtgctcttcttggacttaaagaccttttgtctcaatacccatttataattgatgcacacctttcaaacatattaagtgaagtgactgctgtgtttacagataaagatgctaatgtacgattagcagcagttcaacttcttcaattcctggcccccaaaatacgagctgaacaaatttctccattttttcctttggtaagtgcccatctctctagtgccatgactcacattactgaaggaattcaggaggactctttaaaagttttggacattctgctggaacagtacccagctctaattactggccgtagcagcatattgcttaagaattttgtagaacttatttctcatcagcagctgtccaaaggactgataaatagagacagatcccagtcctggatactttctgtaaatcctaatcggagactcacttctcagcaatggaggctgaaagtcttagtgagactcagtaaattccttcaggccttggcagatggatccagtaggttgagagaaagtgaaggacttcaggaacagaaagaaaatccccatgccactagcaactccatttttatcaactggaaggaacatgccaacgaccagcaacacatccaggtttatgaaaatgggggttcacagccaaatgtcagttcacagttcaggctacggtatctggttggaggactgagtggtgtggatgaaggcctgtcatctactgaaaacctgaaaggatttattgagataataattccattgctaattgaatgctgggttgaagctgtacctccacaactagctactcctgttgggaatggtatagaacgagaacctctacaggttatgcagcaagttcttaatattatttcccttctgtggaaactctctaaacaacaggatgaaacccataaattggagtcatggcttcgaaagaactaccttattgattttaaacaccattttatgagtcgttttccatatgtcttaaaagaaataaccaagcacaaaaggaaagagccaaataaaagcatcaagcattgcacagttctctccaataacatagatcatctcttactgaatttaacactgtctgatatcatggtctccctggcaaatgcgtcaactttgcagaaggattgcagttggatagaaatgataaggaaatttgtaacagagacccttgaagatggctctaggctaaatagtaagcaactgaacagattgctgggagtatcctggaggttaatgcaaatacagccaaacagagaggacacagagactcttattaaggcagtttatacattatatcagcagaggggccttatccttccagttcggactttgttattgaagtttttcagtaaaatctatcagacagaagaactgagatcttgtagattcagatatcgtagtaaagtgttatcccgttggctggctggcttaccattgcaacttgctcatcttggctcccgaaatcctgagctctctacacagcttatcgatatcattcataccgctgcagcacgagcaaataaagaattactaaaaagtttacaagctactgccctccgaatttatgatccacaagaaggtgctgtggtggttctccctgcagactctcagcagcgtttggttcagcttgtatatttcctacccagtctgccggctgatttgctttctcggttaagtcgttgctgtattatgggaagactcagttcaagtttggctgccatgcttatcgggatactgcacatgagatcatcattttctgggtggaagtattcagctaaagactggttgatgagtgatgtagactatttcagcttcttattttccacacttacagggttttcgaaagaggagttgacttggcttcagagccttcgaggagttcctcatgtcatccagacacagctttcccctgtgcttctctaccttacagatttggatcaatttttacaccactgggatgtaacagaggcagtttttcacagtttattggttattcctgcccgaagtcagaactttgacatcttgcaaagtgccatcagtaagcatttgggacaagctgtggggggtctgtgtctccatcctggctctcttgcctcgagtcctcaggttgatgctgcagagcctgcgggtgaacagagttgggcctgaggagctgcctgttgtgggccagctgcttcgactgctgcttcagcatgcacccctcaggactcatatgttgaccaatgcgatcttggtgcagcagatcatcaagaatatcacgacattgaagagtggaagtgttcaggaacagtggctcacagacttacattactgcttcaacgtgtatatcactgggcatccccaagggcccagtgcactggctacagtgtattgaagaggccatagtacctcctgtttgaagttgtttattcacatctatcttatttgaagaaaaagactgatgtaatagatctttgtcattaaagctgaacttttaaaga

SEQ ID NO: 356248 - DNA, 3441 bp, Homo sapiens
ggatttccgggcggcggaaggagacgcggccgcgtgaggacgaggctatttgaaaacacgctccgggagctagagcctgaggtcggcggcgcacgctgttgccccgtgggcttctgctccctcgcttgtcttctcgggcttctcgccccggccgcggccgggtcctcagtagtcgagaatgactaaaaaaagaaaacgccaacatgattttcaaaaagtaaaattgaaagttggtaaaaagaagcccaagttacaaaatgctactcctacaaactttaaaacaaagactatacatctgcctgagcaactcaaagaggatggaacacttccaacaaacaatagaaaacttaacataaaggatttgctgtcacagatgcatcactacaatgctggggttaaacaaagtgctcttcttggacttaaagaccttttgtctcaatacccatttataattgatgcacacctttcaaacatattaagtgaagtgactgctgtgtttacagataaagatgctaatgtacgattagcagcagttcaacttcttcaattcctggcccccaaaatacgagctgaacaaatttctccattttttcctttggtaagtgcccatctctctagtgccatgactcacattactgaaggaattcaggaggactctttaaaagttttggacattctgctggaacagtacccagctctaattactggccgtagcagcatattgcttaagaattttgtagaacttatttctcatcagcagctgtccaaaggactgataaatagagacagatcccagtcctggatactttctgtaaatcctaatcggagactcacttctcagcaatggaggctgaaagtcttagtgagactcagtaaattccttcaggccttggcagatggatccagtaggttgagagaaagtgaaggacttcaggaacagaaagaaaatccccatgccactagcaactccatttttatcaactggaaggaacatgccaacgaccagcaacacatccaggtttatgaaaatgggggttcacagccaaatgtcagttcacagttcaggctacggtatctggttggaggactgagtggtgtggatgaaggcctgtcatctactgaaaacctgaaaggatttattgagataataattccattgctaattgaatgctgggttgaagctgtacctccacaactagctactcctgttgggaatggtatagaacgagaacctctacaggttatgcagcaagttcttaatattatttcccttctgtggaaactctctaaacaacaggatgaaacccataaattggagtcatggcttcgaaagaactaccttattgattttaaacaccattttatgagtcgttttccatatgtcttaaaagaaataaccaagcacaaaaggaaagagccaaataaaagcatcaagcattgcacagttctctccaataacatagatcatctcttactgaatttaacactgtctgatatcatggtctccctggcaaatgcgtcaactttgcagaaggattgcagttggatagaaatgataaggaaatttgtaacagagacccttgaagatggctctaggctaaatagtaagcaactgaacagattgctgggagtatcctggaggttaatgcaaatacagccaaacagagaggacacagagactcttattaaggcagtttatacattatatcagcagaggggccttatccttccagttcggactttgttattgaagtttttcagtaaaatctatcagacagaagaactgagatcttgtagattcagatatcgtagtaaagtgttatcccgttggctggctggcttaccattgcaacttgctcatcttggctcccgaaatcctgagctctctacacagcttatcgatatcattcataccgctgcagcacgagcaaataaagaattactaaaaagtttacaagctactgccctccgaatttatgatccacaagaaggtgctgtggtggttctccctgcagactctcagcagcgtttggttcagcttgtatatttcctacccagtctgccggctgatttgctttctcggttaagtcgttgctgtattatgggaagactcagttcaagtttggctgccatgcttatcgggatactgcacatgagatcatcattttctgggtggaagtattcagctaaagactggttgatgagtgatgtagactatttcagcttcttattttccacacttacagggttttcgaaagaggagttgacttggcttcagagccttcgaggagttcctcatgtcatccagacacagctttcccctgtgcttctctaccttacagatttggatcaatttttacaccactgggatgtaacagaggcagtttttcacagtttattggttattcctgcccgaagtcagaactttgacatcttgcaaagtgccatcagtaagcatttggttgggttgactgtaattcctgacagcacggctggctgtgtttttggtgttatctgtaagctcctggatcatacttgtgtagttagtgagactctactgccatttctggcttcttgttgctacagtcttctttattttctgctcactatagagaaaggggaagcagaacatctaagaaagagggacaagctgtggggggtctgtgtctccatcctggctctcttgcctcgagtcctcaggttgatgctgcagagcctgcgggtgaacagagcctgttgtgggccagctgcttcgactgctgcttcagcatgcacccctcaggactcatatgttgaccaatgcgatcttggtgcagcagatcatcaagaatatcacgacattgaagagtggaagtgttcaggaacagtggctcacagacttacattactgcttcaacgtgtatatcactgggcatccccaagggcccagtgcactggctacagtgtattgaagaggccatagtacctcctgtttgaagttgtttattcacatctatcttatttgaagaaaaagactgatgtaatagatctttgtcattaaagctgaacttttaaagaagtttacgaaccttctttctttgcactgatatatgaaaataatgtttgggcgttcctattgatgtgtaggctggcttcccggactagcacacgatacatggtcataggcggttgtgcattgtgcatttcataggagctaaatatttacaaaatagagagtgatactgtggtaccttctgttatataccaagaaactggctaaatctttgtaatcccatccaggcagacctccttctttgtgtttttgtgatcacaaaaacgatgaatgtaataattagtaaactaaaaaccaaggtaattaagtgaacacttcattgcctatctgtctatctcttaccgttagcacagaagtggcactgatctgaagaaaatgaaagcaacccc

SEQ ID NO: 356249 - DNA, 2710 bp, Homo sapiens
ggatttccgggcggcggaaggagacgcggccgcgtgaggacgaggctatttgaaaacacgctccgggagctagagcctgaggtcggcggcgcacgctgttgccccgtgggcttctgctccctcgcttgtcttctcgggcttctcgccccggccgcggccgggtcctcagtagtcgagaatgactaaaaaaagaaaacgccaacatgattttcaaaaagtaaaattgaaagttggtaaaaagaagcccaagttacaaaatgctactcctacaaactttaaaacaaagactatacatctgcctgagcaactcaaagaggatggaacacttccaacaaacaatagaaaacttaacataaaggatttgctgtcacagatgcatcactacaatgctggggttaaacaaagtgctcttcttggacttaaagaccttttgtctcaatacccatttataattgatgcacacctttcaaacatattaagtgaagtgactgctgtgtttacagataaagatgctaatgtacgattagcagcagttcaacttcttcaattcctggcccccaaaatacgagctgaacaaatttctccattttttcctttggtaagtgcccatctctctagtgccatgactcacattactgaaggaattcaggaggactctttaaaagttttggacattctgctggaacagtacccagctctaattactggccgtagcagcatattgcttaagaattttgtagaacttatttctcatcagcagctgtccaaaggactgataaatagagacagatcccagtcctggatactttctgtaaatcctaatcggagactcacttctcagcaatggaggctgaaagtcttagtgagactcagtaaattccttcaggccttggcagatggatccagtaggttgagagaaagtgaaggacttcaggaacagaaagaaaatccccatgccactagcaactccatttttatcaactggaaggaacatgccaacgaccagcaacacatccaggtttatgaaaatgggggttcacagccaaatgtcagttcacagttcaggctacggtatctggttggaggactgagtggtgtggatgaaggcctgtcatctactgaaaacctgaaaggatttattgagataataattccattgctaattgaatgctgggttgaagctgtacctccacaactagctactcctgttgggaatggtatagaacgagaacctctacaggttatgcagcaagttcttaatattatttcccttctgtggaaactctctaaacaacaggatgaaacccataaattggagtcatggcttcgaaagaactaccttattgattttaaacaccattttatgagtcgttttccatatgtcttaaaagaaataaccaagcacaaaaggaaagagccaaataaaagcatcaagcattgcacagttctctccaataacatagatcatctcttactgaatttaacactgtctgatatcatggtctccctggcaaatgcgtcaactttgcagaaggattgcagttggatagaaatgataaggaaatttgtaacagagacccttgaagatggctctaggctaaatagtaagcaactgaacagattgctgggagtatcctggaggttaatgcaaatacagccaaacagagaggacacagagactcttattaaggcagtttatacattatatcagcagaggggccttatccttccagttcggactttgttattgaagtttttcagtaaaatctatcagacagaagaactgagatcttgtagattcagatatcgtagtaaagtgttatcccgttggctggctggcttaccattgcaacttgctcatcttggctcccgaaatcctgagctctctacacagcttatcgatatcattcataccgctgcagcacgagcaaataaagaattactaaaaagtttacaagctactgccctccgaatttatgatccacaagaaggtgctgtggtggttctccctgcagactctcagcagcgtttggttcagcttgtatatttcctacccagtctgccggctgatttgctttctcggttaagtcgttgctgtattatgggaagactcagttcaagtttggctgccatgcttatcgggatactgcacatgagatcatcattttctgggtggaagtattcagctaaagactggttgatgagtgatgtagactatttcagcttcttattttccacacttacagggttttcgaaagaggagttgacttggcttcagagccttcgaggagttcctcatgtcatccagacacagctttcccctgtgcttctctaccttacagatttggatcaatttttacaccactgggatgtaacagaggcagtttttcacagtttattggttattcctgcccgaagtcagaactttgacatcttgcaaagtgccatcagtaagcatttggttgggttgactgtaattcctgacagcacggctggctgtgtttttggtgttatctgtaagctcctggatcatacttgtgtagttagtgagactctactgccatttctggcttcttgttgctacagtcttctttattttctgctcactatagagaaaggggaagcagaacatctaagaaagaggacaagctgttgctggtctgtgtctccgtccagtctatccgtactcatggtcacaggtgtatgctgg

SEQ ID NO: 356250 - DNA, 940 bp, Homo sapiens
cggacgcgtgggtcgacccacgcatcatcattttctgggtggaagtattcagctaaagactggttgatgagtgatgtagactatttcagcttcttattttccacacttacagggttttcgaaagaggagttgacttggcttcagagccttcgaggagttcctcatgtcatccagacacagctttcccctgtgcttctctaccttacagatttggatcaatttttacaccactgggatgtaacagaggcagtttttcacagtttattggttattcctgcccgaagtcagaactttgacatcttgcaaagtgccatcagtaagcatttggttgggttgactgtaattcctgacagcacggctggctgtgtttttggtgttatctgtaagctcctggatcatacttgtgtagttagtgagactctactgccatttctggcttcttgttgctacagtcttctttattttctgctcactatagagaaaggggaagcagaacatctaagaaagagggacaagctgtggggggtctgtgtctccatcctggctctcttgcctcgagtcctcaggttgatgctgcagagcctgcgggtgaacagagttgggcctgaggagctgcctgttgtgggccagctgcttcgactgctgcttcagcatgcacccctcaggactcatatgttgaccaatgcgatcttggtgcagcagatcatcaagaatatcacgacattgaagagtggaagtgttcaggaacagtggctcacagacttacattactgcttcaacgtgtatatcactgggcatccccaagggcccagtgcactggctacagtgtattgaagaggccatagtacctcctgtttgaagttgtttattcacatctatcttatttgaagaaaaagactgatgtaatagatctttgtcattaaagctgaacttttaaaga

SEQ ID NO: 356251 - DNA, 1466 bp, Homo sapiens
ggatttccgggcggcggaaggagacgcggccgcgtgaggacgaggctatttgaaaacacgctccgggagctagagcctgaggtcggcggcgcacgctgttgccccgtgggcttctgctccctcgcttgtcttctcgggcttctcgccccggccgcggccgggtcctcagtagtcgagaatgactaaaaaaagaaaacgccaacatgattttcaaaaagtaaaattgaaagttggtaaaaagaagcccaagttacaaaatgctactcctacaaactttaaaacaaagactatacatctgcctgagcaactcaaagaggatggaacacttccaacaaacaatagaaaacttaacataaaggatttgctgtcacagatgcatcactacaatgctggggttaaacaaagtgctcttcttggacttaaagaccttttgtctcaatacccatttataattgatgcacacctttcaaacatattaagtgaagtgactgctgtgtttacagataaagatgctaatgtacgattagcagcagttcaacttcttcaattcctggcccccaaaatacgagctgaacaaatttctccattttttcctttggtaagtgcccatctctctagtgccatgactcacattactgaaggaattcaggaggactctttaaaagttttggacattctgctggaacagtacccagctctaattactggccgtagcagcatattgcttaagaattttgtagaacttatttctcatcagcagctgtccaaaggactgataaatagagacagatcccagtcctggatactttctgtaaatcctaatcggagactcacttctcagcaatggaggctgaaagtcttagtgagactcagtaaattccttcaggccttggcagatggatccagtaggttgagagaaagtgaaggacttcaggaacagaaagaaaatccccatgccactagcaactccatttttatcaactggaaggaacatgccaacgaccagcaacacatccaggtttatgaaaatgggggttcacagccaaatgtcagttcacagttcaggctacggtatctggttggaggactgagtggtgtggatgaaggcctgtcatctactgaaaacctgaaaggatttattgagataataattccattgctaattgaatgctgggttgaagctgtacctccacaactagctactcctgttgggaatggtatagaacgagaacctctacaggttatgcagcaagttcttaatattatttcccttctgtggaaactctctaaacaacaggatgaaacccataaattggagtcatggcttcgaaagaactaccttattgattttaaacaccattttatgagtcgttttccatatgtcttaaaagaaataaccaagcacaaaaggaaagagccaaataaaaggtattatgattctttttcactgtataaccttgaaaagc

SEQ ID NO: 356252 - DNA, 392 bp, Homo sapiens
tttttttttgtttaaatttatttcccttgtctttgagtattacattttattcttctttggcctttctaagatatcgtagtaaagtgttatcccgttggctggctggcttaccattgcaacttgctcatcttggctcccgaaatcctgagctctctacacagcttatcgatatcattcataccgctgcagcacgagcaaataaagaattactaaaaagtttacaagctactgccctccgaatttatggtaagagttcatttgtttaatggtatgggtagtcattgatccaccctgatatacaaaagaagtttttaaggggagctctgtaattttgcctttcccttagtctgaattagtaataccatggttaaattgccagaacaaaacatcat

SEQ ID NO: 356253 - DNA, 346 bp, Homo sapiens
aaaacacgctccgggagctagagcctgaggtcggcggcgcacgctgttgccccgtgggcttctgctccctcgcttgtcttctcgggcttctcgccccggccgcggccgggtcctcaggtaagcggccgtcgcccgtcgggccgggtcctcccggggcgcgggactgagcgtggtggggccgtcgccccccgatccgcggcccaagcgggcagggtcggccgtgcacgatttgcgtcccccgggtctgggccgcggcgtccctccgagctgggcctgggtgtgcggccggcactgcgggggcgggaccccctagggcgtttgcggagcttcaggtgactgggcgggt

SEQ ID NO: 356254 - DNA, 3458 bp, Homo sapiens
ggatttccgggcggcggaaggagacgcggccgcgtgaggacgaggctatttgaaaacacgctccgggagctagagcctgaggtcggcggcgcacgctgttgccccgtgggcttctgctccctcgcttgtcttctcgggcttctcgccccggccgcggccgggtcctcagtagtcgagaatgactaaaaaaagaaaacgccaacatgattttcaaaaagtaaaattgaaagttggtaaaaagaagcccaagttacaaaatgctactcctacaaactttaaaacaaagactatacatctgcctgagcaactcaaagaggatggaacacttccaacaaacaatagaaaacttaacataaaggatttgctgtcacagatgcatcactacaatgctggggttaaacaaagtgctcttcttggacttaaagaccttttgtctcaatacccatttataattgatgcacacctttcaaacatattaagtgaagtgactgctgtgtttacagataaagatgctaatgtacgattagcagcagttcaacttcttcaattcctggcccccaaaatacgagctgaacaaatttctccattttttcctttggtaagtgcccatctctctagtgccatgactcacattactgaaggaattcaggaggactctttaaaagttttggacattctgctggaacagtacccagctctaattactggccgtagcagcatattgcttaagaattttgtagaacttatttctcatcagcagctgtccaaaggactgataaatagagacagatcccagtcctggatactttctgtaaatcctaatcggagactcacttctcagcaatggaggctgaaagtcttagtgagactcagtaaattccttcaggccttggcagatggatccagtaggttgagagaaagtgaaggacttcaggaacagaaagaaaatccccatgccactagcaactccatttttatcaactggaaggaacatgccaacgaccagcaacacatccaggtttatgaaaatgggggttcacagccaaatgtcagttcacagttcaggctacggtatctggttggaggactgagtggtgtggatgaaggcctgtcatctactgaaaacctgaaaggatttattgagataataattccattgctaattgaatgctgggttgaagctgtacctccacaactagctactcctgttgggaatggtatagaacgagaacctctacaggttatgcagcaagttcttaatattatttcccttctgtggaaactctctaaacaacaggatgaaacccataaattggagtcatggcttcgaaagaactaccttattgattttaaacaccattttatgagtcgttttccatatgtcttaaaagaaataaccaagcacaaaaggaaagagccaaataaaagcatcaagcattgcacagttctctccaataacatagatcatctcttactgaatttaacactgtctgatatcatggtctccctggcaaatgcgtcaactttgcagaaggattgcagttggatagaaatgataaggaaatttgtaacagagacccttgaagatggctctaggctaaatagtaagcaactgaacagattgctgggagtatcctggaggttaatgcaaatacagccaaacagagaggacacagagactcttattaaggcagtttatacattatatcagcagaggggccttatccttccagttcggactttgttattgaagtttttcagtaaaatctatcagacagaagaactgagatcttgtagattcagatatcgtagtaaagtgttatcccgttggctggctggcttaccattgcaacttgctcatcttggctcccgaaatcctgagctctctacacagcttatcgatatcattcataccgctgcagcacgagcaaataaagaattactaaaaagtttacaagctactgccctccgaatttatgatccacaagaaggtgctgtggtggttctccctgcagactctcagcagcgtttggttcagcttgtatatttcctacccagtctgccggctgatttgctttctcggttaagtcgttgctgtattatgggaagactcagttcaagtttggctgccatgcttatcgggatactgcacatgagatcatcattttctgggtggaagtattcagctaaagactggttgatgagtgatgtagactatttcagcttcttattttccacacttacagggttttcgaaagaggagttgacttggcttcagagccttcgaggagttcctcatgtcatccagacacagctttcccctgtgcttctctaccttacagatttggatcaatttttacaccactgggatgtaacagaggcagtttttcacagtttattggttattcctgcccgaagtcagaactttgacatcttgcaaagtgccatcagtaagcatttggttgggttgactgtaattcctgacagcacggctggctgtgtttttggtgttatctgtaagctcctggatcatacttgtgtagttagtgagactctactgccatttctggcttcttgttgctacagtcttctttattttctgctcactatagagaaaggggaagcagaacatctaagaaagagggacaagctgtggggggtctgtgtctccatcctggctctcttgcctcgagtcctcaggttgatgctgcagagcctgcgggtgaacagagttgggcctgaggagctgcctgttgtgggccagctgcttcgactgctgcttcagcatgcacccctcaggactcatatgttgaccaatgcgatcttggtgcagcagatcatcaagaatatcacgacattgaagagtggaagtgttcaggaacagtggctcacagacttacattactgcttcaacgtgtatatcactgggcatccccaagggcccagtgcactggctacagtgtattgaagaggccatagtacctcctgtttgaagttgtttattcacatctatcttatttgaagaaaaagactgatgtaatagatctttgtcattaaagctgaacttttaaagaagtttacgaaccttctttctttgcactgatatatgaaaataatgtttgggcgttcctattgatgtgtaggctggcttcccggactagcacacgatacatggtcataggcggttgtgcattgtgcatttcataggagctaaatatttacaaaatagagagtgatactgtggtaccttctgttatataccaagaaactggctaaatctttgtaatcccatccaggcagacctccttctttgtgtttttgtgatcacaaaaacgatgaatgtaataattagtaaactaaaaaccaaggtaattaagtgaacacttcattgcctatctgtctatctcttaccgttagcacagaagtggcactgatctgaagaaaatgaaagcaacccc

SEQ ID NO: 356255 - DNA, 4785 bp, Homo sapiens
ggatttccgggcggcggaaggagacgcggccgcgtgaggacgaggctatttgaaaacacgctccgggagctagagcctgaggtcggcggcgcacgctgttgccccgtgggcttctgctccctcgcttgtcttctcgggcttctcgccccggccgcggccgggtcctcagtagtcgagaatgactaaaaaaagaaaacgccaacatgattttcaaaaagtaaaattgaaagttggtaaaaagaagcccaagttacaaaatgctactcctacaaactttaaaacaaagactatacatctgcctgagcaactcaaagaggatggaacacttccaacaaacaatagaaaacttaacataaaggatttgctgtcacagatgcatcactacaatgctggggttaaacaaagtgctcttcttggacttaaagaccttttgtctcaatacccatttataattgatgcacacctttcaaacatattaagtgaagtgactgctgtgtttacagataaagatgctaatgtacgattagcagcagttcaacttcttcaattcctggcccccaaaatacgagctgaacaaatttctccattttttcctttggtaagtgcccatctctctagtgccatgactcacattactgaaggaattcaggaggactctttaaaagttttggacattctgctggaacagtacccagctctaattactggccgtagcagcatattgcttaagaattttgtagaacttatttctcatcagcagctgtccaaaggactgataaatagagacagatcccagtcctggatactttctgtaaatcctaatcggagactcacttctcagcaatggaggctgaaagtcttagtgagactcagtaaattccttcaggccttggcagatggatccagtaggttgagagaaagtgaaggacttcaggaacagaaagaaaatccccatgccactagcaactccatttttatcaactggaaggaacatgccaacgaccagcaacacatccaggtttatgaaaatgggggttcacagccaaatgtcagttcacagttcaggctacggtatctggttggaggactgagtggtgtggatgaaggcctgtcatctactgaaaacctgaaaggatttattgagataataattccattgctaattgaatgctgggttgaagctgtacctccacaactagctactcctgttgggaatggtatagaacgagaacctctacaggttatgcagcaagttcttaatattatttcccttctgtggaaactctctaaacaacaggatgaaacccataaattggagtcatggcttcgaaagaactaccttattgattttaaacaccattttatgagtcgttttccatatgtcttaaaagaaataaccaagcacaaaaggaaagagccaaataaaagcatcaagcattgcacagttctctccaataacatagatcatctcttactgaatttaacactgtctgatatcatggtctccctggcaaatgcgtcaactttgcagaaggattgcagttggatagaaatgataaggaaatttgtaacagagacccttgaagatggctctaggctaaatagtaagcaactgaacagattgctgggagtatcctggaggttaatgcaaatacagccaaacagagaggacacagagactcttattaaggcagtttatacattatatcagcagaggggccttatccttccagttcggactttgttattgaagtttttcagtaaaatctatcagacagaagaactgagatcttgtagattcagatatcgtagtaaagtgttatcccgttggctggctggcttaccattgcaacttgctcatcttggctcccgaaatcctgagctctctacacagcttatcgatatcattcataccgctgcagcacgagcaaataaagaattactaaaaagtttacaagctactgccctccgaatttatgatccacaagaaggtgctgtggtggttctccctgcagactctcagcagcgtttggttcagcttgtatatttcctacccagtctgccggctgatttgctttctcggttaagtcgttgctgtattatgggaagactcagttcaagtttggctgccatgcttatcgggatactgcacatgagatcatcattttctgggtggaagtattcagctaaagactggttgatgagtgatgtagactatttcagcttcttattttccacacttacagggttttcgaaagaggagttgacttggcttcagagccttcgaggagttcctcatgtcatccagacacagctttcccctgtgcttctctaccttacagatttggatcaatttttacaccactgggatgtaacagaggcagtttttcacagtttattggttattcctgcccgaagtcagaactttgacatcttgcaaagtgccatcagtaagcatttggttgggttgactgtaattcctgacagcacggctggctgtgtttttggtgttatctgtaagctcctggatcatacttgtgtagttagtgagactctactgccatttctggcttcttgttgctacagtcttctttattttctgctcactatagagaaaggggaagcagaacatctaagaaagagggacaagctgtggggggtctgtgtctccatcctggctctcttgcctcgagtcctcaggttgatgctgcagagcctgcgggtgaacagagttgggcctgaggagctgcctgttgtgggccagctgcttcgactgctgcttcagcatgcacccctcaggactcatatgttgaccaatgcgatcttggtgcagcagatcatcaagaatatcacggtaagaagcatggtaccggaggctttgcagtattagcataagaatgaatttatgacgggggcatgggggaaagtgtgttttgagggaggaaagggatcccatacattgagtccaggaattaatcccaatatggtagtttctcagggtctcccgtgctgtccagcacctgactgtgacttaatgggggggggggtgtgtctgtgattccagaattagtaataaaagtcttaaaataatcaaactcaatgaaggtgacaaagcttagtttagtttgaaaaggtaagggcatcagagtcattcctacctagactgtgatacagactctattaatgaactgtgacagcttggcaagtttttttctttctttcttacctatccaagcttgttttcctatctgtaaaaatgggaataatgccaactttattgtgttttggtgatcattaaaggagataacccaagtaaagtttttagtatacctgacatttgttaagtgctccataaatgttgtcattaaggaaattatttagcaggaataaacttcaggccaatttctagtcacttagttcactctaaagtaagaaaatcagaagttgcagacttcagctttgtctaatggttggctctctgccttcagctgtgtctgtttggccgggacagctctgttgtttaggattcctttggtgattttagtttggggggggggcggttaaaaaagtgtcttgtatagtttgattggcagattatcccttgagattcgtagtgatactttgaagtaatagtgcttttacatgcatataacacaggtgctcattagtattttttcagtagcctttgtaggggtaatggaagtggcagtggaataattcagaaatagtgaagggaagaaaatcaagagcttggattattcccagactggggaatcagcccatctttgtaaagaagagattgacagaaattgttggttggccctgtagagttattctcagttggcactggggtaaagatcatgagacactagaatggcaagagggagaggcaagggtgaagggatggttggtggtgaaatttcattagtctctagcatgtgcaggagggaacagacttaacaagaaaccattagcatttgaggatataactaggaattttcactgcctgtggtaatgcccaattaatagttccctgtttcctggaagacttcctatggtaatttacagatggggatacagttgccaaagctctgggaaattgtgtttgggtgtgaaaaatactgtcaggtagcatagtgatttgggtgcagttctcagattactcttgtttttctctccagacattgaagagtggaagtgttcaggaacagtggctcacagacttacattactgcttcaacgtgtatatcactgggcatccccaagggcccagtgcactggctacagtgtattgaagaggccatagtacctcctgtttgaagttgtttattcacatctatcttatttgaagaaaaagactgatgtaatagatctttgtcattaaagctgaacttttaaagaagtttacgaaccttctttctttgcactgatatatgaaaataatgtttgggcgttcctattgatgtgtaggctggcttcccggactagcacacgatacatggtcataggcggttgtgcattgtgcatttcataggagctaaatatttacaaaatagagagtgatactgtggtaccttctgttatataccaagaaactggctaaatctttgtaatcccatccaggcagacctccttctttgtgtttttgtgatcacaaaaacgatgaatgtaataattagtaaactaaaaaccaaggtaattaagtgaacacttcattgcctatctgtctatctcttaccgttagcacagaagtggcactgatctgaagaaaatgaaagcaacccc

SEQ ID NO: 356256 - DNA, 4768 bp, Homo sapiens
ggatttccgggcggcggaaggagacgcggccgcgtgaggacgaggctatttgaaaacacgctccgggagctagagcctgaggtcggcggcgcacgctgttgccccgtgggcttctgctccctcgcttgtcttctcgggcttctcgccccggccgcggccgggtcctcagtagtcgagaatgactaaaaaaagaaaacgccaacatgattttcaaaaagtaaaattgaaagttggtaaaaagaagcccaagttacaaaatgctactcctacaaactttaaaacaaagactatacatctgcctgagcaactcaaagaggatggaacacttccaacaaacaatagaaaacttaacataaaggatttgctgtcacagatgcatcactacaatgctggggttaaacaaagtgctcttcttggacttaaagaccttttgtctcaatacccatttataattgatgcacacctttcaaacatattaagtgaagtgactgctgtgtttacagataaagatgctaatgtacgattagcagcagttcaacttcttcaattcctggcccccaaaatacgagctgaacaaatttctccattttttcctttggtaagtgcccatctctctagtgccatgactcacattactgaaggaattcaggaggactctttaaaagttttggacattctgctggaacagtacccagctctaattactggccgtagcagcatattgcttaagaattttgtagaacttatttctcatcagcagctgtccaaaggactgataaatagagacagatcccagtcctggatactttctgtaaatcctaatcggagactcacttctcagcaatggaggctgaaagtcttagtgagactcagtaaattccttcaggccttggcagatggatccagtaggttgagagaaagtgaaggacttcaggaacagaaagaaaatccccatgccactagcaactccatttttatcaactggaaggaacatgccaacgaccagcaacacatccaggtttatgaaaatgggggttcacagccaaatgtcagttcacagttcaggctacggtatctggttggaggactgagtggtgtggatgaaggcctgtcatctactgaaaacctgaaaggatttattgagataataattccattgctaattgaatgctgggttgaagctgtacctccacaactagctactcctgttgggaatggtatagaacgagaacctctacaggttatgcagcaagttcttaatattatttcccttctgtggaaactctctaaacaacaggatgaaacccataaattggagtcatggcttcgaaagaactaccttattgattttaaacaccattttatgagtcgttttccatatgtcttaaaagaaataaccaagcacaaaaggaaagagccaaataaaagcatcaagcattgcacagttctctccaataacatagatcatctcttactgaatttaacactgtctgatatcatggtctccctggcaaatgcgtcaactttgcagaaggattgcagttggatagaaatgataaggaaatttgtaacagagacccttgaagatggctctaggctaaatagtaagcaactgaacagattgctgggagtatcctggaggttaatgcaaatacagccaaacagagaggacacagagactcttattaaggcagtttatacattatatcagcagaggggccttatccttccagttcggactttgttattgaagtttttcagtaaaatctatcagacagaagaactgagatcttgtagattcagatatcgtagtaaagtgttatcccgttggctggctggcttaccattgcaacttgctcatcttggctcccgaaatcctgagctctctacacagcttatcgatatcattcataccgctgcagcacgagcaaataaagaattactaaaaagtttacaagctactgccctccgaatttatgatccacaagaaggtgctgtggtggttctccctgcagactctcagcagcgtttggttcagcttgtatatttcctacccagtctgccggctgatttgctttctcggttaagtcgttgctgtattatgggaagactcagttcaagtttggctgccatgcttatcgggatactgcacatgagatcatcattttctgggtggaagtattcagctaaagactggttgatgagtgatgtagactatttcagcttcttattttccacacttacagggttttcgaaagaggagttgacttggcttcagagccttcgaggagttcctcatgtcatccagacacagctttcccctgtgcttctctaccttacagatttggatcaatttttacaccactgggatgtaacagaggcagtttttcacagtttattggttattcctgcccgaagtcagaactttgacatcttgcaaagtgccatcagtaagcatttggttgggttgactgtaattcctgacagcacggctggctgtgtttttggtgttatctgtaagctcctggatcatacttgtgtagttagtgagactctactgccatttctggcttcttgttgctacagtcttctttattttctgctcactatagagaaaggggaagcagaacatctaagaaagagggacaagctgtggggggtctgtgtctccatcctggctctcttgcctcgagtcctcaggttgatgctgcagagcctgcgggtgaacagagcctgttgtgggccagctgcttcgactgctgcttcagcatgcacccctcaggactcatatgttgaccaatgcgatcttggtgcagcagatcatcaagaatatcacggtaagaagcatggtaccggaggctttgcagtattagcataagaatgaatttatgacgggggcatgggggaaagtgtgttttgagggaggaaagggatcccatacattgagtccaggaattaatcccaatatggtagtttctcagggtctcccgtgctgtccagcacctgactgtgacttaatgggggggggggtgtgtctgtgattccagaattagtaataaaagtcttaaaataatcaaactcaatgaaggtgacaaagcttagtttagtttgaaaaggtaagggcatcagagtcattcctacctagactgtgatacagactctattaatgaactgtgacagcttggcaagtttttttctttctttcttacctatccaagcttgttttcctatctgtaaaaatgggaataatgccaactttattgtgttttggtgatcattaaaggagataacccaagtaaagtttttagtatacctgacatttgttaagtgctccataaatgttgtcattaaggaaattatttagcaggaataaacttcaggccaatttctagtcacttagttcactctaaagtaagaaaatcagaagttgcagacttcagctttgtctaatggttggctctctgccttcagctgtgtctgtttggccgggacagctctgttgtttaggattcctttggtgattttagtttggggggggggcggttaaaaaagtgtcttgtatagtttgattggcagattatcccttgagattcgtagtgatactttgaagtaatagtgcttttacatgcatataacacaggtgctcattagtattttttcagtagcctttgtaggggtaatggaagtggcagtggaataattcagaaatagtgaagggaagaaaatcaagagcttggattattcccagactggggaatcagcccatctttgtaaagaagagattgacagaaattgttggttggccctgtagagttattctcagttggcactggggtaaagatcatgagacactagaatggcaagagggagaggcaagggtgaagggatggttggtggtgaaatttcattagtctctagcatgtgcaggagggaacagacttaacaagaaaccattagcatttgaggatataactaggaattttcactgcctgtggtaatgcccaattaatagttccctgtttcctggaagacttcctatggtaatttacagatggggatacagttgccaaagctctgggaaattgtgtttgggtgtgaaaaatactgtcaggtagcatagtgatttgggtgcagttctcagattactcttgtttttctctccagacattgaagagtggaagtgttcaggaacagtggctcacagacttacattactgcttcaacgtgtatatcactgggcatccccaagggcccagtgcactggctacagtgtattgaagaggccatagtacctcctgtttgaagttgtttattcacatctatcttatttgaagaaaaagactgatgtaatagatctttgtcattaaagctgaacttttaaagaagtttacgaaccttctttctttgcactgatatatgaaaataatgtttgggcgttcctattgatgtgtaggctggcttcccggactagcacacgatacatggtcataggcggttgtgcattgtgcatttcataggagctaaatatttacaaaatagagagtgatactgtggtaccttctgttatataccaagaaactggctaaatctttgtaatcccatccaggcagacctccttctttgtgtttttgtgatcacaaaaacgatgaatgtaataattagtaaactaaaaaccaaggtaattaagtgaacacttcattgcctatctgtctatctcttaccgttagcacagaagtggcactgatctgaagaaaatgaaagcaacccc

SEQ ID NO: 356257 - DNA, 4401 bp, Homo sapiens
ggatttccgggcggcggaaggagacgcggccgcgtgaggacgaggctatttgaaaacacgctccgggagctagagcctgaggtcggcggcgcacgctgttgccccgtgggcttctgctccctcgcttgtcttctcgggcttctcgccccggccgcggccgggtcctcagtagtcgagaatgactaaaaaaagaaaacgccaacatgattttcaaaaagtaaaattgaaagttggtaaaaagaagcccaagttacaaaatgctactcctacaaactttaaaacaaagactatacatctgcctgagcaactcaaagaggatggaacacttccaacaaacaatagaaaacttaacataaaggatttgctgtcacagatgcatcactacaatgctggggttaaacaaagtgctcttcttggacttaaagaccttttgtctcaatacccatttataattgatgcacacctttcaaacatattaagtgaagtgactgctgtgtttacagataaagatgctaatgtacgattagcagcagttcaacttcttcaattcctggcccccaaaatacgagctgaacaaatttctccattttttcctttggtaagtgcccatctctctagtgccatgactcacattactgaaggaattcaggaggactctttaaaagttttggacattctgctggaacagtacccagctctaattactggccgtagcagcatattgcttaagaattttgtagaacttatttctcatcagcagctgtccaaaggactgataaatagagacagatcccagtcctggatactttctgtaaatcctaatcggagactcacttctcagcaatggaggctgaaagtcttagtgagactcagtaaattccttcaggccttggcagatggatccagtaggttgagagaaagtgaaggacttcaggaacagaaagaaaatccccatgccactagcaactccatttttatcaactggaaggaacatgccaacgaccagcaacacatccaggtttatgaaaatgggggttcacagccaaatgtcagttcacagttcaggctacggtatctggttggaggactgagtggtgtggatgaaggcctgtcatctactgaaaacctgaaaggatttattgagataataattccattgctaattgaatgctgggttgaagctgtacctccacaactagctactcctgttgggaatggtatagaacgagaacctctacaggttatgcagcaagttcttaatattatttcccttctgtggaaactctctaaacaacaggatgaaacccataaattggagtcatggcttcgaaagaactaccttattgattttaaacaccattttatgagtcgttttccatatgtcttaaaagaaataaccaagcacaaaaggaaagagccaaataaaagcatcaagcattgcacagttctctccaataacatagatcatctcttactgaatttaacactgtctgatatcatggtctccctggcaaatgcgtcaactttgcagaaggattgcagttggatagaaatgataaggaaatttgtaacagagacccttgaagatggctctaggctaaatagtaagcaactgaacagattgctgggagtatcctggaggttaatgcaaatacagccaaacagagaggacacagagactcttattaaggcagtttatacattatatcagcagaggggccttatccttccagttcggactttgttattgaagtttttcagtaaaatctatcagacagaagaactgagatcttgtagattcagatatcgtagtaaagtgttatcccgttggctggctggcttaccattgcaacttgctcatcttggctcccgaaatcctgagctctctacacagcttatcgatatcattcataccgctgcagcacgagcaaataaagaattactaaaaagtttacaagctactgccctccgaatttatgatccacaagaaggtgctgtggtggttctccctgcagactctcagcagcgtttggttcagcttgtatatttcctacccagtctgccggctgatttgctttctcggttaagtcgttgctgtattatgggaagactcagttcaagtttggctgccatgcttatcgggatactgcacatgagatcatcattttctgggtggaagtattcagctaaagactggttgatgagtgatgtagactatttcagcttcttattttccacacttacagggttttcgaaagaggagttgacttggcttcagagccttcgaggagttcctcatgtcatccagacacagctttcccctgtgcttctctaccttacagatttggatcaatttttacaccactgggatgtaacagaggcagtttttcacagtttattggttattcctgcccgaagtcagaactttgacatcttgcaaagtgccatcagtaagcatttggttgggttgactgtaattcctgacagcacggctggctgtgtttttggtgttatctgtaagctcctggatcatacttgtgtagttagtgagactctactgccatttctggcttcttgttgctacagtcttctttattttctgctcactatagagaaaggggaagcagaacatctaagaaagagggacaagctgtggggggtctgtgtctccatcctggctctcttgcctcgagtcctcaggttgatgctgcagagcctgcgggtgaacagagttgggcctgaggagctgcctgttgtgggccagctgcttcgactgctgcttcagcatgcacccctcaggactcatatgttgaccaatgcgatcttggtgcagcagatcatcaagaatatcacggtaagaagcatggtaccggaggctttgcagtattagcataagaatgaatttatgacgggggcatgggggaaagtgtgttttgagggaggaaagggatcccatacattgagtccaggaattaatcccaatatggtagtttctcagggtctcccgtgctgtccagcacctgactgtgacttaatgggggggggggtgtgtctgtgattccagaattagtaataaaagtcttaaaataatcaaactcaatgaaggtgacaaagcttagtttagtttgaaaaggtaagggcatcagagtcattcctacctagactgtgatacagactctattaatgaactgtgacagcttggcaagtttttttctttctttcttacctatccaagcttgttttcctatctgtaaaaatgggaataatgccaactttattgtgttttggtgatcattaaaggagataacccaagtaaagtttttagtatacctgacatttgttaagtgctccataaatgttgtcattaaggaaattatttagcaggaataaacttcaggccaatttctagtcacttagttcactctaaagtaagaaaatcagaagttgcagacttcagctttgtctaatggttggctctctgccttcagctgtgtctgtttggccgggacagctctgttgtttaggattcctttggtgattttagtttggggggggggcggttaaaaaagtgtcttgtatagtttgattggcagattatcccttgagattcgtagtgatactttgaagtaatagtgcttttacatgcatataacacaggtgctcattagtattttttcagtagcctttgtaggggtaatggaagtggcagtggaataattcagaaatagtgaagggaagaaaatcaagagcttggattattcccagactggggaatcagcccatctttgtaaagaagagattgacagaaattgttggttggccctgtagagttattctcagttggcactggggtaaagatcatgagacactagaatggcaagagggagaggcaagggtgaagggatggttggtggtgaaatttcattagtctctagcatgtgcaggagggaacagacttaacaagaaaccattagcatttgaggatataactaggaattttcactgcctgtggtaatgcccaattaatagttccctgtttcctggaagacttcctatggtaatttacagatggggatacagttgccaaagctctgggaaattgtgtttgggtgtgaaaaatactgtcaggtagcatagtgatttgggtgcagttctcagattactcttgtttttctctccagacattgaagagtggaagtgttcaggaacagtggctcacagacttacattactgcttcaacgtgtatatcactgggcatccccaagggcccagtgcactggctacagtgtattgaagaggccatagtacctcctgtttgaagttgtttattcacatctatcttatttgaagaaaaagactgatgtaatagatctttgtcattaaagctgaacttttaaaga

SEQ ID NO: 356258 - DNA, 1296 bp, Homo sapiens
ggagacattctacggtaaggtagcgatatcgtagtaaagtgttatcccgttggctggctggcttaccattgcaacttgctcatcttggctcccgaaatcctgagctctctacacagcttatcgatatcattcataccgctgcagcacgagcaaataaagaattactaaaaagtttacaagctactgccctccgaatttatgatccacaagaaggtgctgtggtggttctccctgcagactctcagcagcgtttggttcagcttgtatatttcctacccagtctgccggctgatttgctttctcggttaagtcgttgctgtattatgggaagactcagttcaagtttggctgccatgcttatcgggatactgcacatgagatcatcattttctgggtggaagtattcagctaaagactggttgatgagtgatgtagactatttcagcttcttattttccacacttacagggttttcgaaagaggagttgacttggcttcagagccttcgaggagttcctcatgtcatccagacacagctttcccctgtgcttctctaccttacagatttggatcaatttttacaccactgggatgtaacagaggcagtttttcacagtttattggttattcctgcccgaagtcagaactttgacatcttgcaaagtgccatcagtaagcatttggttgggttgactgtaattcctgacagcacggctggctgtgtttttggtgttatctgtaagctcctggatcatacttgtgtagttagtgagactctactgccatttctggcttcttgttgctacagtcttctttattttctgctcactatagagaaaggggaagcagaacatctaagaaagagggacaagctgtggggggtctgtgtctccatcctggctctcttgcctcgagtcctcaggttgatgctgcagagcctgcgggtgaacagagttgggcctgaggagctgcctgttgtgggccagctgcttcgactgctgcttcagcatgcacccctcaggactcatatgttgaccaatgcgatcttggtgcagcagatcatcaagaatatcacgacattgaagagtggaagtgttcaggaacagtggctcacagacttacattactgcttcaacgtgtatatcactgggcatccccaagggcccagtgcactggctacagtgtattgaagaggccatagtacctcctgtttgaagttgtttattcacatctatcttatttgaagaaaaagactgatgtaatagatctttgtcattaaagctgaacttttaaaga

SEQ ID NO: 356259 - DNA, 1639 bp, Homo sapiens
ggatttccgggcggcggaaggagacgcggccgcgtgaggacgaggctatttgaaaacacgctccgggagctagagcctgaggtcggcggcgcacgctgttgccccgtgggcttctgctccctcgcttgtcttctcgggcttctcgccccggccgcggccgggtcctcagtagtcgagaatgactaaaaaaagaaaacgccaacatgattttcaaaaagtaaaattgaaagttggtaaaaagaagcccaagttacaaaatgctactcctacaaactttaaaacaaagactatacatctgcctgagcaactcaaagaggatggaacacttccaacaaacaatagaaaacttaacataaaggatttgctgtcacagatgcatcactacaatgctggggttaaacaaagtgctcttcttggacttaaagaccttttgtctcaatacccatttataattgatgcacacctttcaaacatattaagtgaagtgactgctgtgtttacagataaagatgctaatgtacgattagcagcagttcaacttcttcaattcctggcccccaaaatacgagctgaacaaatttctccattttttcctttggtaagtgcccatctctctagtgccatgactcacattactgaaggaattcaggaggactctttaaaagttttggacattctgctggaacagtacccagctctaattactggccgtagcagcatattgcttaagaattttgtagaacttatttctcatcagcagctgtccaaaggactgataaatagagacagatcccagtcctggatactttctgtaaatcctaatcggagactcacttctcagcaatggaggctgaaagtcttagtgagactcagtaaattccttcaggccttggcagatggatccagtaggttgagagaaagtgaaggacttcaggaacagaaagaaaatccccatgccactagcaactccatttttatcaactggaaggaacatgccaacgaccagcaacacatccaggtttatgaaaatgggggttcacagccaaatgtcagttcacagttcaggctacggtatctggttggaggactgagtggtgtggatgaaggcctgtcatctactgaaaacctgaaaggatttattgagataataattccattgctaattgaatgctgggttgaagctgtacctccacaactagctactcctgttgggaatggtatagaacgagaacctctacaggttatgcagcaagttcttaatattatttcccttctgtggaaactctctaaacaacaggatgaaacccataaattggagtcatggcttcgaaagaactaccttattgattttaaacaccattttatgagtcgttttccatatgtcttaaaagaaataaccaagcacaaaaggaaagagccaaataaaagcatcaagcattgcacagttctctccaataacatagatcatctcttactgaatttaacactgtctgatatcatggtctccctggcaaatgcgtcaactttgcagaaggattgcagttggatagaaatgataaggaaatttgtaacagagaccccctttgaaaatagggttcttgggcttaaatagttagggccacttggaccaaaattgttg

SEQ ID NO: 356260 - DNA, 1415 bp, Homo sapiens
caggcgggcggatcacctgaggtcaggagtttgagaccagcctggccaacatggcaaaaccccgtctctactaaaaatacaaaaattagtggggtgtggtggcaggcgcctgtaatcccacccactcaccctgcttcttcatgcaccctatactcatttccacactgccaggccatggtcccgtgctctgcctggcacacttacgtctctctcttctcccttggcctctatgcttttctcccccatctgcctccctcgccttctcacatcccttccttttctgactcttctgaccttttctgacccttctcatctaccttctcttccctctcacttaccccactgcccctctcaacaccgttctctcagcaccctcactccccacacacttcttcccaatcatggaagctggactctacacccatagagtgggataccatcctctgaggcctggtggcagattcagggtgaagggctggggggcattttcaacagattcatagctcctcactggtctccccattaccatgtggcacttcctgtctgcaaaggaaatgccgccatgttggactgagggtggcctccaggcagcctgaagaaagtgatttggggagccaggagcctggccatcttgcacctggccaaagggatcagacaaagacaaggtctctcctcctcagcaccccacccttgacatcacctttttcctgccctctctcctccctccctccttcccattatcccttcccttctcctcccacaatgggttccatgtagtcaacctggtggtagggcctccgggaagagtggggagaaggcagggccatcagggtgtctgagtgtggcgggccgggtttggggactaagaggccctgtaactctccctcctctcccctcccaccccaaccttccctgccagcctttgatttctcctcacaggtgactcgatgctggggaaacaggatcccttctgtgcttccgtaattttcttcttttactcttcgtcctttcctttcagcgcttgaggccttcagccaccaccgagggggatgcccatctgctccttgaagcctccccacagcactggggacacggctgactcccgcggctgggacagcggggaaggggggtgggaggcagcgagctcagcacaggggggcagtcagatgggtgtaggttcaaggctcgactgggctcttgagttttctggctctgaaaccttgagcaaatgatttaatttctctgggccactacggaaggaggtgtgagtccatgagatgacatgtgagaagcgcttggcccagggccggccacaaagtcgctcctggtggcagggttttgagtgccgagtgtaaacttcccaagggcagaggcttcgtcttcacccgccgccccagcgcccagacccatgcctg

SEQ ID NO: 356261 - DNA, 8061 bp, Homo sapiens
  misc_feature (6026)..(6026): n is a, c, g, or t
gggtttggccctggacggccttgcctttcccgccaaacccggtttaagggaactcctcaaatgctgtgggctccttttccccatgggtatatatcggcggatccctttttttttttttttcctaatttttggtcggcggcggtgctgggccaggggaaggaagggacacggaggccgccctcgtcccgccacctcctacccgcttccccccagccccggctccgggagatgtgccgggcggggggcccgggttcgccgagccgcaggagagacacgctgggccgaccccagagaggcgctggacaggctggtggtccaggccgtggtgcctgccaggtgatgtggggcaaagccccccgcacaggccactgagagctccggacacgcacccggctgccaccatggcccgcctagccgcagtgctctggaatctgtgtgtcaccgccgtcctggtcacctcggccacccaaggcctgagccgggccgggctcccgttcgggctgatgcgccgggagctggcgtgtgaaggctaccccatcgagctgcggtgccccggcagcgacgtcatcatggtggagaatgccaactacgggcgcacggacgacaagatttgcgatgctgaccctttccagatggagaatgtgcagtgctacctgccggacgccttcaagatcatgtcacagaggtgtaacaaccgcacccagtgcgtggtggtcgccggctcggatgcctttcctgacccctgtcctgggacctacaagtacctggaggtgcagtacgactgtgtcccctacaaagtggagcagaaagggattgggggggtggggcggggccccccacctttctgacatcagcgctgccttggtccctcttcccgagccggggatggtcgcagagtcttcgtgtgcccagggaccctgcagaaggtgctggagcccacctcgacacacgagtcagagcaccagtctggcgcatggtgcaaggacccgctgcaggcgggtgaccgcatctacgtgatgccctggatcccctaccgcacggacacactgactgagtatgcctcgtgggaggactacgtggccgcccgccacaccaccacctaccgcctgcccaaccgcgtggatggcacaggctttgtggtctacgatggtgccgtcttctacaacaaggagcgcacgcgcaacatcgtcaagtatgacctacggacgcgcatcaagagcggggagacggtcatcaataccgccaactaccatgacacctcgccctaccgctggggcggaaagaccgacattgacctggcggtggacgagaacgggctgtgggtcatctacgccactgagggcaacaacgggcggctggtggtgagccagctgaacccctacacactgcgctttgagggcacgtgggagacgggttacgacaagcgctcggcatccaacgccttcatggtgtgtggggtcctgtacgtcctgcgttccgtgtacgtggatgatgacagcgaggcggctggcaaccgcgtggactatgccttcaacaccaatgccaaccgcgaggagcctgtcagcctcaccttccccaacccctaccagttcatctcctccgttgactacaaccctcgcgacaaccagctgtacgtctggaacaactatttcgtggtgcgctacagcctggagttcgggccgcccgaccccagtgctggcccagccacttccccacccctcagcacgaccaccacagccaggcccacgcccctcaccagcacagcctcgcccgcagccaccaccccgctccgccgggcacccctcaccacgcacccagtgggtgccatcaaccagctgggacctgatctgcctccagccacagccccagtccccagcacccggcggcccccagccccgaatctacacgtgtcccctgagctcttctgcgagccccgagaggtacggcgggtccagtggccggccacccagcagggcatgctggtggagaggccctgccccaaggggactcgaggaattgcctccttccagtgtctaccagccttggggctctggaacccccggggccctgacctcagcaactgcacctccccctgggtcaaccaggtggcccagaagatcaagagtggggagaacgcggccaacatcgccagcgagctggcccgacacacccggggctccatctacgcgggggacgtctcctcctctgtgaagctgatggagcagctgctggacatcctggatgcccagctgcaggccctgcggcccatcgagcgcgagtcagccggcaagaactacaacaagatgcacaagcgagagagaacttgtaaggattatatcaaggccgtggtggagacagtggacaatctgctccggccagaagctctggagtcctggaaggacatgaatgccacggagcaggtgcacacggccaccatgctcctcgacgtcctggaggagggcgccttcctgctggccgacaatgtcagggagcctgcccgcttcctggctgccaaggagaacgtggtcctggaggtcacagtcctgaacacagagggccaggtgcaggagctggtgttcccccaggaggagtacccgagaaagaactccatccagctgtctgccaaaaccatcaagcagaacagccgcaatggggtggtcaaagttgtcttcatcctctacaacaacctgggcctcttcctgtccacggagaatgccacagtgaagctggccggcgaagcaggcccgggtggccctgggggcgcctctctagtggtgaactcacaggtcatcgcagcatccatcaacaaggagtccagccgcgtcttcctcatggaccctgtcatcttcaccgtggcccacctggaggacaagaaccacttcaatgctaactgctccttctggaactactcggagcgttccatgctgggctactggtcgacccaaggctgccgcctggtggagtccaacaagacccataccacgtgtgcctgcagccacctcaccaacttcgctgtgctcatggctcaccgtgagatctaccagggccgcatcaacgagctgctgctgtcggtcatcacctgggtgggcattgtgatctccctggtctgcttggccatctgcatctccaccttctgcttcctgcgggggctgcagaccgaccgcaacaccatccacaagaacctgtgcatcaacctcttcctggctgagctgctcttcctggtcgggatcgacaagactcagtatgagattgcctgccccatcttcgccggcctgctgcactatttcttcctggctgccttctcctggctgtgcctggagggcgtgcacctctacctgctactagtggaggtgtttgagagcgagtattcccgcaccaagtactactacctgggtggctactgcttcccggccctggtggtgggcatcgcggctgccattgactaccgcagctacggcaccgagaaggcctgctggctccgagtggacaattacttcatctggagtttcatcgggccagtctccttcgttatcgtggtcaacctggtgttcctcatggtgaccctgcacaagatgatccgaagctcatctgtgctcaagcccgactccagccgcctggacaacattaaatcctgggcgctgggggccatcgcgctgctgttcctgctgggcctcacctgggctttcggcctcctcttcatcaacaaggagtcggtggtcatggcctatctcttcaccaccttcaacgccttccagggggtcttcatcttcgtctttcactgcgccttacagaagaaggtgcacaaggagtacagcaagtgcctgcgtcactcctactgctgcatccgctccccacccgggggcactcacggatccctcaagacctcagccatgcgaagcaacacccgctactacacagggacccagagccgaattcggaggatgtggaatgacactgtgaggaaacagacggagtcctccttcatggcgggtgacatcaacagcacccccaccctgaaccgaggtaccatggggaaccacctgctgaccaaccccgtgctgcagccccgtgggggcaccagtccctacaacaccctcatcgccgagtcagtgggcttcaatccctcctcgccccctgtcttcaactccccagggagctaccgggaacccaagcaccccttgggaggccgggaagcctgtggcatggacaccctgcccctgaacggcaacttcaataacagttactccttgcgaagtggggatttccctcccggggatgggggccctgagccgccccgaggccggaacctagccgatgcggcggcctttgagaagatgatcatctcagagctggtgcacaacaacctgcgggggagcagcagcgcggccaagggccctccaccgcctgagccccctgtgccacctgtgccagggggcgggggcgaggaagaggcgggcgggcccgggggtgctgaccgggccgagattgaacttctctataaggccctggaggagcctctgctgctgccccgggcccagtcggtgctgtaccagagcgatctggacgagtcggagagctgcacggccgaggacggcgccaccagccggcccctctcctcccctcctggccgggactccctctatgccagcggggccaacctgcgggactcaccctcctacccggacagcagccctgaggggcccagtgaggccctgcccccaccccctcccgcaccccccggcccccccgaaatctactacacctcgcgcccgccagccctggtggcccggaatcccctgcagggctactaccaggtgcggcgtcctagccacgagggctacctggcagccccaggccttgaggggccagggcccgatggggacgggcagatgcagctggtcaccagtctctgagggcacctcatggaccaggggctggtggcccaggccagggagggaaccctgggcagggctctggtgggagagggagacagatggaggcagtggctggtgggccactctctccaggtgcccctcagccatgggccctacagtcccctcaggggactctaacctgggggcctgaggtgccagggttcacagacagggtttcccaccagccacacgcaccagctctatttgggggaagtgtagtgaggaggagcccagaggaccccaggggagtgaggagggagaacttggaagggtgcagcccacttccagactctcccctctcccacccttctaccctgtgaagggaaatgagggctttagtttcctgggcagggaggggcagcttctgaggttgccaaaggcccccactggatggaacctgttagctgctcctctccgcagccagaaatgctgccggctgcacccagagggagcagtgaggcaggacagatggacaggttcctcctgcgctgtaattccctgctccctggagactgggaaaaggccgcagggcagggggactgggcggtggtggctggtggtttaaaggttgaactttctctgaagctcctttccccttgctcttggtccctgccccgcaagcaaacctgccccctctgcctcccagtgcacccaatgaccccctcccttggggcgactcctgatgaagcacaactccccgcagggcccccagcccacaggggtggccatatttgggcagttcccagtcctgtgggctcggctatctggggagcagattttgggtctggatctccctggggagtgggtcctgggcttggatctttccctagggggccctcttactccttcctctctcctcctccttccccattgctgtaaatatttcaacgaaatggaaaagaaaaaaaaagacaaaaaaaaaaaaaaagaaaagaaaaaaatctcatcacttgaagccaccgggagcctgcggcccgggccagcccgggctttctccggagcagagcagcgctgctggcctggcagccaggacttctccgtgtacgtgcatccccagtccccgccggggcgggcgggccgccagagcagctntttacaatccagagacagaaaacaaaatctagatgcaacagcgaaacaaagaacccatttccttcctggcacccgtttctgtcccctcctttcctgctccgcctgcccggcatcatcagcccttctggggcgtgtacctctcactgcctgccccaggaccagaggcctgtctcccccttccctccccaccggcccgggggagacctcttcacacccaaagatgctttgtcaagatggctgcgctgtccctttgagttcctgcttcttgtatattgctctggggactctcgccggggaagatggggctgatttcccacctagagaggttgatggcagaaggaaaatggggaggcactggggttgtggagggcatgggtatggctgaggagggtgctgggaacggcaaggcggtctgggggatggggaggggcaaaggtgagagatcaccttccctatcctccaccttcccgcagggaagacgaagccaggtgccagggctggggtcgggacacccatgttctgggcggcttgaccccaaatcccagaccccggaagctccaggctcgggatgtgtcctgagcacctgtcccggccccctcctctccagcctgtcaggccagcctccccagcccccttccctcaactctaggggcagcatagccccaggccaccctagcccagcccctgcattgccgtttccccagaggtggcccctccacctctgctctgacctctccccatctctctgcccctccttttctcacaagtgccatgagttttcaaacatcttcgggtctcagcctgctgctgccatgaactttgttgggttaagggggaggggctctaggaaggaactggggggaaggggacaggtaggtggctggagggaccctttttgctgctagaaagcccctcccttctcccggggagctggggctggcttgtccccatcaattaggggagaaggggtcagaccaaagatggtggtttgtcccgtgtaagggaacaggtgtggggaagaggtggggttgggttccaactctggctttttctggtagaaaggcctaacccattacaccagaagaccatgggtgaagtctagatggggaggagaagtgaggccagggacagtcttgccagacgactctgaggagggcaagggacagttccatggcccttcccggactgcactaggctgggagctctgttgtgtggaggggtggtcagaggtctgtgaagagcgggcaggaggcatgagcaggcgaggagctggcctgtcccgggaagcagcccagcctgtggctgcccccgacaccaggaggagggccaggagagttccagggggctgaggcacacagagaggccaacttcctccctgcccagccttccttgtatctctccagactcggacaatcaaagggagagagggtgtatcgggtcctgttccagccggcatcgccgggtggcttccaggcctcagagctgtgtggcagggccccctgctggggctggacatcactgcagtccagtgcaaagccgcccccagagcccaggtgtccccccaacctaaccagacctggtgccttgacgcccccaccccagctgggacggtacagagaagggtcttggtttcctctcctactcccttccttaggctcctgaactcgtttgctcctaaatcttgttaattctttttctctggattttggtttcttttggctttcccttgccttcccctttctctgtctccaacactctttccccatgtctttctggctgtctctatgttcctcttctcttatcctcaactttctgtccattcgggcctcctccccacctcccacgccccagcccctccctccttggtctccttttcgatatgccaaaccaattttgggtcgagtgcatttaacgagaacaaaacaaaaggctcataacaacaagaacgtttcagaaaaaaacaaaaagttttaaaaaaattgttgagtcaaaaagtcaaacaataaagaaattaagatttcttggaaaaaaaaaa

SEQ ID NO: 356262 - DNA, 7932 bp, Homo sapiens
  misc_feature (5897)..(5897): n is a, c, g, or t
gggtttggccctggacggccttgcctttcccgccaaacccggtttaagggaactcctcaaatgctgtgggctccttttccccatgggtatatatcggcggatccctttttttttttttttcctaatttttggtcggcggcggtgctgggccaggggaaggaagggacacggaggccgccctcgtcccgccacctcctacccgcttccccccagccccggctccgggagatgtgccgggcggggggcccgggttcgccgagccgcaggagagacacgctgggccgaccccagagaggcgctggacaggctggtggtccaggccgtggtgcctgccaggtgatgtggggcaaagccccccgcacaggccactgagagctccggacacgcacccggctgccaccatggcccgcctagccgcagtgctctggaatctgtgtgtcaccgccgtcctggtcacctcggccacccaaggcctgagccgggccgggctcccgttcgggctgatgcgccgggagctggcgtgtgaaggctaccccatcgagctgcggtgccccggcagcgacgtcatcatggtggagaatgccaactacgggcgcacggacgacaagatttgcgatgctgaccctttccagatggagaatgtgcagtgctacctgccggacgccttcaagatcatgtcacagaggtgtaacaaccgcacccagtgcgtggtggtcgccggctcggatgcctttcctgacccctgtcctgggacctacaagtacctggaggtgcagtacgactgtgtcccctacaaagtggagcagaaagggattgggggggtggggcggggccccccacctttctgacatcagcgctgccttggtccctcttcccgagccggggatggtcgcagagtcttcgtgtgcccagggaccctgcagaaggtgctggagcccacctcgacacacgagtcagagcaccagtctggcgcatggtgcaaggacccgctgcaggcgggtgaccgcatctacgtgatgccctggatcccctaccgcacggacacactgactgagtatgcctcgtgggaggactacgtggccgcccgccacaccaccacctaccgcctgcccaaccgcgtggatggcacaggctttgtggtctacgatggtgccgtcttctacaacaaggagcgcacgcgcaacatcgtcaagtatgacctacggacgcgcatcaagagcggggagacggtcatcaataccgccaactaccatgacacctcgccctaccgctggggcggaaagaccgacattgacctggcggtggacgagaacgggctgtgggtcatctacgccactgagggcaacaacgggcggctggtggtgagccagctgaacccctacacactgcgctttgagggcacgtgggagacgggttacgacaagcgctcggcatccaacgccttcatggtgtgtggggtcctgtacgtcctgcgttccgtgtacgtggatgatgacagcgaggcggctggcaaccgcgtggactatgccttcaacaccaatgccaaccgcgaggagcctgtcagcctcaccttccccaacccctaccagttcatctcctccgttgactacaaccctcgcgacaaccagctgtacgtctggaacaactatttcgtggtgcgctacagcctggagttcgggccgcccgaccccagtgctggcccagccacttccccacccctcagcacgaccaccacagccaggcccacgcccctcaccagcacagcctcgcccgcagccaccaccccgctccgccgggcacccctcaccacgcacccagtgggtgccatcaaccagctgggacctgatctgcctccagccacagccccagtccccagcacccggcggcccccagccccgaatctacacgtgtcccctgagctcttctgcgagccccgagaggtacggcgggtccagtggccggccacccagcagggcatgctggtggagaggccctgccccaaggggactcgaggaattgcctccttccagtgtctaccagccttggggctctggaacccccggggccctgacctcagcaactgcacctccccctgggtcaaccaggtggcccagaagatcaagagtggggagaacgcggccaacatcgccagcgagctggcccgacacacccggggctccatctacgcgggggacgtctcctcctctgtgaagctgatggagcagctgctggacatcctggatgcccagctgcaggccctgcggcccatcgagcgcgagtcagccggcaagaactacaacaagatgcacaagcgagagagaacttgtaaggattatatcaaggccgtggtggagacagtggacaatctgctccggccagaagctctggagtcctggaaggacatgaatgccacggagcaggtgcacacggccaccatgctcctcgacgtcctggaggagggcgccttcctgctggccgacaatgtcagggagcctgcccgcttcctggctgccaaggagaacgtggtcctggaggtcacagtcctgaacacagagggccaggtgcaggagctggtgttcccccaggaggagtacccgagaaagaactccatccagctgtctgccaaaaccatcaagcagaacagccgcaatggggtggtcaaagttgtcttcatcctctacaacaacctgggcctcttcctgtccacggagaatgccacagtgaagctggccggcgaagcaggcccgggtggccctgggggcgcctctctagtggtgaactcacaggtcatcgcagcatccatcaacaaggagtccagccgcgtcttcctcatggaccctgtcatcttcaccgtggcccacctggaggacaagaaccacttcaatgctaactgctccttctggaactactcggagcgttccatgctgggctactggtcgacccaaggctgccgcctggtggagtccaacaagacccataccacgtgtgcctgcagccacctcaccaacttcgctgtgctcatggctcaccgtgagatctaccagggccgcatcaacgagctgctgctgtcggtcatcacctgggtgggcattgtgatctccctggtctgcttggccatctgcatctccaccttctgcttcctgcgggggctgcagaccgaccgcaacaccatccacaagaacctgtgcatcaacctcttcctggctgagctgctcttcctggtcgggatcgacaagactcagtatgagattgcctgccccatcttcgccggcctgctgcactatttcttcctggctgccttctcctggctgtgcctggagggcgtgcacctctacctgctactagtggaggtgtttgagagcgagtattcccgcaccaagtactactacctgggtggctactgcttcccggccctggtggtgggcatcgcggctgccattgactaccgcagctacggcaccgagaaggcctgctggctccgagtggacaattacttcatctggagtttcatcgggccagtctccttcgttatcgtggtcaacctggtgttcctcatggtgaccctgcacaagatgatccgaagctcatctgtgctcaagcccgactccagccgcctggacaacattaaatcctgggcgctgggggccatcgcgctgctgttcctgctgggcctcacctgggctttcggcctcctcttcatcaacaaggagtcggtggtcatggcctatctcttcaccaccttcaacgccttccagggggtcttcatcttcgtctttcactgcgccttacagaagaaggtgcacaaggagtacagcaagtgcctgcgtcactcctactgctgcatccgctccccacccgggggcactcacggatccctcaagacctcagccatgcgaagcaacacccgctactacacagggacccagagccgaattcggaggatgtggaatgacactgtgaggaaacagacggagtcctccttcatggcgggtgacatcaacagcacccccaccctgaaccgaggtaccatggggaaccacctgctgaccaaccccgtgctgcagccccgtgggggcaccagtccctacaacaccctcatcgccgagtcagtgggcttcaatccctcctcgccccctgtcttcaactccccagggagctaccgggaacccaagcaccccttgggaggccgggaagcctgtggcatggacaccctgcccctgaacggcaacttcaataacagttactccttgcgaagtggggatttccctccaccgcctgagccccctgtgccacctgtgccagggggcgggggcgaggaagaggcgggcgggcccgggggtgctgaccgggccgagattgaacttctctataaggccctggaggagcctctgctgctgccccgggcccagtcggtgctgtaccagagcgatctggacgagtcggagagctgcacggccgaggacggcgccaccagccggcccctctcctcccctcctggccgggactccctctatgccagcggggccaacctgcgggactcaccctcctacccggacagcagccctgaggggcccagtgaggccctgcccccaccccctcccgcaccccccggcccccccgaaatctactacacctcgcgcccgccagccctggtggcccggaatcccctgcagggctactaccaggtgcggcgtcctagccacgagggctacctggcagccccaggccttgaggggccagggcccgatggggacgggcagatgcagctggtcaccagtctctgagggcacctcatggaccaggggctggtggcccaggccagggagggaaccctgggcagggctctggtgggagagggagacagatggaggcagtggctggtgggccactctctccaggtgcccctcagccatgggccctacagtcccctcaggggactctaacctgggggcctgaggtgccagggttcacagacagggtttcccaccagccacacgcaccagctctatttgggggaagtgtagtgaggaggagcccagaggaccccaggggagtgaggagggagaacttggaagggtgcagcccacttccagactctcccctctcccacccttctaccctgtgaagggaaatgagggctttagtttcctgggcagggaggggcagcttctgaggttgccaaaggcccccactggatggaacctgttagctgctcctctccgcagccagaaatgctgccggctgcacccagagggagcagtgaggcaggacagatggacaggttcctcctgcgctgtaattccctgctccctggagactgggaaaaggccgcagggcagggggactgggcggtggtggctggtggtttaaaggttgaactttctctgaagctcctttccccttgctcttggtccctgccccgcaagcaaacctgccccctctgcctcccagtgcacccaatgaccccctcccttggggcgactcctgatgaagcacaactccccgcagggcccccagcccacaggggtggccatatttgggcagttcccagtcctgtgggctcggctatctggggagcagattttgggtctggatctccctggggagtgggtcctgggcttggatctttccctagggggccctcttactccttcctctctcctcctccttccccattgctgtaaatatttcaacgaaatggaaaagaaaaaaaaagacaaaaaaaaaaaaaaagaaaagaaaaaaatctcatcacttgaagccaccgggagcctgcggcccgggccagcccgggctttctccggagcagagcagcgctgctggcctggcagccaggacttctccgtgtacgtgcatccccagtccccgccggggcgggcgggccgccagagcagctntttacaatccagagacagaaaacaaaatctagatgcaacagcgaaacaaagaacccatttccttcctggcacccgtttctgtcccctcctttcctgctccgcctgcccggcatcatcagcccttctggggcgtgtacctctcactgcctgccccaggaccagaggcctgtctcccccttccctccccaccggcccgggggagacctcttcacacccaaagatgctttgtcaagatggctgcgctgtccctttgagttcctgcttcttgtatattgctctggggactctcgccggggaagatggggctgatttcccacctagagaggttgatggcagaaggaaaatggggaggcactggggttgtggagggcatgggtatggctgaggagggtgctgggaacggcaaggcggtctgggggatggggaggggcaaaggtgagagatcaccttccctatcctccaccttcccgcagggaagacgaagccaggtgccagggctggggtcgggacacccatgttctgggcggcttgaccccaaatcccagaccccggaagctccaggctcgggatgtgtcctgagcacctgtcccggccccctcctctccagcctgtcaggccagcctccccagcccccttccctcaactctaggggcagcatagccccaggccaccctagcccagcccctgcattgccgtttccccagaggtggcccctccacctctgctctgacctctccccatctctctgcccctccttttctcacaagtgccatgagttttcaaacatcttcgggtctcagcctgctgctgccatgaactttgttgggttaagggggaggggctctaggaaggaactggggggaaggggacaggtaggtggctggagggaccctttttgctgctagaaagcccctcccttctcccggggagctggggctggcttgtccccatcaattaggggagaaggggtcagaccaaagatggtggtttgtcccgtgtaagggaacaggtgtggggaagaggtggggttgggttccaactctggctttttctggtagaaaggcctaacccattacaccagaagaccatgggtgaagtctagatggggaggagaagtgaggccagggacagtcttgccagacgactctgaggagggcaagggacagttccatggcccttcccggactgcactaggctgggagctctgttgtgtggaggggtggtcagaggtctgtgaagagcgggcaggaggcatgagcaggcgaggagctggcctgtcccgggaagcagcccagcctgtggctgcccccgacaccaggaggagggccaggagagttccagggggctgaggcacacagagaggccaacttcctccctgcccagccttccttgtatctctccagactcggacaatcaaagggagagagggtgtatcgggtcctgttccagccggcatcgccgggtggcttccaggcctcagagctgtgtggcagggccccctgctggggctggacatcactgcagtccagtgcaaagccgcccccagagcccaggtgtccccccaacctaaccagacctggtgccttgacgcccccaccccagctgggacggtacagagaagggtcttggtttcctctcctactcccttccttaggctcctgaactcgtttgctcctaaatcttgttaattctttttctctggattttggtttcttttggctttcccttgccttcccctttctctgtctccaacactctttccccatgtctttctggctgtctctatgttcctcttctcttatcctcaactttctgtccattcgggcctcctccccacctcccacgccccagcccctccctccttggtctccttttcgatatgccaaaccaattttgggtcgagtgcatttaacgagaacaaaacaaaaggctcataacaacaagaacgtttcagaaaaaaacaaaaagttttaaaaaaattgttgagtcaaaaagtcaaacaataaagaaattaagatttcttggaaaaaaaaaa

SEQ ID NO: 356263 - DNA, 8130 bp, Homo sapiens
  misc_feature (6095)..(6095): n is a, c, g, or t
gggtttggccctggacggccttgcctttcccgccaaacccggtttaagggaactcctcaaatgctgtgggctccttttccccatgggtatatatcggcggatccctttttttttttttttcctaatttttggtcggcggcggtgctgggccaggggaaggaagggacacggaggccgccctcgtcccgccacctcctacccgcttccccccagccccggctccgggagatgtgccgggcggggggcccgggttcgccgagccgcaggagagacacgctgggccgaccccagagaggcgctggacaggctggtggtccaggccgtggtgcctgccaggtgatgtggggcaaagccccccgcacaggccactgagagctccggacacgcacccggctgccaccatggcccgcctagccgcagtgctctggaatctgtgtgtcaccgccgtcctggtcacctcggccacccaaggcctgagccgggccgggctcccgttcgggctgatgcgccgggagctggcgtgtgaaggctaccccatcgagctgcggtgccccggcagcgacgtcatcatggtggagaatgccaactacgggcgcacggacgacaagatttgcgatgctgaccctttccagatggagaatgtgcagtgctacctgccggacgccttcaagatcatgtcacagaggtgtaacaaccgcacccagtgcgtggtggtcgccggctcggatgcctttcctgacccctgtcctgggacctacaagtacctggaggtgcagtacgactgtgtcccctacaaagtggagcagaaagggattgggggggtggggcggggccccccacctttctgacatcagcgctgccttggtccctcttcccgagccggggatggtcgcagagtcttcgtgtgcccagggaccctgcagaaggtgctggagcccacctcgacacacgagtcagagcaccagtctggcgcatggtgcaaggacccgctgcaggcgggtgaccgcatctacgtgatgccctggatcccctaccgcacggacacactgactgagtatgcctcgtgggaggactacgtggccgcccgccacaccaccacctaccgcctgcccaaccgcgtggatggcacaggctttgtggtctacgatggtgccgtcttctacaacaaggagcgcacgcgcaacatcgtcaagtatgacctacggacgcgcatcaagagcggggagacggtcatcaataccgccaactaccatgacacctcgccctaccgctggggcggaaagaccgacattgacctggcggtggacgagaacgggctgtgggtcatctacgccactgagggcaacaacgggcggctggtggtgagccagctgaacccctacacactgcgctttgagggcacgtgggagacgggttacgacaagcgctcggcatccaacgccttcatggtgtgtggggtcctgtacgtcctgcgttccgtgtacgtggatgatgacagcgaggcggctggcaaccgcgtggactatgccttcaacaccaatgccaaccgcgaggagcctgtcagcctcaccttccccaacccctaccagttcatctcctccgttgactacaaccctcgcgacaaccagctgtacgtctggaacaactatttcgtggtgcgctacagcctggagttcgggccgcccgaccccagtgctggcccagccacttccccacccctcagcacgaccaccacagccaggcccacgcccctcaccagcacagcctcgcccgcagccaccaccccgctccgccgggcacccctcaccacgcacccagtgggtgccatcaaccagctgggacctgatctgcctccagccacagccccagtccccagcacccggcggcccccagccccgaatctacacgtgtcccctgagctcttctgcgagccccgagaggtacggcgggtccagtggccggccacccagcagggcatgctggtggagaggccctgccccaaggggactcgaggaattgcctccttccagtgtctaccagccttggggctctggaacccccggggccctgacctcagcaactgcacctccccctgggtcaaccaggtggcccagaagatcaagagtggggagaacgcggccaacatcgccagcgagctggcccgacacacccggggctccatctacgcgggggacgtctcctcctctgtgaagctgatggagcagctgctggacatcctggatgcccagctgcaggccctgcggcccatcgagcgcgagtcagccggcaagaactacaacaagatgcacaagcgagagagaacttgtaaggattatatcaaggccgtggtggagacagtggacaatctgctccggccagaagctctggagtcctggaaggacatgaatgccacggagcaggtgcacacggccaccatgctcctcgacgtcctggaggagggcgccttcctgctggccgacaatgtcagggagcctgcccgcttcctggctgccaaggagaacgtggtcctggaggtcacagtcctgaacacagagggccaggtgcaggagctggtgttcccccaggaggagtacccgagaaagaactccatccagctgtctgccaaaaccatcaagcagaacagccgcaatggggtggtcaaagttgtcttcatcctctacaacaacctgggcctcttcctgtccacggagaatgccacagtgaagctggccggcgaagcaggcccgggtggccctgggggcgcctctctagtggtgaactcacaggtcatcgcagcatccatcaacaaggagtccagccgcgtcttcctcatggaccctgtcatcttcaccgtggcccacctggaggacaagaaccacttcaatgctaactgctccttctggaactactcggagcgttccatgctgggctactggtcgacccaaggctgccgcctggtggagtccaacaagacccataccacgtgtgcctgcagccacctcaccaacttcgctgtgctcatggctcaccgtgagatctaccagggccgcatcaacgagctgctgctgtcggtcatcacctgggtgggcattgtgatctccctggtctgcttggccatctgcatctccaccttctgcttcctgcgggggctgcagaccgaccgcaacaccatccacaagaacctgtgcatcaacctcttcctggctgagctgctcttcctggtcgggatcgacaagactcagtatgagattgcctgccccatcttcgccggcctgctgcactatttcttcctggctgccttctcctggctgtgcctggagggcgtgcacctctacctgctactagtggaggtgtttgagagcgagtattcccgcaccaagtactactacctgggtggctactgcttcccggccctggtggtgggcatcgcggctgccattgactaccgcagctacggcaccgagaaggcctgctggctccgagtggacaattacttcatctggagtttcatcgggccagtctccttcgttatcgtggtcaacctggtgttcctcatggtgaccctgcacaagatgatccgaagctcatctgtgctcaagcccgactccagccgcctggacaacattaaatcctgggcgctgggggccatcgcgctgctgttcctgctgggcctcacctgggctttcggcctcctcttcatcaacaaggagtcggtggtcatggcctatctcttcaccaccttcaacgccttccagggggtcttcatcttcgtctttcactgcgccttacagaagaaggtgcacaaggagtacagcaagtgcctgcgtcactcctactgctgcatccgctccccacccgggggcactcacggatccctcaagacctcagccatgcgaagcaacacccgctactacacagggacccagagccgaattcggaggatgtggaatgacactgtgaggaaacagacggagtcctccttcatggcgggtgacatcaacagcacccccaccctgaaccgaggtaccatggggaaccacctgctgaccaaccccgtgctgcagccccgtgggggcaccagtccctacaacaccctcatcgccgagtcagtgggcttcaatccctcctcgccccctgtcttcaactccccaaactggagcctggacttgcatttcgagctcatccttgccttttctcttctctcttctggctgccacctgcagggagctaccgggaacccacaccccttgggaggccgggaagcctgtggcatggacaccctgcccctgaacggcaacttcaataacagttactccttgcgaagtggggatttccctcccggggatgggggccctgagccgccccgaggccggaacctagccgatgcggcggcctttgagaagatgatcatctcagagctggtgcacaacaacctgcgggggagcagcagcgcggccaagggccctccaccgcctgagccccctgtgccacctgtgccagggggcgggggcgaggaagaggcgggcgggcccgggggtgctgaccgggccgagattgaacttctctataaggccctggaggagcctctgctgctgccccgggcccagtcggtgctgtaccagagcgatctggacgagtcggagagctgcacggccgaggacggcgccaccagccggcccctctcctcccctcctggccgggactccctctatgccagcggggccaacctgcgggactcaccctcctacccggacagcagccctgaggggcccagtgaggccctgcccccaccccctcccgcaccccccggcccccccgaaatctactacacctcgcgcccgccagccctggtggcccggaatcccctgcagggctactaccaggtgcggcgtcctagccacgagggctacctggcagccccaggccttgaggggccagggcccgatggggacgggcagatgcagctggtcaccagtctctgagggcacctcatggaccaggggctggtggcccaggccagggagggaaccctgggcagggctctggtgggagagggagacagatggaggcagtggctggtgggccactctctccaggtgcccctcagccatgggccctacagtcccctcaggggactctaacctgggggcctgaggtgccagggttcacagacagggtttcccaccagccacacgcaccagctctatttgggggaagtgtagtgaggaggagcccagaggaccccaggggagtgaggagggagaacttggaagggtgcagcccacttccagactctcccctctcccacccttctaccctgtgaagggaaatgagggctttagtttcctgggcagggaggggcagcttctgaggttgccaaaggcccccactggatggaacctgttagctgctcctctccgcagccagaaatgctgccggctgcacccagagggagcagtgaggcaggacagatggacaggttcctcctgcgctgtaattccctgctccctggagactgggaaaaggccgcagggcagggggactgggcggtggtggctggtggtttaaaggttgaactttctctgaagctcctttccccttgctcttggtccctgccccgcaagcaaacctgccccctctgcctcccagtgcacccaatgaccccctcccttggggcgactcctgatgaagcacaactccccgcagggcccccagcccacaggggtggccatatttgggcagttcccagtcctgtgggctcggctatctggggagcagattttgggtctggatctccctggggagtgggtcctgggcttggatctttccctagggggccctcttactccttcctctctcctcctccttccccattgctgtaaatatttcaacgaaatggaaaagaaaaaaaaagacaaaaaaaaaaaaaaagaaaagaaaaaaatctcatcacttgaagccaccgggagcctgcggcccgggccagcccgggctttctccggagcagagcagcgctgctggcctggcagccaggacttctccgtgtacgtgcatccccagtccccgccggggcgggcgggccgccagagcagctntttacaatccagagacagaaaacaaaatctagatgcaacagcgaaacaaagaacccatttccttcctggcacccgtttctgtcccctcctttcctgctccgcctgcccggcatcatcagcccttctggggcgtgtacctctcactgcctgccccaggaccagaggcctgtctcccccttccctccccaccggcccgggggagacctcttcacacccaaagatgctttgtcaagatggctgcgctgtccctttgagttcctgcttcttgtatattgctctggggactctcgccggggaagatggggctgatttcccacctagagaggttgatggcagaaggaaaatggggaggcactggggttgtggagggcatgggtatggctgaggagggtgctgggaacggcaaggcggtctgggggatggggaggggcaaaggtgagagatcaccttccctatcctccaccttcccgcagggaagacgaagccaggtgccagggctggggtcgggacacccatgttctgggcggcttgaccccaaatcccagaccccggaagctccaggctcgggatgtgtcctgagcacctgtcccggccccctcctctccagcctgtcaggccagcctccccagcccccttccctcaactctaggggcagcatagccccaggccaccctagcccagcccctgcattgccgtttccccagaggtggcccctccacctctgctctgacctctccccatctctctgcccctccttttctcacaagtgccatgagttttcaaacatcttcgggtctcagcctgctgctgccatgaactttgttgggttaagggggaggggctctaggaaggaactggggggaaggggacaggtaggtggctggagggaccctttttgctgctagaaagcccctcccttctcccggggagctggggctggcttgtccccatcaattaggggagaaggggtcagaccaaagatggtggtttgtcccgtgtaagggaacaggtgtggggaagaggtggggttgggttccaactctggctttttctggtagaaaggcctaacccattacaccagaagaccatgggtgaagtctagatggggaggagaagtgaggccagggacagtcttgccagacgactctgaggagggcaagggacagttccatggcccttcccggactgcactaggctgggagctctgttgtgtggaggggtggtcagaggtctgtgaagagcgggcaggaggcatgagcaggcgaggagctggcctgtcccgggaagcagcccagcctgtggctgcccccgacaccaggaggagggccaggagagttccagggggctgaggcacacagagaggccaacttcctccctgcccagccttccttgtatctctccagactcggacaatcaaagggagagagggtgtatcgggtcctgttccagccggcatcgccgggtggcttccaggcctcagagctgtgtggcagggccccctgctggggctggacatcactgcagtccagtgcaaagccgcccccagagcccaggtgtccccccaacctaaccagacctggtgccttgacgcccccaccccagctgggacggtacagagaagggtcttggtttcctctcctactcccttccttaggctcctgaactcgtttgctcctaaatcttgttaattctttttctctggattttggtttcttttggctttcccttgccttcccctttctctgtctccaacactctttccccatgtctttctggctgtctctatgttcctcttctcttatcctcaactttctgtccattcgggcctcctccccacctcccacgccccagcccctccctccttggtctccttttcgatatgccaaaccaattttgggtcgagtgcatttaacgagaacaaaacaaaaggctcataacaacaagaacgtttcagaaaaaaacaaaaagttttaaaaaaattgttgagtcaaaaagtcaaacaataaagaaattaagatttcttggaaaaaaaaaa

SEQ ID NO: 356264 - DNA, 8001 bp, Homo sapiens
  misc_feature (5966)..(5966): n is a, c, g, or t
gggtttggccctggacggccttgcctttcccgccaaacccggtttaagggaactcctcaaatgctgtgggctccttttccccatgggtatatatcggcggatccctttttttttttttttcctaatttttggtcggcggcggtgctgggccaggggaaggaagggacacggaggccgccctcgtcccgccacctcctacccgcttccccccagccccggctccgggagatgtgccgggcggggggcccgggttcgccgagccgcaggagagacacgctgggccgaccccagagaggcgctggacaggctggtggtccaggccgtggtgcctgccaggtgatgtggggcaaagccccccgcacaggccactgagagctccggacacgcacccggctgccaccatggcccgcctagccgcagtgctctggaatctgtgtgtcaccgccgtcctggtcacctcggccacccaaggcctgagccgggccgggctcccgttcgggctgatgcgccgggagctggcgtgtgaaggctaccccatcgagctgcggtgccccggcagcgacgtcatcatggtggagaatgccaactacgggcgcacggacgacaagatttgcgatgctgaccctttccagatggagaatgtgcagtgctacctgccggacgccttcaagatcatgtcacagaggtgtaacaaccgcacccagtgcgtggtggtcgccggctcggatgcctttcctgacccctgtcctgggacctacaagtacctggaggtgcagtacgactgtgtcccctacaaagtggagcagaaagggattgggggggtggggcggggccccccacctttctgacatcagcgctgccttggtccctcttcccgagccggggatggtcgcagagtcttcgtgtgcccagggaccctgcagaaggtgctggagcccacctcgacacacgagtcagagcaccagtctggcgcatggtgcaaggacccgctgcaggcgggtgaccgcatctacgtgatgccctggatcccctaccgcacggacacactgactgagtatgcctcgtgggaggactacgtggccgcccgccacaccaccacctaccgcctgcccaaccgcgtggatggcacaggctttgtggtctacgatggtgccgtcttctacaacaaggagcgcacgcgcaacatcgtcaagtatgacctacggacgcgcatcaagagcggggagacggtcatcaataccgccaactaccatgacacctcgccctaccgctggggcggaaagaccgacattgacctggcggtggacgagaacgggctgtgggtcatctacgccactgagggcaacaacgggcggctggtggtgagccagctgaacccctacacactgcgctttgagggcacgtgggagacgggttacgacaagcgctcggcatccaacgccttcatggtgtgtggggtcctgtacgtcctgcgttccgtgtacgtggatgatgacagcgaggcggctggcaaccgcgtggactatgccttcaacaccaatgccaaccgcgaggagcctgtcagcctcaccttccccaacccctaccagttcatctcctccgttgactacaaccctcgcgacaaccagctgtacgtctggaacaactatttcgtggtgcgctacagcctggagttcgggccgcccgaccccagtgctggcccagccacttccccacccctcagcacgaccaccacagccaggcccacgcccctcaccagcacagcctcgcccgcagccaccaccccgctccgccgggcacccctcaccacgcacccagtgggtgccatcaaccagctgggacctgatctgcctccagccacagccccagtccccagcacccggcggcccccagccccgaatctacacgtgtcccctgagctcttctgcgagccccgagaggtacggcgggtccagtggccggccacccagcagggcatgctggtggagaggccctgccccaaggggactcgaggaattgcctccttccagtgtctaccagccttggggctctggaacccccggggccctgacctcagcaactgcacctccccctgggtcaaccaggtggcccagaagatcaagagtggggagaacgcggccaacatcgccagcgagctggcccgacacacccggggctccatctacgcgggggacgtctcctcctctgtgaagctgatggagcagctgctggacatcctggatgcccagctgcaggccctgcggcccatcgagcgcgagtcagccggcaagaactacaacaagatgcacaagcgagagagaacttgtaaggattatatcaaggccgtggtggagacagtggacaatctgctccggccagaagctctggagtcctggaaggacatgaatgccacggagcaggtgcacacggccaccatgctcctcgacgtcctggaggagggcgccttcctgctggccgacaatgtcagggagcctgcccgcttcctggctgccaaggagaacgtggtcctggaggtcacagtcctgaacacagagggccaggtgcaggagctggtgttcccccaggaggagtacccgagaaagaactccatccagctgtctgccaaaaccatcaagcagaacagccgcaatggggtggtcaaagttgtcttcatcctctacaacaacctgggcctcttcctgtccacggagaatgccacagtgaagctggccggcgaagcaggcccgggtggccctgggggcgcctctctagtggtgaactcacaggtcatcgcagcatccatcaacaaggagtccagccgcgtcttcctcatggaccctgtcatcttcaccgtggcccacctggaggacaagaaccacttcaatgctaactgctccttctggaactactcggagcgttccatgctgggctactggtcgacccaaggctgccgcctggtggagtccaacaagacccataccacgtgtgcctgcagccacctcaccaacttcgctgtgctcatggctcaccgtgagatctaccagggccgcatcaacgagctgctgctgtcggtcatcacctgggtgggcattgtgatctccctggtctgcttggccatctgcatctccaccttctgcttcctgcgggggctgcagaccgaccgcaacaccatccacaagaacctgtgcatcaacctcttcctggctgagctgctcttcctggtcgggatcgacaagactcagtatgagattgcctgccccatcttcgccggcctgctgcactatttcttcctggctgccttctcctggctgtgcctggagggcgtgcacctctacctgctactagtggaggtgtttgagagcgagtattcccgcaccaagtactactacctgggtggctactgcttcccggccctggtggtgggcatcgcggctgccattgactaccgcagctacggcaccgagaaggcctgctggctccgagtggacaattacttcatctggagtttcatcgggccagtctccttcgttatcgtggtcaacctggtgttcctcatggtgaccctgcacaagatgatccgaagctcatctgtgctcaagcccgactccagccgcctggacaacattaaatcctgggcgctgggggccatcgcgctgctgttcctgctgggcctcacctgggctttcggcctcctcttcatcaacaaggagtcggtggtcatggcctatctcttcaccaccttcaacgccttccagggggtcttcatcttcgtctttcactgcgccttacagaagaaggtgcacaaggagtacagcaagtgcctgcgtcactcctactgctgcatccgctccccacccgggggcactcacggatccctcaagacctcagccatgcgaagcaacacccgctactacacagggacccagagccgaattcggaggatgtggaatgacactgtgaggaaacagacggagtcctccttcatggcgggtgacatcaacagcacccccaccctgaaccgaggtaccatggggaaccacctgctgaccaaccccgtgctgcagccccgtgggggcaccagtccctacaacaccctcatcgccgagtcagtgggcttcaatccctcctcgccccctgtcttcaactccccaaactggagcctggacttgcatttcgagctcatccttgccttttctcttctctcttctggctgccacctgcagggagctaccgggaacccacaccccttgggaggccgggaagcctgtggcatggacaccctgcccctgaacggcaacttcaataacagttactccttgcgaagtggggatttccctccaccgcctgagccccctgtgccacctgtgccagggggcgggggcgaggaagaggcgggcgggcccgggggtgctgaccgggccgagattgaacttctctataaggccctggaggagcctctgctgctgccccgggcccagtcggtgctgtaccagagcgatctggacgagtcggagagctgcacggccgaggacggcgccaccagccggcccctctcctcccctcctggccgggactccctctatgccagcggggccaacctgcgggactcaccctcctacccggacagcagccctgaggggcccagtgaggccctgcccccaccccctcccgcaccccccggcccccccgaaatctactacacctcgcgcccgccagccctggtggcccggaatcccctgcagggctactaccaggtgcggcgtcctagccacgagggctacctggcagccccaggccttgaggggccagggcccgatggggacgggcagatgcagctggtcaccagtctctgagggcacctcatggaccaggggctggtggcccaggccagggagggaaccctgggcagggctctggtgggagagggagacagatggaggcagtggctggtgggccactctctccaggtgcccctcagccatgggccctacagtcccctcaggggactctaacctgggggcctgaggtgccagggttcacagacagggtttcccaccagccacacgcaccagctctatttgggggaagtgtagtgaggaggagcccagaggaccccaggggagtgaggagggagaacttggaagggtgcagcccacttccagactctcccctctcccacccttctaccctgtgaagggaaatgagggctttagtttcctgggcagggaggggcagcttctgaggttgccaaaggcccccactggatggaacctgttagctgctcctctccgcagccagaaatgctgccggctgcacccagagggagcagtgaggcaggacagatggacaggttcctcctgcgctgtaattccctgctccctggagactgggaaaaggccgcagggcagggggactgggcggtggtggctggtggtttaaaggttgaactttctctgaagctcctttccccttgctcttggtccctgccccgcaagcaaacctgccccctctgcctcccagtgcacccaatgaccccctcccttggggcgactcctgatgaagcacaactccccgcagggcccccagcccacaggggtggccatatttgggcagttcccagtcctgtgggctcggctatctggggagcagattttgggtctggatctccctggggagtgggtcctgggcttggatctttccctagggggccctcttactccttcctctctcctcctccttccccattgctgtaaatatttcaacgaaatggaaaagaaaaaaaaagacaaaaaaaaaaaaaaagaaaagaaaaaaatctcatcacttgaagccaccgggagcctgcggcccgggccagcccgggctttctccggagcagagcagcgctgctggcctggcagccaggacttctccgtgtacgtgcatccccagtccccgccggggcgggcgggccgccagagcagctntttacaatccagagacagaaaacaaaatctagatgcaacagcgaaacaaagaacccatttccttcctggcacccgtttctgtcccctcctttcctgctccgcctgcccggcatcatcagcccttctggggcgtgtacctctcactgcctgccccaggaccagaggcctgtctcccccttccctccccaccggcccgggggagacctcttcacacccaaagatgctttgtcaagatggctgcgctgtccctttgagttcctgcttcttgtatattgctctggggactctcgccggggaagatggggctgatttcccacctagagaggttgatggcagaaggaaaatggggaggcactggggttgtggagggcatgggtatggctgaggagggtgctgggaacggcaaggcggtctgggggatggggaggggcaaaggtgagagatcaccttccctatcctccaccttcccgcagggaagacgaagccaggtgccagggctggggtcgggacacccatgttctgggcggcttgaccccaaatcccagaccccggaagctccaggctcgggatgtgtcctgagcacctgtcccggccccctcctctccagcctgtcaggccagcctccccagcccccttccctcaactctaggggcagcatagccccaggccaccctagcccagcccctgcattgccgtttccccagaggtggcccctccacctctgctctgacctctccccatctctctgcccctccttttctcacaagtgccatgagttttcaaacatcttcgggtctcagcctgctgctgccatgaactttgttgggttaagggggaggggctctaggaaggaactggggggaaggggacaggtaggtggctggagggaccctttttgctgctagaaagcccctcccttctcccggggagctggggctggcttgtccccatcaattaggggagaaggggtcagaccaaagatggtggtttgtcccgtgtaagggaacaggtgtggggaagaggtggggttgggttccaactctggctttttctggtagaaaggcctaacccattacaccagaagaccatgggtgaagtctagatggggaggagaagtgaggccagggacagtcttgccagacgactctgaggagggcaagggacagttccatggcccttcccggactgcactaggctgggagctctgttgtgtggaggggtggtcagaggtctgtgaagagcgggcaggaggcatgagcaggcgaggagctggcctgtcccgggaagcagcccagcctgtggctgcccccgacaccaggaggagggccaggagagttccagggggctgaggcacacagagaggccaacttcctccctgcccagccttccttgtatctctccagactcggacaatcaaagggagagagggtgtatcgggtcctgttccagccggcatcgccgggtggcttccaggcctcagagctgtgtggcagggccccctgctggggctggacatcactgcagtccagtgcaaagccgcccccagagcccaggtgtccccccaacctaaccagacctggtgccttgacgcccccaccccagctgggacggtacagagaagggtcttggtttcctctcctactcccttccttaggctcctgaactcgtttgctcctaaatcttgttaattctttttctctggattttggtttcttttggctttcccttgccttcccctttctctgtctccaacactctttccccatgtctttctggctgtctctatgttcctcttctcttatcctcaactttctgtccattcgggcctcctccccacctcccacgccccagcccctccctccttggtctccttttcgatatgccaaaccaattttgggtcgagtgcatttaacgagaacaaaacaaaaggctcataacaacaagaacgtttcagaaaaaaacaaaaagttttaaaaaaattgttgagtcaaaaagtcaaacaataaagaaattaagatttcttggaaaaaaaaaa

SEQ ID NO: 356265 - DNA, 7353 bp, Homo sapiens
  misc_feature (5318)..(5318): n is a, c, g, or t
gggtttggccctggacggccttgcctttcccgccaaacccggtttaagggaactcctcaaatgctgtgggctccttttccccatgggtatatatcggcggatccctttttttttttttttcctaatttttggtcggcggcggtgctgggccaggggaaggaagggacacggaggccgccctcgtcccgccacctcctacccgcttccccccagccccggctccgggagatgtgccgggcggggggcccgggttcgccgagccgcaggagagacacgctgggccgaccccagagaggcgctggacaggctggtggtccaggccgtggtgcctgccaggtgatgtggggcaaagccccccgcacaggccactgagagctccggacacgcacccggctgccaccatggcccgcctagccgcagtgctctggaatctgtgtgtcaccgccgtcctggtcacctcggccacccaaggcctgagccgggccgggctcccgttcgggctgatgcgccgggagctggcgtgtgaaggctaccccatcgagctgcggtgccccggcagcgacgtcatcatggtggagaatgccaactacgggcgcacggacgacaagatttgcgatgctgaccctttccagatggagaatgtgcagtgctacctgccggacgccttcaagatcatgtcacagaggtgtaacaaccgcacccagtgcgtggtggtcgccggctcggatgcctttcctgacccctgtcctgggacctacaagtacctggaggtgcagtacgactgtgtcccctacaaagtggagcagaaagggattgggggggtggggcggggccccccacctttctgacatcagcgctgccttggtccctcttcccgagccggggatggtcgcagagtcttcgtgtgcccagggaccctgcagaaggtgctggagcccacctcgacacacgagtcagagcaccagtctggcgcatggtgcaaggacccgctgcaggcgggtgaccgcatctacgtgatgccctggatcccctaccgcacggacacactgactgagtatgcctcgtgggaggactacgtggccgcccgccacaccaccacctaccgcctgcccaaccgcgtggatggcacaggctttgtggtctacgatggtgccgtcttctacaacaaggagcgcacgcgcaacatcgtcaagtatgacctacggacgcgcatcaagagcggggagacggtcatcaataccgccaactaccatgacacctcgccctaccgctggggcggaaagaccgacattgacctggcggtggacgagaacgggctgtgggtcatctacgccactgagggcaacaacgggcggctggtggtgagccagctgaacccctacacactgcgctttgagggcacgtgggagacgggttacgacaagcgctcggcatccaacgccttcatggtgtgtggggtcctgtacgtcctgcgttccgtgtacgtggatgatgacagcgaggcggctggcaaccgcgtggactatgccttcaacaccaatgccaaccgcgaggagcctgtcagcctcaccttccccaacccctaccagttcatctcctccgttgactacaaccctcgcgacaaccagctgtacgtctggaacaactatttcgtggtgcgctacagcctggagttcgggccgcccgaccccagtgctggcccagccacttccccacccctcagcacgaccaccacagccaggcccacgcccctcaccagcacagcctcgcccgcagccaccaccccgctccgccgggcacccctcaccacgcacccagtgggtgccatcaaccagctgggacctgatctgcctccagccacagccccagtccccagcacccggcggcccccagccccgaatctacacgtgtcccctgagctcttctgcgagccccgagaggtacggcgggtccagtggccggccacccagcagggcatgctggtggagaggccctgccccaaggggactcgaggaattgcctccttccagtgtctaccagccttggggctctggaacccccggggccctgacctcagcaactgcacctccccctgggtcaaccaggtggcccagaagatcaagagtggggagaacgcggccaacatcgccagcgagctggcccgacacacccggggctccatctacgcgggggacgtctcctcctctgtgaagctgatggagcagctgctggacatcctggatgcccagctgcaggccctgcggcccatcgagcgcgagtcagccggcaagaactacaacaagatgcacaagcgagagagaacttgtaaggattatatcaaggccgtggtggagacagtggacaatctgctccggccagaagctctggagtcctggaaggacatgaatgccacggagcaggtgcacacggccaccatgctcctcgacgtcctggaggagggcgccttcctgctggccgacaatgtcagggagcctgcccgcttcctggctgccaaggagaacgtggtcctggaggtcacagtcctgaacacagagggccaggtgcaggagctggtgttcccccaggaggagtacccgagaaagaactccatccagctgtctgccaaaaccatcaagcagaacagccgcaatggggtggtcaaagttgtcttcatcctctacaacaacctgggcctcttcctgtccacggagaatgccacagtgaagctggccggcgaagcaggcccgggtggccctgggggcgcctctctagtggtgaactcacaggtcatcgcagcatccatcaacaaggagtccagccgcgtcttcctcatggaccctgtcatcttcaccgtggcccacctggaggacaagaaccacttcaatgctaactgctccttctggaactactcggagcgttccatgctgggctactggtcgacccaaggctgccgcctggtggagtccaacaagacccataccacgtgtgcctgcagccacctcaccaacttcgctgtgctcatggctcaccgtgagatctaccagggccgcatcaacgagctgctgctgtcggtcatcacctgggtgggcattgtgatctccctggtctgcttggccatctgcatctccaccttctgcttcctgcgggggctgcagaccgaccgcaacaccatccacaagaacctgtgcatcaacctcttcctggctgagctgctcttcctggtcgggatcgacaagactcagtatgagattgcctgccccatcttcgccggcctgctgcactatttcttcctggctgccttctcctggctgtgcctggagggcgtgcacctctacctgctactagtggaggtgtttgagagcgagtattcccgcaccaagtactactacctgggtggctactgcttcccggccctggtggtgggcatcgcggctgccattgactaccgcagctacggcaccgagaaggcctgctggctccgagtggacaattacttcatctggagtttcatcgggccagtctccttcgttatcgtggtcaacctggtgttcctcatggtgaccctgcacaagatgatccgaagctcatctgtgctcaagcccgactccagccgcctggacaacattaaatcctgggcgctgggggccatcgcgctgctgttcctgctgggcctcacctgggctttcggcctcctcttcatcaacaaggagtcggtggtcatggcctatctcttcaccaccttcaacgccttccagggggtcttcatcttcgtctttcactgcgccttacagaagaaggtgcacaaggagtacagcaagtgcctgcgtcactcctactgctgcatccgctccccacccgggggcactcacggatccctcaagacctcagccatgcgaagcaacacccgctactacacagggacccagtccctctatgccagcggggccaacctgcgggactcaccctcctacccggacagcagccctgaggggcccagtgaggccctgcccccaccccctcccgcaccccccggcccccccgaaatctactacacctcgcgcccgccagccctggtggcccggaatcccctgcagggctactaccaggtgcggcgtcctagccacgagggctacctggcagccccaggccttgaggggccagggcccgatggggacgggcagatgcagctggtcaccagtctctgagggcacctcatggaccaggggctggtggcccaggccagggagggaaccctgggcagggctctggtgggagagggagacagatggaggcagtggctggtgggccactctctccaggtgcccctcagccatgggccctacagtcccctcaggggactctaacctgggggcctgaggtgccagggttcacagacagggtttcccaccagccacacgcaccagctctatttgggggaagtgtagtgaggaggagcccagaggaccccaggggagtgaggagggagaacttggaagggtgcagcccacttccagactctcccctctcccacccttctaccctgtgaagggaaatgagggctttagtttcctgggcagggaggggcagcttctgaggttgccaaaggcccccactggatggaacctgttagctgctcctctccgcagccagaaatgctgccggctgcacccagagggagcagtgaggcaggacagatggacaggttcctcctgcgctgtaattccctgctccctggagactgggaaaaggccgcagggcagggggactgggcggtggtggctggtggtttaaaggttgaactttctctgaagctcctttccccttgctcttggtccctgccccgcaagcaaacctgccccctctgcctcccagtgcacccaatgaccccctcccttggggcgactcctgatgaagcacaactccccgcagggcccccagcccacaggggtggccatatttgggcagttcccagtcctgtgggctcggctatctggggagcagattttgggtctggatctccctggggagtgggtcctgggcttggatctttccctagggggccctcttactccttcctctctcctcctccttccccattgctgtaaatatttcaacgaaatggaaaagaaaaaaaaagacaaaaaaaaaaaaaaagaaaagaaaaaaatctcatcacttgaagccaccgggagcctgcggcccgggccagcccgggctttctccggagcagagcagcgctgctggcctggcagccaggacttctccgtgtacgtgcatccccagtccccgccggggcgggcgggccgccagagcagctntttacaatccagagacagaaaacaaaatctagatgcaacagcgaaacaaagaacccatttccttcctggcacccgtttctgtcccctcctttcctgctccgcctgcccggcatcatcagcccttctggggcgtgtacctctcactgcctgccccaggaccagaggcctgtctcccccttccctccccaccggcccgggggagacctcttcacacccaaagatgctttgtcaagatggctgcgctgtccctttgagttcctgcttcttgtatattgctctggggactctcgccggggaagatggggctgatttcccacctagagaggttgatggcagaaggaaaatggggaggcactggggttgtggagggcatgggtatggctgaggagggtgctgggaacggcaaggcggtctgggggatggggaggggcaaaggtgagagatcaccttccctatcctccaccttcccgcagggaagacgaagccaggtgccagggctggggtcgggacacccatgttctgggcggcttgaccccaaatcccagaccccggaagctccaggctcgggatgtgtcctgagcacctgtcccggccccctcctctccagcctgtcaggccagcctccccagcccccttccctcaactctaggggcagcatagccccaggccaccctagcccagcccctgcattgccgtttccccagaggtggcccctccacctctgctctgacctctccccatctctctgcccctccttttctcacaagtgccatgagttttcaaacatcttcgggtctcagcctgctgctgccatgaactttgttgggttaagggggaggggctctaggaaggaactggggggaaggggacaggtaggtggctggagggaccctttttgctgctagaaagcccctcccttctcccggggagctggggctggcttgtccccatcaattaggggagaaggggtcagaccaaagatggtggtttgtcccgtgtaagggaacaggtgtggggaagaggtggggttgggttccaactctggctttttctggtagaaaggcctaacccattacaccagaagaccatgggtgaagtctagatggggaggagaagtgaggccagggacagtcttgccagacgactctgaggagggcaagggacagttccatggcccttcccggactgcactaggctgggagctctgttgtgtggaggggtggtcagaggtctgtgaagagcgggcaggaggcatgagcaggcgaggagctggcctgtcccgggaagcagcccagcctgtggctgcccccgacaccaggaggagggccaggagagttccagggggctgaggcacacagagaggccaacttcctccctgcccagccttccttgtatctctccagactcggacaatcaaagggagagagggtgtatcgggtcctgttccagccggcatcgccgggtggcttccaggcctcagagctgtgtggcagggccccctgctggggctggacatcactgcagtccagtgcaaagccgcccccagagcccaggtgtccccccaacctaaccagacctggtgccttgacgcccccaccccagctgggacggtacagagaagggtcttggtttcctctcctactcccttccttaggctcctgaactcgtttgctcctaaatcttgttaattctttttctctggattttggtttcttttggctttcccttgccttcccctttctctgtctccaacactctttccccatgtctttctggctgtctctatgttcctcttctcttatcctcaactttctgtccattcgggcctcctccccacctcccacgccccagcccctccctccttggtctccttttcgatatgccaaaccaattttgggtcgagtgcatttaacgagaacaaaacaaaaggctcataacaacaagaacgtttcagaaaaaaacaaaaagttttaaaaaaattgttgagtcaaaaagtcaaacaataaagaaattaagatttcttggaaaaaaaaaa

SEQ ID NO: 356266 - DNA, 4770 bp, Homo sapiens
  misc_feature (2735)..(2735): n is a, c, g, or t
tcaaaaggtgagtctgtttaagggcaacttaaagagaaataggcagcaaatatagcctaagtggtctggaaatttagcagaaacaatgaagttggcagaggaataactgatgttcacaataccccgacccctgacccagtacctttccctcaggcccaggctccggtggaggtgtcctgggcaggccactgcccccaaggcccactcggcccgctcagggctttgcagacagtgcccaggcccacccaagggcccccgttgtaggctgcaggggaggcctgggctgaggccgtcccctccggcgggtactttgactcccctgtcgccccactcccagatcctgggcgctgggggccatcgcgctgctgttcctgctgggcctcacctgggctttcggcctcctcttcatcaacaaggagtcggtggtcatggcctatctcttcaccaccttcaacgccttccagggggtcttcatcttcgtctttcactgcgccttacagaagaaggtgcacaaggagtacagcaagtgcctgcgtcactcctactgctgcatccgctccccacccgggggcactcacggatccctcaagacctcagccatgcgaagcaacacccgctactacacagggacccagagccgaattcggaggatgtggaatgacactgtgaggaaacagacggagtcctccttcatggcgggtgacatcaacagcacccccaccctgaaccgaggtaccatggggaaccacctgctgaccaaccccgtgctgcagccccgtgggggcaccagtccctacaacaccctcatcgccgagtcagtgggcttcaatccctcctcgccccctgtcttcaactccccagggagctaccgggaacccaagcaccccttgggaggccgggaagcctgtggcatggacaccctgcccctgaacggcaacttcaataacagttactccttgcgaagtggggatttccctcccggggatgggggccctgagccgccccgaggccggaacctagccgatgcggcggcctttgagaagatgatcatctcagagctggtgcacaacaacctgcgggggagcagcagcgcggccaagggccctccaccgcctgagccccctgtgccacctgtgccagggggcgggggcgaggaagaggcgggcgggcccgggggtgctgaccgggccgagattgaacttctctataaggccctggaggagcctctgctgctgccccgggcccagtcggtgctgtaccagagcgatctggacgagtcggagagctgcacggccgaggacggcgccaccagccggcccctctcctcccctcctggccgggactccctctatgccagcggggccaacctgcgggactcaccctcctacccggacagcagccctgaggggcccagtgaggccctgcccccaccccctcccgcaccccccggcccccccgaaatctactacacctcgcgcccgccagccctggtggcccggaatcccctgcagggctactaccaggtgcggcgtcctagccacgagggctacctggcagccccaggccttgaggggccagggcccgatggggacgggcagatgcagctggtcaccagtctctgagggcacctcatggaccaggggctggtggcccaggccagggagggaaccctgggcagggctctggtgggagagggagacagatggaggcagtggctggtgggccactctctccaggtgcccctcagccatgggccctacagtcccctcaggggactctaacctgggggcctgaggtgccagggttcacagacagggtttcccaccagccacacgcaccagctctatttgggggaagtgtagtgaggaggagcccagaggaccccaggggagtgaggagggagaacttggaagggtgcagcccacttccagactctcccctctcccacccttctaccctgtgaagggaaatgagggctttagtttcctgggcagggaggggcagcttctgaggttgccaaaggcccccactggatggaacctgttagctgctcctctccgcagccagaaatgctgccggctgcacccagagggagcagtgaggcaggacagatggacaggttcctcctgcgctgtaattccctgctccctggagactgggaaaaggccgcagggcagggggactgggcggtggtggctggtggtttaaaggttgaactttctctgaagctcctttccccttgctcttggtccctgccccgcaagcaaacctgccccctctgcctcccagtgcacccaatgaccccctcccttggggcgactcctgatgaagcacaactccccgcagggcccccagcccacaggggtggccatatttgggcagttcccagtcctgtgggctcggctatctggggagcagattttgggtctggatctccctggggagtgggtcctgggcttggatctttccctagggggccctcttactccttcctctctcctcctccttccccattgctgtaaatatttcaacgaaatggaaaagaaaaaaaaagacaaaaaaaaaaaaaaagaaaagaaaaaaatctcatcacttgaagccaccgggagcctgcggcccgggccagcccgggctttctccggagcagagcagcgctgctggcctggcagccaggacttctccgtgtacgtgcatccccagtccccgccggggcgggcgggccgccagagcagctntttacaatccagagacagaaaacaaaatctagatgcaacagcgaaacaaagaacccatttccttcctggcacccgtttctgtcccctcctttcctgctccgcctgcccggcatcatcagcccttctggggcgtgtacctctcactgcctgccccaggaccagaggcctgtctcccccttccctccccaccggcccgggggagacctcttcacacccaaagatgctttgtcaagatggctgcgctgtccctttgagttcctgcttcttgtatattgctctggggactctcgccggggaagatggggctgatttcccacctagagaggttgatggcagaaggaaaatggggaggcactggggttgtggagggcatgggtatggctgaggagggtgctgggaacggcaaggcggtctgggggatggggaggggcaaaggtgagagatcaccttccctatcctccaccttcccgcagggaagacgaagccaggtgccagggctggggtcgggacacccatgttctgggcggcttgaccccaaatcccagaccccggaagctccaggctcgggatgtgtcctgagcacctgtcccggccccctcctctccagcctgtcaggccagcctccccagcccccttccctcaactctaggggcagcatagccccaggccaccctagcccagcccctgcattgccgtttccccagaggtggcccctccacctctgctctgacctctccccatctctctgcccctccttttctcacaagtgccatgagttttcaaacatcttcgggtctcagcctgctgctgccatgaactttgttgggttaagggggaggggctctaggaaggaactggggggaaggggacaggtaggtggctggagggaccctttttgctgctagaaagcccctcccttctcccggggagctggggctggcttgtccccatcaattaggggagaaggggtcagaccaaagatggtggtttgtcccgtgtaagggaacaggtgtggggaagaggtggggttgggttccaactctggctttttctggtagaaaggcctaacccattacaccagaagaccatgggtgaagtctagatggggaggagaagtgaggccagggacagtcttgccagacgactctgaggagggcaagggacagttccatggcccttcccggactgcactaggctgggagctctgttgtgtggaggggtggtcagaggtctgtgaagagcgggcaggaggcatgagcaggcgaggagctggcctgtcccgggaagcagcccagcctgtggctgcccccgacaccaggaggagggccaggagagttccagggggctgaggcacacagagaggccaacttcctccctgcccagccttccttgtatctctccagactcggacaatcaaagggagagagggtgtatcgggtcctgttccagccggcatcgccgggtggcttccaggcctcagagctgtgtggcagggccccctgctggggctggacatcactgcagtccagtgcaaagccgcccccagagcccaggtgtccccccaacctaaccagacctggtgccttgacgcccccaccccagctgggacggtacagagaagggtcttggtttcctctcctactcccttccttaggctcctgaactcgtttgctcctaaatcttgttaattctttttctctggattttggtttcttttggctttcccttgccttcccctttctctgtctccaacactctttccccatgtctttctggctgtctctatgttcctcttctcttatcctcaactttctgtccattcgggcctcctccccacctcccacgccccagcccctccctccttggtctccttttcgatatgccaaaccaattttgggtcgagtgcatttaacgagaacaaaacaaaaggctcataacaacaagaacgtttcagaaaaaaacaaaaagttttaaaaaaattgttgagtcaaaaagtcaaacaataaagaaattaagatttcttggaaaaaaaaaa

SEQ ID NO: 356267 - DNA, 5195 bp, Homo sapiens
  misc_feature (4724)..(4725): n is a, c, g, or t
  misc_feature (4742)..(4743): n is a, c, g, or t
  misc_feature (4753)..(4753): n is a, c, g, or t
  misc_feature (4759)..(4759): n is a, c, g, or t
  misc_feature (4766)..(4766): n is a, c, g, or t
  misc_feature (4773)..(4773): n is a, c, g, or t
  misc_feature (4777)..(4777): n is a, c, g, or t
  misc_feature (4785)..(4785): n is a, c, g, or t
  misc_feature (4789)..(4789): n is a, c, g, or t
gggtttggccctggacggccttgcctttcccgccaaacccggtttaagggaactcctcaaatgctgtgggctccttttccccatgggtatatatcggcggatccctttttttttttttttcctaatttttggtcggcggcggtgctgggccaggggaaggaagggacacggaggccgccctcgtcccgccacctcctacccgcttccccccagccccggctccgggagatgtgccgggcggggggcccgggttcgccgagccgcaggagagacacgctgggccgaccccagagaggcgctggacaggctggtggtccaggccgtggtgcctgccaggtgatgtggggcaaagccccccgcacaggccactgagagctccggacacgcacccggctgccaccatggcccgcctagccgcagtgctctggaatctgtgtgtcaccgccgtcctggtcacctcggccacccaaggcctgagccgggccgggctcccgttcgggctgatgcgccgggagctggcgtgtgaaggctaccccatcgagctgcggtgccccggcagcgacgtcatcatggtggagaatgccaactacgggcgcacggacgacaagatttgcgatgctgaccctttccagatggagaatgtgcagtgctacctgccggacgccttcaagatcatgtcacagaggtgtaacaaccgcacccagtgcgtggtggtcgccggctcggatgcctttcctgacccctgtcctgggacctacaagtacctggaggtgcagtacgactgtgtcccctacaaagtggagcagaaagggattgggggggtggggcggggccccccacctttctgacatcagcgctgccttggtccctcttcccgagccggggatggtcgcagagtcttcgtgtgcccagggaccctgcagaaggtgctggagcccacctcgacacacgagtcagagcaccagtctggcgcatggtgcaaggacccgctgcaggcgggtgaccgcatctacgtgatgccctggatcccctaccgcacggacacactgactgagtatgcctcgtgggaggactacgtggccgcccgccacaccaccacctaccgcctgcccaaccgcgtggatggcacaggctttgtggtctacgatggtgccgtcttctacaacaaggagcgcacgcgcaacatcgtcaagtatgacctacggacgcgcatcaagagcggggagacggtcatcaataccgccaactaccatgacacctcgccctaccgctggggcggaaagaccgacattgacctggcggtggacgagaacgggctgtgggtcatctacgccactgagggcaacaacgggcggctggtggtgagccagctgaacccctacacactgcgctttgagggcacgtgggagacgggttacgacaagcgctcggcatccaacgccttcatggtgtgtggggtcctgtacgtcctgcgttccgtgtacgtggatgatgacagcgaggcggctggcaaccgcgtggactatgccttcaacaccaatgccaaccgcgaggagcctgtcagcctcaccttccccaacccctaccagttcatctcctccgttgactacaaccctcgcgacaaccagctgtacgtctggaacaactatttcgtggtgcgctacagcctggagttcgggccgcccgaccccagtgctggcccagccacttccccacccctcagcacgaccaccacagccaggcccacgcccctcaccagcacagcctcgcccgcagccaccaccccgctccgccgggcacccctcaccacgcacccagtgggtgccatcaaccagctgggacctgatctgcctccagccacagccccagtccccagcacccggcggcccccagccccgaatctacacgtgtcccctgagctcttctgcgagccccgagaggtacggcgggtccagtggccggccacccagcagggcatgctggtggagaggccctgccccaaggggactcgaggaattgcctccttccagtgtctaccagccttggggctctggaacccccggggccctgacctcagcaactgcacctccccctgggtcaaccaggtggcccagaagatcaagagtggggagaacgcggccaacatcgccagcgagctggcccgacacacccggggctccatctacgcgggggacgtctcctcctctgtgaagctgatggagcagctgctggacatcctggatgcccagctgcaggccctgcggcccatcgagcgcgagtcagccggcaagaactacaacaagatgcacaagcgagagagaacttgtaaggattatatcaaggccgtggtggagacagtggacaatctgctccggccagaagctctggagtcctggaaggacatgaatgccacggagcaggtgcacacggccaccatgctcctcgacgtcctggaggagggcgccttcctgctggccgacaatgtcagggagcctgcccgcttcctggctgccaaggagaacgtggtcctggaggtcacagtcctgaacacagagggccaggtgcaggagctggtgttcccccaggaggagtacccgagaaagaactccatccagctgtctgccaaaaccatcaagcagaacagccgcaatggggtggtcaaagttgtcttcatcctctacaacaacctgggcctcttcctgtccacggagaatgccacagtgaagctggccggcgaagcaggcccgggtggccctgggggcgcctctctagtggtgaactcacaggtcatcgcagcatccatcaacaaggagtccagccgcgtcttcctcatggaccctgtcatcttcaccgtggcccacctggaggacaagaaccacttcaatgctaactgctccttctggaactactcggagcgttccatgctgggctactggtcgacccaaggctgccgcctggtggagtccaacaagacccataccacgtgtgcctgcagccacctcaccaacttcgctgtgctcatggctcaccgtgagatctaccagggccgcatcaacgagctgctgctgtcggtcatcacctgggtgggcattgtgatctccctggtctgcttggccatctgcatctccaccttctgcttcctgcgggggctgcagaccgaccgcaacaccatccacaagaacctgtgcatcaacctcttcctggctgagctgctcttcctggtcgggatcgacaagactcagtatgagattgcctgccccatcttcgccggcctgctgcactatttcttcctggctgccttctcctggctgtgcctggagggcgtgcacctctacctgctactagtggaggtgtttgagagcgagtattcccgcaccaagtactactacctgggtggctactgcttcccggccctggtggtgggcatcgcggctgccattgactaccgcagctacggcaccgagaaggcctgctggctccgagtggacaattacttcatctggagtttcatcgggccagtctccttcgttatcgtggtcaacctggtgttcctcatggtgaccctgcacaagatgatccgaagctcatctgtgctcaagcccgactccagccgcctggacaacattaaatcctgggcgctgggggccatcgcgctgctgttcctgctgggcctcacctgggctttcggcctcctcttcatcaacaaggagtcggtggtcatggcctatctcttcaccaccttcaacgccttccagggggtcttcatcttcgtctttcactgcgccttacagaagaaggtgcacaaggagtacagcaagtgcctgcgtcactcctactgctgcatccgctccccacccgggggcactcacggatccctcaagacctcagccatgcgaagcaacacccgctactacacagggacccagagccgaattcggaggatgtggaatgacactgtgaggaaacagacggagtcctccttcatggcgggtgacatcaacagcacccccaccctgaaccgaggtaccatggggaaccacctgctgaccaaccccgtgctgcagccccgtgggggcaccagtccctacaacaccctcatcgccgagtcagtgggcttcaatccctcctcgccccctgtcttcaactccccagggagctaccgggaacccaagcaccccttgggaggccgggaagcctgtggcatggacaccctgcccctgaacggcaacttcaataacagttactccttgcgaagtggggatttccctcccggggatgggggccctgagccgccccgaggccggaacctagccgatgcggcggcctttgagaagatgatcatctcagagctggtgcacaacaacctgcgggggagcagcagcgcggccaagggccctccaccgcctgagccccctgtgccacctgtgccagggggcgggggcgaggaagaggcgggcgggcccgggggtgctgaccgggccgagattgaacttctctataaggccctggaggagcctctgctgctgccccgggcccagtcggtgctgtaccagagcgatctggacgagtcggagagctgcacggccgaggacggcgccaccagccggcccctctcctcccctcctggccgggactccctctatgccagcggggccaacctgcgggactcaccctcctacccggacagcagccctgaggggcccagtgaggccctgccccggagnngaggagagagaaagggnngagaggaagnaagaanaaaaaanaaagaanaaanagaaaaanaagnaagaagaaagaaagacaccaaagaagaaagactaaaacagaaaagataaagacaaaaaaaagaaacaaaaaaaaaaaaaaaaaaaaaaaaagacaaaaaataaacagagaagaaaaaaggagagaaaaaaaaagaaaagaaggaaaggcagaaaaagagaagagaagaggaaaaaaagaagaaaaaaaacgagagaaaaaaacagagagaaggaaaagaaagaagaaagaaagaaaagaagagaacaaaagaggaaggagaggaaagagcaaaaagaggagacaagaaagaagacagaagaaaagagaagaacaaagagaaaagaagaaaaaaacacaagaagaaaaaaaaaagaagaaaagagaagaagaaaaagaagaagagaagaaggagagaaaagaaaagc

SEQ ID NO: 356268 - DNA, 844 bp, Homo sapiens
  misc_feature (19)..(19): n is a, c, g, or t
gagctcggtacccgctccncccgacggggtggtcagaggtctgtgaagagcgggcaggaggcatgagcaggcgaggagctggcctgtcccgggaagcagcccagcctgtggctgcccccgacaccaggaggagggccaggagagttccagggggctgaggcacacagagaggccaacttcctccctgcccagccttccttgtatctctccagactcggacaatcaaagggagagagggtgtatcgggtcctgttccagccggcatcgccgggtggcttccaggcctcagagctgtgtggcagggccccctgctggggctggacatcactgcagtccagtgcaaagccgcccccagagcccaggtgtccccccaacctaaccagacctggtgccttgacgcccccaccccagctgggacggtacagagaagggtcttggtttcctctcctactcccttccttaggctcctgaactcgtttgctcctaaatcttgttaattctttttctctggattttggtttcttttggctttcccttgccttcccctttctctgtctccaacactctttccccatgtctttctggctgtctctatgttcctcttctcttatcctcaactttctgtccattcgggcctcctccccacctcccacgccccagcccctccctccttggtctccttttcgatatgccaaaccaattttgggtcgagtgcatttaacgagaacaaaacaaaaggctcataacaacaagaacgtttcagaaaaaaacaaaaagttttaaaaaaattgttgagtcaaaaagtcaaacaataaagaaattaagatttcttggaaaaaaaaaa

SEQ ID NO: 356269 - DNA, 2344 bp, Homo sapiens
gggtttggccctggacggccttgcctttcccgccaaacccggtttaagggaactcctcaaatgctgtgggctccttttccccatgggtatatatcggcggatccctttttttttttttttcctaatttttggtcggcggcggtgctgggccaggggaaggaagggacacggaggccgccctcgtcccgccacctcctacccgcttccccccagccccggctccgggagatgtgccgggcggggggcccgggttcgccgagccgcaggagagacacgctgggccgaccccagagaggcgctggacaggctggtggtccaggccgtggtgcctgccaggtgatgtggggcaaagccccccgcacaggccactgagagctccggacacgcacccggctgccaccatggcccgcctagccgcagtgctctggaatctgtgtgtcaccgccgtcctggtcacctcggccacccaaggcctgagccgggccgggctcccgttcgggctgatgcgccgggagctggcgtgtgaaggctaccccatcgagctgcggtgccccggcagcgacgtcatcatggtggagaatgccaactacgggcgcacggacgacaagatttgcgatgctgaccctttccagatggagaatgtgcagtgctacctgccggacgccttcaagatcatgtcacagaggtgtaacaaccgcacccagtgcgtggtggtcgccggctcggatgcctttcctgacccctgtcctgggacctacaagtacctggaggtgcagtacgactgtgtcccctacaaagtggagcagcatcttgttccttgtgcggatgcgggcccttctcgcatgagtgagtgaggaggagacaccttgacccatcacacatgtgcacacatgcatggggcctgggcacagtggggacagccgggcctgctctctccaacacacattctctaatcccagacaccagtgtccacactcagtgcctgctccccgcctcacagactctgtcccctcctgtggggacaccttctccagctctccttaccccagcccactcaccctgcttcttcatgcaccctatactcatttccacactgccaggccatggtcccgtgctctgcctggcacacttacgtctctctcttctcccttggcctctatgcttttctcccccatctgcctccctcgccttctcacatcccttccttttctgactcttctgaccttttctgacccttctcatctaccttctcttccctctcacttaccccactgcccctctcaacaccgttctctcagcaccctcactccccacacacttcttcccaatcatggaagctggactctacacccatagagtgggataccatcctctgaggcctggtggcagattcagggtgaagggctggggggcattttcaacagattcatagctcctcactggtctccccattaccatgtggcacttcctgtctgcaaaggaaatgccgccatgttggactgagggtggcctccaggcagcctgaagaaagtgatttggggagccaggagcctggccatcttgcacctggccaaagggatcagacaaagacaaggtctctcctcctcagcaccccacccttgacatcacctttttcctgccctctctcctccctccctccttcccattatcccttcccttctcctcccacaatgggttccatgtagtcaacctggtggtagggcctccgggaagagtggggagaaggcagggccatcagggtgtctgagtgtggcgggccgggtttggggactaagaggccctgtaactctccctcctctcccctcccaccccaaccttccctgccagcctttgatttctcctcacaggtgactcgatgctggggaaacaggatcccttctgtgcttccgtaattttcttcttttactcttcgtcctttcctttcagcgcttgaggccttcagccaccaccgagggggatgcccatctgctccttgaagcctccccacagcactggggacacggctgactcccgcggctgggacagcggggaaggggggtgggaggcagcgagctcagcacaggggggcagtcagatgggtgtaggttcaaggctcgactgggctcttgagttttctggctctgaaaccttgagcaaatgatttaatttctctgggccactacggaaggaggtgtgagtccatgagatgacatgtgagaagcgcttggcccagggccggccacaaagtcgctcctggtggcagggttttgagtgccgagtgtaaacttcccaagggcagaggcttcgtcttcacccgccgccccagcgcccagacccatgcctg

SEQ ID NO: 356270 - DNA, 549 bp, Homo sapiens
tcaaaaggtgagtctgtttaagggcaacttaaagagaaataggcagcaaatatagcctaagtggtctggaaatttagcagaaacaatgaagttggcagaggaataactgatgttcacaataccccgacccctgacccagtacctttccctcaggcccaggctccggtggaggtgtcctgggcaggccactgcccccaaggcccactcggcccgctcagggctttgcagacagtgcccaggcccacccaagggcccccgttgtaggctgcaggggaggcctgggctgaggccgtcccctccggcgggtactttgactcccctgtcgccccactcccagatcctgggcgctgggggccatcgcgctgctgttcctgctgggcctcacctgggctttcggcctcctcttcatcaacaaggagtcggtggtcatggcctatctcttcaccaccttcaacgccttccagggggtcttcatcttcgtctttcactgcgccttacagaagaaggtgaggtcgaggcggggtcctgggtcacagcctcccttggaga

SEQ ID NO: 356271 - DNA, 7972 bp, Homo sapiens
  misc_feature (5937)..(5937): n is a, c, g, or t
gggtttggccctggacggccttgcctttcccgccaaacccggtttaagggaactcctcaaatgctgtgggctccttttccccatgggtatatatcggcggatccctttttttttttttttcctaatttttggtcggcggcggtgctgggccaggggaaggaagggacacggaggccgccctcgtcccgccacctcctacccgcttccccccagccccggctccgggagatgtgccgggcggggggcccgggttcgccgagccgcaggagagacacgctgggccgaccccagagaggcgctggacaggctggtggtccaggccgtggtgcctgccaggtgatgtggggcaaagccccccgcacaggccactgagagctccggacacgcacccggctgccaccatggcccgcctagccgcagtgctctggaatctgtgtgtcaccgccgtcctggtcacctcggccacccaaggcctgagccgggccgggctcccgttcgggctgatgcgccgggagctggcgtgtgaaggctaccccatcgagctgcggtgccccggcagcgacgtcatcatggtggagaatgccaactacgggcgcacggacgacaagatttgcgatgctgaccctttccagatggagaatgtgcagtgctacctgccggacgccttcaagatcatgtcacagaggtgtaacaaccgcacccagtgcgtggtggtcgccggctcggatgcctttcctgacccctgtcctgggacctacaagtacctggaggtgcagtacgactgtgtcccctacaaagtggagcagagtcttcgtgtgcccagggaccctgcagaaggtgctggagcccacctcgacacacgagtcagagcaccagtctggcgcatggtgcaaggacccgctgcaggcgggtgaccgcatctacgtgatgccctggatcccctaccgcacggacacactgactgagtatgcctcgtgggaggactacgtggccgcccgccacaccaccacctaccgcctgcccaaccgcgtggatggcacaggctttgtggtctacgatggtgccgtcttctacaacaaggagcgcacgcgcaacatcgtcaagtatgacctacggacgcgcatcaagagcggggagacggtcatcaataccgccaactaccatgacacctcgccctaccgctggggcggaaagaccgacattgacctggcggtggacgagaacgggctgtgggtcatctacgccactgagggcaacaacgggcggctggtggtgagccagctgaacccctacacactgcgctttgagggcacgtgggagacgggttacgacaagcgctcggcatccaacgccttcatggtgtgtggggtcctgtacgtcctgcgttccgtgtacgtggatgatgacagcgaggcggctggcaaccgcgtggactatgccttcaacaccaatgccaaccgcgaggagcctgtcagcctcaccttccccaacccctaccagttcatctcctccgttgactacaaccctcgcgacaaccagctgtacgtctggaacaactatttcgtggtgcgctacagcctggagttcgggccgcccgaccccagtgctggcccagccacttccccacccctcagcacgaccaccacagccaggcccacgcccctcaccagcacagcctcgcccgcagccaccaccccgctccgccgggcacccctcaccacgcacccagtgggtgccatcaaccagctgggacctgatctgcctccagccacagccccagtccccagcacccggcggcccccagccccgaatctacacgtgtcccctgagctcttctgcgagccccgagaggtacggcgggtccagtggccggccacccagcagggcatgctggtggagaggccctgccccaaggggactcgaggaattgcctccttccagtgtctaccagccttggggctctggaacccccggggccctgacctcagcaactgcacctccccctgggtcaaccaggtggcccagaagatcaagagtggggagaacgcggccaacatcgccagcgagctggcccgacacacccggggctccatctacgcgggggacgtctcctcctctgtgaagctgatggagcagctgctggacatcctggatgcccagctgcaggccctgcggcccatcgagcgcgagtcagccggcaagaactacaacaagatgcacaagcgagagagaacttgtaaggattatatcaaggccgtggtggagacagtggacaatctgctccggccagaagctctggagtcctggaaggacatgaatgccacggagcaggtgcacacggccaccatgctcctcgacgtcctggaggagggcgccttcctgctggccgacaatgtcagggagcctgcccgcttcctggctgccaaggagaacgtggtcctggaggtcacagtcctgaacacagagggccaggtgcaggagctggtgttcccccaggaggagtacccgagaaagaactccatccagctgtctgccaaaaccatcaagcagaacagccgcaatggggtggtcaaagttgtcttcatcctctacaacaacctgggcctcttcctgtccacggagaatgccacagtgaagctggccggcgaagcaggcccgggtggccctgggggcgcctctctagtggtgaactcacaggtcatcgcagcatccatcaacaaggagtccagccgcgtcttcctcatggaccctgtcatcttcaccgtggcccacctggaggacaagaaccacttcaatgctaactgctccttctggaactactcggagcgttccatgctgggctactggtcgacccaaggctgccgcctggtggagtccaacaagacccataccacgtgtgcctgcagccacctcaccaacttcgctgtgctcatggctcaccgtgagatctaccagggccgcatcaacgagctgctgctgtcggtcatcacctgggtgggcattgtgatctccctggtctgcttggccatctgcatctccaccttctgcttcctgcgggggctgcagaccgaccgcaacaccatccacaagaacctgtgcatcaacctcttcctggctgagctgctcttcctggtcgggatcgacaagactcagtatgagattgcctgccccatcttcgccggcctgctgcactatttcttcctggctgccttctcctggctgtgcctggagggcgtgcacctctacctgctactagtggaggtgtttgagagcgagtattcccgcaccaagtactactacctgggtggctactgcttcccggccctggtggtgggcatcgcggctgccattgactaccgcagctacggcaccgagaaggcctgctggctccgagtggacaattacttcatctggagtttcatcgggccagtctccttcgttatcgtggtcaacctggtgttcctcatggtgaccctgcacaagatgatccgaagctcatctgtgctcaagcccgactccagccgcctggacaacattaaatcctgggcgctgggggccatcgcgctgctgttcctgctgggcctcacctgggctttcggcctcctcttcatcaacaaggagtcggtggtcatggcctatctcttcaccaccttcaacgccttccagggggtcttcatcttcgtctttcactgcgccttacagaagaaggtgcacaaggagtacagcaagtgcctgcgtcactcctactgctgcatccgctccccacccgggggcactcacggatccctcaagacctcagccatgcgaagcaacacccgctactacacagggacccagagccgaattcggaggatgtggaatgacactgtgaggaaacagacggagtcctccttcatggcgggtgacatcaacagcacccccaccctgaaccgaggtaccatggggaaccacctgctgaccaaccccgtgctgcagccccgtgggggcaccagtccctacaacaccctcatcgccgagtcagtgggcttcaatccctcctcgccccctgtcttcaactccccagggagctaccgggaacccaagcaccccttgggaggccgggaagcctgtggcatggacaccctgcccctgaacggcaacttcaataacagttactccttgcgaagtggggatttccctcccggggatgggggccctgagccgccccgaggccggaacctagccgatgcggcggcctttgagaagatgatcatctcagagctggtgcacaacaacctgcgggggagcagcagcgcggccaagggccctccaccgcctgagccccctgtgccacctgtgccagggggcgggggcgaggaagaggcgggcgggcccgggggtgctgaccgggccgagattgaacttctctataaggccctggaggagcctctgctgctgccccgggcccagtcggtgctgtaccagagcgatctggacgagtcggagagctgcacggccgaggacggcgccaccagccggcccctctcctcccctcctggccgggactccctctatgccagcggggccaacctgcgggactcaccctcctacccggacagcagccctgaggggcccagtgaggccctgcccccaccccctcccgcaccccccggcccccccgaaatctactacacctcgcgcccgccagccctggtggcccggaatcccctgcagggctactaccaggtgcggcgtcctagccacgagggctacctggcagccccaggccttgaggggccagggcccgatggggacgggcagatgcagctggtcaccagtctctgagggcacctcatggaccaggggctggtggcccaggccagggagggaaccctgggcagggctctggtgggagagggagacagatggaggcagtggctggtgggccactctctccaggtgcccctcagccatgggccctacagtcccctcaggggactctaacctgggggcctgaggtgccagggttcacagacagggtttcccaccagccacacgcaccagctctatttgggggaagtgtagtgaggaggagcccagaggaccccaggggagtgaggagggagaacttggaagggtgcagcccacttccagactctcccctctcccacccttctaccctgtgaagggaaatgagggctttagtttcctgggcagggaggggcagcttctgaggttgccaaaggcccccactggatggaacctgttagctgctcctctccgcagccagaaatgctgccggctgcacccagagggagcagtgaggcaggacagatggacaggttcctcctgcgctgtaattccctgctccctggagactgggaaaaggccgcagggcagggggactgggcggtggtggctggtggtttaaaggttgaactttctctgaagctcctttccccttgctcttggtccctgccccgcaagcaaacctgccccctctgcctcccagtgcacccaatgaccccctcccttggggcgactcctgatgaagcacaactccccgcagggcccccagcccacaggggtggccatatttgggcagttcccagtcctgtgggctcggctatctggggagcagattttgggtctggatctccctggggagtgggtcctgggcttggatctttccctagggggccctcttactccttcctctctcctcctccttccccattgctgtaaatatttcaacgaaatggaaaagaaaaaaaaagacaaaaaaaaaaaaaaagaaaagaaaaaaatctcatcacttgaagccaccgggagcctgcggcccgggccagcccgggctttctccggagcagagcagcgctgctggcctggcagccaggacttctccgtgtacgtgcatccccagtccccgccggggcgggcgggccgccagagcagctntttacaatccagagacagaaaacaaaatctagatgcaacagcgaaacaaagaacccatttccttcctggcacccgtttctgtcccctcctttcctgctccgcctgcccggcatcatcagcccttctggggcgtgtacctctcactgcctgccccaggaccagaggcctgtctcccccttccctccccaccggcccgggggagacctcttcacacccaaagatgctttgtcaagatggctgcgctgtccctttgagttcctgcttcttgtatattgctctggggactctcgccggggaagatggggctgatttcccacctagagaggttgatggcagaaggaaaatggggaggcactggggttgtggagggcatgggtatggctgaggagggtgctgggaacggcaaggcggtctgggggatggggaggggcaaaggtgagagatcaccttccctatcctccaccttcccgcagggaagacgaagccaggtgccagggctggggtcgggacacccatgttctgggcggcttgaccccaaatcccagaccccggaagctccaggctcgggatgtgtcctgagcacctgtcccggccccctcctctccagcctgtcaggccagcctccccagcccccttccctcaactctaggggcagcatagccccaggccaccctagcccagcccctgcattgccgtttccccagaggtggcccctccacctctgctctgacctctccccatctctctgcccctccttttctcacaagtgccatgagttttcaaacatcttcgggtctcagcctgctgctgccatgaactttgttgggttaagggggaggggctctaggaaggaactggggggaaggggacaggtaggtggctggagggaccctttttgctgctagaaagcccctcccttctcccggggagctggggctggcttgtccccatcaattaggggagaaggggtcagaccaaagatggtggtttgtcccgtgtaagggaacaggtgtggggaagaggtggggttgggttccaactctggctttttctggtagaaaggcctaacccattacaccagaagaccatgggtgaagtctagatggggaggagaagtgaggccagggacagtcttgccagacgactctgaggagggcaagggacagttccatggcccttcccggactgcactaggctgggagctctgttgtgtggaggggtggtcagaggtctgtgaagagcgggcaggaggcatgagcaggcgaggagctggcctgtcccgggaagcagcccagcctgtggctgcccccgacaccaggaggagggccaggagagttccagggggctgaggcacacagagaggccaacttcctccctgcccagccttccttgtatctctccagactcggacaatcaaagggagagagggtgtatcgggtcctgttccagccggcatcgccgggtggcttccaggcctcagagctgtgtggcagggccccctgctggggctggacatcactgcagtccagtgcaaagccgcccccagagcccaggtgtccccccaacctaaccagacctggtgccttgacgcccccaccccagctgggacggtacagagaagggtcttggtttcctctcctactcccttccttaggctcctgaactcgtttgctcctaaatcttgttaattctttttctctggattttggtttcttttggctttcccttgccttcccctttctctgtctccaacactctttccccatgtctttctggctgtctctatgttcctcttctcttatcctcaactttctgtccattcgggcctcctccccacctcccacgccccagcccctccctccttggtctccttttcgatatgccaaaccaattttgggtcgagtgcatttaacgagaacaaaacaaaaggctcataacaacaagaacgtttcagaaaaaaacaaaaagttttaaaaaaattgttgagtcaaaaagtcaaacaataaagaaattaagatttcttggaaaaaaaaaa

SEQ ID NO: 356272 - DNA, 7957 bp, Homo sapiens
  misc_feature (5922)..(5922): n is a, c, g, or t
gggtttggccctggacggccttgcctttcccgccaaacccggtttaagggaactcctcaaatgctgtgggctccttttccccatgggtatatatcggcggatccctttttttttttttttcctaatttttggtcggcggcggtgctgggccaggggaaggaagggacacggaggccgccctcgtcccgccacctcctacccgcttccccccagccccggctccgggagatgtgccgggcggggggcccgggttcgccgagccgcaggagagacacgctgggccgaccccagagaggcgctggacaggctggtggtccaggccgtggtgcctgccaggtgatgtggggcaaagccccccgcacaggccactgagagctccggacacgcacccggctgccaccatggcccgcctagccgcagtgctctggaatctgtgtgtcaccgccgtcctggtcacctcggccacccaaggcctgagccgggccgggctcccgttcgggctgatgcgccgggagctggcgtgtgaaggctaccccatcgagctgcggtgccccggcagcgacgtcatcatggtggagaatgccaactacgggcgcacggacgacaagatttgcgatgctgaccctttccagatggagaatgtgcagtgctacctgccggacgccttcaagatcatgtcacagaggtgtaacaaccgcacccagtgcgtggtggtcgccggctcggatgcctttcctgacccctgtcctgggacctacaagtacctggaggtgcagtacgactgtgtcccctacaaagtggagcagaaagggattgggggggtggggcggggccccccacctttctgacatcagcgctgccttggtccctcttcccgagccggggatggtcgcagagtcttcgtgtgcccagggaccctgcagaaggtgctggagcccacctcgacacacgagtcagagcaccagtctggcgcatggtgcaaggacccgctgcaggcgggtgaccgcatctacgtgatgccctggatcccctaccgcacggacacactgactgagtatgcctcgtgggaggactacgtggccgcccgccacaccaccacctaccgcctgcccaaccgcgtggatggcacaggctttgtggtctacgatggtgccgtcttctacaacaaggagcgcacgcgcaacatcgtcaagtatgacctacggacgcgcatcaagagcggggagacggtcatcaataccgccaactaccatgacacctcgccctaccgctggggcggaaagaccgacattgacctggcggtggacgagaacgggctgtgggtcatctacgccactgagggcaacaacgggcggctggtggtgagccagctgaacccctacacactgcgctttgagggcacgtgggagacgggttacgacaagcgctcggcatccaacgccttcatggtgtgtggggtcctgtacgtcctgcgttccgtgtacgtggatgatgacagcgaggcggctggcaaccgcgtggactatgccttcaacaccaatgccaaccgcgaggagcctgtcagcctcaccttccccaacccctaccagttcatctcctccgttgactacaaccctcgcgacaaccagctgtacgtctggaacaactatttcgtggtgcgctacagcctggagttcgggccgcccgaccccagtgctggcccagccacttccccacccctcagcacgaccaccacagccaggcccacgcccctcaccagcacagcctcgcccgcagccaccaccccgctccgccgggcacccctcaccacgcacccagtgggtgccatcaaccagctgggacctgatctgcctccagccacagccccagtccccagcacccggcggcccccagccccgaatctacacgtgtcccctgagctcttctgcgagccccgagaggtacggcgggtccagtggccggccacccagcagggcatgctggtggagaggccctgccccaaggggactcgagatcaagagtggggagaacgcggccaacatcgccagcgagctggcccgacacacccggggctccatctacgcgggggacgtctcctcctctgtgaagctgatggagcagctgctggacatcctggatgcccagctgcaggccctgcggcccatcgagcgcgagtcagccggcaagaactacaacaagatgcacaagcgagagagaacttgtaaggattatatcaaggccgtggtggagacagtggacaatctgctccggccagaagctctggagtcctggaaggacatgaatgccacggagcaggtgcacacggccaccatgctcctcgacgtcctggaggagggcgccttcctgctggccgacaatgtcagggagcctgcccgcttcctggctgccaaggagaacgtggtcctggaggtcacagtcctgaacacagagggccaggtgcaggagctggtgttcccccaggaggagtacccgagaaagaactccatccagctgtctgccaaaaccatcaagcagaacagccgcaatggggtggtcaaagttgtcttcatcctctacaacaacctgggcctcttcctgtccacggagaatgccacagtgaagctggccggcgaagcaggcccgggtggccctgggggcgcctctctagtggtgaactcacaggtcatcgcagcatccatcaacaaggagtccagccgcgtcttcctcatggaccctgtcatcttcaccgtggcccacctggaggacaagaaccacttcaatgctaactgctccttctggaactactcggagcgttccatgctgggctactggtcgacccaaggctgccgcctggtggagtccaacaagacccataccacgtgtgcctgcagccacctcaccaacttcgctgtgctcatggctcaccgtgagatctaccagggccgcatcaacgagctgctgctgtcggtcatcacctgggtgggcattgtgatctccctggtctgcttggccatctgcatctccaccttctgcttcctgcgggggctgcagaccgaccgcaacaccatccacaagaacctgtgcatcaacctcttcctggctgagctgctcttcctggtcgggatcgacaagactcagtatgagattgcctgccccatcttcgccggcctgctgcactatttcttcctggctgccttctcctggctgtgcctggagggcgtgcacctctacctgctactagtggaggtgtttgagagcgagtattcccgcaccaagtactactacctgggtggctactgcttcccggccctggtggtgggcatcgcggctgccattgactaccgcagctacggcaccgagaaggcctgctggctccgagtggacaattacttcatctggagtttcatcgggccagtctccttcgttatcgtggtcaacctggtgttcctcatggtgaccctgcacaagatgatccgaagctcatctgtgctcaagcccgactccagccgcctggacaacattaaatcctgggcgctgggggccatcgcgctgctgttcctgctgggcctcacctgggctttcggcctcctcttcatcaacaaggagtcggtggtcatggcctatctcttcaccaccttcaacgccttccagggggtcttcatcttcgtctttcactgcgccttacagaagaaggtgcacaaggagtacagcaagtgcctgcgtcactcctactgctgcatccgctccccacccgggggcactcacggatccctcaagacctcagccatgcgaagcaacacccgctactacacagggacccagagccgaattcggaggatgtggaatgacactgtgaggaaacagacggagtcctccttcatggcgggtgacatcaacagcacccccaccctgaaccgaggtaccatggggaaccacctgctgaccaaccccgtgctgcagccccgtgggggcaccagtccctacaacaccctcatcgccgagtcagtgggcttcaatccctcctcgccccctgtcttcaactccccagggagctaccgggaacccaagcaccccttgggaggccgggaagcctgtggcatggacaccctgcccctgaacggcaacttcaataacagttactccttgcgaagtggggatttccctcccggggatgggggccctgagccgccccgaggccggaacctagccgatgcggcggcctttgagaagatgatcatctcagagctggtgcacaacaacctgcgggggagcagcagcgcggccaagggccctccaccgcctgagccccctgtgccacctgtgccagggggcgggggcgaggaagaggcgggcgggcccgggggtgctgaccgggccgagattgaacttctctataaggccctggaggagcctctgctgctgccccgggcccagtcggtgctgtaccagagcgatctggacgagtcggagagctgcacggccgaggacggcgccaccagccggcccctctcctcccctcctggccgggactccctctatgccagcggggccaacctgcgggactcaccctcctacccggacagcagccctgaggggcccagtgaggccctgcccccaccccctcccgcaccccccggcccccccgaaatctactacacctcgcgcccgccagccctggtggcccggaatcccctgcagggctactaccaggtgcggcgtcctagccacgagggctacctggcagccccaggccttgaggggccagggcccgatggggacgggcagatgcagctggtcaccagtctctgagggcacctcatggaccaggggctggtggcccaggccagggagggaaccctgggcagggctctggtgggagagggagacagatggaggcagtggctggtgggccactctctccaggtgcccctcagccatgggccctacagtcccctcaggggactctaacctgggggcctgaggtgccagggttcacagacagggtttcccaccagccacacgcaccagctctatttgggggaagtgtagtgaggaggagcccagaggaccccaggggagtgaggagggagaacttggaagggtgcagcccacttccagactctcccctctcccacccttctaccctgtgaagggaaatgagggctttagtttcctgggcagggaggggcagcttctgaggttgccaaaggcccccactggatggaacctgttagctgctcctctccgcagccagaaatgctgccggctgcacccagagggagcagtgaggcaggacagatggacaggttcctcctgcgctgtaattccctgctccctggagactgggaaaaggccgcagggcagggggactgggcggtggtggctggtggtttaaaggttgaactttctctgaagctcctttccccttgctcttggtccctgccccgcaagcaaacctgccccctctgcctcccagtgcacccaatgaccccctcccttggggcgactcctgatgaagcacaactccccgcagggcccccagcccacaggggtggccatatttgggcagttcccagtcctgtgggctcggctatctggggagcagattttgggtctggatctccctggggagtgggtcctgggcttggatctttccctagggggccctcttactccttcctctctcctcctccttccccattgctgtaaatatttcaacgaaatggaaaagaaaaaaaaagacaaaaaaaaaaaaaaagaaaagaaaaaaatctcatcacttgaagccaccgggagcctgcggcccgggccagcccgggctttctccggagcagagcagcgctgctggcctggcagccaggacttctccgtgtacgtgcatccccagtccccgccggggcgggcgggccgccagagcagctntttacaatccagagacagaaaacaaaatctagatgcaacagcgaaacaaagaacccatttccttcctggcacccgtttctgtcccctcctttcctgctccgcctgcccggcatcatcagcccttctggggcgtgtacctctcactgcctgccccaggaccagaggcctgtctcccccttccctccccaccggcccgggggagacctcttcacacccaaagatgctttgtcaagatggctgcgctgtccctttgagttcctgcttcttgtatattgctctggggactctcgccggggaagatggggctgatttcccacctagagaggttgatggcagaaggaaaatggggaggcactggggttgtggagggcatgggtatggctgaggagggtgctgggaacggcaaggcggtctgggggatggggaggggcaaaggtgagagatcaccttccctatcctccaccttcccgcagggaagacgaagccaggtgccagggctggggtcgggacacccatgttctgggcggcttgaccccaaatcccagaccccggaagctccaggctcgggatgtgtcctgagcacctgtcccggccccctcctctccagcctgtcaggccagcctccccagcccccttccctcaactctaggggcagcatagccccaggccaccctagcccagcccctgcattgccgtttccccagaggtggcccctccacctctgctctgacctctccccatctctctgcccctccttttctcacaagtgccatgagttttcaaacatcttcgggtctcagcctgctgctgccatgaactttgttgggttaagggggaggggctctaggaaggaactggggggaaggggacaggtaggtggctggagggaccctttttgctgctagaaagcccctcccttctcccggggagctggggctggcttgtccccatcaattaggggagaaggggtcagaccaaagatggtggtttgtcccgtgtaagggaacaggtgtggggaagaggtggggttgggttccaactctggctttttctggtagaaaggcctaacccattacaccagaagaccatgggtgaagtctagatggggaggagaagtgaggccagggacagtcttgccagacgactctgaggagggcaagggacagttccatggcccttcccggactgcactaggctgggagctctgttgtgtggaggggtggtcagaggtctgtgaagagcgggcaggaggcatgagcaggcgaggagctggcctgtcccgggaagcagcccagcctgtggctgcccccgacaccaggaggagggccaggagagttccagggggctgaggcacacagagaggccaacttcctccctgcccagccttccttgtatctctccagactcggacaatcaaagggagagagggtgtatcgggtcctgttccagccggcatcgccgggtggcttccaggcctcagagctgtgtggcagggccccctgctggggctggacatcactgcagtccagtgcaaagccgcccccagagcccaggtgtccccccaacctaaccagacctggtgccttgacgcccccaccccagctgggacggtacagagaagggtcttggtttcctctcctactcccttccttaggctcctgaactcgtttgctcctaaatcttgttaattctttttctctggattttggtttcttttggctttcccttgccttcccctttctctgtctccaacactctttccccatgtctttctggctgtctctatgttcctcttctcttatcctcaactttctgtccattcgggcctcctccccacctcccacgccccagcccctccctccttggtctccttttcgatatgccaaaccaattttgggtcgagtgcatttaacgagaacaaaacaaaaggctcataacaacaagaacgtttcagaaaaaaacaaaaagttttaaaaaaattgttgagtcaaaaagtcaaacaataaagaaattaagatttcttggaaaaaaaaaa

SEQ ID NO: 356273 - DNA, 8040 bp, Homo sapiens
  misc_feature (6005)..(6005): n is a, c, g, or t
gggtttggccctggacggccttgcctttcccgccaaacccggtttaagggaactcctcaaatgctgtgggctccttttccccatgggtatatatcggcggatccctttttttttttttttcctaatttttggtcggcggcggtgctgggccaggggaaggaagggacacggaggccgccctcgtcccgccacctcctacccgcttccccccagccccggctccgggagatgtgccgggcggggggcccgggttcgccgagccgcaggagagacacgctgggccgaccccagagaggcgctggacaggctggtggtccaggccgtggtgcctgccaggtgatgtggggcaaagccccccgcacaggccactgagagctccggacacgcacccggctgccaccatggcccgcctagccgcagtgctctggaatctgtgtgtcaccgccgtcctggtcacctcggccacccaaggcctgagccgggccgggctcccgttcgggctgatgcgccgggagctggcgtgtgaaggctaccccatcgagctgcggtgccccggcagcgacgtcatcatggtggagaatgccaactacgggcgcacggacgacaagatttgcgatgctgaccctttccagatggagaatgtgcagtgctacctgccggacgccttcaagatcatgtcacagaggtgtaacaaccgcacccagtgcgtggtggtcgccggctcggatgcctttcctgacccctgtcctgggacctacaagtacctggaggtgcagtacgactgtgtcccctacaaagtggagcagaaagggattgggggggtggggcggggccccccacctttctgacatcagcgctgccttggtccctcttcccgagccggggatggtcgcagagtcttcgtgtgcccagggaccctgcagaaggtgctggagcccacctcgacacacgagtcagagcaccagtctggcgcatggtgcaaggacccgctgcaggcgggtgaccgcatctacgtgatgccctggatcccctaccgcacggacacactgactgagtatgcctcgtgggaggactacgtggccgcccgccacaccaccacctaccgcctgcccaaccgcgtggatggcacaggctttgtggtctacgatggtgccgtcttctacaacaaggagcgcacgcgcaacatcgtcaagtatgacctacggacgcgcatcaagagcggggagacggtcatcaataccgccaactaccatgacacctcgccctaccgctggggcggaaagaccgacattgacctggcggtggacgagaacgggctgtgggtcatctacgccactgagggcaacaacgggcggctggtggtgagccagctgaacccctacacactgcgctttgagggcacgtgggagacgggttacgacaagcgctcggcatccaacgccttcatggtgtgtggggtcctgtacgtcctgcgttccgtgtacgtggatgatgacagcgaggcggctggcaaccgcgtggactatgccttcaacaccaatgccaaccgcgaggagcctgtcagcctcaccttccccaacccctaccagttcatctcctccgttgactacaaccctcgcgacaaccagctgtacgtctggaacaactatttcgtggtgcgctacagcctggagttcgggccgcccgaccccagtgctggcccagccacttccccacccctcagcacgaccaccacagccaggcccacgcccctcaccagcacagcctcgcccgcagccaccaccccgctccgccgggcacccctcaccacgcacccagtgggtgccatcaaccagctgggacctgatctgcctccagccacagccccagtccccagcacccggcggcccccagccccgaatctacacgtgtcccctgagctcttctgcgagccccgagaggtacggcgggtccagtggccggccacccagcagggcatgctggtggagaggccctgccccaaggggactcgaggaattgcctccttccagtgtctaccagccttggggctctggaacccccggggccctgacctcagcaactgcacctccccctgggtcaaccaggtggcccagaagatcaagagtggggagaacgcggccaacatcgccagcgagctggcccgacacacccggggctccatctacgcgggggacgtctcctcctctgtgaagctgatggagcagctgctggacatcctggatgcccagctgcaggccctgcggcccatcgagcgcgagtcagccggcaagaactacaacaagatgcacaagcgagagagaacttgtaaggattatatcaaggccgtggtggagacagtggacaatctgctccggccagaagctctggagtcctggaaggacatgaatgccacggagcaggtgcacacggccaccatgctcctcgacgtcctggaggagggcgccttcctgctggccgacaatgtcagggagcctgcccgcttcctggctgccaaggagaacgtggtcctggaggtcacagtcctgaacacagagggccaggtgcaggagctggtgttcccccaggaggagtacccgagaaagaactccatccagctgtctgccaaaaccatcaagcagaacagccgcaatggggtggtcaaagttgtcttcatcctctacaacaacctgggcctcttcctgtccacggagaatgccacagtgaagctggccggcgaagcaggcccgggtggccctgggggcgcctctctagtggtgaactcacaggtcatcgcagcatccatcaacaaggagtccagccgcgtcttcctcatggaccctgtcatcttcaccgtggcccacctggaggacaagaaccacttcaatgctaactgctccttctggaactactcggagcgttccatgctgggctactggtcgacccaaggctgccgcctggtggagtccaacaagacccataccacgtgtgcctgcagccacctcaccaacttcgctgtgctcatggctcaccgtgagatctaccagggccgcatcaacgagctgctgctgtcggtcatcacctgggtgggcattgtgatctccctggtctgcttggccatctgcatctccaccttctgcttcctgcgggggctgcagaccgaccgcaacaccatccacaagaacctgtgcatcaacctcttcctggctgagctgctcttcctggtcgggatcgacaagactcagtatgagattgcctgccccatcttcgccggcctgctgcactatttcttcctggctgccttctcctggctgtgcctggagggcgtgcacctctacctgctactagtggaggtgtttgagagcgagtattcccgcaccaagtactactacctgggtggctactgcttcccggccctggtggtgggcatcgcggctgccattgactaccgcagctacggcaccgagaaggcctgctggctccgagtggacaattacttcatctggagtttcatcgggccagtctccttcgttatcgtggtcaacctggtgttcctcatggtgaccctgcacaagatgatccgaagctcatctgtgctcaagcccgactccagccgcctggacaacattaaatcctgggcgctgggggccatcgcgctgctgttcctgctgggcctcacctgggctttcggcctcctcttcatcaacaaggagtcggtggtcatggcctatctcttcaccaccttcaacgccttccagggggtcttcatcttcgtctttcactgcgccttacagaagaaggtgcacaaggagtacagcaagtgcctgcgtcactcctactgctgcatccgctccccacccgggggcactcacggatccctcaagacctcagccatgcgaagcaacacccgctactacacagggacccagagccgaattcggaggatgtggaatgacactgtgaggaaacagacggagtcctccttcatggcgggtgacatcaacagcacccccaccctgaaccgaggtaccatggggaaccacctgctgaccaaccccgtgctgcagccccgtgggggcaccagtccctacaacaccctcatcgccgagtcagtgggcttcaatccctcctcgccccctgtcttcaactccccacaccccttgggaggccgggaagcctgtggcatggacaccctgcccctgaacggcaacttcaataacagttactccttgcgaagtggggatttccctcccggggatgggggccctgagccgccccgaggccggaacctagccgatgcggcggcctttgagaagatgatcatctcagagctggtgcacaacaacctgcgggggagcagcagcgcggccaagggccctccaccgcctgagccccctgtgccacctgtgccagggggcgggggcgaggaagaggcgggcgggcccgggggtgctgaccgggccgagattgaacttctctataaggccctggaggagcctctgctgctgccccgggcccagtcggtgctgtaccagagcgatctggacgagtcggagagctgcacggccgaggacggcgccaccagccggcccctctcctcccctcctggccgggactccctctatgccagcggggccaacctgcgggactcaccctcctacccggacagcagccctgaggggcccagtgaggccctgcccccaccccctcccgcaccccccggcccccccgaaatctactacacctcgcgcccgccagccctggtggcccggaatcccctgcagggctactaccaggtgcggcgtcctagccacgagggctacctggcagccccaggccttgaggggccagggcccgatggggacgggcagatgcagctggtcaccagtctctgagggcacctcatggaccaggggctggtggcccaggccagggagggaaccctgggcagggctctggtgggagagggagacagatggaggcagtggctggtgggccactctctccaggtgcccctcagccatgggccctacagtcccctcaggggactctaacctgggggcctgaggtgccagggttcacagacagggtttcccaccagccacacgcaccagctctatttgggggaagtgtagtgaggaggagcccagaggaccccaggggagtgaggagggagaacttggaagggtgcagcccacttccagactctcccctctcccacccttctaccctgtgaagggaaatgagggctttagtttcctgggcagggaggggcagcttctgaggttgccaaaggcccccactggatggaacctgttagctgctcctctccgcagccagaaatgctgccggctgcacccagagggagcagtgaggcaggacagatggacaggttcctcctgcgctgtaattccctgctccctggagactgggaaaaggccgcagggcagggggactgggcggtggtggctggtggtttaaaggttgaactttctctgaagctcctttccccttgctcttggtccctgccccgcaagcaaacctgccccctctgcctcccagtgcacccaatgaccccctcccttggggcgactcctgatgaagcacaactccccgcagggcccccagcccacaggggtggccatatttgggcagttcccagtcctgtgggctcggctatctggggagcagattttgggtctggatctccctggggagtgggtcctgggcttggatctttccctagggggccctcttactccttcctctctcctcctccttccccattgctgtaaatatttcaacgaaatggaaaagaaaaaaaaagacaaaaaaaaaaaaaaagaaaagaaaaaaatctcatcacttgaagccaccgggagcctgcggcccgggccagcccgggctttctccggagcagagcagcgctgctggcctggcagccaggacttctccgtgtacgtgcatccccagtccccgccggggcgggcgggccgccagagcagctntttacaatccagagacagaaaacaaaatctagatgcaacagcgaaacaaagaacccatttccttcctggcacccgtttctgtcccctcctttcctgctccgcctgcccggcatcatcagcccttctggggcgtgtacctctcactgcctgccccaggaccagaggcctgtctcccccttccctccccaccggcccgggggagacctcttcacacccaaagatgctttgtcaagatggctgcgctgtccctttgagttcctgcttcttgtatattgctctggggactctcgccggggaagatggggctgatttcccacctagagaggttgatggcagaaggaaaatggggaggcactggggttgtggagggcatgggtatggctgaggagggtgctgggaacggcaaggcggtctgggggatggggaggggcaaaggtgagagatcaccttccctatcctccaccttcccgcagggaagacgaagccaggtgccagggctggggtcgggacacccatgttctgggcggcttgaccccaaatcccagaccccggaagctccaggctcgggatgtgtcctgagcacctgtcccggccccctcctctccagcctgtcaggccagcctccccagcccccttccctcaactctaggggcagcatagccccaggccaccctagcccagcccctgcattgccgtttccccagaggtggcccctccacctctgctctgacctctccccatctctctgcccctccttttctcacaagtgccatgagttttcaaacatcttcgggtctcagcctgctgctgccatgaactttgttgggttaagggggaggggctctaggaaggaactggggggaaggggacaggtaggtggctggagggaccctttttgctgctagaaagcccctcccttctcccggggagctggggctggcttgtccccatcaattaggggagaaggggtcagaccaaagatggtggtttgtcccgtgtaagggaacaggtgtggggaagaggtggggttgggttccaactctggctttttctggtagaaaggcctaacccattacaccagaagaccatgggtgaagtctagatggggaggagaagtgaggccagggacagtcttgccagacgactctgaggagggcaagggacagttccatggcccttcccggactgcactaggctgggagctctgttgtgtggaggggtggtcagaggtctgtgaagagcgggcaggaggcatgagcaggcgaggagctggcctgtcccgggaagcagcccagcctgtggctgcccccgacaccaggaggagggccaggagagttccagggggctgaggcacacagagaggccaacttcctccctgcccagccttccttgtatctctccagactcggacaatcaaagggagagagggtgtatcgggtcctgttccagccggcatcgccgggtggcttccaggcctcagagctgtgtggcagggccccctgctggggctggacatcactgcagtccagtgcaaagccgcccccagagcccaggtgtccccccaacctaaccagacctggtgccttgacgcccccaccccagctgggacggtacagagaagggtcttggtttcctctcctactcccttccttaggctcctgaactcgtttgctcctaaatcttgttaattctttttctctggattttggtttcttttggctttcccttgccttcccctttctctgtctccaacactctttccccatgtctttctggctgtctctatgttcctcttctcttatcctcaactttctgtccattcgggcctcctccccacctcccacgccccagcccctccctccttggtctccttttcgatatgccaaaccaattttgggtcgagtgcatttaacgagaacaaaacaaaaggctcataacaacaagaacgtttcagaaaaaaacaaaaagttttaaaaaaattgttgagtcaaaaagtcaaacaataaagaaattaagatttcttggaaaaaaaaaa

SEQ ID NO: 356274 - DNA, 7230 bp, Homo sapiens
  misc_feature (5195)..(5195): n is a, c, g, or t
gggtttggccctggacggccttgcctttcccgccaaacccggtttaagggaactcctcaaatgctgtgggctccttttccccatgggtatatatcggcggatccctttttttttttttttcctaatttttggtcggcggcggtgctgggccaggggaaggaagggacacggaggccgccctcgtcccgccacctcctacccgcttccccccagccccggctccgggagatgtgccgggcggggggcccgggttcgccgagccgcaggagagacacgctgggccgaccccagagaggcgctggacaggctggtggtccaggccgtggtgcctgccaggtgatgtggggcaaagccccccgcacaggccactgagagctccggacacgcacccggctgccaccatggcccgcctagccgcagtgctctggaatctgtgtgtcaccgccgtcctggtcacctcggccacccaaggcctgagccgggccgggctcccgttcgggctgatgcgccgggagctggcgtgtgaaggctaccccatcgagctgcggtgccccggcagcgacgtcatcatggtggagaatgccaactacgggcgcacggacgacaagatttgcgatgctgaccctttccagatggagaatgtgcagtgctacctgccggacgccttcaagatcatgtcacagaggtgtaacaaccgcacccagtgcgtggtggtcgccggctcggatgcctttcctgacccctgtcctgggacctacaagtacctggaggtgcagtacgactgtgtcccctacaaagtggagcagaaagggattgggggggtggggcggggccccccacctttctgacatcagcgctgccttggtccctcttcccgagccggggatggtcgcagagtcttcgtgtgcccagggaccctgcagaaggtgctggagcccacctcgacacacgagtcagagcaccagtctggcgcatggtgcaaggacccgctgcaggcgggtgaccgcatctacgtgatgccctggatcccctaccgcacggacacactgactgagtatgcctcgtgggaggactacgtggccgcccgccacaccaccacctaccgcctgcccaaccgcgtggatggcacaggctttgtggtctacgatggtgccgtcttctacaacaaggagcgcacgcgcaacatcgtcaagtatgacctacggacgcgcatcaagagcggggagacggtcatcaataccgccaactaccatgacacctcgccctaccgctggggcggaaagaccgacattgacctggcggtggacgagaacgggctgtgggtcatctacgccactgagggcaacaacgggcggctggtggtgagccagctgaacccctacacactgcgctttgagggcacgtgggagacgggttacgacaagcgctcggcatccaacgccttcatggtgtgtggggtcctgtacgtcctgcgttccgtgtacgtggatgatgacagcgaggcggctggcaaccgcgtggactatgccttcaacaccaatgccaaccgcgaggagcctgtcagcctcaccttccccaacccctaccagttcatctcctccgttgactacaaccctcgcgacaaccagctgtacgtctggaacaactatttcgtggtgcgctacagcctggagttcgggccgcccgaccccagtgctggcccagccacttccccacccctcagcacgaccaccacagccaggcccacgcccctcaccagcacagcctcgcccgcagccaccaccccgctccgccgggcacccctcaccacgcacccagtgggtgccatcaaccagctgggacctgatctgcctccagccacagccccagtccccagcacccggcggcccccagccccgaatctacacgtgtcccctgagctcttctgcgagccccgagaggtacggcgggtccagtggccggccacccagcagggcatgctggtggagaggccctgccccaaggggactcgaggaattgcctccttccagtgtctaccagccttggggctctggaacccccggggccctgacctcagcaactgcacctccccctgggtcaaccaggtggcccagaagatcaagagtggggagaacgcggccaacatcgccagcgagctggcccgacacacccggggctccatctacgcgggggacgtctcctcctctgtgaagctgatggagcagctgctggacatcctggatgcccagctgcaggccctgcggcccatcgagcgcgagtcagccggcaagaactacaacaagatgcacaagcgagagagaacttgtaaggattatatcaaggccgtggtggagacagtggacaatctgctccggccagaagctctggagtcctggaaggacatgaatgccacggagcaggtgcacacggccaccatgctcctcgacgtcctggaggagggcgccttcctgctggccgacaatgtcagggagcctgcccgcttcctggctgccaaggagaacgtggtcctggaggtcacagtcctgaacacagagggccaggtgcaggagctggtgttcccccaggaggagtacccgagaaagaactccatccagctgtctgccaaaaccatcaagcagaacagccgcaatggggtggtcaaagttgtcttcatcctctacaacaacctgggcctcttcctgtccacggagaatgccacagtgaagctggccggcgaagcaggcccgggtggccctgggggcgcctctctagtggtgaactcacaggtcatcgcagcatccatcaacaaggagtccagccgcgtcttcctcatggaccctgtcatcttcaccgtggcccacctggaggacaagaaccacttcaatgctaactgctccttctggaactactcggagcgttccatgctgggctactggtcgacccaaggctgccgcctggtggagtccaacaagacccataccacgtgtgcctgcagccacctcaccaacttcgctgtgctcatggctcaccgtgagatctaccagggccgcatcaacgagctgctgctgtcggtcatcacctgggtgggcattgtgatctccctggtctgcttggccatctgcatctccaccttctgcttcctgcgggggctgcagaccgaccgcaacaccatccacaagaacctgtgcatcaacctcttcctggctgagctgctcttcctggtcgggatcgacaagactcagtatgagattgcctgccccatcttcgccggcctgctgcactatttcttcctggctgccttctcctggctgtgcctggagggcgtgcacctctacctgctactagtggaggtgtttgagagcgagtattcccgcaccaagtactactacctgggtggctactgcttcccggccctggtggtgggcatcgcggctgccattgactaccgcagctacggcaccgagaaggcctgctggctccgagtggacaattacttcatctggagtttcatcgggccagtctccttcgttatcgtggtcaacctggtgttcctcatggtgaccctgcacaagatgatccgaagctcatctgtgctcaagcccgactccagccgcctggacaacattaaatcctgggcgctgggggccatcgcgctgctgttcctgctgggcctcacctgggctttcggcctcctcttcatcaacaaggagtcggtggtcatggcctatctcttcaccaccttcaacgccttccagggggtcttcatcttcgtctttcactgcgccttacagaagaaggtgcacaaggagtacagcaagtgcctgcgtcactcctactgctgcatccgctccccacccgggggcactcacggatccctcaagacctcagccatgcgaagcaacacccgctactacacagggacccagtacacctcgcgcccgccagccctggtggcccggaatcccctgcagggctactaccaggtgcggcgtcctagccacgagggctacctggcagccccaggccttgaggggccagggcccgatggggacgggcagatgcagctggtcaccagtctctgagggcacctcatggaccaggggctggtggcccaggccagggagggaaccctgggcagggctctggtgggagagggagacagatggaggcagtggctggtgggccactctctccaggtgcccctcagccatgggccctacagtcccctcaggggactctaacctgggggcctgaggtgccagggttcacagacagggtttcccaccagccacacgcaccagctctatttgggggaagtgtagtgaggaggagcccagaggaccccaggggagtgaggagggagaacttggaagggtgcagcccacttccagactctcccctctcccacccttctaccctgtgaagggaaatgagggctttagtttcctgggcagggaggggcagcttctgaggttgccaaaggcccccactggatggaacctgttagctgctcctctccgcagccagaaatgctgccggctgcacccagagggagcagtgaggcaggacagatggacaggttcctcctgcgctgtaattccctgctccctggagactgggaaaaggccgcagggcagggggactgggcggtggtggctggtggtttaaaggttgaactttctctgaagctcctttccccttgctcttggtccctgccccgcaagcaaacctgccccctctgcctcccagtgcacccaatgaccccctcccttggggcgactcctgatgaagcacaactccccgcagggcccccagcccacaggggtggccatatttgggcagttcccagtcctgtgggctcggctatctggggagcagattttgggtctggatctccctggggagtgggtcctgggcttggatctttccctagggggccctcttactccttcctctctcctcctccttccccattgctgtaaatatttcaacgaaatggaaaagaaaaaaaaagacaaaaaaaaaaaaaaagaaaagaaaaaaatctcatcacttgaagccaccgggagcctgcggcccgggccagcccgggctttctccggagcagagcagcgctgctggcctggcagccaggacttctccgtgtacgtgcatccccagtccccgccggggcgggcgggccgccagagcagctntttacaatccagagacagaaaacaaaatctagatgcaacagcgaaacaaagaacccatttccttcctggcacccgtttctgtcccctcctttcctgctccgcctgcccggcatcatcagcccttctggggcgtgtacctctcactgcctgccccaggaccagaggcctgtctcccccttccctccccaccggcccgggggagacctcttcacacccaaagatgctttgtcaagatggctgcgctgtccctttgagttcctgcttcttgtatattgctctggggactctcgccggggaagatggggctgatttcccacctagagaggttgatggcagaaggaaaatggggaggcactggggttgtggagggcatgggtatggctgaggagggtgctgggaacggcaaggcggtctgggggatggggaggggcaaaggtgagagatcaccttccctatcctccaccttcccgcagggaagacgaagccaggtgccagggctggggtcgggacacccatgttctgggcggcttgaccccaaatcccagaccccggaagctccaggctcgggatgtgtcctgagcacctgtcccggccccctcctctccagcctgtcaggccagcctccccagcccccttccctcaactctaggggcagcatagccccaggccaccctagcccagcccctgcattgccgtttccccagaggtggcccctccacctctgctctgacctctccccatctctctgcccctccttttctcacaagtgccatgagttttcaaacatcttcgggtctcagcctgctgctgccatgaactttgttgggttaagggggaggggctctaggaaggaactggggggaaggggacaggtaggtggctggagggaccctttttgctgctagaaagcccctcccttctcccggggagctggggctggcttgtccccatcaattaggggagaaggggtcagaccaaagatggtggtttgtcccgtgtaagggaacaggtgtggggaagaggtggggttgggttccaactctggctttttctggtagaaaggcctaacccattacaccagaagaccatgggtgaagtctagatggggaggagaagtgaggccagggacagtcttgccagacgactctgaggagggcaagggacagttccatggcccttcccggactgcactaggctgggagctctgttgtgtggaggggtggtcagaggtctgtgaagagcgggcaggaggcatgagcaggcgaggagctggcctgtcccgggaagcagcccagcctgtggctgcccccgacaccaggaggagggccaggagagttccagggggctgaggcacacagagaggccaacttcctccctgcccagccttccttgtatctctccagactcggacaatcaaagggagagagggtgtatcgggtcctgttccagccggcatcgccgggtggcttccaggcctcagagctgtgtggcagggccccctgctggggctggacatcactgcagtccagtgcaaagccgcccccagagcccaggtgtccccccaacctaaccagacctggtgccttgacgcccccaccccagctgggacggtacagagaagggtcttggtttcctctcctactcccttccttaggctcctgaactcgtttgctcctaaatcttgttaattctttttctctggattttggtttcttttggctttcccttgccttcccctttctctgtctccaacactctttccccatgtctttctggctgtctctatgttcctcttctcttatcctcaactttctgtccattcgggcctcctccccacctcccacgccccagcccctccctccttggtctccttttcgatatgccaaaccaattttgggtcgagtgcatttaacgagaacaaaacaaaaggctcataacaacaagaacgtttcagaaaaaaacaaaaagttttaaaaaaattgttgagtcaaaaagtcaaacaataaagaaattaagatttcttggaaaaaaaaaa

SEQ ID NO: 356275 - DNA, 7655 bp, Homo sapiens
  misc_feature (5620)..(5620): n is a, c, g, or t
gggtttggccctggacggccttgcctttcccgccaaacccggtttaagggaactcctcaaatgctgtgggctccttttccccatgggtatatatcggcggatccctttttttttttttttcctaatttttggtcggcggcggtgctgggccaggggaaggaagggacacggaggccgccctcgtcccgccacctcctacccgcttccccccagccccggctccgggagatgtgccgggcggggggcccgggttcgccgagccgcaggagagacacgctgggccgaccccagagaggcgctggacaggctggtggtccaggccgtggtgcctgccaggtgatgtggggcaaagccccccgcacaggccactgagagctccggacacgcacccggctgccaccatggcccgcctagccgcagtgctctggaatctgtgtgtcaccgccgtcctggtcacctcggccacccaaggcctgagccgggccgggctcccgttcgggctgatgcgccgggagctggcgtgtgaaggctaccccatcgagctgcggtgccccggcagcgacgtcatcatggtggagaatgccaactacgggcgcacggacgacaagatttgcgatgctgaccctttccagatggagaatgtgcagtgctacctgccggacgccttcaagatcatgtcacagaggtgtaacaaccgcacccagtgcgtggtggtcgccggctcggatgcctttcctgacccctgtcctgggacctacaagtacctggaggtgcagtacgactgtgtcccctacaaagtggagcagaaagggattgggggggtggggcggggccccccacctttctgacatcagcgctgccttggtccctcttcccgagccggggatggtcgcagagtcttcgtgtgcccagggaccctgcagaaggtgctggagcccacctcgacacacgagtcagagcaccagtctggcgcatggtgcaaggacccgctgcaggcgggtgaccgcatctacgtgatgccctggatcccctaccgcacggacacactgactgagtatgcctcgtgggaggactacgtggccgcccgccacaccaccacctaccgcctgcccaaccgcgtggatggcacaggctttgtggtctacgatggtgccgtcttctacaacaaggagcgcacgcgcaacatcgtcaagtatgacctacggacgcgcatcaagagcggggagacggtcatcaataccgccaactaccatgacacctcgccctaccgctggggcggaaagaccgacattgacctggcggtggacgagaacgggctgtgggtcatctacgccactgagggcaacaacgggcggctggtggtgagccagctgaacccctacacactgcgctttgagggcacgtgggagacgggttacgacaagcgctcggcatccaacgccttcatggtgtgtggggtcctgtacgtcctgcgttccgtgtacgtggatgatgacagcgaggcggctggcaaccgcgtggactatgccttcaacaccaatgccaaccgcgaggagcctgtcagcctcaccttccccaacccctaccagttcatctcctccgttgactacaaccctcgcgacaaccagctgtacgtctggaacaactatttcgtggtgcgctacagcctggagttcgggccgcccgaccccagtgctggcccagccacttccccacccctcagcacgaccaccacagccaggcccacgcccctcaccagcacagcctcgcccgcagccaccaccccgctccgccgggcacccctcaccacgcacccagtgggtgccatcaaccagctgggacctgatctgcctccagccacagccccagtccccagcacccggcggcccccagccccgaatctacacgtgtcccctgagctcttctgcgagccccgagaggtacggcgggtccagtggccggccacccagcagggcatgctggtggagaggccctgccccaaggggactcgaggaattgcctccttccagtgtctaccagccttggggctctggaacccccggggccctgacctcagcaactgcacctccccctgggtcaaccaggtggcccagaagatcaagagtggggagaacgcggccaacatcgccagcgagctggcccgacacacccggggctccatctacgcgggggacgtctcctcctctgtgaagctgatggagcagctgctggacatcctggatgcccagctgcaggccctgcggcccatcgagcgcgagtcagccggcaagaactacaacaagatgcacaagcgagagagaacttgtaaggattatatcaaggccgtggtggagacagtggacaatctgctccggccagaagctctggagtcctggaaggacatgaatgccacggagcaggtgcacacggccaccatgctcctcgacgtcctggaggagggcgccttcctgctggccgacaatgtcagggagcctgcccgcttcctggctgccaaggagaacgtggtcctggaggtcacagtcctgaacacagagggccaggtgcaggagctggtgttcccccaggaggagtacccgagaaagaactccatccagctgtctgccaaaaccatcaagcagaacagccgcaatggggtggtcaaagttgtcttcatcctctacaacaacctgggcctcttcctgtccacggagaatgccacagtgaagctggccggcgaagcaggcccgggtggccctgggggcgcctctctagtggtgaactcacaggtcatcgcagcatccatcaacaaggagtccagccgcgtcttcctcatggaccctgtcatcttcaccgtggcccacctggaggacaagaaccacttcaatgctaactgctccttctggaactactcggagcgttccatgctgggctactggtcgacccaaggctgccgcctggtggagtccaacaagacccataccacgtgtgcctgcagccacctcaccaacttcgctgtgctcatggctcaccgtgagatctaccagggccgcatcaacgagctgctgctgtcggtcatcacctgggtgggcattgtgatctccctggtctgcttggccatctgcatctccaccttctgcttcctgcgggggctgcagaccgaccgcaacaccatccacaagaacctgtgcatcaacctcttcctggctgagctgctcttcctggtcgggatcgacaagactcagtatgagattgcctgccccatcttcgccggcctgctgcactatttcttcctggctgccttctcctggctgtgcctggagggcgtgcacctctacctgctactagtggaggtgtttgagagcgagtattcccgcaccaagtactactacctgggtggctactgcttcccggccctggtggtgggcatcgcggctgccattgactaccgcagctacggcaccgagaaggcctgctggctccgagtggacaattacttcatctggagtttcatcgggccagtctccttcgttatcgtggtcaacctggtgttcctcatggtgaccctgcacaagatgatccgaagctcatctgtgctcaagcccgactccagccgcctggacaacattaaatcctgggcgctgggggccatcgcgctgctgttcctgctgggcctcacctgggctttcggcctcctcttcatcaacaaggagtcggtggtcatggcctatctcttcaccaccttcaacgccttccagggggtcttcatcttcgtctttcactgcgccttacagaagaaggtgcacaaggagtacagcaagtgcctgcgtcactcctactgctgcatccgctccccacccgggggcactcacggatccctcaagacctcagccatgcgaagcaacacccgctactacacagggacccagagccgaattcggaggatgtggaatgacactgtgaggaaacagacggagtcctccttcatggcgggtgacatcaacagcacccccaccctgaaccgaggtaccatggggaaccacctgctgaccaaccccgtgctgcagccccgtgggggcaccagtccctacaacaccctcatcgccgagtcagtgggcttcaatccctcctcgccccctgtcttcaactccccagggagctaccgggaacccaagcaccccttgggaggccgggaagcctgtggcatggacaccctgcccctgaacggcaacttcaataacagttactccttgcgaagtggggatttccctcccggggatgggggccctgagccgccccgaggccggaacctagccgatgcggcggcctttgagaagatgatcatctcagagctggtgcacaacaacctgcgggggagcagcagcgcggccaagggccctccaccgcctgagccccctgtgccacctgtgccagggggcgggggcgaggaagaggcgggcgggcccgggggtgctgaccgggccgagattgaacttctctataaggccctggaggagcctctgctgctgccccgggcccagtcggtgctgtaccagagcgatctggacgagtcggagagctgcacggccgaggacggcgccaccagccggcccctctcctcccctcctggccgggactccctctatgccagcggggccaacctgcgggactcaccctcctacccggacagcagccctgaggggcccagtgaggccctgcccccaccccctcccgcaccccccggcccccccgaaatctactacacctcgcgcccgccagccctggtggcccggaatcccctgcagggctactaccaggtgcggcgtcctagccacgagggctacctggcagccccaggccttgaggggccagggcccgatggggacgggcagatgcagctggtcaccagtctctgagggcacctcatggaccaggggctggtggcccaggccagggagggaaccctgggcagggctctggtgggagagggagacagatggaggcagtggctggtgggccactctctccaggtgcccctcagccatgggccctacagtcccctcaggggactctaacctgggggcctgaggtgccagggttcacagacagggtttcccaccagccacacgcaccagctctatttgggggaagtgtagtgaggaggagcccagaggaccccaggggagtgaggagggagaacttggaagggtgcagcccacttccagactctgcagggcccccagcccacaggggtggccatatttgggcagttcccagtcctgtgggctcggctatctggggagcagattttgggtctggatctccctggggagtgggtcctgggcttggatctttccctagggggccctcttactccttcctctctcctcctccttccccattgctgtaaatatttcaacgaaatggaaaagaaaaaaaaagacaaaaaaaaaaaaaaagaaaagaaaaaaatctcatcacttgaagccaccgggagcctgcggcccgggccagcccgggctttctccggagcagagcagcgctgctggcctggcagccaggacttctccgtgtacgtgcatccccagtccccgccggggcgggcgggccgccagagcagctntttacaatccagagacagaaaacaaaatctagatgcaacagcgaaacaaagaacccatttccttcctggcacccgtttctgtcccctcctttcctgctccgcctgcccggcatcatcagcccttctggggcgtgtacctctcactgcctgccccaggaccagaggcctgtctcccccttccctccccaccggcccgggggagacctcttcacacccaaagatgctttgtcaagatggctgcgctgtccctttgagttcctgcttcttgtatattgctctggggactctcgccggggaagatggggctgatttcccacctagagaggttgatggcagaaggaaaatggggaggcactggggttgtggagggcatgggtatggctgaggagggtgctgggaacggcaaggcggtctgggggatggggaggggcaaaggtgagagatcaccttccctatcctccaccttcccgcagggaagacgaagccaggtgccagggctggggtcgggacacccatgttctgggcggcttgaccccaaatcccagaccccggaagctccaggctcgggatgtgtcctgagcacctgtcccggccccctcctctccagcctgtcaggccagcctccccagcccccttccctcaactctaggggcagcatagccccaggccaccctagcccagcccctgcattgccgtttccccagaggtggcccctccacctctgctctgacctctccccatctctctgcccctccttttctcacaagtgccatgagttttcaaacatcttcgggtctcagcctgctgctgccatgaactttgttgggttaagggggaggggctctaggaaggaactggggggaaggggacaggtaggtggctggagggaccctttttgctgctagaaagcccctcccttctcccggggagctggggctggcttgtccccatcaattaggggagaaggggtcagaccaaagatggtggtttgtcccgtgtaagggaacaggtgtggggaagaggtggggttgggttccaactctggctttttctggtagaaaggcctaacccattacaccagaagaccatgggtgaagtctagatggggaggagaagtgaggccagggacagtcttgccagacgactctgaggagggcaagggacagttccatggcccttcccggactgcactaggctgggagctctgttgtgtggaggggtggtcagaggtctgtgaagagcgggcaggaggcatgagcaggcgaggagctggcctgtcccgggaagcagcccagcctgtggctgcccccgacaccaggaggagggccaggagagttccagggggctgaggcacacagagaggccaacttcctccctgcccagccttccttgtatctctccagactcggacaatcaaagggagagagggtgtatcgggtcctgttccagccggcatcgccgggtggcttccaggcctcagagctgtgtggcagggccccctgctggggctggacatcactgcagtccagtgcaaagccgcccccagagcccaggtgtccccccaacctaaccagacctggtgccttgacgcccccaccccagctgggacggtacagagaagggtcttggtttcctctcctactcccttccttaggctcctgaactcgtttgctcctaaatcttgttaattctttttctctggattttggtttcttttggctttcccttgccttcccctttctctgtctccaacactctttccccatgtctttctggctgtctctatgttcctcttctcttatcctcaactttctgtccattcgggcctcctccccacctcccacgccccagcccctccctccttggtctccttttcgatatgccaaaccaattttgggtcgagtgcatttaacgagaacaaaacaaaaggctcataacaacaagaacgtttcagaaaaaaacaaaaagttttaaaaaaattgttgagtcaaaaagtcaaacaataaagaaattaagatttcttggaaaaaaaaaa

SEQ ID NO: 356276 - DNA, 1850 bp, Homo sapiens
gggtttggccctggacggccttgcctttcccgccaaacccggtttaagggaactcctcaaatgctgtgggctccttttccccatgggtatatatcggcggatccctttttttttttttttcctaatttttggtcggcggcggtgctgggccaggggaaggaagggacacggaggccgccctcgtcccgccacctcctacccgcttccccccagccccggctccgggagatgtgccgggcggggggcccgggttcgccgagccgcaggagagacacgctgggccgaccccagagaggcgctggacaggctggtggtccaggccgtggtgcctgccaggtgatgtggggcaaagccccccgcacaggccactgagagctccggacacgcacccggctgccaccatggcccgcctagccgcagtgctctggaatctgtgtgtcaccgccgtcctggtcacctcggccacccaaggcctgagccgggccgggctcccgttcgggctgatgcgccgggagctggcgtgtgaaggctaccccatcgagctgcggtgccccggcagcgacgtcatcatggtggagaatgccaactacgggcgcacggacgacaagatttgcgatgctgaccctttccagatggagaatgtgcagtgctacctgccggacgccttcaagatcatgtcacagaggtgtaacaaccgcacccagtgcgtggtggtcgccggctcggatgcctttcctgacccctgtcctgggacctacaagtacctggaggtgcagtacgactgtgtcccctacaaagtggagcagaaagggattgggggggtggggcggggccccccacctttctgacatcagcgctgccttggtccctcttcccgagccggggatggtcgcagagtcttcgtgtgcccagggaccctgcagaaggtgctggagcccacctcgacacacgagtcagagcaccagtctggcgcatggtgcaaggacccgctgcaggcgggtgaccgcatctacgtgatgccctggatcccctaccgcacggacacactgactgagtatgcctcgtgggaggactacgtggccgcccgccacaccaccacctaccgcctgcccaaccgcgtggatggcacaggctttgtggtctacgatggtgccgtcttctacaacaaggagcgcacgcgcaacatcgtcaagtatgacctacggacgcgcatcaagagcggggagacggtcatcaataccgccaactaccatgacacctcgccctaccgctggggcggaaagaccgacattgacctggcggtggacgagaacgggctgtgggtcatctacgccactgagggcaacaacgggcggctggtggtgagccagctgaacccctacacactgcgctttgagggcacgtgggagacgggttacgacaagcgctcggcatccaacgccttcatggtgtgtggggtcctgtacgtcctgcgttccgtgtacgtggatgatgacagcgaggcggctggcaaccgcgtggactatgccttcaacaccaatgccaaccgcgaggagcctgtcagcctcaccttccccaacccctaccagttcatctcctccgttgactacaaccctcgcgacaaccagctgtacgtctggaacaactatttcgtggtgcgctacagcctggagttcgggccgcccgaccccagtgctggtgaggacgactcacttccaggcatggagcctgcttgcctttgtcccctccacccccacccacccctgggtcccagagtggggagccccatcctgtgagctcttggggatcgggaggtaaaggaaattcacagcatgtgacagacgctgttc

SEQ ID NO: 356277 - DNA, 3535 bp, Homo sapiens
tgcgctgaacgcatgcgtgctgtggtcgcctagtaaacggggctgctggtgggccgcgtcgaagacatggaccagggctacggaggctacggggcgtggagtgctggacctgccaacacccagggtgcatatggaactggtgtggccagctggcaaggttatgaaaactacaattactatggcgcccagaacaccagtgtcaccacaggcgcaacctacagctacggcccagcctcgtgggaggccgccaaggccaatgatggcggcctggcggccggggcccctgccatgcacatggcctcttacggcccagagccatgcaccgacaattccgactccctcattgccaagatcaaccagcgtttggacatgatgtccaaggaaggaggcaggggcgggagcggcggcggtggggagggcatacaggaccgggagagctccttccgcttccagccgttcgagtcctatgactccaggccctgcctgccggagcacaacccctaccgccccagctacagctacgactatgagttcgacctggggtccgaccgcaatggcagctttggggggcagtacagtgaatgccgagacccagcccgggagcggggctcccttgatggcttcatgcggggccggggccagggccgcttccaggaccggagcaaccctggcaccttcatgcgcagcgaccccttcgtgccccccgctgcgtcctctgagcccctgtccacgccctggaacgagctgaactacgtgggtggacggggcctgggagggccctcccccagccggccacctccgtccctcttctcccagtccatggctcccgactacggcgtgatgggcatgcagggggcgggcggctatgacagcaccatgccctacggatgtggccgctcgcagcctcggatgcgggatcgggatcggcccaagaggagagggtttgaccgcttcggaccagatggcacgggcaggaaacggaagcagttccaactttacgaggagccagacaccaaactggcccgggttgacagtgaaggagatttctccgaaaatgatgacgcagctggtgacttccgctcaggagatgaagaattcaagggtgaggatgaactctgcgactctgggaggcaaagaggagagaaggaggacgaggacgaggatgtgaagaagagaagggaaaagcaaaggagaagagacaggacgcgggaccgtgcagccgacagaattcagtttgcctgttctgtatgcaagttccgtagctttgatgacgaagagatccagaagcatctgcaaagcaaatttcacaaagagaccctgcggttcataagcaccaagctgcccgacaagaccgtggagttcctccaggaatacattgtaaacagaaataagaaaattgagaagcggcgtcaggaattgatggagaaagaaaccgcaaaaccaaaaccagatcctttcaaagggattggccaggagcacttcttcaagaagatcgaggctgctcactgcctggcctgcgacatgctaattcctgcacagccgcagctcctccagcggcacctgcactccgtggaccacaatcacaaccgcaggttggctgctgaacagttcaagaaaaccagtctccatgtggctaagagtgttttgaacaacagacatatagtgaagatgctggaaaaatacctcaagggtgaggaccctttcaccagtgaaactgttgatccagaaatggaaggagatgacaatttaggaggtgaggataagaaagagacacctgaggaggtggccgcggacgtcttagcagaggtgattacagcagcagtgagggccgtagatggggaaggagcgcccgctccagagagcagcggggagccggctgaggacgaaggccccacggacacagcggaggccggtagtgatcctcaagccgaacagctgctggaagagcaggtgccctgtggaacggcacatgagaagggcgtccccaaggccagaagtgaggctgcagaggctggaaatggcgccgagacaatggcagcagaggcagaaagtgcccaaaccagagttgctcctgccccagctgccgcggatgctgaagtggaacaaactgatgcagagtctaaagacgctgttcccacagaatgatgctcatttccctgttccagggaaggcgttgggatgatggatgcgttggtctttctcccttggtttgtaagcagtacaagggcgtgtgctcccagaatatgctgtaatctaattttggtgaagagacccagcgtttcctcctgagcagtgcctctcacggcttgtctcatgcagtcgtgtggcttcttgcccaggtttcaaagctgaagtacattgtccttagcggctgtaacatgtctcttgacagtagtgcacttggaataataaaggttgggtgattatatcttgatgatacattacttgttcaatacagccactgatggaatgcttccttttttatttttttccttaatttttttttttatttggttgggaacagctgaatactaggaatatatcttgctctatagaggatttttttttgtatgtttcaagcttcagcctttaacctatacctttgtagtgcaccatatggtgtgtgactttcacaggacttcgcagcacctggttcacatgtggcactgaccgcgtcacatccacgcactcccaaaggccagaagtatctgaccgacctacgccactggaaacacacccaccgcaacctcaagaaccagactgtgcagagggcattgcgtcccaatctttagtccttgctgaatcagttctctaatattttacctcatttgtgttccacctctagattacttcaggtttttttcctttaaaattagttactaccactcaaatgtatttacaaagagaatttggccaggcacggtgatgcatacctataatcccagcacttggggaggccgtggtgagaggatagcttaagcccaggagttcaagaccaacctggacaacatagcaagaccccatctcttaaaaaaaaaggaaagaaaacttgatgtgattgccataggtggaataatccaacataaattgccatagatagaaggtatctgtaatatatatatatatataaaatgaaatatatgtttcattttagagaaataactattactttagatctttccaaatctgagaaagggaggctagcatgtgttcaaggttagcacgcaacagaatttcctaaaatcagaagaattggaagatcctccccttttgaaatggccctgctgtgtcagtttccctgtggccttttgaactgtacatctcacatgttgggaaacgctggccactgggaaatcattagaaaggaggctgtagaatatttgccgagcctctactgtataccaggggctaactcaccaagcacattctaggaattgggccctgctcatgaggagccttagtggagattccaggtgaatatttatgaaaaagtcaacattagaactgaaaatggaaataaactgcttgaaaagac

SEQ ID NO: 356278 - DNA, 2428 bp, Homo sapiens
tgcgctgaacgcatgcgtgctgtggtcgcctagtaaacggggctgctggtgggccgcgtcgaagacatggaccagggctacggaggctacggggcgtggagtgctggacctgccaacacccagggtgcatatggaactggtgtggccagctggcaaggttatgaaaactacaattactatggcgcccagaacaccagtgtcaccacaggcgcaacctacagctacggcccagcctcgtgggaggccgccaaggccaatgatggcggcctggcggccggggcccctgccatgcacatggcctcttacggcccagagccatgcaccgacaattccgactccctcattgccaagatcaaccagcgtttggacatgatgtccaaggaaggaggcaggggcgggagcggcggcggtggggagggcatacaggaccgggagagctccttccgcttccagccgttcgagtcctatgactccaggccctgcctgccggagcacaacccctaccgccccagctacagctacgactatgagttcgacctggggtccgaccgcaatggcagctttggggggcagtacagtgaatgccgagacccagcccgggagcggggctcccttgatggcttcatgcggggccggggccagggccgcttccaggaccggagcaaccctggcaccttcatgcgcagcgaccccttcgtgccccccgctgcgtcctctgagcccctgtccacgccctggaacgagctgaactacgtgggtggacggggcctgggagggccctcccccagccggccacctccgtccctcttctcccagtccatggctcccgactacggcgtgatgggcatgcagggggcgggcggctatgacagcaccatgccctacggatgtggccgctcgcagcctcggatgcgggatcgggatcggcccaagaggagagggtttgaccgcttcggaccagatggcacgggcaggaaacggaagcagttccaactttacgaggagccagacaccaaactggcccgggttgacagtgaaggagatttctccgaaaatgatgacgcagctggtgacttccgctcaggagatgaagaattcaagggtgaggatgaactctgcgactctgggaggcaaagaggagagaaggaggacgaggacgaggatgtgaagaagagaagggaaaagcaaaggagaagagacaggacgcgggaccgtgcagccgacagaattcagtttgcctgttctgtatgcaagttccgtagctttgatgacgaagagatccagaagcatctgcaaagcaaatttcacaaagagaccctgcggttcataagcaccaagctgcccgacaagaccgtggagttcctccaggaatacattgtaaacagaaataagaaaattgagaagcggcgtcaggaattgatggagaaagaaaccgcaaaaccaaaaccagatcctttcaaagggattggccaggagcacttcttcaagaagatcgaggctgctcactgcctggcctgcgacatgctaattcctgcacagccgcagctcctccagcggcacctgcactccgtggaccacaatcacaaccgcaggttggctgctgaacagttcaagaaaaccagtctccatgtggctaagagtgttttgaacaacagacatatagtgaagatgctggaaaaatacctcaagggtgaggaccctttcaccagtgaaactgttgatccagaaatggaaggagatgacaatttaggaggtgaggataagaaagagacacctgaggaggtggccgcggacgtcttagcagaggtgattacagcagcagtgagggccgtagatggggaaggagcgcccgctccagagagcagcggggagccggctgaggacgaaggccccacggacacagcggaggccggtagtgatcctcaagccgaacagctgctggaagagcaggtgccctgtggaacggcacatgagaagggcgtccccaaggccagaagtgaggctgcagaggctggaaatggcgccgagacaatggcagcagaggcagaaagtgcccaaaccagagttgctcctgccccagctgccgcggatgctgaagtggaacaaactgatgcagagtctaaagacgctgttcccacagaatgatgctcatttccctgttccagggaaggcgttgggatgatggatgcgttggtctttctcccttggtttgtaagcagtacaagggcgtgtgctcccagaatatgctgtaatctaattttggtgaagagacccagcgtttcctcctgagcagtgcctctcacggcttgtctcatgcagtcgtgtggcttcttgcccaggtttcaaagctgaagtacattgtccttagcggctgtaacatgtctcttgacagtagtgcacttggaataataaaggttgggtgattata

SEQ ID NO: 356279 - DNA, 345 bp, Homo sapiens
cgcagcctcggatgcgggatcgggatcgggtaagccctcgcaaggttccttccggccgccttcgcttctctttttagcagctttattgaggtaaaatttccccatctcaacattcacttaaatgtttttaagtgcgcagttcgacttttagttaatttacaggattgtgcaaccatccccaccatcacagtctaatcttagcatttatgtcaaccagaagagaaacttcttctcattagtcacccctgtctcttccccgcccccaccagcccccgacaaccaccactggtctctggatttgtgtgttctagacattttgcacaaatggagtcgcgaaacgtgtgg

SEQ ID NO: 356280 - DNA, 781 bp, Homo sapiens
tgggggcgcgcggaagtagtgacgtgtgcgcctggtcttccagtagtcgatggcggaggtgcgctgaacgcatgcgtgctgtggtcgcctagtaaacggggctgctggtgggccgcgtcgaagacatggaccagggctacggaggtttgtgttggctgctgggtgcggagcggggagggaaggctctgtgcgggcgacgcagccgctgcgcagactgccgccggccgggccttcgtcccgagcgtggttgccccagctgggccctccggagaggcggccagggcgcgcgcgcgccgctcattgggctttggcgccgtcgctcccggggctctgcgtgcggattggccgccaggccccgaggaggcgggcgggactcggggttggggcagacgccgcggtgggcttcgtgggggcgtcttagacagtgtgggccgtttttgcccctcaccttcggcggagtccttccggcccccagcgaccccggggtttgcactcccggcttcctcttccgaagacgccacaaaatggcggcgctaggggggcggagctacagcgtggggttgtgaggtcggacccggggagctgggtctggggccgcgggcggaccgcgggggccgcctctctcccgacctgccctaggcccgcggggccgtgtagggtctccgctgggctcacgtggcccagggcgcctgtcccggaagccgtcgggctgcgcggggtcgggcctttagtccccggtgcagcgcggtggggccgagtgctgccggcgcgagagtcagcc

SEQ ID NO: 356281 - DNA, 1421 bp, Homo sapiens
tgcgctgaacgcatgcgtgctgtggtcgcctagtaaacggggctgctggtgggccgcgtcgaagacatggaccagggctacggaggctacggggcgtggagtgctggacctgccaacacccagggtgcatatggaactggtgtggccagctggcaaggttatgaaaactacaattactatggcgcccagaacaccagtgtcaccacaggcgcaacctacagctacggcccagcctcgtgggaggccgccaaggccaatgatggcggcctggcggccggggcccctgccatgcacatggcctcttacggcccagagccatgcaccgacaattccgactccctcattgccaagatcaaccagcgtttggacatgatgtccaaggaaggaggcaggggcgggagcggcggcggtggggagggcatacaggaccgggagagctccttccgcttccagccgttcgagtcctatgactccaggccctgcctgccggagcacaacccctaccgccccagctacagctacgactatgagttcgacctggggtccgaccgcaatggcagctttggggggcagtacagtgaatgccgagacccagcccgggagcggggctcccttgatggcttcatgcggggccggggccagggccgcttccaggaccggagcaaccctggcaccttcatgcgcagcgaccccttcgtgccccccgctgcgtcctctgagcccctgtccacgccctggaacgagctgaactacgtgggtggacggggcctgggagggccctcccccagccggccacctccgtccctcttctcccagtccatggctcccgactacggcgtgatgggcatgcagggggcgggcggctatgacagcaccatgccctacggatgtggccgctcgcagcctcggatgcgggatcgggatcggcccaagaggagagggtttgaccgcttcggaccagatggcacgggcaggaaacggaagcagttccaactttacgaggagccagacaccaaactggcccgggttgacagtgaaggagatttctccgaaaatgatgacgcagctggtgacttccgctcaggagatgaagaattcaagggtgaggatgaactctgcgactctgggaggcaaagaggagagaaggaggacgaggacgaggatgtgaagaagagaagggaaaagcaaaggagaagagacaggacgcgggaccgtgcagccgacagaattcagtttgcctgttctgtatgcaagttccgtagctttgatgacgaagagatccagaagcatctgcaaagcaaatttcacaaagagaccctgcggttcataagcaccaagctgcccgacaagaccgtggagttcctccaggatacattgtaaacagaaataagaaattgagacggctccacgctgccagtggc

SEQ ID NO: 356282 - DNA, 2717 bp, Homo sapiens
  misc_feature (189)..(189): n is a, c, g, or t
tggaagagatcacagggagtccagaaacgcctgtcatcccaagcttatgctgtttttctaaaagctctttatgggggcttgatattgggttggtggtctttgtccagaaatatgaagggacaaaggcgggccataaccctcccttctagagtccaggagcttcccctgccactgccacaacccccgatnccaccacagccatcgccactgccacctgcctcccgctgaatcttggctcttgtcttctctttccagcccaggtgaagcctctgggcttcctgaagcccttctccttgatgaaggcttccagccgcttcaaggcacaccaggatgcactgccacggctgcccgtgccccctctccagcagtccctggaccactacctgaaggcgctgcagcccatcgtgagtgaggaggagtgggcccacaccaagcagctggtggatgagtttcaggcctcaggaggtgtaggggagcgcctgcagaaggggctggagcgtcgggccaggaagacggagaactggctgtctgagtggtggctcaagaccgcctacctccagtaccgccagcctgtggtcatctactcgagcccaggcgtgatgctacccaagcaggacttcgtggacctgcagggtcagctccgatttgctgccaaactcattgagggtgtgttggatttcaaggtcatgattgacaacgagaccctgcccgtggagtacctgggggggaagccactgtgcatgaaccagtactatcagatcttgtcctcctgccgagtgccgggccccaagcaggacacagtcagcaacttcagcaagaccaagaagcctcccacgcacatcaccgtggtacacaactaccagttttttgagctggatgtgtaccacagtgacgggacacccctcactgcggatcagatctttgtgcagctggagaagatctggaactcatccctacagaccaacaaggagcctgtgggcatcctcacctccaaccaccgcaactcctgggccaaggcatacaacaccctcatcaaagacaaggtgaaccgggattccgtgcgctccatccagaagagcatcttcaccgtgtgcctagatgcaaccatgcccagggtctcagaagacgtgtaccgcagccacgtggcaggccagatgctgcatgggggcggcagcaggctcaacagcggcaaccgctggttcgacaagacgctgcagttcatcgtggcagaagatggctcctgtgggcttgtgtacgagcatgctgcagcggaggggccccctattgtcacccttctggactatgtcatcgagtacacgaagaaacccgagcttgtgcggtctcccatggtgcccctgcccatgcccaagaagctgcggttcaacatcacccccgagatcaagagcgacatcgagaaggccaagcagaacctcagcatcatgatccaggacctggatatcaccgtgatggtgttccaccattttggaaaagacttccccaagtcggagaagctaagcccagatgccttcatccagatggctttgcagctggcctactacaggatctacggacaggcatgtgccacctatgaaagtgcctccctgcgcatgtttcacctgggccgcaccgacaccatccgctcggcttccatggactcactcacctttgtcaaggccatggatgactccagcgtcacggagcaccagaaggtggagctgctgcggaaggccgtgcaggcccaccgaggctacaccgaccgggccatccgcggggaggcctttgatcgacacctgctgggcctgaagctgcaggccatcgaggacctggtgagcatgcccgacatcttcatggacacctcctacgccatcgccatgcacttccacctctccaccagccaggtccctgccaagacagactgtgtcatgttcttcgggcccgtggtccccgacggctacggtgtctgctataaccccatggaggcccacatcaacttctccctgtcggcctacaacagctgcgcggagaccaacgccgcccgcctggcgcattacctggagaaggcgctcctggacatgcgtgccctgctgcagagccacccccgggccaagctctgagcccctaggactcaggcctgccaatgccacagccaagcccaccctgggatgggccacccaccagggctcagctccttggttccctcttccttggttccctcttccctggtccccccaaatctactgagccacggaccgcatcctccagggggcctgcaggccccagccaagtgccttccgtgggtcatcccagcacctgccagggcccgacctggggctgagtgcagaggctgagcaggacgttaggcccgggcccctggcacgtcctccaccggtgcctcctctggggaagggaaccagccctccagagcaggagactggcaagagctctttgtctcaccagctcagccccggccactccctgccaactccatgaccaggccaccatctgtaccctgcttcccaaactcccaggacctggagacaggattgtctggggccgaggggccagggtgtgaggtttcacctccgttgcggctgtgctcctgtggataacattgctagcgagccgcctctggttccactcagcttggttcctgcccccgccctgctgtatgatattaatgtggaaggtcatcaataaaggggaattgtgttggtgaa

SEQ ID NO: 356283 - DNA, 3342 bp, Homo sapiens
cgccccacagccaacctcccgggcaccgttgcccgcccggggcccgctaccggcccaggccccgcctcgcgagtcctcctccccgggtgcctgcccgcagcccgctcggcccagagggtgggcgcggggctgcctctaccggctggcggctgtaactcagcgaccttggcccgaaggctctagcaaggacccaccgaccccagccgcggcggcggcggcgcggactttgcccggtgtgtggggcggagcggactgcgtgtccgcggacgggcagcgaagatgttagccttcgctgccaggaccgtggtgaagcctctgggcttcctgaagcccttctccttgatgaaggcttccagccgcttcaaggcacaccaggatgcactgccacggctgcccgtgccccctctccagcagtccctggaccactacctgaaggcgctgcagcccatcgtgagtgaggaggagtgggcccacaccaagcagctggtggatgagtttcaggcctcaggaggtgtaggggagcgcctgcagaaggggctggagcgtcgggccaggaagacggagaactggctgtctgagtggtggctcaagaccgcctacctccagtaccgccagcctgtggtcatctactcgagcccaggcgtgatgctacccaagcaggacttcgtggacctgcagggtcagctccgatttgctgccaaactcattgagggtgtgttggatttcaaggtcatgattgacaacgagaccctgcccgtggagtacctgggggggaagccactgtgcatgaaccagtactatcagatcttgtcctcctgccgagtgccgggccccaagcaggacacagtcagcaacttcagcaagaccaagaagcctcccacgcacatcaccgtggtacacaactaccagttttttgagctggatgtgtaccacagtgacgggacacccctcactgcggatcagatctttgtgcagctggagaagatctggaactcatccctacagaccaacaaggagcctgtgggcatcctcacctccaaccaccgcaactcctgggccaaggcatacaacaccctcatcaaagacaaggtgaaccgggattccgtgcgctccatccagaagagcatcttcaccgtgtgcctagatgcaaccatgcccagggtctcagaagacgtgtaccgcagccacgtggcaggccagatgctgcatgggggcggcagcaggctcaacagcggcaaccgctggttcgacaagacgctgcagttcatcgtggcagaagatggctcctgtgggcttgtgtacgagcatgctgcagcggaggggccccctattgtcacccttctggactatgtcatcgagtacacgaagaaacccgagcttgtgcggtctcccatggtgcccctgcccatgcccaagaagctgcggttcaacatcacccccgagatcaagagcgacatcgagaaggccaagcagaacctcagcatcatgatccaggacctggatatcaccgtgatggtgttccaccattttggaaaagacttccccaagtcggagaagctaagcccagatgccttcatccagatggctttgcagctggcctactacaggatctacggacaggcatgtgccacctatgaaagtgcctccctgcgcatgtttcacctgggccgcaccgacaccatccgctcggcttccatggactcactcacctttgtcaaggccatggatgactccagcgtcacggagcaccagaaggtggagctgctgcggaaggccgtgcaggcccaccgaggctacaccgaccgggccatccgcggggaggcctttgatcgacacctgctgggcctgaagctgcaggccatcgaggacctggtgagcatgcccgacatcttcatggacacctcctacgccatcgccatgcacttccacctctccaccagccaggtccctgccaagacagactgtgtcatgttcttcgggcccgtggtccccgacggctacggtgtctgctataaccccatggaggcccacatcaacttctccctgtcggcctacaacagctgcgcggagaccaacgccgcccgcctggcgcattacctggagaaggcgctcctggacatgcgtgccctgctgcagagccacccccgggccaagctctgagcccctaggactcaggcctgccaatgccacagccaagcccaccctgggatgggccacccaccagggctcagctccttggttccctcttccttggttccctcttccctggtccccccaaatctactgagccacggaccgcatcctccagggggcctgcaggccccagccaagtgccttccgtgggtcatcccagcacctgccagggcccgacctggggctgagtgcagaggctgagcaggacgttaggcccgggcccctggcacgtcctccaccggtgcctcctctggggaagggaaccagccctccagagcaggagactggcaagagctctttgtctcaccagctcagccccggccactccctgccaactccatgaccaggccaccatctgtaccctgcttcccaaactcccaggacctggagacaggattgtctggggccgaggggccagggtgtgaggtttcacctccgttgcggctgtgctcctgtggataacattgctagcgagccgcctctggttccactcagcttggttcctgcccccgccctgctgtatgatattaatgtggaaggtcatcaataaaggggaattgtgttggtgaaaaaaaaaaaaaaaaaaaaaaaaacaaaaaaaaaaaaaacaaaacaaaaaaagggggggcgcgcgcccaaagaagaacaccccccgggggggcccgagaacagacggccacccccacgtgcggagaagcaaacggggggccccacagaagaggaggagcacacactaattataagagccgagagcgagcggcggcgaggaggaaagaaaaaagcacggaaagagggcgaaacaaacggagcacacagcagggaacaaactgggagaagagagagaaaccaaaacagccagaggcgggcagaggcgacaacatagaggagcgcagacacacacaacaaaaacggaacaactacagcacgctaccaagaagcgagccaaacaatccccacccaatataagcagcgcgggtgacaacagggacggggagagaccacgcacgcgagagacaccaagactacgcagggtagcaagtcgggaacgacgcgaggggcgcaacgaccgtgaaaaaatgaaaagacaaaacgacaacacaattataacaacaagagaaagacgcagacaggcaaaacaccacggacggt

SEQ ID NO: 356284 - DNA, 3441 bp, Homo sapiens
cgccccacagccaacctcccgggcaccgttgcccgcccggggcccgctaccggcccaggccccgcctcgcgagtcctcctccccgggtgcctgcccgcagcccgctcggcccagagggtgggcgcggggctgcctctaccggctggcggctgtaactcagcgaccttggcccgaaggctctagcaaggacccaccgaccccagccgcggcggcggcggcgcggactttgcccggtgtgtggggcggagcggactgcgtgtccgcggacgggcagcgaagatgttagccttcgctgccaggaccgtggaccgatcccagggctgtggtgtaacctcagcggccaggcagtctctgtcctccagccaagttttccctcatcaaaacgatcttcgcagattctgacaggtgaagcctctgggcttcctgaagcccttctccttgatgaaggcttccagccgcttcaaggcacaccaggatgcactgccacggctgcccgtgccccctctccagcagtccctggaccactacctgaaggcgctgcagcccatcgtgagtgaggaggagtgggcccacaccaagcagctggtggatgagtttcaggcctcaggaggtgtaggggagcgcctgcagaaggggctggagcgtcgggccaggaagacggagaactggctgtctgagtggtggctcaagaccgcctacctccagtaccgccagcctgtggtcatctactcgagcccaggcgtgatgctacccaagcaggacttcgtggacctgcagggtcagctccgatttgctgccaaactcattgagggtgtgttggatttcaaggtcatgattgacaacgagaccctgcccgtggagtacctgggggggaagccactgtgcatgaaccagtactatcagatcttgtcctcctgccgagtgccgggccccaagcaggacacagtcagcaacttcagcaagaccaagaagcctcccacgcacatcaccgtggtacacaactaccagttttttgagctggatgtgtaccacagtgacgggacacccctcactgcggatcagatctttgtgcagctggagaagatctggaactcatccctacagaccaacaaggagcctgtgggcatcctcacctccaaccaccgcaactcctgggccaaggcatacaacaccctcatcaaagacaaggtgaaccgggattccgtgcgctccatccagaagagcatcttcaccgtgtgcctagatgcaaccatgcccagggtctcagaagacgtgtaccgcagccacgtggcaggccagatgctgcatgggggcggcagcaggctcaacagcggcaaccgctggttcgacaagacgctgcagttcatcgtggcagaagatggctcctgtgggcttgtgtacgagcatgctgcagcggaggggccccctattgtcacccttctggactatgtcatcgagtacacgaagaaacccgagcttgtgcggtctcccatggtgcccctgcccatgcccaagaagctgcggttcaacatcacccccgagatcaagagcgacatcgagaaggccaagcagaacctcagcatcatgatccaggacctggatatcaccgtgatggtgttccaccattttggaaaagacttccccaagtcggagaagctaagcccagatgccttcatccagatggctttgcagctggcctactacaggatctacggacaggcatgtgccacctatgaaagtgcctccctgcgcatgtttcacctgggccgcaccgacaccatccgctcggcttccatggactcactcacctttgtcaaggccatggatgactccagcgtcacggagcaccagaaggtggagctgctgcggaaggccgtgcaggcccaccgaggctacaccgaccgggccatccgcggggaggcctttgatcgacacctgctgggcctgaagctgcaggccatcgaggacctggtgagcatgcccgacatcttcatggacacctcctacgccatcgccatgcacttccacctctccaccagccaggtccctgccaagacagactgtgtcatgttcttcgggcccgtggtccccgacggctacggtgtctgctataaccccatggaggcccacatcaacttctccctgtcggcctacaacagctgcgcggagaccaacgccgcccgcctggcgcattacctggagaaggcgctcctggacatgcgtgccctgctgcagagccacccccgggccaagctctgagcccctaggactcaggcctgccaatgccacagccaagcccaccctgggatgggccacccaccagggctcagctccttggttccctcttccttggttccctcttccctggtccccccaaatctactgagccacggaccgcatcctccagggggcctgcaggccccagccaagtgccttccgtgggtcatcccagcacctgccagggcccgacctggggctgagtgcagaggctgagcaggacgttaggcccgggcccctggcacgtcctccaccggtgcctcctctggggaagggaaccagccctccagagcaggagactggcaagagctctttgtctcaccagctcagccccggccactccctgccaactccatgaccaggccaccatctgtaccctgcttcccaaactcccaggacctggagacaggattgtctggggccgaggggccagggtgtgaggtttcacctccgttgcggctgtgctcctgtggataacattgctagcgagccgcctctggttccactcagcttggttcctgcccccgccctgctgtatgatattaatgtggaaggtcatcaataaaggggaattgtgttggtgaaaaaaaaaaaaaaaaaaaaaaaaacaaaaaaaaaaaaaacaaaacaaaaaaagggggggcgcgcgcccaaagaagaacaccccccgggggggcccgagaacagacggccacccccacgtgcggagaagcaaacggggggccccacagaagaggaggagcacacactaattataagagccgagagcgagcggcggcgaggaggaaagaaaaaagcacggaaagagggcgaaacaaacggagcacacagcagggaacaaactgggagaagagagagaaaccaaaacagccagaggcgggcagaggcgacaacatagaggagcgcagacacacacaacaaaaacggaacaactacagcacgctaccaagaagcgagccaaacaatccccacccaatataagcagcgcgggtgacaacagggacggggagagaccacgcacgcgagagacaccaagactacgcagggtagcaagtcgggaacgacgcgaggggcgcaacgaccgtgaaaaaatgaaaagacaaaacgacaacacaattataacaacaagagaaagacgcagacaggcaaaacaccacggacggt

SEQ ID NO: 356285 - DNA, 3512 bp, Homo sapiens
cgccccacagccaacctcccgggcaccgttgcccgcccggggcccgctaccggcccaggccccgcctcgcgagtcctcctccccgggtgcctgcccgcagcccgctcggcccagagggtgggcgcggggctgcctctaccggctggcggctgtaactcagcgaccttggcccgaaggctctagcaaggacccaccgaccccagccgcggcggcggcggcgcggactttgcccggtgtgtggggcggagcggactgcgtgtccgcggacgggcagcgaagatgttagccttcgctgccaggaccgtggaccgatcccagggctgtggtgtaacctcagcggccaggcagtctctgtcctccagccaagttttccctcatcaaaacgatcttcgcagattctgacagggtgggagaaaaggacgtggggacctccaagagggacagtcaccactctgctggctggctcctcttccagggtgaagcctctgggcttcctgaagcccttctccttgatgaaggcttccagccgcttcaaggcacaccaggatgcactgccacggctgcccgtgccccctctccagcagtccctggaccactacctgaaggcgctgcagcccatcgtgagtgaggaggagtgggcccacaccaagcagctggtggatgagtttcaggcctcaggaggtgtaggggagcgcctgcagaaggggctggagcgtcgggccaggaagacggagaactggctgtctgagtggtggctcaagaccgcctacctccagtaccgccagcctgtggtcatctactcgagcccaggcgtgatgctacccaagcaggacttcgtggacctgcagggtcagctccgatttgctgccaaactcattgagggtgtgttggatttcaaggtcatgattgacaacgagaccctgcccgtggagtacctgggggggaagccactgtgcatgaaccagtactatcagatcttgtcctcctgccgagtgccgggccccaagcaggacacagtcagcaacttcagcaagaccaagaagcctcccacgcacatcaccgtggtacacaactaccagttttttgagctggatgtgtaccacagtgacgggacacccctcactgcggatcagatctttgtgcagctggagaagatctggaactcatccctacagaccaacaaggagcctgtgggcatcctcacctccaaccaccgcaactcctgggccaaggcatacaacaccctcatcaaagacaaggtgaaccgggattccgtgcgctccatccagaagagcatcttcaccgtgtgcctagatgcaaccatgcccagggtctcagaagacgtgtaccgcagccacgtggcaggccagatgctgcatgggggcggcagcaggctcaacagcggcaaccgctggttcgacaagacgctgcagttcatcgtggcagaagatggctcctgtgggcttgtgtacgagcatgctgcagcggaggggccccctattgtcacccttctggactatgtcatcgagtacacgaagaaacccgagcttgtgcggtctcccatggtgcccctgcccatgcccaagaagctgcggttcaacatcacccccgagatcaagagcgacatcgagaaggccaagcagaacctcagcatcatgatccaggacctggatatcaccgtgatggtgttccaccattttggaaaagacttccccaagtcggagaagctaagcccagatgccttcatccagatggctttgcagctggcctactacaggatctacggacaggcatgtgccacctatgaaagtgcctccctgcgcatgtttcacctgggccgcaccgacaccatccgctcggcttccatggactcactcacctttgtcaaggccatggatgactccagcgtcacggagcaccagaaggtggagctgctgcggaaggccgtgcaggcccaccgaggctacaccgaccgggccatccgcggggaggcctttgatcgacacctgctgggcctgaagctgcaggccatcgaggacctggtgagcatgcccgacatcttcatggacacctcctacgccatcgccatgcacttccacctctccaccagccaggtccctgccaagacagactgtgtcatgttcttcgggcccgtggtccccgacggctacggtgtctgctataaccccatggaggcccacatcaacttctccctgtcggcctacaacagctgcgcggagaccaacgccgcccgcctggcgcattacctggagaaggcgctcctggacatgcgtgccctgctgcagagccacccccgggccaagctctgagcccctaggactcaggcctgccaatgccacagccaagcccaccctgggatgggccacccaccagggctcagctccttggttccctcttccttggttccctcttccctggtccccccaaatctactgagccacggaccgcatcctccagggggcctgcaggccccagccaagtgccttccgtgggtcatcccagcacctgccagggcccgacctggggctgagtgcagaggctgagcaggacgttaggcccgggcccctggcacgtcctccaccggtgcctcctctggggaagggaaccagccctccagagcaggagactggcaagagctctttgtctcaccagctcagccccggccactccctgccaactccatgaccaggccaccatctgtaccctgcttcccaaactcccaggacctggagacaggattgtctggggccgaggggccagggtgtgaggtttcacctccgttgcggctgtgctcctgtggataacattgctagcgagccgcctctggttccactcagcttggttcctgcccccgccctgctgtatgatattaatgtggaaggtcatcaataaaggggaattgtgttggtgaaaaaaaaaaaaaaaaaaaaaaaaacaaaaaaaaaaaaaacaaaacaaaaaaagggggggcgcgcgcccaaagaagaacaccccccgggggggcccgagaacagacggccacccccacgtgcggagaagcaaacggggggccccacagaagaggaggagcacacactaattataagagccgagagcgagcggcggcgaggaggaaagaaaaaagcacggaaagagggcgaaacaaacggagcacacagcagggaacaaactgggagaagagagagaaaccaaaacagccagaggcgggcagaggcgacaacatagaggagcgcagacacacacaacaaaaacggaacaactacagcacgctaccaagaagcgagccaaacaatccccacccaatataagcagcgcgggtgacaacagggacggggagagaccacgcacgcgagagacaccaagactacgcagggtagcaagtcgggaacgacgcgaggggcgcaacgaccgtgaaaaaatgaaaagacaaaacgacaacacaattataacaacaagagaaagacgcagacaggcaaaacaccacggacggt

SEQ ID NO: 356286 - DNA, 3140 bp, Homo sapiens
gtaccacctgtcatctttgtgggtggtactgaccctaacccaaggaatattagaggacattccccggtcaacatggttgtgttttcctatcactctaagagttaggctcaaggacaccagacggagttggaaaggtgcacaccactacctccaacagcttagaagacatgtggggacaggggagagacagctggacggtgacctcctccttcctcctccacaggtgaagcctctgggcttcctgaagcccttctccttgatgaaggcttccagccgcttcaaggcacaccaggatgcactgccacggctgcccgtgccccctctccagcagtccctggaccactacctgaaggcgctgcagcccatcgtgagtgaggaggagtgggcccacaccaagcagctggtggatgagtttcaggcctcaggaggtgtaggggagcgcctgcagaaggggctggagcgtcgggccaggaagacggagaactggatttgctgccaaactcattgagggtgtgttggatttcaaggtcatgattgacaacgagaccctgcccgtggagtacctgggggggaagccactgtgcatgaaccagtactatcagatcttgtcctcctgccgagtgccgggccccaagcaggacacagtcagcaacttcagcaagaccaagaagcctcccacgcacatcaccgtggtacacaactaccagttttttgagctggatgtgtaccacagtgacgggacacccctcactgcggatcagatctttgtgcagctggagaagatctggaactcatccctacagaccaacaaggagcctgtgggcatcctcacctccaaccaccgcaactcctgggccaaggcatacaacaccctcatcaaagacaaggtgaaccgggattccgtgcgctccatccagaagagcatcttcaccgtgtgcctagatgcaaccatgcccagggtctcagaagacgtgtaccgcagccacgtggcaggccagatgctgcatgggggcggcagcaggctcaacagcggcaaccgctggttcgacaagacgctgcagttcatcgtggcagaagatggctcctgtgggcttgtgtacgagcatgctgcagcggaggggccccctattgtcacccttctggactatgtcatcgagtacacgaagaaacccgagcttgtgcggtctcccatggtgcccctgcccatgcccaagaagctgcggttcaacatcacccccgagatcaagagcgacatcgagaaggccaagcagaacctcagcatcatgatccaggacctggatatcaccgtgatggtgttccaccattttggaaaagacttccccaagtcggagaagctaagcccagatgccttcatccagatggctttgcagctggcctactacaggatctacggacaggcatgtgccacctatgaaagtgcctccctgcgcatgtttcacctgggccgcaccgacaccatccgctcggcttccatggactcactcacctttgtcaaggccatggatgactccagcgtcacggagcaccagaaggtggagctgctgcggaaggccgtgcaggcccaccgaggctacaccgaccgggccatccgcggggaggcctttgatcgacacctgctgggcctgaagctgcaggccatcgaggacctggtgagcatgcccgacatcttcatggacacctcctacgccatcgccatgcacttccacctctccaccagccaggtccctgccaagacagactgtgtcatgttcttcgggcccgtggtccccgacggctacggtgtctgctataaccccatggaggcccacatcaacttctccctgtcggcctacaacagctgcgcggagaccaacgccgcccgcctggcgcattacctggagaaggcgctcctggacatgcgtgccctgctgcagagccacccccgggccaagctctgagcccctaggactcaggcctgccaatgccacagccaagcccaccctgggatgggccacccaccagggctcagctccttggttccctcttccttggttccctcttccctggtccccccaaatctactgagccacggaccgcatcctccagggggcctgcaggccccagccaagtgccttccgtgggtcatcccagcacctgccagggcccgacctggggctgagtgcagaggctgagcaggacgttaggcccgggcccctggcacgtcctccaccggtgcctcctctggggaagggaaccagccctccagagcaggagactggcaagagctctttgtctcaccagctcagccccggccactccctgccaactccatgaccaggccaccatctgtaccctgcttcccaaactcccaggacctggagacaggattgtctggggccgaggggccagggtgtgaggtttcacctccgttgcggctgtgctcctgtggataacattgctagcgagccgcctctggttccactcagcttggttcctgcccccgccctgctgtatgatattaatgtggaaggtcatcaataaaggggaattgtgttggtgaaaaaaaaaaaaaaaaaaaaaaaaacaaaaaaaaaaaaaacaaaacaaaaaaagggggggcgcgcgcccaaagaagaacaccccccgggggggcccgagaacagacggccacccccacgtgcggagaagcaaacggggggccccacagaagaggaggagcacacactaattataagagccgagagcgagcggcggcgaggaggaaagaaaaaagcacggaaagagggcgaaacaaacggagcacacagcagggaacaaactgggagaagagagagaaaccaaaacagccagaggcgggcagaggcgacaacatagaggagcgcagacacacacaacaaaaacggaacaactacagcacgctaccaagaagcgagccaaacaatccccacccaatataagcagcgcgggtgacaacagggacggggagagaccacgcacgcgagagacaccaagactacgcagggtagcaagtcgggaacgacgcgaggggcgcaacgaccgtgaaaaaatgaaaagacaaaacgacaacacaattataacaacaagagaaagacgcagacaggcaaaacaccacggacggt

SEQ ID NO: 356287 - DNA, 2625 bp, Homo sapiens
cgccccacagccaacctcccgggcaccgttgcccgcccggggcccgctaccggcccaggccccgcctcgcgagtcctcctccccgggtgcctgcccgcagcccgctcggcccagagggtgggcgcggggctgcctctaccggctggcggctgtaactcagcgaccttggcccgaaggctctagcaaggacccaccgaccccagccgcggcggcggcggcgcggactttgcccggtgtgtggggcggagcggactgcgtgtccgcggacgggcagcgaagatgttagccttcgctgccaggaccgtggtgaagcctctgggcttcctgaagcccttctccttgatgaaggcttccagccgcttcaaggcacaccaggatgcactgccacggctgcccgtgccccctctccagcagtccctggaccactacctgaaggcgctgcagcccatcgtgagtgaggaggagtgggcccacaccaagcagctggtggatgagtttcaggcctcaggaggtgtaggggagcgcctgcagaaggggctggagcgtcgggccaggaagacggagaactggctgtctgagtggtggctcaagaccgcctacctccagtaccgccagcctgtggtcatctactcgagcccaggcgtgatgctacccaagcaggacttcgtggacctgcagggtcagctccgatttgctgccaaactcattgagggtgtgttggatttcaaggtcatgattgacaacgagaccctgcccgtggagtacctgggggggaagccactgtgcatgaaccagtactatcagatcttgtcctcctgccgagtgccgggccccaagcaggacacagtcagcaacttcagcaagaccaagaagcctcccacgcacatcaccgtggtacacaactaccagttttttgagctggatgtgtaccacagtgacgggacacccctcactgcggatcagatctttgtgcagctggagaagatctggaactcatccctacagaccaacaaggagcctgtgggcatcctcacctccaaccaccgcaactcctgggccaaggcatacaacaccctcatcaaagacaaggtgaaccgggattccgtgcgctccatccagaagagcatcttcaccgtgtgcctagatgcaaccatgcccagggtctcagaagacgtgtaccgcagccacgtggcaggccagatgctgcatgggggcggcagcaggctcaacagcggcaaccgctggttcgacaagacgctgcagttcatcgtggcagaagatggctcctgtgggcttgtgtacgagcatgctgcagcggaggggccccctattgtcacccttctggactatgtcatcgagtacacgaagaaacccgagcttgtgcggtctcccatggtgcccctgcccatgcccaagaagctgcggttcaacatcacccccgagatcaagagcgacatcgagaaggccaagcagaacctcagcatcatgatccaggacctggatatcaccgtgatggtgttccaccattttggaaaagacttccccaagtcggagaagctaagcccagatgccttcatccagatggctttgcagctggcctactacaggatctacggacaggcatgtgccacctatgaaagtgcctccctgcgcatgtttcacctgggccgcaccgacaccatccgctcggcttccatggactcactcacctttgtcaaggccatggatgactccagcgtcacggagcaccagaaggtggagctgctgcggaaggccgtgcaggcccaccgaggctacaccgaccgggccatccgcggggaggcctttgatcgacacctgctgggcctgaagctgcaggccatcgaggacctggtccctgccaagacagactgtgtcatgttcttcgggcccgtggtccccgacggctacggtgtctgctataaccccatggaggcccacatcaacttctccctgtcggcctacaacagctgcgcggagaccaacgccgcccgcctggcgcattacctggagaaggcgctcctggacatgcgtgccctgctgcagagccacccccgggccaagctctgagcccctaggactcaggcctgccaatgccacagccaagcccaccctgggatgggccacccaccagggctcagctccttggttccctcttccttggttccctcttccctggtccccccaaatctactgagccacggaccgcatcctccagggggcctgcaggccccagccaagtgccttccgtgggtcatccctggcacgtcctccaccggtgcctcctctggggaagggaaccagccctccagagcaggagactggcaagagctctttgtctcaccagctcagccccggccactccctgccaactccatgaccaggccaccatctgtaccctgcttcccaaactcccaggacctggagacaggattgtctggggccgaggggccagggtgtgaggtttcacctccgttgcggctgtgctcctgtggataacattgctagcgagccgcctctggttccactcagcttggttcctgcccccgccctgctgtatgatattaatgtggaaggtcatcaataaaggggaattgtgttggtgaa

SEQ ID NO: 356288 - DNA, 1178 bp, Homo sapiens
cgccccacagccaacctcccgggcaccgttgcccgcccggggcccgctaccggcccaggccccgcctcgcgagtcctcctccccgggtgcctgcccgcagcccgctcggcccagagggtgggcgcggggctgcctctaccggctggcggctgtaactcagcgaccttggcccgaaggctctagcaaggacccaccgaccccagccgcggcggcggcggcgcggactttgcccggtgtgtggggcggagcggactgcgtgtccgcggacgggcagcgaagatgttagccttcgctgccaggaccgtggtgaagcctctgggcttcctgaagcccttctccttgatgaaggcttccagccgcttcaaggcacaccaggatgcactgccacggctgcccgtgccccctctccagcagtccctggaccactacctgaaggcgctgcagcccatcgtgagtgaggaggagtgggcccacaccaagcagctggtggatgagtttcaggcctcaggaggtgtaggggagcgcctgcagaaggggctggagcgtcgggccaggaagacggagaactggctgtctgagtggtggctcaagaccgcctacctccagtaccgccagcctgtggtcatctactcgagcccaggcgtgatgctacccaagcaggacttcgtggacctgcagggtcagctccgatttgctgccaaactcattgagggtgtgttggatttcaaggtcatgattgacaacgagaccctgcccgtggagtacctgggggggaagccactgtgcatgaaccagtactatcagatcttgtcctcctgccgagtgccgggccccaagcaggacacagtcagcaacttcagcaagaccaagaagcctcccacgcacatcaccgtggtacacaactaccagttttttgagctggatgtgtaccacagtgacgggacacccctcactgcggatcagatctttgtgcagctggagaagatctggaactcatccctacagaccaacaaggagcctgtgggcatcctcacctccaaccaccgcaactcctgggccaaggcatacaacaccctcatcaaaggtgcctcttgggggccgtgctggggctgcacacccaggcctcttcccctgttggggaccagcctcaactccacctgtagggtacccgaagtctg

SEQ ID NO: 356289 - DNA, 411 bp, Homo sapiens
atgccccgtccccgccccacagccaacctcccgggcaccgttgcccgcccggggcccgctaccggcccaggccccgcctcgcgagtcctcctccccgggtgcctgcccgcagcccgctcggcccagagggtgggcgcggggctgcctctaccggctggcggctgtaactcagcgaccttggcccgaaggctctagcaaggacccaccgaccccagccgcggcggcggcggcgcggactttgcccggtgtgtggggcggagcggactgcgtgtccgcggacgggcagcgaagatgttagccttcgctgccaggaccgtggtgagtgcggcggatcccgggcctgagggccctggacggcctgggcgggccgtgcggttgcgtccgggaacggagaccgcgtcctgcggccgc

SEQ ID NO: 356290 - DNA, 2763 bp, Homo sapiens
cgccccacagccaacctcccgggcaccgttgcccgcccggggcccgctaccggcccaggccccgcctcgcgagtcctcctccccgggtgcctgcccgcagcccgctcggcccagagggtgggcgcggggctgcctctaccggctggcggctgtaactcagcgaccttggcccgaaggctctagcaaggacccaccgaccccagccgcggcggcggcggcgcggactttgcccggtgtgtggggcggagcggactgcgtgtccgcggacgggcagcgaagatgttagccttcgctgccaggaccgtggtgaagcctctgggcttcctgaagcccttctccttgatgaaggcttccagccgcttcaaggcacaccaggatgcactgccacggctgcccgtgccccctctccagcagtccctggaccactacctgaaggcgctgcagcccatcgtgagtgaggaggagtgggcccacaccaagcagctggtggatgagtttcaggcctcaggaggtgtaggggagcgcctgcagaaggggctggagcgtcgggccaggaagacggagaactggctgtctgagtggtggctcaagaccgcctacctccagtaccgccagcctgtggtcatctactcgagcccaggcgtgatgctacccaagcaggacttcgtggacctgcagggtcagctccgatttgctgccaaactcattgagggtgtgttggatttcaaggtcatgattgacaacgagaccctgcccgtggagtacctgggggggaagccactgtgcatgaaccagtactatcagatcttgtcctcctgccgagtgccgggccccaagcaggacacagtcagcaacttcagcaagaccaagaagcctcccacgcacatcaccgtggtacacaactaccagttttttgagctggatgtgtaccacagtgacgggacacccctcactgcggatcagatctttgtgcagctggagaagatctggaactcatccctacagaccaacaaggagcctgtgggcatcctcacctccaaccaccgcaactcctgggccaaggcatacaacaccctcatcaaagacaaggtgaaccgggattccgtgcgctccatccagaagagcatcttcaccgtgtgcctagatgcaaccatgcccagggtctcagaagacgtgtaccgcagccacgtggcaggccagatgctgcatgggggcggcagcaggctcaacagcggcaaccgctggttcgacaagacgctgcagttcatcgtggcagaagatggctcctgtgggcttgtgtacgagcatgctgcagcggaggggccccctattgtcacccttctggactatgtcatcgagtacacgaagaaacccgagcttgtgcggtctcccatggtgcccctgcccatgcccaagaagctgcggttcaacatcacccccgagatcaagagcgacatcgagaaggccaagcagaacctcagcatcatgatccaggacctggatatcaccgtgatggtgttccaccattttggaaaagacttccccaagtcggagaagctaagcccagatgccttcatccagatggctttgcagctggcctactacaggatctacggacaggcatgtgccacctatgaaagtgcctccctgcgcatgtttcacctgggccgcaccgacaccatccgctcggcttccatggactcactcacctttgtcaaggccatggatgactccagcgtcacggagcaccagaaggtggagctgctgcggaaggccgtgcaggcccaccgaggctacaccgaccgggccatccgcggggaggcctttgatcgacacctgctgggcctgaagctgcaggccatcgaggacctggtgagcatgcccgacatcttcatggacacctcctacgccatcgccatgcacttccacctctccaccagccaggtccctgccaagacagactgtgtcatgttcttcgggcccgtggtccccgacggctacggtgtctgctataaccccatggaggcccacatcaacttctccctgtcggcctacaacagctgcgcggagaccaacgccgcccgcctggcgcattacctggagaaggcgctcctggacatgcgtgccctgctgcagagccacccccgggccaagctctgagcccctaggactcaggcctgccaatgccacagccaagcccaccctgggatgggccacccaccagggctcagctccttggttccctcttccttggttccctcttccctggtccccccaaatctactgagccacggaccgcatcctccagggggcctgcaggccccagccaagtgccttccgtgggtcatcccagcacctgccagggcccgacctggggctgagtgcagaggctgagcaggacgttaggcccgggcccctggcacgtcctccaccggtgcctcctctggggaagggaaccagccctccagagcaggagactggcaagagctctttgtctcaccagctcagccccggccactccctgccaactccatgaccaggccaccatctgtaccctgcttcccaaactcccaggacctggagacaggattgtctggggccgaggggccagggtgtgaggtttcacctccgttgcggctgtgctcctgtggataacattgctagcgagccgcctctggttccactcagcttggttcctgcccccgccctgctgtatgatattaatgtggaaggtcatcaataaaggggaattgtgttggtgaa

SEQ ID NO: 356291 - DNA, 2517 bp, Homo sapiens
cgccccacagccaacctcccgggcaccgttgcccgcccggggcccgctaccggcccaggccccgcctcgcgagtcctcctccccgggtgcctgcccgcagcccgctcggcccagagggtgggcgcggggctgcctctaccggctggcggctgtaactcagcgaccttggcccgaaggctctagcaaggacccaccgaccccagccgcggcggcggcggcgcggactttgcccggtgtgtggggcggagcggactgcgtgtccgcggacgggcagcgaagatgttagccttcgctgccaggaccgtggtgaagcctctgggcttcctgaagcccttctccttgatgaaggcttccagccgcttcaaggcacaccaggatgcactgccacggctgcccgtgccccctctccagcagtccctggaccactacctgaaggcgctgcagcccatcgtgagtgaggaggagtgggcccacaccaagcagctggtggatgagtttcaggcctcaggaggtgtaggggagcgcctgcagaaggggctggagcgtcgggccaggaagacggagaactggctgtctgagtggtggctcaagaccgcctacctccagtaccgccagcctgtggtcatctactcgagcccaggcgtgatgctacccaagcaggacttcgtggacctgcagggtcagctccgatttgctgccaaactcattgagggtgtgttggatttcaaggtcatgattgacaacgagaccctgcccgtggagtacctgggggggaagccactgtgcatgaaccagtactatcagatcttgtcctcctgccgagtgccgggccccaagcaggacacagtcagcaacttcagcaagaccaagaagcctcccacgcacatcaccgtggtacacaactaccagttttttgagctggatgtgtaccacagtgacgggacacccctcactgcggatcagatctttgtgcagctggagaagatctggaactcatccctacagaccaacaaggagcctgtgggcatcctcacctccaaccaccgcaactcctgggccaaggcatacaacaccctcatcaaagacaaggtgaaccgggattccgtgcgctccatccagaagaaacccgagcttgtgcggtctcccatggtgcccctgcccatgcccaagaagctgcggttcaacatcacccccgagatcaagagcgacatcgagaaggccaagcagaacctcagcatcatgatccaggacctggatatcaccgtgatggtgttccaccattttggaaaagacttccccaagtcggagaagctaagcccagatgccttcatccagatggctttgcagctggcctactacaggatctacggacaggcatgtgccacctatgaaagtgcctccctgcgcatgtttcacctgggccgcaccgacaccatccgctcggcttccatggactcactcacctttgtcaaggccatggatgactccagcgtcacggagcaccagaaggtggagctgctgcggaaggccgtgcaggcccaccgaggctacaccgaccgggccatccgcggggaggcctttgatcgacacctgctgggcctgaagctgcaggccatcgaggacctggtgagcatgcccgacatcttcatggacacctcctacgccatcgccatgcacttccacctctccaccagccaggtccctgccaagacagactgtgtcatgttcttcgggcccgtggtccccgacggctacggtgtctgctataaccccatggaggcccacatcaacttctccctgtcggcctacaacagctgcgcggagaccaacgccgcccgcctggcgcattacctggagaaggcgctcctggacatgcgtgccctgctgcagagccacccccgggccaagctctgagcccctaggactcaggcctgccaatgccacagccaagcccaccctgggatgggccacccaccagggctcagctccttggttccctcttccttggttccctcttccctggtccccccaaatctactgagccacggaccgcatcctccagggggcctgcaggccccagccaagtgccttccgtgggtcatcccagcacctgccagggcccgacctggggctgagtgcagaggctgagcaggacgttaggcccgggcccctggcacgtcctccaccggtgcctcctctggggaagggaaccagccctccagagcaggagactggcaagagctctttgtctcaccagctcagccccggccactccctgccaactccatgaccaggccaccatctgtaccctgcttcccaaactcccaggacctggagacaggattgtctggggccgaggggccagggtgtgaggtttcacctccgttgcggctgtgctcctgtggataacattgctagcgagccgcctctggttccactcagcttggttcctgcccccgccctgctgtatgatattaatgtggaaggtcatcaataaaggggaattgtgttggtgaa

SEQ ID NO: 356292 - DNA, 3085 bp, Homo sapiens
gggctccagagccggggagggaatgaacaggatgttctgctacctgcaggtgaagcctctgggcttcctgaagcccttctccttgatgaaggcttccagccgcttcaaggcacaccaggatgcactgccacggctgcccgtgccccctctccagcagtccctggaccactacctgaaggcgctgcagcccatcgtgagtgaggaggagtgggcccacaccaagcagctggtggatgagtttcaggcctcaggaggtgtaggggagcgcctgcagaaggggctggagcgtcgggccaggaagacggagaactggctgtctgagtggtggctcaagaccgcctacctccagtaccgccagcctgtggtcatctactcgagcccaggcgtgatgctacccaagcaggacttcgtggacctgcagggtcagctccgatttgctgccaaactcattgagggtgtgttggatttcaaggtcatgattgacaacgagaccctgcccgtggagtacctgggggggaagccactgtgcatgaaccagtactatcagatcttgtcctcctgccgagtgccgggccccaagcaggacacagtcagcaacttcagcaagaccaagaagcctcccacgcacatcaccgtggtacacaactaccagttttttgagctggatgtgtaccacagtgacgggacacccctcactgcggatcagatctttgtgcagctggagaagatctggaactcatccctacagaccaacaaggagcctgtgggcatcctcacctccaaccaccgcaactcctgggccaaggcatacaacaccctcatcaaagacaaggtgaaccgggattccgtgcgctccatccagaagagcatcttcaccgtgtgcctagatgcaaccatgcccagggtctcagaagacgtgtaccgcagccacgtggcaggccagatgctgcatgggggcggcagcaggctcaacagcggcaaccgctggttcgacaagacgctgcagttcatcgtggcagaagatggctcctgtgggcttgtgtacgagcatgctgcagcggaggggccccctattgtcacccttctggactatgtcatcgagtacacgaagaaacccgagcttgtgcggtctcccatggtgcccctgcccatgcccaagaagctgcggttcaacatcacccccgagatcaagagcgacatcgagaaggccaagcagaacctcagcatcatgatccaggacctggatatcaccgtgatggtgttccaccattttggaaaagacttccccaagtcggagaagctaagcccagatgccttcatccagatggctttgcagctggcctactacaggatctacggacaggcatgtgccacctatgaaagtgcctccctgcgcatgtttcacctgggccgcaccgacaccatccgctcggcttccatggactcactcacctttgtcaaggccatggatgactccagcgtcacggagcaccagaaggtggagctgctgcggaaggccgtgcaggcccaccgaggctacaccgaccgggccatccgcggggaggcctttgatcgacacctgctgggcctgaagctgcaggccatcgaggacctggtgagcatgcccgacatcttcatggacacctcctacgccatcgccatgcacttccacctctccaccagccaggtccctgccaagacagactgtgtcatgttcttcgggcccgtggtccccgacggctacggtgtctgctataaccccatggaggcccacatcaacttctccctgtcggcctacaacagctgcgcggagaccaacgccgcccgcctggcgcattacctggagaaggcgctcctggacatgcgtgccctgctgcagagccacccccgggccaagctctgagcccctaggactcaggcctgccaatgccacagccaagcccaccctgggatgggccacccaccagggctcagctccttggttccctcttccttggttccctcttccctggtccccccaaatctactgagccacggaccgcatcctccagggggcctgcaggccccagccaagtgccttccgtgggtcatcccagcacctgccagggcccgacctggggctgagtgcagaggctgagcaggacgttaggcccgggcccctggcacgtcctccaccggtgcctcctctggggaagggaaccagccctccagagcaggagactggcaagagctctttgtctcaccagctcagccccggccactccctgccaactccatgaccaggccaccatctgtaccctgcttcccaaactcccaggacctggagacaggattgtctggggccgaggggccagggtgtgaggtttcacctccgttgcggctgtgctcctgtggataacattgctagcgagccgcctctggttccactcagcttggttcctgcccccgccctgctgtatgatattaatgtggaaggtcatcaataaaggggaattgtgttggtgaaaaaaaaaaaaaaaaaaaaaaaaacaaaaaaaaaaaaaacaaaacaaaaaaagggggggcgcgcgcccaaagaagaacaccccccgggggggcccgagaacagacggccacccccacgtgcggagaagcaaacggggggccccacagaagaggaggagcacacactaattataagagccgagagcgagcggcggcgaggaggaaagaaaaaagcacggaaagagggcgaaacaaacggagcacacagcagggaacaaactgggagaagagagagaaaccaaaacagccagaggcgggcagaggcgacaacatagaggagcgcagacacacacaacaaaaacggaacaactacagcacgctaccaagaagcgagccaaacaatccccacccaatataagcagcgcgggtgacaacagggacggggagagaccacgcacgcgagagacaccaagactacgcagggtagcaagtcgggaacgacgcgaggggcgcaacgaccgtgaaaaaatgaaaagacaaaacgacaacacaattataacaacaagagaaagacgcagacaggcaaaacaccacggacggt

SEQ ID NO: 356293 - DNA, 2697 bp, Homo sapiens
cgccccacagccaacctcccgggcaccgttgcccgcccggggcccgctaccggcccaggccccgcctcgcgagtcctcctccccgggtgcctgcccgcagcccgctcggcccagagggtgggcgcggggctgcctctaccggctggcggctgtaactcagcgaccttggcccgaaggctctagcaaggacccaccgaccccagccgcggcggcggcggcgcggactttgcccggtgtgtggggcggagcggactgcgtgtccgcggacgggcagcgaagatgttagccttcgctgccaggaccgtggtgaagcctctgggcttcctgaagcccttctccttgatgaaggcttccagccgcttcaaggcacaccaggatgcactgccacggctgcccgtgccccctctccagcagtccctggaccactacctgaaggcgctgcagcccatcgtgagtgaggaggagtgggcccacaccaagcagctggtggatgagtttcaggcctcaggaggtgtaggggagcgcctgcagaaggggctggagcgtcgggccaggaagacggagaactggctgtctgagtggtggctcaagaccgcctacctccagtaccgccagcctgtggtcatctactcgagcccaggcgtgatgctacccaagcaggacttcgtggacctgcagggtcagctccgatttgctgccaaactcattgagggtgtgttggatttcaaggtcatgattgacaacgagaccctgcccgtggagtacctgggggggaagccactgtgcatgaaccagtactatcagatcttgtcctcctgccgagtgccgggccccaagcaggacacagtcagcaacttcagcaagaccaagaagcctcccacgcacatcaccgtggtacacaactaccagttttttgagctggatgtgtaccacagtgacgggacacccctcactgcggatcagatctttgtgcagctggagaagatctggaactcatccctacagaccaacaaggagcctgtgggcatcctcacctccaaccaccgcaactcctgggccaaggcatacaacaccctcatcaaagacaaggtgaaccgggattccgtgcgctccatccagaagagcatcttcaccgtgtgcctagatgcaaccatgcccagggtctcagaagacgtgtaccgcagccacgtggcaggccagatgctgcatgggggcggcagcaggctcaacagcggcaaccgctggttcgacaagacgctgcagttcatcgtggcagaagatggctcctgtgggcttgtgtacgagcatgctgcagcggaggggccccctattgtcacccttctggactatgtcatcgagtacacgaagaaacccgagcttgtgcggtctcccatggtgcccctgcccatgcccaagaagctgcggttcaacatcacccccgagatcaagagcgacatcgagaaggccaagcagaacctcagcatcatgatccaggacctggatatcaccgtgatggtgttccaccattttggaaaagacttccccaagtcggagaagctaagcccagatgccttcatccagatggctttgcagctggcctactacaggatctacggacaggcatgtgccacctatgaaagtgcctccctgcgcatgtttcacctgggccgcaccgacaccatccgctcggcttccatggactcactcacctttgtcaaggccatggatgactccagcgtcacggagcaccagaaggtggagctgctgcggaaggccgtgcaggcccaccgaggctacaccgaccgggccatccgcggggaggcctttgatcgacacctgctgggcctgaagctgcaggccatcgaggacctggtgagcatgcccgacatcttcatggacacctcctacgccatcgccatgcacttccacctctccaccagccaggtccctgccaagacagactgtgtcatgttcttcgggcccgtggtccccgacggctacggtgtctgctataaccccatggaggcccacatcaacttctccctgtcggcctacaacagctgcgcggagaccaacgccgcccgcctggcgcattacctggagaaggcgctcctggacatgcgtgccctgctgcagagccacccccgggccaagctctgagcccctaggactcaggcctgccaatgccacagccaagcccaccctgggatgggccacccaccagggctcagctccttggttccctcttccttggttccctcttccctggtccccccaaatctactgagccacggaccgcatcctccagggggcctgcaggccccagccaagtgccttccgtgggtcatccctggcacgtcctccaccggtgcctcctctggggaagggaaccagccctccagagcaggagactggcaagagctctttgtctcaccagctcagccccggccactccctgccaactccatgaccaggccaccatctgtaccctgcttcccaaactcccaggacctggagacaggattgtctggggccgaggggccagggtgtgaggtttcacctccgttgcggctgtgctcctgtggataacattgctagcgagccgcctctggttccactcagcttggttcctgcccccgccctgctgtatgatattaatgtggaaggtcatcaataaaggggaattgtgttggtgaa

SEQ ID NO: 356294 - DNA, 2759 bp, Homo sapiens
gtcctagttgaggacacctcatggttagggtagtttctctcagctaaatagcaagttaggattagagtccaagtcctctggctgagaagcccacccgcctccacaccccctgtgcccccaagtaccagcagtcctccaaagcatgtcttgctcaggggcattgaccccaaagtcagaccacctgtgtgggttccccggctgccacaccagctcccatgtgacccctgggcttcggtttcctgtgtctaaagtgggccaggtgttgggccctgcctcgaggagtgctgtgggcctgcagggtcctgttgagttcgaagctctgaacccacaccctgcacttggtgaatgccctggagggccggcgaggtggggggtctcctcatcccagagaggtacaaatgggtcagaagagcccagggcaggaggctgcggaggggctggtccatctctcccacaccatgagaccccattttgcgtctccccgccccatgccacctgcagacaaggtgaaccgggattccgtgcgctccatccagaagagcatcttcaccgtgtgcctagatgcaaccatgcccagggtctcagaagacgtgtaccgcagccacgtggcaggccagatgctgcatgggggcggcagcaggctcaacagcggcaaccgctggttcgacaagacgctgcagttcatcgtggcagaagatggctcctgtgggcttgtgtacgagcatgctgcagcggaggggccccctattgtcacccttctggactatgtcatcgagtacacgaagaaacccgagcttgtgcggtctcccatggtgcccctgcccatgcccaagaagctgcggttcaacatcacccccgagatcaagagcgacatcgagaaggccaagcagaacctcagcatcatgatccaggacctggatatcaccgtgatggtgttccaccattttggaaaagacttccccaagtcggagaagctaagcccagatgccttcatccagatggctttgcagctggcctactacaggatctacggacaggcatgtgccacctatgaaagtgcctccctgcgcatgtttcacctgggccgcaccgacaccatccgctcggcttccatggactcactcacctttgtcaaggccatggatgactccagcgtcacggagcaccagaaggtggagctgctgcggaaggccgtgcaggcccaccgaggctacaccgaccgggccatccgcggggaggcctttgatcgacacctgctgggcctgaagctgcaggccatcgaggacctggtgagcatgcccgacatcttcatggacacctcctacgccatcgccatgcacttccacctctccaccagccaggtccctgccaagacagactgtgtcatgttcttcgggcccgtggtccccgacggctacggtgtctgctataaccccatggaggcccacatcaacttctccctgtcggcctacaacagctgcgcggagaccaacgccgcccgcctggcgcattacctggagaaggcgctcctggacatgcgtgccctgctgcagagccacccccgggccaagctctgagcccctaggactcaggcctgccaatgccacagccaagcccaccctgggatgggccacccaccagggctcagctccttggttccctcttccttggttccctcttccctggtccccccaaatctactgagccacggaccgcatcctccagggggcctgcaggccccagccaagtgccttccgtgggtcatcccagcacctgccagggcccgacctggggctgagtgcagaggctgagcaggacgttaggcccgggcccctggcacgtcctccaccggtgcctcctctggggaagggaaccagccctccagagcaggagactggcaagagctctttgtctcaccagctcagccccggccactccctgccaactccatgaccaggccaccatctgtaccctgcttcccaaactcccaggacctggagacaggattgtctggggccgaggggccagggtgtgaggtttcacctccgttgcggctgtgctcctgtggataacattgctagcgagccgcctctggttccactcagcttggttcctgcccccgccctgctgtatgatattaatgtggaaggtcatcaataaaggggaattgtgttggtgaaaaaaaaaaaaaaaaaaaaaaaaacaaaaaaaaaaaaaacaaaacaaaaaaagggggggcgcgcgcccaaagaagaacaccccccgggggggcccgagaacagacggccacccccacgtgcggagaagcaaacggggggccccacagaagaggaggagcacacactaattataagagccgagagcgagcggcggcgaggaggaaagaaaaaagcacggaaagagggcgaaacaaacggagcacacagcagggaacaaactgggagaagagagagaaaccaaaacagccagaggcgggcagaggcgacaacatagaggagcgcagacacacacaacaaaaacggaacaactacagcacgctaccaagaagcgagccaaacaatccccacccaatataagcagcgcgggtgacaacagggacggggagagaccacgcacgcgagagacaccaagactacgcagggtagcaagtcgggaacgacgcgaggggcgcaacgaccgtgaaaaaatgaaaagacaaaacgacaacacaattataacaacaagagaaagacgcagacaggcaaaacaccacggacggt

SEQ ID NO: 356295 - DNA, 1597 bp, Homo sapiens
cgccccacagccaacctcccgggcaccgttgcccgcccggggcccgctaccggcccaggccccgcctcgcgagtcctcctccccgggtgcctgcccgcagcccgctcggcccagagggtgggcgcggggctgcctctaccggctggcggctgtaactcagcgaccttggcccgaaggctctagcaaggacccaccgaccccagccgcggcggcggcggcgcggactttgcccggtgtgtggggcggagcggactgcgtgtccgcggacgggcagcgaagatgttagccttcgctgccaggaccgtggtgaagcctctgggcttcctgaagcccttctccttgatgaaggcttccagccgcttcaaggcacaccaggatgcactgccacggctgcccgtgccccctctccagcagtccctggaccactacctgaaggcgctgcagcccatcgtgagtgaggaggagtgggcccacaccaagcagctggtggatgagtttcaggcctcaggaggtgtaggggagcgcctgcagaaggggctggagcgtcgggccaggaagacggagaactggctgtctgagtggtggctcaagaccgcctacctccagtaccgccagcctgtggtcatctactcgagcccaggcgtgatgctacccaagcaggacttcgtggacctgcagggtcagctccgatttgctgccaaactcattgagggtgtgttggatttcaaggtcatgattgacaacgagaccctgcccgtggagtacctgggggggaagccactgtgcatgaaccagtactatcagatcttgtcctcctgccgagtgccgggccccaagcaggacacagtcagcaacttcagcaagaccaagaagcctcccacgcacatcaccgtggtacacaactaccagttttttgagctggatgtgtaccacagtgacgggacacccctcactgcggatcagatctttgtgcagctggagaagatctggaactcatccctacagaccaacaaggagcctgtgggcatcctcacctccaaccaccgcaactcctgggccaaggcatacaacaccctcatcaaagacaaggtgaaccgggattccgtgcgctccatccagaagagcatcttcaccgtgtgcctagatgcaaccatgcccagggtctcagaagacgtgtaccgcagccacgtggcaggccagatgctgcatgggggcggcagcaggctcaacagcggcaaccgctggttcgacaagacgctgcagttcatcgtggcagaagatggctcctgtgggcttgtgtacgagcatgctgcagcggaggggccccctattgtcacccttctggactatgtcatcgagtacacgaagaaacccgagcttgtgcggtctcccatggtgcccctgcccatgcccaagaagctgcggttcaacatcacccctcgctgcttgccctgcgtcgccttgctgcatgtccgctcctctgtgtgctctcactttccactgtaaccttaagcctgcttagcttggaataagacttaggagaaaatggtgcttcactaacccgcttccggtccagtcacaatcatcatgtcactgt

SEQ ID NO: 356296 - DNA, 1476 bp, Homo sapiens
cgccccacagccaacctcccgggcaccgttgcccgcccggggcccgctaccggcccaggccccgcctcgcgagtcctcctccccgggtgcctgcccgcagcccgctcggcccagagggtgggcgcggggctgcctctaccggctggcggctgtaactcagcgaccttggcccgaaggctctagcaaggacccaccgaccccagccgcggcggcggcggcgcggactttgcccggtgtgtggggcggagcggactgcgtgtccgcggacgggcagcgaagatgttagccttcgctgccaggaccgtggaccgatcccagggctgtggtgtaacctcagcggccaggcagtctctgtcctccagccaagttttccctcatcaaaacgatcttcgcagattctgacaggtgaagcctctgggcttcctgaagcccttctccttgatgaaggcttccagccgcttcaaggcacaccaggatgcactgccacggctgcccgtgccccctctccagcagtccctggaccactacctgaaggcgctgcagcccatcgtgagtgaggaggagtgggcccacaccaagcagctggtggatgagtttcaggcctcaggaggtgtaggggagcgcctgcagaaggggctggagcgtcgggccaggaagacggagaactgggtgagtgagggcatcctcactgtgacctgctgctggctgcacatgcacagttctccagtgcccactgctctggcacggccgttcgtttgctgcccagagtttcgtgagcacatactctgtgtctggcacttggcagggtgctgggtgatcaagaaggacacagtcaccagctccttggagctaacattcaagtagggaggagagaaaggtaatgaacaggatacaggttgtggacaaggtttcatgttccaggacagaggcaggagtggggtgcacggcaggtacaaccagatagaagatgcccttgtgcttggtgggacagcctcaggcaggggatatgtgtcactcagtgaccgatcgcccaggttctgtatctgatctatgacacaggtgtacccagtttggcaaatatgtctacaccaatgtttggtgtgcttttctatttgcatctcatacttcaatacacagatttaaaaagtgaaaaaaaaaaaaaaaaaaaaaaacaaaaaaaaaaaaaacaaaacaaaaaaaggggggcgggcgggctatataataatctcgccagggggggccaccactaatggccgcgcagcgcacatatatggttgcgaaaagggggcccccacgagaaagggccgcgctaacaagaagacgtcaggactaaggagcaagatgtcacataacaacggtgtgcgaggggaggaacgaggtcacaggcgggcccgtgggcagaagacaaccacgcggtgggggggggcacacaaagggaacaactcctcccaacagatggaaacggcggggaaaaag

SEQ ID NO: 356297 - DNA, 1486 bp, Homo sapiens
cgagtgtggccaagggtgccggaggcagggttcgggtgcgtagtcgttgcgtgggcgctgcccaaaaggcgcagagcatcaagtgtgcgtgggcagaaccggcgcgggcgcccgccgcgggtctgcgcggggcgggggcgcagcaagtgcatccgagcgagcggagactagcgcaccggcgtcggtggcgagggtggtgcagaggagtccggctgggcggagggaggaaggatgggtgcgggtaactttttgaccgccttggaagtaccagtagccgcgctcgcaggggctgcctccgaccgccgggcgagctgcgagcgagtgagcccgccaccgcccctcccccacttccgcctcccgagcctcttcctcgttcccggctcccagggccgtcggtcccgtccaggccggagccaggggccccactgttgggatgctggctgcagtggggcgccccaagcccaggtcccctctgtcttctctttcgactttgcagctgtacttgttttgctcctctacccgcaggagctgacatggacccaaatcctcgggccgccctggagcgccagcagctccgccttcgggagcggcaaaaattcttcgaggacattttacagccagagacagagtttgtctttcctctgtcccatctgcatctcgagtcgcagagaccccccataggtagtatctcatccatggaagtgaatgtggacacactggagcaagtagaacttattgaccttggggacccggatgcagcagatgtgttcttgccttgcgaagatcctccaccaaccccccagtcgtctggggtggacaaccatttggaggagctgagcctgccggtgcctacatcagacaggaccacatctaggacctcctcctcctcctcctccgactcctccaccaacctgcatagcccaaatccaagtgatgatggagcagatacgcccttggcacagtcggatgaagaggaggaaaggggtgatggaggggcagagcctggagcctgcagctagcagtgggcccctgcctacagactgaccacgctggctattctccacatgagaccacaggcccagccagagcctgtcgggagaagaccagactctttacttgcagtaggcaccagaggtgggaaggatggtgggattgtgtacctttctaagaattaaccctctcctgctttactgctaattttttcctgctgcaaccctcccaccagtttttggcttactcctgagatatgatttgcaaatgaggagagagaagatgaggttggacaagatgccactgcttttcttagcactcttccctcccctaaaccatcccgtagtcttctaatacagtctctcagacaagtgtctctagatggatgtgaactccttaactcatcaagtaaggtggtactcaagccatgctgcctccttacatcctttttggaacagagcacggtataaataataaactaataataatatgccaa

SEQ ID NO: 356298 - DNA, 948 bp, Homo sapiens
catgtgctcagttcgctatccggcaggtcttgtacctggttcaggaggttcaggcagaggttgcacccactacgcctgcgcaacctcagccccgcccctccgctgctttccccggaaacgtttctttcctgttctttcctacgcagccgctcctgccgccgtggtcgctggagctttgcctctctaggccggcagcgcctctcctccatggtcctgtctgtcagcgctgttttgggagcccgccggtgaggccgggccacgctcagacacttcgatcgtcgagtctgtcactgggcatggcgggtcagttccgcagctacgtgtgggacccgctgctgatcctgtcgcagatcgtcctcatgcagaccgtgtattacggctcgctgggcctgtggctggcgctggtggacgggctagtgcgaagcagcccctcgctggaccagatgttcgacgccgagatcctgggcttttccacccctccaggccggctctccatgatgtccttcatcctcaacgccctcacctgacagggtcttgctctcttgcccaggctggagtgcagtggcgaagtcacagctcactgcagcctcgactcctgggcttaagcgatcctccgacctcagcctcctgagtagctgatactacaagcgcaaggcaccacatctggctaatttttaaattttttgtagagacagtgtctcattatgttgcccaggatggtcttgaactcctggcctcaagcagtcttcctgcctcgacctcccaaggtgctgggattacaggcgtgagccaccatgcctagcctgttcagagtaaatcttatttgaggcatgaatcaatcaaacataaatagagagttgaattgatcttagagggaatgggatgcagcaaagccctacttgaccatctcccccctcccacatttggaaatccttaaacccacttatg

SEQ ID NO: 356299 - DNA, 1273 bp, Homo sapiens
  misc_feature (1221)..(1221): n is a, c, g, or t
cgagtgtggccaagggtgccggaggcagggttcgggtgcgtagtcgttgcgtgggcgctgcccaaaaggcgcagagcatcaagtgtgcgtgggcagaaccggcgcgggcgcccgccgcgggtctgcgcggggcgggggcgcagcaagtgcatccgagcgagcggagactagcgcaccggcgtcggtggcgagggtggtgcagaggagtccggctgggcggagggaggaaggatgggtgcgggtaactttttgaccgccttggaagtaccagtagccgcgctcgcaggggctgcctccgaccgccgggcgagctgcgagcgagtgagcccgccaccgcccctcccccacttccgcctcccgagcctcttcctcgttcccggctcccagggccgtcggtcccccgggagccctggaggcgcagccccaccccggccggcgcggctcgctcccacgcccccgccgcggcctcgctggagcggacggactgagtcagagggggcgccagcgctgcaggagctgacatggacccaaatcctcgggccgccctggagcgccagcagctccgccttcgggagcggcaccatctgcatctcgagtcgcagagaccccccataggtagtatctcatccatggaagtgaatgtggacacactggagcaagtagaacttattgaccttggggacccggatgcagcagatgtgttcttgccttgcgaagatcctccaccaaccccccagtcgtctggggtggacaaccatttggaggagctgagcctgccggtgcctacatcagacaggaccacatctaggactgatgatggagcagatacgcccttggcacagtcggatgaagaggaggaaaggggtgatggaggggcagagcctggagcctgcagctagcagtgggcccctgcctacagactgaccacgctggctattctccacatgagaccacaggcccagccagagcctgtcgggagaagaccagactctttacttgcagtaggcaccagaggtgggaaggatggtgggattgtgtacctttctaagaattaaccctctcctgctttactgctaattttttcctgctgcaaccctcccaccagtttttggcttactcctgagatatgatttgcaaagccatgacggaagaatatagttgcaggtgcactgtttctagaccttcttcctaacatccgaagcttaacaagttagcaaggtntaaagatggactccattataagaggggctaaccagtgctctaacctttgaat

SEQ ID NO: 356300 - DNA, 1474 bp, Homo sapiens
cgagtgtggccaagggtgccggaggcagggttcgggtgcgtagtcgttgcgtgggcgctgcccaaaaggcgcagagcatcaagtgtgcgtgggcagaaccggcgcgggcgcccgccgcgggtctgcgcggggcgggggcgcagcaagtgcatccgagcgagcggagactagcgcaccggcgtcggtggcgagggtggtgcagaggagtccggctgggcggagggaggaaggatgggtgcgggtaactttttgaccgccttggaagtaccagtagccgcgctcgcaggggctgcctccgaccgccgggcgagctgcgagcgagtgagcccgccaccgcccctcccccacttccgcctcccgagcctcttcctcgttcccggctcccagggccgtcggtcccccgggagccctggaggcgcagccccaccccggccggcgcggctcgctcccacgcccccgccgcggcctcgctggagcggacggactgagtcagagggggcgccagcgctgcaggagctgacatggacccaaatcctcgggccgccctggagcgccagcagctccgccttcgggagcggcaaaaattcttcgaggacattttacagccagagacagagtttgtctttcctctgtcccatctgcatctcgagtcgcagagaccccccataggtagtatctcatccatggaagtgaatgtggacacactggagcaagtagaacttattgaccttggggacccggatgcagcagatgtgttcttgccttgcgaagatcctccaccaaccccccagtcgtctggggtggacaaccatttggaggagctgagcctgccggtgcctacatcagacaggaccacatctaggacctcctcctcctcctcctccgactcctccaccaacctgcatagcccaaatccaagtgatgatggagcagatacgcccttggcacagtcggatgaagaggaggaaaggggtgatggaggggcagagcctggagcctgcagctagcagtgggcccctgcctacagactgaccacgctggctattctccacatgagaccacaggcccagccagagcctgtcgggagaagaccagactctttacttgcagtaggcaccagaggtgggaaggatggtgggattgtgtacctttctaagaattaaccctctcctgctttactgctaattttttcctgctgcaaccctcccaccagtttttggcttactcctgagatatgatttgcaaatgaggagagagaagatgaggttggacaagatgccactgcttttcttagcactcttccctcccctaaaccatcccgtagtcttctaatacagtctctcagacaagtgtctctagatggatgtgaactccttaactcatcaagtaaggtggtactcaagccatgctgcctccttacatcctttttggaacagagcacggtataaataataaactaataataatatgccaa

SEQ ID NO: 356301 - DNA, 2879 bp, Homo sapiens
catgtgctcagttcgctatccggcaggtcttgtacctggttcaggaggttcaggcagaggttgcacccactacgcctgcgcaacctcagccccgcccctccgctgctttccccggaaacgtttctttcctgttctttcctacgcagccgctcctgccgccgtggtcgctggagctttgcctctctaggccggcagcgcctctcctccatggtcctgtctgtcagcgctgttttgggagcccgccggtgaggccgggccacgctcagacacttcgatcgtcgagtctgtcactgggcatggcgggtcagttccgcagctacgtgtgggacccgctgctgatcctgtcgcagatcgtcctcatgcagaccgtgtattacggctcgctgggcctgtggctggcgctggtggacgggctagtgcgaagcagcccctcgctggaccagatgttcgacgccgagatcctgggcttttccacccctccaggccggctctccatgatgtccttcatcctcaacgccctcacctgtgccctgggcttgctgtacttcatccggcgaggaaagcagtgtctggatttcactgtcactgtccatttctttcacctcctgggctgctggttctacagctcccgtttcccctcggcgctgacctggtggctggtccaagccgtgtgcattgcactcatggctgtcatcggggagtacctgtgcatgcggacggagctcaaggagatacccctcaactcagcccctaaatccaatgtctagaatcaggccctttggacatcctgctgacacttgggccccttaacaccttgggctgctcagaccctccagatgaggtccagcccagatctgagaggaaccctggaaatgtgaagtctctgttggtgtgggagagatagtgagggcctgtcaaagaaggcaggtagcagtcagcatgacagctgcaagaatgacctctgtctgttgaagccttggtatctgagaggtcaggaaggggacctctttgagggtaataacagaattggaaccatgccactcttgagccacaatacctgtcaccagcctgttgttttaagagagaaaaaaaatcaaggatatctgattggagcaaaccacttctttagtcatctgtcttacccccctgggacagctgttacctttgcagtgttgccgaatcacagcagttacctttgcagtgttgccgaatcacagcagttctgttggagaaacgcttggtttccggatccagagccacagaaagaaatgtaggtgtgaagtattaggctgctgtcagggagaggatggcagatggaggcatcaagcacaaggaaaatgcacaacctgtgccctgttatacacacgttcatgtgcacccaagaacctatgactttcttccagttccttctaccaggtccccatcctgctgccagctctcaacatagcaggccataggacccagagaagaatcccagcgttgctcaaagtctaaccatcataaagacactgcctgtcttctaggaatgaccaggcacccagctcccactggactccaattttttttcctgccttatttagaattctttggcgggaagggtatgatgggttcccagagacaagaagcccaaccttctggcctgggctgtgctgatagtgctgagggagataggaatttgctgctaagatttttctttggggtggagtttcctctgtgaggggcttgcagctatccttcctgtgtatacaaatacagtattttccatggttctgcctgcacttactttgtaatgccacggttgagattgagagagatcagcgcagccaggcaagggaactttaaagaattattaggccaccttctccctttcctggaccccagagtcattcctccatttggttaaaatactcagtgcagggaactcttacatcctgtctccttcacttgcagcgtcccctgctatgcctcaggtgaaccacataattcttgggtttccgttcctacttgctagtgatttctgaacatgttcaatggagcggcacacagtctagacccacttccgcattgaaaccttcactgttcctctttggtttcttcagagctttcccaagagagctgtcagttttcagctgtcagtaacacaaatgagtttatggtaacacaaatgagttttgctatctctctgagaagctcatctgacctcctgactctcagccctacagagtagggagttgatgctgacaggatgaaggtttaggaataaatatgcctgggaagagactgggaaggttctagggtgaggcacctcagtaactcatggtaccttggccaagttggaaggaagcagtttgttaatgaggcacagtaatcctggctgcagggtctaggaggtaagaccagctgggatgaccttccctgggttaatcaatttccctctagacaacacaaactgcaggcatgtgactaactttgaaagaacacccatcatgtggctgctgtcacccttgaccagccgtggtggtggttactccatctgtggttggagcgcctctttgggattcacttcaaggtcttgtgcctatttttctgcatatcttctgtgatgacaaatctctgtcccctgagtgttaatttgatttttagaaatggccaaaagtaacgtgatccaaactttttttcagtaatatggagactgagctgcatggtagttggggatcaaaaatatgtgaccttaatgagatttttatgatttctaaagtaacaataaaagcagtttttagagttgagttccagagagggcagggcaatggcagtgacatgtttgtcattttaataataaataacatctattgagtgcttaagaggtgtccagcagtgtg

SEQ ID NO: 356302 - DNA, 1600 bp, Homo sapiens
ttttgaaggatgggaaggggtgggctgcagcactggaggaagggaaccctccaccctgagatctctgtctctatcctatcctgtccctggccttctgaggcaagcggggccaattaaggggaaaacgtacctcctccatttgtgctgaaccaatccctccaacccctctcaggagggcatgatatggagagttgggcattggctgtgttccctgaatacagagtatctctcttgtggtgcctggaactggcatcccctttgtggagcttagggcaagccccgcctctgcatgagacttggtttgtgggacacacttggtttcagggaaggggaaagaggtcaccaagggcagaggtgtccaggccggagccaggggccccactgttgggatgctggctgcagtggggcgccccaagcccaggtcccctctgtcttctctttcgactttgcagctgtacttgttttgctcctctacccgcaggagctgacatggacccaaatcctcgggccgccctggagcgccagcagctccgccttcgggagcggcaaaaattcttcgaggacattttacagccagagacagagtttgtctttcctctgtcccatctgcatctcgagtcgcagagaccccccataggtagtatctcatccatggaagtgaatgtggacacactggagcaagtagaacttattgaccttggggacccggatgcagcagatgtgttcttgccttgcgaagatcctccaccaaccccccagtcgtctggggtggacaaccatttggaggagctgagcctgccggtgcctacatcagacaggaccacatctaggacctcctcctcctcctcctccgactcctccaccaacctgcatagcccaaatccaagtgatgatggagcagatacgcccttggcacagtcggatgaagaggaggaaaggggtgatggaggggcagagcctggagcctgcagctagcagtgggcccctgcctacagactgaccacgctggctattctccacatgagaccacaggcccagccagagcctgtcgggagaagaccagactctttacttgcagtaggcaccagaggtgggaaggatggtgggattgtgtacctttctaagaattaaccctctcctgctttactgctaattttttcctgctgcaaccctcccaccagtttttggcttactcctgagatatgatttgcaaatgaggagagagaagatgaggttggacaagatgccactgcttttcttagcactcttccctcccctaaaccatcccgtagtcttctaatacagtctctcagacaagtgtctctagatggatgtgaactccttaactcatcaagtaaggtggtactcaagccatgctgcctccttacatcctttttggaacagagcacggtataaataataaactaataataatatgccaaaaaaaaacaaaagacaaaacccgccacacaccccacagaccccacacgacgcgcctgacacagccaccagaactccaacagaccaaacaaacccagcacgagggggggcccgccaaaagaaaactccccgggcggggcgcccaacagagccacccacc

SEQ ID NO: 356303 - DNA, 1741 bp, Homo sapiens
ctggaacaacttacttcccgtctttccacttcagagagggggaacctaggatcaatgaagttgatgggttttcgtctgctggagtaggaataagttctttcctacgcagccgctcctgccgccgtggtcgctggagctttgcctctctaggccggcagcgcctctcctccatggtcctgtctgtcagcgctgttttgggagcccgccggtgaggccgggccacgctcagacacttcgatcgtcgagtctgtcactgggcatggcgggtcagttccgcagctacgtgtgggacccgctgctgatcctgtcgcagatcgtcctcatgcagaccgtgtattacggctcgctgggcctgtggctggcgctggtggacgggctagtgcgaagcagcccctcgctggaccagatgttcgacgccgagatcctgggcttttccacccctccaggccggctctccatgatgtccttcatcctcaacgccctcacctgtgccctgggcttgctgtacttcatccggcgaggaaagcagtgtctggatttcactgtcactgtccatttctttcacctcctgggctgctggttctacagctcccgtttcccctcggcgctgacctggtggctggtccaagccgtgtgcattgcactcatggctgtcatcggggagtacctgtgcatgcggacggagctcaaggagatacccctcaactcagcccctaaatccaatgtctagaatcaggccctttggacatcctgctgacacttgggccccttaacaccttgggctgctcagaccctccagatgaggtccagcccagatctgagaggaaccctggaaatgtgaagtctctgttggtgtgggagagatagtgagggcctgtcaaagaaggcaggtagcagtcagcatgacagctgcaagaatgacctctgtctgttgaagccttggtatctgagaggtcaggaaggggacctctttgagggtaataacagaattggaaccatgccactcttgagccacaatacctgtcaccagcctgttgttttaagagagaaaaaaaatcaaggatatctgattggagcaaaccacttctttagtcatctgtcttacccccctgggacagctgttacctttgcagtgttgccgaatcacagcagttacctttgcagtgttgccgaatcacagcagttctgttggagaaacgcttggtttccggatccagagccacagaaagaaatgtaggtgtgaagtattaggctgctgtcagggagaggatggcagatggaggcatcaagcacaaggaaaatgcacaacctgtgccctgttatacacacgttcatgtgcacccaagaacctatgactttcttccagttccttctaccaggtccccatcctgctgccagctctcaacatagcaggccataggacccagagaagaatcccagcgttgctcaaagtctaaccatcataaagacactgcctgtcttctaggaatgaccaggcacccagctcccactggactccaattttttttcctgccttatttagaattctttggcgggaagggtatgatgggttcccagagacaagaagcccaaccttctggcctgggctgtgctgatagtgctgagggagataggaatttgctgctaagatttttctttggggtggagtttcctctgtgaggggcttgcagctatccttcctgtgtatacaaatacagtattttccatggttctgcctgca

SEQ ID NO: 356304 - DNA, 1346 bp, Homo sapiens
  misc_feature (2)..(2): n is a, c, g, or t
  misc_feature (20)..(20): n is a, c, g, or t
  misc_feature (25)..(25): n is a, c, g, or t
  misc_feature (38)..(38): n is a, c, g, or t
gntaggctaggtagaggccngtgtnaatcggccgaggnctctctaggccggcagcgcctctcctccatggtcctgtctgtcagcgctgttttgggagcccgccggtgaggccgggccacgctcagacacttcgatcgtcgagtctgtcactgggcatggcgggtcagttccgcagctacgtgtgggacccgctgctgatcctgtcgcagatcgtcctcatgcagaccgtgtattacggctcgctgggcctgtggctggcgctggtggacgggctagtgcgaagcagcccctcgctggaccagatgttcgacgccgagatcctgggcttttccacccctccaggccggctctccatgatgtccttcatcctcaacgccctcacctggagctgacatggacccaaatcctcgggccgccctggagcgccagcagctccgccttcgggagcggcaaaaattcttcgaggacattttacagccagagacagagtttgtctttcctctgtcccatctgcatctcgagtcgcagagaccccccataggtagtatctcatccatggaagtgaatgtggacacactggagcaagtagaacttattgaccttggggacccggatgcagcagatgtgttcttgccttgcgaagatcctccaccaaccccccagtcgtctggggtggacaaccatttggaggagctgagcctgccggtgcctacatcagacaggaccacatctaggacctcctcctcctcctcctccgactcctccaccaacctgcatagcccaaatccaagtgatgatggagcagatacgcccttggcacagtcggatgaagaggaggaaaggggtgatggaggggcagagcctggagcctgcagctagcagtgggcccctgcctacagactgaccacgctggctattctccacatgagaccacaggcccagccagagcctgtcgggagaagaccagactctttacttgcagtaggcaccagaggtgggaaggatggtgggattgtgtacctttctaagaattaaccctctcctgctttactgctaattttttcctgctgcaaccctcccaccagtttttggcttactcctgagatatgatttgcaaatgaggagagagaagatgaggttggacaagatgccactgcttttcttagcactcttccctcccctaaaccatcccgtagtcttctaatacagtctctcagacaagtgtctctagatggatgtgaactccttaactcatcaagtaaggtggtactcaagccatgctgcctccttacatcctttttggaacagagcacggtataaataataaactaataataatatgccaa

SEQ ID NO: 356305 - DNA, 1322 bp, Homo sapiens
catgtgctcagttcgctatccggcaggtcttgtacctggttcaggaggttcaggcagaggttgcacccactacgcctgcgcaacctcagccccgcccctccgctgctttccccggaaacgtttctttcctgttctttcctacgcagccgctcctgccgccgtggtcgctggagctttgcctctctaggccggcagcgcctctcctccatggtcctgtctgtcagcgctgttttgggagcccgccggtgaggccgggccacgctcagacacttcgatcgtcgagtctgtcactgatcctgggcttttccacccctccaggccggctctccatgatgtccttcatcctcaacgccctcacctggagctgacatggacccaaatcctcgggccgccctggagcgccagcagctccgccttcgggagcggcaaaaattcttcgaggacattttacagccagagacagagtttgtctttcctctgtcccatctgcatctcgagtcgcagagaccccccataggtagtatctcatccatggaagtgaatgtggacacactggagcaagtagaacttattgaccttggggacccggatgcagcagatgtgttcttgccttgcgaagatcctccaccaaccccccagtcgtctggggtggacaaccatttggaggagctgagcctgccggtgcctacatcagacaggaccacatctaggacctcctcctcctcctcctccgactcctccaccaacctgcatagcccaaatccaagtgatgatggagcagatacgcccttggcacagtcggatgaagaggaggaaaggggtgatggaggggcagagcctggagcctgcagctagcagtgggcccctgcctacagactgaccacgctggctattctccacatgagaccacaggcccagccagagcctgtcgggagaagaccagactctttacttgcagtaggcaccagaggtgggaaggatggtgggattgtgtacctttctaagaattaaccctctcctgctttactgctaattttttcctgctgcaaccctcccaccagtttttggcttactcctgagatatgatttgcaaatgaggagagagaagatgaggttggacaagatgccactgcttttcttagcactcttccctcccctaaaccatcccgtagtcttctaatacagtctctcagacaagtgtctctagatggatgtgaactccttaactcatcaagtaaggtggtactcaagccatgctgcctccttacatcctttttggaacagagcacggtataaataataaactaataataatatgccaa

SEQ ID NO: 356306 - DNA, 1122 bp, Homo sapiens
ccagagccaggaatcaggggcagccgggcgagtcccagggcaggggtcctccgccgccttgcacctgccctgctgggcggcaccgggtcagtgccctgccccctcctgcgggtcccaactctctctttcccatcgtgcgtcctctggagaagtgcgcgcgtgagctgacatggacccaaatcctcgggccgccctggagcgccagcagctccgccttcgggagcggcaaaaattcttcgaggacattttacagccagagacagagtttgtctttcctctgtcccatctgcatctcgagtcgcagagaccccccataggtagtatctcatccatggaagtgaatgtggacacactggagcaagtagaacttattgaccttggggacccggatgcagcagatgtgttcttgccttgcgaagatcctccaccaaccccccagtcgtctggggtggacaaccatttggaggagctgagcctgccggtgcctacatcagacaggaccacatctaggacctcctcctcctcctcctccgactcctccaccaacctgcatagcccaaatccaagtgatgatggagcagatacgcccttggcacagtcggatgaagaggaggaaaggggtgatggaggggcagagcctggagcctgcagctagcagtgggcccctgcctacagactgaccacgctggctattctccacatgagaccacaggcccagccagagcctgtcgggagaagaccagactctttacttgcagtaggcaccagaggtgggaaggatggtgggattgtgtacctttctaagaattaaccctctcctgctttactgctaattttttcctgctgcaaccctcccaccagtttttggcttactcctgagatatgatttgcaaatgaggagagagaagatgaggttggacaagatgccactgcttttcttagcactcttccctcccctaaaccatcccgtagtcttctaatacagtctctcagacaagtgtctctagatggatgtgaactccttaactcatcaagtaaggtggtactcaagccatgctgcctccttacatcctttttggaacagagcacggtataaataataaactaataataatatgccaa

SEQ ID NO: 356307 - DNA, 1357 bp, Homo sapiens
ttttgaaggatgggaaggggtgggctgcagcactggaggaagggaaccctccaccctgagatctctgtctctatcctatcctgtccctggccttctgaggcaagcggggccaattaaggggaaaacgtacctcctccatttgtgctgaaccaatccctccaacccctctcaggagggcatgatatggagagttgggcattggctgtgttccctgaatacagagtatctctcttgtggtgcctggaactggcatcccctttgtggagcttagggcaagccccgcctctgcatgagacttggtttgtgggacacacttggtttcagggaaggggaaagaggtcaccaagggcagaggtgtccaggccggagccaggggccccactgttgggatgctggctgcagtggggcgccccaagcccaggtcccctctgtcttctctttcgactttgcagctgtacttgttttgctcctctacccgcaggagctgacatggacccaaatcctcgggccgccctggagcgccagcagctccgccttcgggagcggcaaaaattcttcgaggacattttacagccagagacagagtttgtctttcctctgtcccatctgcatctcgagtcgcagagaccccccataggtagtatctcatccatggaagtgaatgtggacacactggagcaagtagaacttattgaccttggggacccggatgcagcagatgtgttcttgccttgcgaagatcctccaccaaccccccagtcgtctggggtggacaaccatttggaggagctgagcctgccggtgcctacatcagacaggaccacatctaggacctcctcctcctcctcctccgactcctccaccaacctgcatagcccaaatccaagtgatgatggagcagatacgcccttggcacagtcggatgaagaggaggaaaggggtgatggaggggcagagcctggagcctgcagctagcagtgggcccctgcctacagactgaccacgctggctattctccacatgagaccacaggcccagccagagcctgtcgggagaagaccagactctttacttgcagtaggcaccagaggtgggaaggatggtgggattgtgtacctttctaagaattaaccctctcctgctttactgctaattttttcctgctgcaaccctcccaccagtttttggcttactcctgagatatgatttgcaaatgaggagagagaagatgaggttggacaagatgccactgcttttcttagcactcttccctcccctaaaccatcccgtagtcttctaatacagtctctcagacaagtgtctctagatggaagcgtcgcgcatggggatcctctag

SEQ ID NO: 356308 - DNA, 887 bp, Homo sapiens
  misc_feature (73)..(73): n is a, c, g, or t
atggggtaaccgttcgtacgagaatcgctgtcctctccttgcggccgccagtgtggtggaattcgacgccgancccccataggtagtatctcatccatggaagtgaatgtggacacactggagcaagtagaacttattgaccttggggacccggatgcagcagatgtgttcttgccttgcgaagatcctccaccaaccccccagtcgtctggggtggacaaccatttggaggagctgagcctgccggtgcctacatcagacaggaccacatctaggacctcctcctcctcctcctccgactcctccaccaacctgcatagcccaaatccaagtgatgatggagcagatacgcccttggcacagtcggatgaagaggaggaaaggggtgatggaggggcagagcctggagcctgcagctagcagtgggcccctgcctacagactgaccacgctggctattctccacatgagaccacaggcccagccagagcctgtcgggagaagaccagactctttacttgcagtaggcaccagaggtgggaaggatggtgggattgtgtacctttctaagaattaaccctctcctgctttactgctaattttttcctgctgcaaccctcccaccagtttttggcttactcctgagatatgatttgcaaatgaggagagagaagatgaggttggacaagatgccactgcttttcttagcactcttccctcccctaaaccatcccgtagtcttctaatacagtctctcagacaagtgtctctagatggatgtgaactccttaactcatcaagtaaggtggtactcaagccatgctgcctccttacatcctttttggaacagagcacggtataaataataaactaataataatatgccaa

SEQ ID NO: 356309 - DNA, 1540 bp, Homo sapiens
ttttgaaggatgggaaggggtgggctgcagcactggaggaagggaaccctccaccctgagatctctgtctctatcctatcctgtccctggccttctgaggcaagcggggccaattaaggggaaaacgtacctcctccatttgtgctgaaccaatccctccaacccctctcaggagggcatgatatggagagttgggcattggctgtgttccctgaatacagagtatctctcttgtggtgcctggaactggcatcccctttgtggagcttagggcaagccccgcctctgcatgagacttggtttgtgggacacacttggtttcagggaaggggaaagaggtcaccaagggcagaggtgtccaggccggagccaggggccccactgttgggatgctggctgcagtggggcgccccaagcccaggtcccctctgtcttctctttcgactttgcagctgtacttgttttgctcctctacccgcaggagctgacatggacccaaatcctcgggccgccctggagcgccagcagctccgccttcgggagcggcaaaaattcttcgaggacattttacagccagagacagagtttgtctttcctctgtcccatctgcatctcgagtcgcagagaccccccataggtagtatctcatccatggaagtgaatgtggacacactggagcaagtagaacttattgaccttggggacccggatgcagcagatgtgttcttgccttgcgaagatcctccaccaaccccccagtcgtctggtatgcccctctgctttggggacttcagtgccagtcagccagagccggatgtcaggctctgaaacgaggctacaaggctgggctggggaagtacacaagggtggacaaccatttggaggagctgagcctgccggtgcctacatcagacaggaccacatctaggacctcctcctcctcctcctccgactcctccaccaacctgcatagcccaaatccaagtgatgatggagcagatacgcccttggcacagtcggatgaagaggaggaaaggggtgatggaggggcagagcctggagcctgcagctagcagtgggcccctgcctacagactgaccacgctggctattctccacatgagaccacaggcccagccagagcctgtcgggagaagaccagactctttacttgcagtaggcaccagaggtgggaaggatggtgggattgtgtacctttctaagaattaaccctctcctgctttactgctaattttttcctgctgcaaccctcccaccagtttttggcttactcctgagatatgatttgcaaatgaggagagagaagatgaggttggacaagatgccactgcttttcttagcactcttccctcccctaaaccatcccgtagtcttctaatacagtctctcagacaagtgtctctagatggatgtgaactccttaactcatcaagtaaggtggtactcaagccatgctgcctccttacatcctttttggaacagagcacggtataaataataaactaataataatatgccaa

SEQ ID NO: 356310 - DNA, 1572 bp, Homo sapiens
cgagtgtggccaagggtgccggaggcagggttcgggtgcgtagtcgttgcgtgggcgctgcccaaaaggcgcagagcatcaagtgtgcgtgggcagaaccggcgcgggcgcccgccgcgggtctgcgcggggcgggggcgcagcaagtgcatccgagcgagcggagactagcgcaccggcgtcggtggcgagggtggtgcagaggagtccggctgggcggagggaggaaggatgggtgcgggtaactttttgaccgccttggaagtaccagtagccgcgctcgcaggggctgcctccgaccgccgggcgagctgcgagcgagtgagcccgccaccgcccctcccccacttccgcctcccgagcctcttcctcgttcccggctcccagggccgtcggtcccccgggagccctggaggcgcagccccaccccggccggcgcggctcgctcccacgcccccgccgcggcctcgctggagcggacggactgagtcagagggggcgccagcgctgcaggagctgacatggacccaaatcctcgggccgccctggagcgccagcagctccgccttcgggagcggcaaaaattcttcgaggacattttacagccagagacagagtttgtctttcctctgtcccatctgcatctcgagtcgcagagaccccccataggtagtatctcatccatggaagtgaatgtggacacactggagcaagtagaacttattgaccttggggacccggatgcagcagatgtgttcttgccttgcgaagatcctccaccaaccccccagtcgtctggtatgcccctctgctttggggacttcagtgccagtcagccagagccggatgtcaggctctgaaacgaggctacaaggctgggctggggaagtacacaagggtggacaaccatttggaggagctgagcctgccggtgcctacatcagacaggaccacatctaggacctcctcctcctcctcctccgactcctccaccaacctgcatagcccaaatccaagtgatgatggagcagatacgcccttggcacagtcggatgaagaggaggaaaggggtgatggaggggcagagcctggagcctgcagctagcagtgggcccctgcctacagactgaccacgctggctattctccacatgagaccacaggcccagccagagcctgtcgggagaagaccagactctttacttgcagtaggcaccagaggtgggaaggatggtgggattgtgtacctttctaagaattaaccctctcctgctttactgctaattttttcctgctgcaaccctcccaccagtttttggcttactcctgagatatgatttgcaaatgaggagagagaagatgaggttggacaagatgccactgcttttcttagcactcttccctcccctaaaccatcccgtagtcttctaatacagtctctcagacaagtgtctctagatggatgtgaactccttaactcatcaagtaaggtggtactcaagccatgctgcctccttacatcctttttggaacagagcacggtataaataataaactaataataatatgccaa

SEQ ID NO: 356311 - DNA, 715 bp, Homo sapiens
gccctgtttgtggcctgaccagcttttctctctgggcaggggtggacaaccatttggaggagctgagcctgccggtgcctacatcagacaggaccacatctaggacctcctcctcctcctcctccgactcctccaccaacctgcatagcccaaatccaagtgatgatggagcagatacgcccttggcacagtcggatgaagaggaggaaaggggtgatggaggggcagagcctggagcctgcagctagcagtgggcccctgcctacagactgaccacgctggctattctccacatgagaccacaggcccagccagagcctgtcgggagaagaccagactctttacttgcagtaggcaccagaggtgggaaggatggtgggattgtgtacctttctaagaattaaccctctcctgctttactgctaattttttcctgctgcaaccctcccaccagtttttggcttactcctgagatatgatttgcaaatgaggagagagaagatgaggttggacaagatgccactgcttttcttagcactcttccctcccctaaaccatcccgtagtcttctaatacagtctctcagacaagtgtctctagatggatgtgaactccttaactcatcaagtaaggtggtactcaagccatgctgcctccttacatcctttttggaacagagcacggtataaataataaactaataataatatgccaa

SEQ ID NO: 356312 - DNA, 2650 bp, Homo sapiens
ccgggcggggcgacgttgccatggagacaggccgctggctgaggcccggctcgtgtccctgcagggcatggcgggtcagttccgcagctacgtgtgggacccgctgctgatcctgtcgcagatcgtcctcatgcagaccgtgtattacggctcgctgggcctgtggctggcgctggtggacgggctagtgcgaagcagcccctcgctggaccagatgttcgacgccgagatcctgggcttttccacccctccaggccggctctccatgatgtccttcatcctcaacgccctcacctgtgccctgggcttgctgtacttcatccggcgaggaaagcagtgtctggatttcactgtcactgtccatttctttcacctcctgggctgctggttctacagctcccgtttcccctcggcgctgacctggtggctggtccaagccgtgtgcattgcactcatggctgtcatcggggagtacctgtgcatgcggacggagctcaaggagatacccctcaactcagcccctaaatccaatgtctagaatcaggccctttggacatcctgctgacacttgggccccttaacaccttgggctgctcagaccctccagatgaggtccagcccagatctgagaggaaccctggaaatgtgaagtctctgttggtgtgggagagatagtgagggcctgtcaaagaaggcaggtagcagtcagcatgacagctgcaagaatgacctctgtctgttgaagccttggtatctgagaggtcaggaaggggacctctttgagggtaataacagaattggaaccatgccactcttgagccacaatacctgtcaccagcctgttgttttaagagagaaaaaaaatcaaggatatctgattggagcaaaccacttctttagtcatctgtcttacccccctgggacagctgttacctttgcagtgttgccgaatcacagcagttacctttgcagtgttgccgaatcacagcagttctgttggagaaacgcttggtttccggatccagagccacagaaagaaatgtaggtgtgaagtattaggctgctgtcagggagaggatggcagatggaggcatcaagcacaaggaaaatgcacaacctgtgccctgttatacacacgttcatgtgcacccaagaacctatgactttcttccagttccttctaccaggtccccatcctgctgccagctctcaacatagcaggccataggacccagagaagaatcccagcgttgctcaaagtctaaccatcataaagacactgcctgtcttctaggaatgaccaggcacccagctcccactggactccaattttttttcctgccttatttagaattctttggcgggaagggtatgatgggttcccagagacaagaagcccaaccttctggcctgggctgtgctgatagtgctgagggagataggaatttgctgctaagatttttctttggggtggagtttcctctgtgaggggcttgcagctatccttcctgtgtatacaaatacagtattttccatggttctgcctgcacttactttgtaatgccacggttgagattgagagagatcagcgcagccaggcaagggaactttaaagaattattaggccaccttctccctttcctggaccccagagtcattcctccatttggttaaaatactcagtgcagggaactcttacatcctgtctccttcacttgcagcgtcccctgctatgcctcaggtgaaccacataattcttgggtttccgttcctacttgctagtgatttctgaacatgttcaatggagcggcacacagtctagacccacttccgcattgaaaccttcactgttcctctttggtttcttcagagctttcccaagagagctgtcagttttcagctgtcagtaacacaaatgagtttatggtaacacaaatgagttttgctatctctctgagaagctcatctgacctcctgactctcagccctacagagtagggagttgatgctgacaggatgaaggtttaggaataaatatgcctgggaagagactgggaaggttctagggtgaggcacctcagtaactcatggtaccttggccaagttggaaggaagcagtttgttaatgaggcacagtaatcctggctgcagggtctaggaggtaagaccagctgggatgaccttccctgggttaatcaatttccctctagacaacacaaactgcaggcatgtgactaactttgaaagaacacccatcatgtggctgctgtcacccttgaccagccgtggtggtggttactccatctgtggttggagcgcctctttgggattcacttcaaggtcttgtgcctatttttctgcatatcttctgtgatgacaaatctctgtcccctgagtgttaatttgatttttagaaatggccaaaagtaacgtgatccaaactttttttcagtaatatggagactgagctgcatggtagttggggatcaaaaatatgtgaccttaatgagatttttatgatttctaaagtaacaataaaagcagtttttagagttgagttccagagagggcagggcaatggcagtgacatgtttgtcattttaataataaataacatctattgagtgcttaagaggtgtccagcagtgtg

SEQ ID NO: 356313 - DNA, 2822 bp, Homo sapiens
catgtgctcagttcgctatccggcaggtcttgtacctggttcaggaggttcaggcagaggttgcacccactacgcctgcgcaacctcagccccgcccctccgctgctttccccggaaacgtttctttcctgttctttcctacgcagccgctcctgccgccgtggtcgctggagctttgcctctctaggccggcagcgcctctcctccatggtcctgtctgtcagcgctgttttgggagcccgccggtgaggccgggccacgctcagacacttcgatcgtcgagtctgtcactgatcgtcctcatgcagaccgtgtattacggctcgctgggcctgtggctggcgctggtggacgggctagtgcgaagcagcccctcgctggaccagatgttcgacgccgagatcctgggcttttccacccctccaggccggctctccatgatgtccttcatcctcaacgccctcacctgtgccctgggcttgctgtacttcatccggcgaggaaagcagtgtctggatttcactgtcactgtccatttctttcacctcctgggctgctggttctacagctcccgtttcccctcggcgctgacctggtggctggtccaagccgtgtgcattgcactcatggctgtcatcggggagtacctgtgcatgcggacggagctcaaggagatacccctcaactcagcccctaaatccaatgtctagaatcaggccctttggacatcctgctgacacttgggccccttaacaccttgggctgctcagaccctccagatgaggtccagcccagatctgagaggaaccctggaaatgtgaagtctctgttggtgtgggagagatagtgagggcctgtcaaagaaggcaggtagcagtcagcatgacagctgcaagaatgacctctgtctgttgaagccttggtatctgagaggtcaggaaggggacctctttgagggtaataacagaattggaaccatgccactcttgagccacaatacctgtcaccagcctgttgttttaagagagaaaaaaaatcaaggatatctgattggagcaaaccacttctttagtcatctgtcttacccccctgggacagctgttacctttgcagtgttgccgaatcacagcagttacctttgcagtgttgccgaatcacagcagttctgttggagaaacgcttggtttccggatccagagccacagaaagaaatgtaggtgtgaagtattaggctgctgtcagggagaggatggcagatggaggcatcaagcacaaggaaaatgcacaacctgtgccctgttatacacacgttcatgtgcacccaagaacctatgactttcttccagttccttctaccaggtccccatcctgctgccagctctcaacatagcaggccataggacccagagaagaatcccagcgttgctcaaagtctaaccatcataaagacactgcctgtcttctaggaatgaccaggcacccagctcccactggactccaattttttttcctgccttatttagaattctttggcgggaagggtatgatgggttcccagagacaagaagcccaaccttctggcctgggctgtgctgatagtgctgagggagataggaatttgctgctaagatttttctttggggtggagtttcctctgtgaggggcttgcagctatccttcctgtgtatacaaatacagtattttccatggttctgcctgcacttactttgtaatgccacggttgagattgagagagatcagcgcagccaggcaagggaactttaaagaattattaggccaccttctccctttcctggaccccagagtcattcctccatttggttaaaatactcagtgcagggaactcttacatcctgtctccttcacttgcagcgtcccctgctatgcctcaggtgaaccacataattcttgggtttccgttcctacttgctagtgatttctgaacatgttcaatggagcggcacacagtctagacccacttccgcattgaaaccttcactgttcctctttggtttcttcagagctttcccaagagagctgtcagttttcagctgtcagtaacacaaatgagtttatggtaacacaaatgagttttgctatctctctgagaagctcatctgacctcctgactctcagccctacagagtagggagttgatgctgacaggatgaaggtttaggaataaatatgcctgggaagagactgggaaggttctagggtgaggcacctcagtaactcatggtaccttggccaagttggaaggaagcagtttgttaatgaggcacagtaatcctggctgcagggtctaggaggtaagaccagctgggatgaccttccctgggttaatcaatttccctctagacaacacaaactgcaggcatgtgactaactttgaaagaacacccatcatgtggctgctgtcacccttgaccagccgtggtggtggttactccatctgtggttggagcgcctctttgggattcacttcaaggtcttgtgcctatttttctgcatatcttctgtgatgacaaatctctgtcccctgagtgttaatttgatttttagaaatggccaaaagtaacgtgatccaaactttttttcagtaatatggagactgagctgcatggtagttggggatcaaaaatatgtgaccttaatgagatttttatgatttctaaagtaacaataaaagcagtttttagagttgagttccagagagggcagggcaatggcagtgacatgtttgtcattttaataataaataacatctattgagtgcttaagaggtgtccagcagtgtg

SEQ ID NO: 356314 - DNA, 2494 bp, Homo sapiens
  misc_feature (73)..(73): n is a, c, g, or t
atggggtaaccgttcgtacgagaatcgctgtcctctccttgcggccgccagtgtggtggaattcgacgccganatcctgggcttttccacccctccaggccggctctccatgatgtccttcatcctcaacgccctcacctgtgccctgggcttgctgtacttcatccggcgaggaaagcagtgtctggatttcactgtcactgtccatttctttcacctcctgggctgctggttctacagctcccgtttcccctcggcgctgacctggtggctggtccaagccgtgtgcattgcactcatggctgtcatcggggagtacctgtgcatgcggacggagctcaaggagatacccctcaactcagcccctaaatccaatgtctagaatcaggccctttggacatcctgctgacacttgggccccttaacaccttgggctgctcagaccctccagatgaggtccagcccagatctgagaggaaccctggaaatgtgaagtctctgttggtgtgggagagatagtgagggcctgtcaaagaaggcaggtagcagtcagcatgacagctgcaagaatgacctctgtctgttgaagccttggtatctgagaggtcaggaaggggacctctttgagggtaataacagaattggaaccatgccactcttgagccacaatacctgtcaccagcctgttgttttaagagagaaaaaaaatcaaggatatctgattggagcaaaccacttctttagtcatctgtcttacccccctgggacagctgttacctttgcagtgttgccgaatcacagcagttacctttgcagtgttgccgaatcacagcagttctgttggagaaacgcttggtttccggatccagagccacagaaagaaatgtaggtgtgaagtattaggctgctgtcagggagaggatggcagatggaggcatcaagcacaaggaaaatgcacaacctgtgccctgttatacacacgttcatgtgcacccaagaacctatgactttcttccagttccttctaccaggtccccatcctgctgccagctctcaacatagcaggccataggacccagagaagaatcccagcgttgctcaaagtctaaccatcataaagacactgcctgtcttctaggaatgaccaggcacccagctcccactggactccaattttttttcctgccttatttagaattctttggcgggaagggtatgatgggttcccagagacaagaagcccaaccttctggcctgggctgtgctgatagtgctgagggagataggaatttgctgctaagatttttctttggggtggagtttcctctgtgaggggcttgcagctatccttcctgtgtatacaaatacagtattttccatggttctgcctgcacttactttgtaatgccacggttgagattgagagagatcagcgcagccaggcaagggaactttaaagaattattaggccaccttctccctttcctggaccccagagtcattcctccatttggttaaaatactcagtgcagggaactcttacatcctgtctccttcacttgcagcgtcccctgctatgcctcaggtgaaccacataattcttgggtttccgttcctacttgctagtgatttctgaacatgttcaatggagcggcacacagtctagacccacttccgcattgaaaccttcactgttcctctttggtttcttcagagctttcccaagagagctgtcagttttcagctgtcagtaacacaaatgagtttatggtaacacaaatgagttttgctatctctctgagaagctcatctgacctcctgactctcagccctacagagtagggagttgatgctgacaggatgaaggtttaggaataaatatgcctgggaagagactgggaaggttctagggtgaggcacctcagtaactcatggtaccttggccaagttggaaggaagcagtttgttaatgaggcacagtaatcctggctgcagggtctaggaggtaagaccagctgggatgaccttccctgggttaatcaatttccctctagacaacacaaactgcaggcatgtgactaactttgaaagaacacccatcatgtggctgctgtcacccttgaccagccgtggtggtggttactccatctgtggttggagcgcctctttgggattcacttcaaggtcttgtgcctatttttctgcatatcttctgtgatgacaaatctctgtcccctgagtgttaatttgatttttagaaatggccaaaagtaacgtgatccaaactttttttcagtaatatggagactgagctgcatggtagttggggatcaaaaatatgtgaccttaatgagatttttatgatttctaaagtaacaataaaagcagtttttagagttgagttccagagagggcagggcaatggcagtgacatgtttgtcattttaataataaataacatctattgagtgcttaagaggtgtccagcagtgtg

SEQ ID NO: 356315 - DNA, 1066 bp, Homo sapiens
ctggaacaacttacttcccgtctttccacttcagagagggggaacctaggatcaatgaagttgatgggttttcgtctgctggagtaggaataagttctttcctacgcagccgctcctgccgccgtggtcgctggagctttgcctctctaggccggcagcgcctctcctccatggtcctgtctgtcagcgctgttttgggagcccgccggtgaggccgggccacgctcagacacttcgatcgtcgagtctgtcactgggcatggcgggtcagttccgcagctacgtgtgggacccgctgctgatcctgtcgcagatcgtcctcatgcagaccgtgtattacggctcgctgggcctgtggctggcgctggtggacgggctagtgcgaagcagcccctcgctggaccagatgttcgacgccgagatcctgggcttttccacccctccaggccggctctccatgatgtccttcatcctcaacgccctcacctgtgccctgggcttgctgtacttcatccggcgaggaaagcagtgtctggatttcactgtcactgtccatttctttcacctcctgggctgctggttctacagctcccgtttcccctcggcgctgacctggtggctggtccaagccgtgtgcattgcactcatggctgtcatcggggagtacctgtgcatgcggacggagctcaaggagatacccctcaactcagcccctaaatccaatgtctagaatcaggccctttggacatcctgctgacacttgggccccttaacaccttgggctgctcagaccctccagatgaggtccagcccagatctgagaggaaccctggaaatgtgaagtctctgttggtgtgggagagatagtgagggcctgtcaaagaaggcaggtagcagtcagcatgacagctgcaagaatgacctctgtctgttgaagccttggtatctgagaggtcaggaaggggacctctttgagggtaataacagaattggaaccatgccactcttgagccacaatacctgtcaccagcctgcaccgcacgattcccttagcaccagcacgagt

SEQ ID NO: 356316 - DNA, 1943 bp, Homo sapiens
catgtgctcagttcgctatccggcaggtcttgtacctggttcaggaggttcaggcagaggttgcacccactacgcctgcgcaacctcagccccgcccctccgctgctttccccggaaacgtttctttcctgttctttcctacgcagccgctcctgccgccgtggtcgctggagctttgcctctctaggccggcagcgcctctcctccatggtcctgtctgtcagcgctgttttgggagcccgccggtgaggccgggccacgctcagacacttcgatcgtcgagtctgtcactgggcatggcgggtcagttccgcagctacgtgtgggacccgctgctgatcctgtcgcagatcgtcctcatgcagaccgtgtattacggctcgctgggcctgtggctggcgctggtggacgggctagtgcgaagcagcccctcgctggaccagatgttcgacgccgagatcctgggcttttccacccctccaggccggctctccatgatgtccttcatcctcaacgccctcacctgtgccctgggcttgctgtacttcatccggcgaggaaagcagtgtctggatttcactgtcactgtccatttctttcacctcctgggctgctggttctacagctcccgtttcccctcggcgctgacctggtggctggtccaagccgtgtgcattgcactcatggctgtcatcggggagtacctgtgcatgcggacggagctcaaggagataggaatttgctgctaagatttttctttggggtggagtttcctctgtgaggggcttgcagctatccttcctgtgtatacaaatacagtattttccatggttctgcctgcacttactttgtaatgccacggttgagattgagagagatcagcgcagccaggcaagggaactttaaagaattattaggccaccttctccctttcctggaccccagagtcattcctccatttggttaaaatactcagtgcagggaactcttacatcctgtctccttcacttgcagcgtcccctgctatgcctcaggtgaaccacataattcttgggtttccgttcctacttgctagtgatttctgaacatgttcaatggagcggcacacagtctagacccacttccgcattgaaaccttcactgttcctctttggtttcttcagagctttcccaagagagctgtcagttttcagctgtcagtaacacaaatgagtttatggtaacacaaatgagttttgctatctctctgagaagctcatctgacctcctgactctcagccctacagagtagggagttgatgctgacaggatgaaggtttaggaataaatatgcctgggaagagactgggaaggttctagggtgaggcacctcagtaactcatggtaccttggccaagttggaaggaagcagtttgttaatgaggcacagtaatcctggctgcagggtctaggaggtaagaccagctgggatgaccttccctgggttaatcaatttccctctagacaacacaaactgcaggcatgtgactaactttgaaagaacacccatcatgtggctgctgtcacccttgaccagccgtggtggtggttactccatctgtggttggagcgcctctttgggattcacttcaaggtcttgtgcctatttttctgcatatcttctgtgatgacaaatctctgtcccctgagtgttaatttgatttttagaaatggccaaaagtaacgtgatccaaactttttttcagtaatatggagactgagctgcatggtagttggggatcaaaaatatgtgaccttaatgagatttttatgatttctaaagtaacaataaaagcagtttttagagttgagttccagagagggcagggcaatggcagtgacatgtttgtcattttaataataaataacatctattgagtgcttaagaggtgtccagcagtgtg

SEQ ID NO: 356317 - DNA, 1843 bp, Homo sapiens
catgtgctcagttcgctatccggcaggtcttgtacctggttcaggaggttcaggcagaggttgcacccactacgcctgcgcaacctcagccccgcccctccgctgctttccccggaaacgtttctttcctgttctttcctacgcagccgctcctgccgccgtggtcgctggagctttgcctctctaggccggcagcgcctctcctccatggtcctgtctgtcagcgctgttttgggagcccgccggtgaggccgggccacgctcagacacttcgatcgtcgagtctgtcactgggcatggcgggtcagttccgcagctacgtgtgggacccgctgctgatcctgtcgcagatcgtcctcatgcagaccgtgtattacggctcgctgggcctgctgccagctctcaacatagcaggccataggacccagagaagaatcccagcgttgctcaaagtctaaccatcataaagacactgcctgtcttctaggaatgaccaggcacccagctcccactggactccaattttttttcctgccttatttagaattctttggcgggaagggtatgatgggttcccagagacaagaagcccaaccttctggcctgggctgtgctgatagtgctgagggagataggaatttgctgctaagatttttctttggggtggagtttcctctgtgaggggcttgcagctatccttcctgtgtatacaaatacagtattttccatggttctgcctgcacttactttgtaatgccacggttgagattgagagagatcagcgcagccaggcaagggaactttaaagaattattaggccaccttctccctttcctggaccccagagtcattcctccatttggttaaaatactcagtgcagggaactcttacatcctgtctccttcacttgcagcgtcccctgctatgcctcaggtgaaccacataattcttgggtttccgttcctacttgctagtgatttctgaacatgttcaatggagcggcacacagtctagacccacttccgcattgaaaccttcactgttcctctttggtttcttcagagctttcccaagagagctgtcagttttcagctgtcagtaacacaaatgagtttatggtaacacaaatgagttttgctatctctctgagaagctcatctgacctcctgactctcagccctacagagtagggagttgatgctgacaggatgaaggtttaggaataaatatgcctgggaagagactgggaaggttctagggtgaggcacctcagtaactcatggtaccttggccaagttggaaggaagcagtttgttaatgaggcacagtaatcctggctgcagggtctaggaggtaagaccagctgggatgaccttccctgggttaatcaatttccctctagacaacacaaactgcaggcatgtgactaactttgaaagaacacccatcatgtggctgctgtcacccttgaccagccgtggtggtggttactccatctgtggttggagcgcctctttgggattcacttcaaggtcttgtgcctatttttctgcatatcttctgtgatgacaaatctctgtcccctgagtgttaatttgatttttagaaatggccaaaagtaacgtgatccaaactttttttcagtaatatggagactgagctgcatggtagttggggatcaaaaatatgtgaccttaatgagatttttatgatttctaaagtaacaataaaagcagtttttagagttgagttccagagagggcagggcaatggcagtgacatgtttgtcattttaataataaataacatctattgagtgcttaagaggtgtccagcagtgtg

SEQ ID NO: 356318 - DNA, 1639 bp, Homo sapiens
ctctcttaccgccatcttggctcctgtggaggcctgctgggaacgggacttctaaaaggaactatgtctggaaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaacaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtgatgctgtacccctcaaggatttaaactaacgaaaaatcaataaataaatgtggatttgtgctcttgtatttttaagtggattaaaaaacttactaccttaaaaaaaaaaaaaaaaaaaaaaaaaaaaaaaaaaaaaaaaaaaaaaaaaaaaaaaaaaaaaaaaaaaaaaaaaaaaaaaaaaaaaaacggtcccccgggagccctggaggcgcagccccaccccggccggcgcggctcgctcccacgcccccgccgcggcctcgctggagcggacggactgagtcagagggggcgccagcgctgcaggagctgacatggacccaaatcctcgggccgccctggagcgccagcagctccgccttcgggagcggcaaaaattcttcgaggacattttacagccagagacagagtttgtctttcctctgtcccatctgcatctcgagtcgcagagaccccccataggtagtatctcatccatggaagtgaatgtggacacactggagcaagtagaacttattgaccttggggacccggatgcagcagatgtgttcttgccttgcgaagatcctccaccaaccccccagtcgtctggggtggacaaccatttggaggagctgagcctgccggtgcctacatcagacaggaccacatctaggacctcctcctcctcctcctccgactcctccaccaacctgcatagcccaaatccaagtgatgatggagcagatacgcccttggcacagtcggatgaagaggaggaaaggggtgatggaggggcagagcctggagcctgcagctagcagtgggcccctgcctacagactgaccacgctggctattctccacatgagaccacaggcccagccagagcctgtcgggagaagaccagactctttacttgcagtaggcaccagaggtgggaaggatggtgggattgtgtacctttctaagaattaaccctctcctgctttactgctaattttttcctgctgcaaccctcccaccagtttttggcttactcctgagatatgatttgcaaatgaggagagagaagatgaggttggacaagatgccactgcttttcttagcactcttccctcccctaaaccatcccgtagtcttctaatacagtctctcagacaagtgtctctagatggatgtgaactccttaactcatcaagtaaggtggtactcaagccatgctgcctccttacatcctttttggaacagagcacggtataaataataaactaataataatatgccaa

SEQ ID NO: 356319 - DNA, 1260 bp, Homo sapiens
ttttgaaggatgggaaggggtgggctgcagcactggaggaagggaaccctccaccctgagatctctgtctctatcctatcctgtccctggccttctgaggcaagcggggccaattaaggggaaaacgtacctcctccatttgtgctgaaccaatccctccaacccctctcaggagggcatgatatggagagttgggcattggctgtgttccctgaatacagagtatctctcttgtggtgcctggaactggcatcccctttgtggagcttagggcaagccccgcctctgcatgagacttggagctgacatggacccaaatcctcgggccgccctggagcgccagcagctccgccttcgggagcggcaaaaattcttcgaggacattttacagccagagacagagtttgtctttcctctgtcccatctgcatctcgagtcgcagagaccccccataggtagtatctcatccatggaagtgaatgtggacacactggagcaagtagaacttattgaccttggggacccggatgcagcagatgtgttcttgccttgcgaagatcctccaccaaccccccagtcgtctggggtggacaaccatttggaggagctgagcctgccggtgcctacatcagacaggaccacatctaggacctcctcctcctcctcctccgactcctccaccaacctgcatagcccaaatccaagtgatgatggagcagatacgcccttggcacagtcggatgaagaggaggaaaggggtgatggaggggcagagcctggagcctgcagctagcagtgggcccctgcctacagactgaccacgctggctattctccacatgagaccacaggcccagccagagcctgtcgggagaagaccagactctttacttgcagtaggcaccagaggtgggaaggatggtgggattgtgtacctttctaagaattaaccctctcctgctttactgctaattttttcctgctgcaaccctcccaccagtttttggcttactcctgagatatgatttgcaaatgaggagagagaagatgaggttggacaagatgccactgcttttcttagcactcttccctcccctaaaccatcccgtagtcttctaatacagtctctcagacaagtgtctctagatggatgtgaactccttaactcatcaagtaaggtggtactcaagccatgctgcctccttacatcctttttggaacagagcacggtataaataataaactaataataatatgccaa

SEQ ID NO: 356320 - DNA, 1442 bp, Homo sapiens
ttttgaaggatgggaaggggtgggctgcagcactggaggaagggaaccctccaccctgagatctctgtctctatcctatcctgtccctggccttctgaggcaagcggggccaattaaggggaaaacgtacctcctccatttgtgctgaaccaatccctccaacccctctcaggagggcatgatatggagagttgggcattggctgtgttccctgaatacagagtatctctcttgtggtgcctggaactggcatcccctttgtggagcttagggcaagccccgcctctgcatgagacttggtttgtgggacacacttggtttcagggaaggggaaagaggtcaccaagggcagaggtgtccaggccggagccaggggccccactgttgggatgctggctgcagtggggcgccccaagcccaggtcccctctgtcttctctttcgactttgcagctgtacttgttttgctcctctacccgcaggagctgacatggacccaaatcctcgggccgccctggagcgccagcagctccgccttcgggagcggcaaaaattcttcgaggacattttacagccagagacagagtttgtctttcctctgtcccatctgcatctcgagtcgcagagaccccccataggtagtatctcatccatggaagtgaatgtggacacactggagcaagtagaacttattgaccttggggacccggatgcagcagatgtgttcttgccttgcgaagatcctccaccaaccccccagtcgtctggggtggacaaccatttggaggagctgagcctgccggtgcctacatcagacaggaccacatctaggacctcctcctcctcctcctccgactcctccaccaacctgcatagcccaaatccaagtgatgatggagcagatacgcccttggcacagtcggatgaagaggaggaaaggggtgatggaggggcagagcctggagcctgcagctagcagtgggcccctgcctacagactgaccacgctggctattctccacatgagaccacaggcccagccagagcctgtcgggagaagaccagactctttacttgcagtaggcaccagaggtgggaaggatggtgggattgtgtacctttctaagaattaaccctctcctgctttactgctaattttttcctgctgcaaccctcccaccagtttttggcttactcctgagatatgatttgcaaatgaggagagagaagatgaggttggacaagatgccactgcttttcttagcactcttccctcccctaaaccatcccgtagtcttctaatacagtctctcagacaagtgtctctagatggatgtgaactccttaactcatcaagtaaggtggtactcaagccatgctgcctccttacatcctttttggaacagagcacggtataaataataaactaataataatatgccaa

SEQ ID NO: 356321 - DNA, 2842 bp, Homo sapiens
ctggaacaacttacttcccgtctttccacttcagagagggggaacctaggatcaatgaagttgatgggttttcgtctgctggagtaggaataagttctttcctacgcagccgctcctgccgccgtggtcgctggagctttgcctctctaggccggcagcgcctctcctccatggtcctgtctgtcagcgctgttttgggagcccgccggtgaggccgggccacgctcagacacttcgatcgtcgagtctgtcactgggcatggcgggtcagttccgcagctacgtgtgggacccgctgctgatcctgtcgcagatcgtcctcatgcagaccgtgtattacggctcgctgggcctgtggctggcgctggtggacgggctagtgcgaagcagcccctcgctggaccagatgttcgacgccgagatcctgggcttttccacccctccaggccggctctccatgatgtccttcatcctcaacgccctcacctgtgccctgggcttgctgtacttcatccggcgaggaaagcagtgtctggatttcactgtcactgtccatttctttcacctcctgggctgctggttctacagctcccgtttcccctcggcgctgacctggtggctggtccaagccgtgtgcattgcactcatggctgtcatcggggagtacctgtgcatgcggacggagctcaaggagatacccctcaactcagcccctaaatccaatgtctagaatcaggccctttggacatcctgctgacacttgggccccttaacaccttgggctgctcagaccctccagatgaggtccagcccagatctgagaggaaccctggaaatgtgaagtctctgttggtgtgggagagatagtgagggcctgtcaaagaaggcaggtagcagtcagcatgacagctgcaagaatgacctctgtctgttgaagccttggtatctgagaggtcaggaaggggacctctttgagggtaataacagaattggaaccatgccactcttgagccacaatacctgtcaccagcctgttgttttaagagagaaaaaaaatcaaggatatctgattggagcaaaccacttctttagtcatctgtcttacccccctgggacagctgttacctttgcagtgttgccgaatcacagcagttacctttgcagtgttgccgaatcacagcagttctgttggagaaacgcttggtttccggatccagagccacagaaagaaatgtaggtgtgaagtattaggctgctgtcagggagaggatggcagatggaggcatcaagcacaaggaaaatgcacaacctgtgccctgttatacacacgttcatgtgcacccaagaacctatgactttcttccagttccttctaccaggtccccatcctgctgccagctctcaacatagcaggccataggacccagagaagaatcccagcgttgctcaaagtctaaccatcataaagacactgcctgtcttctaggaatgaccaggcacccagctcccactggactccaattttttttcctgccttatttagaattctttggcgggaagggtatgatgggttcccagagacaagaagcccaaccttctggcctgggctgtgctgatagtgctgagggagataggaatttgctgctaagatttttctttggggtggagtttcctctgtgaggggcttgcagctatccttcctgtgtatacaaatacagtattttccatggttctgcctgcacttactttgtaatgccacggttgagattgagagagatcagcgcagccaggcaagggaactttaaagaattattaggccaccttctccctttcctggaccccagagtcattcctccatttggttaaaatactcagtgcagggaactcttacatcctgtctccttcacttgcagcgtcccctgctatgcctcaggtgaaccacataattcttgggtttccgttcctacttgctagtgatttctgaacatgttcaatggagcggcacacagtctagacccacttccgcattgaaaccttcactgttcctctttggtttcttcagagctttcccaagagagctgtcagttttcagctgtcagtaacacaaatgagtttatggtaacacaaatgagttttgctatctctctgagaagctcatctgacctcctgactctcagccctacagagtagggagttgatgctgacaggatgaaggtttaggaataaatatgcctgggaagagactgggaaggttctagggtgaggcacctcagtaactcatggtaccttggccaagttggaaggaagcagtttgttaatgaggcacagtaatcctggctgcagggtctaggaggtaagaccagctgggatgaccttccctgggttaatcaatttccctctagacaacacaaactgcaggcatgtgactaactttgaaagaacacccatcatgtggctgctgtcacccttgaccagccgtggtggtggttactccatctgtggttggagcgcctctttgggattcacttcaaggtcttgtgcctatttttctgcatatcttctgtgatgacaaatctctgtcccctgagtgttaatttgatttttagaaatggccaaaagtaacgtgatccaaactttttttcagtaatatggagactgagctgcatggtagttggggatcaaaaatatgtgaccttaatgagatttttatgatttctaaagtaacaataaaagcagtttttagagttgagttccagagagggcagggcaatggcagtgacatgtttgtcattttaataataaataacatctattgagtgcttaagaggtgtccagcagtgtg

SEQ ID NO: 356322 - DNA, 2787 bp, Homo sapiens
  misc_feature (2)..(2): n is a, c, g, or t
  misc_feature (20)..(20): n is a, c, g, or t
  misc_feature (25)..(25): n is a, c, g, or t
  misc_feature (38)..(38): n is a, c, g, or t
gntaggctaggtagaggccngtgtnaatcggccgaggngttctttcctacgcagccgctcctgccgccgtggtcgctggagctttgcctctctaggccggcagcgcctctcctccatggtcctgtctgtcagcgctgttttgggagcccgccggtgaggccgggccacgctcagacacttcgatcgtcgagtctgtcactgggcatggcgggtcagttccgcagctacgtgtgggacccgctgctgatcctgtcgcagatcgtcctcatgcagaccgtgtattacggctcgctgggcctgtggctggcgctggtggacgggctagtgcgaagcagcccctcgctggaccagatgttcgacgccgagatcctgggcttttccacccctccaggccggctctccatgatgtccttcatcctcaacgccctcacctgtgccctgggcttgctgtacttcatccggcgaggaaagcagtgtctggatttcactgtcactgtccatttctttcacctcctgggctgctggttctacagctcccgtttcccctcggcgctgacctggtggctggtccaagccgtgtgcattgcactcatggctgtcatcggggagtacctgtgcatgcggacggagctcaaggagatacccctcaactcagcccctaaatccaatgtctagaatcaggccctttggacatcctgctgacacttgggccccttaacaccttgggctgctcagaccctccagatgaggtccagcccagatctgagaggaaccctggaaatgtgaagtctctgttggtgtgggagagatagtgagggcctgtcaaagaaggcaggtagcagtcagcatgacagctgcaagaatgacctctgtctgttgaagccttggtatctgagaggtcaggaaggggacctctttgagggtaataacagaattggaaccatgccactcttgagccacaatacctgtcaccagcctgttgttttaagagagaaaaaaaatcaaggatatctgattggagcaaaccacttctttagtcatctgtcttacccccctgggacagctgttacctttgcagtgttgccgaatcacagcagttacctttgcagtgttgccgaatcacagcagttctgttggagaaacgcttggtttccggatccagagccacagaaagaaatgtaggtgtgaagtattaggctgctgtcagggagaggatggcagatggaggcatcaagcacaaggaaaatgcacaacctgtgccctgttatacacacgttcatgtgcacccaagaacctatgactttcttccagttccttctaccaggtccccatcctgctgccagctctcaacatagcaggccataggacccagagaagaatcccagcgttgctcaaagtctaaccatcataaagacactgcctgtcttctaggaatgaccaggcacccagctcccactggactccaattttttttcctgccttatttagaattctttggcgggaagggtatgatgggttcccagagacaagaagcccaaccttctggcctgggctgtgctgatagtgctgagggagataggaatttgctgctaagatttttctttggggtggagtttcctctgtgaggggcttgcagctatccttcctgtgtatacaaatacagtattttccatggttctgcctgcacttactttgtaatgccacggttgagattgagagagatcagcgcagccaggcaagggaactttaaagaattattaggccaccttctccctttcctggaccccagagtcattcctccatttggttaaaatactcagtgcagggaactcttacatcctgtctccttcacttgcagcgtcccctgctatgcctcaggtgaaccacataattcttgggtttccgttcctacttgctagtgatttctgaacatgttcaatggagcggcacacagtctagacccacttccgcattgaaaccttcactgttcctctttggtttcttcagagctttcccaagagagctgtcagttttcagctgtcagtaacacaaatgagtttatggtaacacaaatgagttttgctatctctctgagaagctcatctgacctcctgactctcagccctacagagtagggagttgatgctgacaggatgaaggtttaggaataaatatgcctgggaagagactgggaaggttctagggtgaggcacctcagtaactcatggtaccttggccaagttggaaggaagcagtttgttaatgaggcacagtaatcctggctgcagggtctaggaggtaagaccagctgggatgaccttccctgggttaatcaatttccctctagacaacacaaactgcaggcatgtgactaactttgaaagaacacccatcatgtggctgctgtcacccttgaccagccgtggtggtggttactccatctgtggttggagcgcctctttgggattcacttcaaggtcttgtgcctatttttctgcatatcttctgtgatgacaaatctctgtcccctgagtgttaatttgatttttagaaatggccaaaagtaacgtgatccaaactttttttcagtaatatggagactgagctgcatggtagttggggatcaaaaatatgtgaccttaatgagatttttatgatttctaaagtaacaataaaagcagtttttagagttgagttccagagagggcagggcaatggcagtgacatgtttgtcattttaataataaataacatctattgagtgcttaagaggtgtccagcagtgtg

SEQ ID NO: 356323 - DNA, 1258 bp, Homo sapiens
ccgggcggggcgacgttgccatggagacaggccgctggctgaggcccggctcgtgtccctgcagggcatggcgggtcagttccgcagctacgtgtgggacccgctgctgatcctgtcgcagatcgtcctcatgcagaccgtgtattacggctcgctgggcctgtggctggcgctggtggacgggctagtgcgaagcagcccctcgctggaccagatgttcgacgccgagatcctgggcttttccacccctccaggccggctctccatgatgtccttcatcctcaacgccctcacctggagctgacatggacccaaatcctcgggccgccctggagcgccagcagctccgccttcgggagcggcaaaaattcttcgaggacattttacagccagagacagagtttgtctttcctctgtcccatctgcatctcgagtcgcagagaccccccataggtagtatctcatccatggaagtgaatgtggacacactggagcaagtagaacttattgaccttggggacccggatgcagcagatgtgttcttgccttgcgaagatcctccaccaaccccccagtcgtctggggtggacaaccatttggaggagctgagcctgccggtgcctacatcagacaggaccacatctaggacctcctcctcctcctcctccgactcctccaccaacctgcatagcccaaatccaagtgatgatggagcagatacgcccttggcacagtcggatgaagaggaggaaaggggtgatggaggggcagagcctggagcctgcagctagcagtgggcccctgcctacagactgaccacgctggctattctccacatgagaccacaggcccagccagagcctgtcgggagaagaccagactctttacttgcagtaggcaccagaggtgggaaggatggtgggattgtgtacctttctaagaattaaccctctcctgctttactgctaattttttcctgctgcaaccctcccaccagtttttggcttactcctgagatatgatttgcaaatgaggagagagaagatgaggttggacaagatgccactgcttttcttagcactcttccctcccctaaaccatcccgtagtcttctaatacagtctctcagacaagtgtctctagatggatgtgaactccttaactcatcaagtaaggtggtactcaagccatgctgcctccttacatcctttttggaacagagcacggtataaataataaactaataataatatgccaa

SEQ ID NO: 356324 - DNA, 1320 bp, Homo sapiens
ccgggcggggcgacgttgccatggagacaggccgctggctgaggcccggctcgtgtccctgcagggcatggcgggtcagttccgcagctacgtgtgggacccgctgctgatcctgtcgcagatcgtcctcatgcagaccgtgtattacggctcgctgggcctgtggctggcgctggtggacgggctagtgcgaagcagcccctcgctggaccagatgttcgacgccgagatcctgggcttttccacccctccaggccggctctccatgatgtccttcatcctcaacgccctcacctggcacttctccttgctgctgccacatgaagaaggacgtgtttgcttccccttccaccatgattgagctgacatggacccaaatcctcgggccgccctggagcgccagcagctccgccttcgggagcggcaaaaattcttcgaggacattttacagccagagacagagtttgtctttcctctgtcccatctgcatctcgagtcgcagagaccccccataggtagtatctcatccatggaagtgaatgtggacacactggagcaagtagaacttattgaccttggggacccggatgcagcagatgtgttcttgccttgcgaagatcctccaccaaccccccagtcgtctggggtggacaaccatttggaggagctgagcctgccggtgcctacatcagacaggaccacatctaggacctcctcctcctcctcctccgactcctccaccaacctgcatagcccaaatccaagtgatgatggagcagatacgcccttggcacagtcggatgaagaggaggaaaggggtgatggaggggcagagcctggagcctgcagctagcagtgggcccctgcctacagactgaccacgctggctattctccacatgagaccacaggcccagccagagcctgtcgggagaagaccagactctttacttgcagtaggcaccagaggtgggaaggatggtgggattgtgtacctttctaagaattaaccctctcctgctttactgctaattttttcctgctgcaaccctcccaccagtttttggcttactcctgagatatgatttgcaaatgaggagagagaagatgaggttggacaagatgccactgcttttcttagcactcttccctcccctaaaccatcccgtagtcttctaatacagtctctcagacaagtgtctctagatggatgtgaactccttaactcatcaagtaaggtggtactcaagccatgctgcctccttacatcctttttggaacagagcacggtataaataataaactaataataatatgccaa

SEQ ID NO: 356325 - DNA, 1357 bp, Homo sapiens
ttttgaaggatgggaaggggtgggctgcagcactggaggaagggaaccctccaccctgagatctctgtctctatcctatcctgtccctggccttctgaggcaagcggggccaattaaggggaaaacgtacctcctccatttgtgctgaaccaatccctccaacccctctcaggagggcatgatatggagagttgggcattggctgtgttccctgaatacagagtatctctcttgtggtgcctggaactggcatcccctttgtggagcttagggcaagccccgcctctgcatgagacttggtttgtgggacacacttggtttcagggaaggggaaagaggtcaccaagggcagaggtgtccaggccggagccaggggccccactgttgggatgctggctgcagtggggcgccccaagcccaggtcccctctgtcttctctttcgactttgcagctgtacttgttttgctcctctacccgcaggagctgacatggacccaaatcctcgggccgccctggagcgccagcagctccgccttcgggagcggcaaaaattcttcgaggacattttacagccagagacagagtttgtctttcctctgtcccatctgcatctcgagtcgcagagaccccccataggtagtatctcatccatggaagtgaatgtggacacactggagcaagtagaacttattgaccttggggacccggatgcagcagatgtgttcttgccttgcgaagatcctccaccaaccccccagtcgtctggggtggacaaccatttggaggagctgagcctgccggtgcctacatcagacaggaccacatctaggacctcctcctcctcctcctccgactcctccaccaacctgcatagcccaaatccaagtgatgatggagcagatacgcccttggcacagtcggatgaagaggaggaaaggggtgatggaggggcagagcctggagcctgcagctagcagtgggcccctgcctacagactgaccacgctggctattctccacatgagaccacaggcccagccagagcctgtcgggagaagaccagactctttacttgcagtaggcaccagaggtgggaaggatggtgggattgtgtacctttctaagaattaaccctctcctgctttactgctaattttttcctgctgcaaccctcccaccagtttttggcttactcctgagatatgatttgcaaatgaggagagagaagatgaggttggacaagatgccactgcttttcttagcactcttccctcccctaaaccatcccgtagtcttctaatacagtctctcagacaagtgtctctagatggagcgtcgcgcatgggtaccgagctcg

SEQ ID NO: 356326 - DNA, 1388 bp, Homo sapiens
ttttgaaggatgggaaggggtgggctgcagcactggaggaagggaaccctccaccctgagatctctgtctctatcctatcctgtccctggccttctgaggcaagcggggccaattaaggggaaaacgtacctcctccatttgtgctgaaccaatccctccaacccctctcaggagggcatgatatggagagttgggcattggctgtgttccctgaatacagagtatctctcttgtggtgcctggaactggcatcccctttgtggagcttagggcaagccccgcctctgcatgagacttggtttgtgggacacacttggtttcagggaaggggaaagaggtcaccaagggcagaggtgtccaggccggagccaggggccccactgttgggatgctggctgcagtggggcgccccaagcccaggtcccctctgtcttctctttcgactttgcagctgtacttgttttgctcctctacccgcaggagctgacatggacccaaatcctcgggccgccctggagcgccagcagctccgccttcgggagcggcaccatctgcatctcgagtcgcagagaccccccataggtagtatctcatccatggaagtgaatgtggacacactggagcaagtagaacttattgaccttggggacccggatgcagcagatgtgttcttgccttgcgaagatcctccaccaaccccccagtcgtctggggtggacaaccatttggaggagctgagcctgccggtgcctacatcagacaggaccacatctaggacctcctcctcctcctcctccgactcctccaccaacctgcatagcccaaatccaagtgatgatggagcagatacgcccttggcacagtcggatgaagaggaggaaaggggtgatggaggggcagagcctggagcctgcagctagcagtgggcccctgcctacagactgaccacgctggctattctccacatgagaccacaggcccagccagagcctgtcgggagaagaccagactctttacttgcagtaggcaccagaggtgggaaggatggtgggattgtgtacctttctaagaattaaccctctcctgctttactgctaattttttcctgctgcaaccctcccaccagtttttggcttactcctgagatatgatttgcaaatgaggagagagaagatgaggttggacaagatgccactgcttttcttagcactcttccctcccctaaaccatcccgtagtcttctaatacagtctctcagacaagtgtctctagatggatgtgaactccttaactcatcaagtaaggtggtactcaagccatgctgcctccttacatcctttttggaacagagcacggtataaataataaactaataataatatgccaa

SEQ ID NO: 356327 - DNA, 1737 bp, Homo sapiens
ctggaacaacttacttcccgtctttccacttcagagagggggaacctaggatcaatgaagttgatgggttttcgtctgctggagtaggaataagttctttcctacgcagccgctcctgccgccgtggtcgctggagctttgcctctctaggccggcagcgcctctcctccatggtcctgtctgtcagcgctgttttgggagcccgccggtgaggccgggccacgctcagacacttcgatcgtcgagtctgtcactgggcatggcgggtcagttccgcagctacgtgtgggacccgctgctgatcctgtcgcagatcgtcctcatgcagaccgtgtattacggctcgctgggcctgtggctggcgctggtggacgggctagtgcgaagcagcccctcgctggaccagatgttcgacgccgagatcctgggcttttccacccctccaggccggctctccatgatgtccttcatcctcaacgccctcacctgtgccctgggcttgctgtacttcatccggcgaggaaagcagtgtctggatttcactgtcactgtccatttctttcacctcctgggctgctggttctacagctcccgtttcccctcggcgctgacctggtggctggtccaagccgtgtgcattgcactcatggctgtcatcggggagtacctgtgcatgcggacggagctcaaggagatacccctcaactcagcccctaaatccaatgtctagaatcaggccctttggacatcctgctgacacttgggccccttaacaccttgggctgctcagaccctccagatgaggtccagcccagatctgagaggaaccctggaaatgtgaagtctctgttggtgtgggagagatagtgagggcctgtcaaagaaggcaggtagcagtcagcatgacagctgcaagaatgacctctgtctgttgaagccttggtatctgagaggtcaggaaggggacctctttgagggtaataacagaattggaaccatgccactcttgagccacaatacctgtcaccagcctgttgttttaagagagaaaaaaaatcaaggatatctgattggagcaaaccacttctttagtcatctgtcttacccccctgggacagctgttacctttgcagtgttgccgaatcacagcagttacctttgcagtgttgccgaatcacagcagttctgttggagaaacgcttggtttccggatccagagccacagaaagaaatgtaggtgtgaagtattaggctgctgtcagggagaggatggcagatggaggcatcaagcacaaggaaaatgcacaacctgtgccctgttatacacacgttcatgtgcacccaagaacctatgactttcttccagttccttctaccaggtccccatcctgctgccagctctcaacatagcaggccataggacccagagaagaatcccagcgttgctcaaagtctaaccatcataaagacactgcctgtcttctaggaatgaccaggcacccagctcccactggactccaattttttttcctgccttatttagaattctttggcgggaagggtatgatgggttcccagagacaagaagcccaaccttctggcctgggctgtgctgatagtgctgagggagataggaatttgctgctaagatttttctttggggtggagtttcctctgtcaccgcctcccccatctccatcccgtgctagcctgatcgagctattttccaggcagcag

SEQ ID NO: 356328 - DNA, 1220 bp, Homo sapiens
ccagagccaggaatcaggggcagccgggcgagtcccagggcaggggtcctccgccgccttgcacctgccctgctgggcggcaccgggtcagtgccctgccccctcctgcgggtcccaactctctctttcccatcgtgcgtcctctggagaagtgcgcgcgtgagctgacatggacccaaatcctcgggccgccctggagcgccagcagctccgccttcgggagcggcaaaaattcttcgaggacattttacagccagagacagagtttgtctttcctctgtcccatctgcatctcgagtcgcagagaccccccataggtagtatctcatccatggaagtgaatgtggacacactggagcaagtagaacttattgaccttggggacccggatgcagcagatgtgttcttgccttgcgaagatcctccaccaaccccccagtcgtctggtatgcccctctgctttggggacttcagtgccagtcagccagagccggatgtcaggctctgaaacgaggctacaaggctgggctggggaagtacacaagggtggacaaccatttggaggagctgagcctgccggtgcctacatcagacaggaccacatctaggacctcctcctcctcctcctccgactcctccaccaacctgcatagcccaaatccaagtgatgatggagcagatacgcccttggcacagtcggatgaagaggaggaaaggggtgatggaggggcagagcctggagcctgcagctagcagtgggcccctgcctacagactgaccacgctggctattctccacatgagaccacaggcccagccagagcctgtcgggagaagaccagactctttacttgcagtaggcaccagaggtgggaaggatggtgggattgtgtacctttctaagaattaaccctctcctgctttactgctaattttttcctgctgcaaccctcccaccagtttttggcttactcctgagatatgatttgcaaatgaggagagagaagatgaggttggacaagatgccactgcttttcttagcactcttccctcccctaaaccatcccgtagtcttctaatacagtctctcagacaagtgtctctagatggatgtgaactccttaactcatcaagtaaggtggtactcaagccatgctgcctccttacatcctttttggaacagagcacggtataaataataaactaataataatatgccaa

SEQ ID NO: 356329 - DNA, 1075 bp, Homo sapiens
ctggaacaacttacttcccgtctttccacttcagagagggggaacctaggatcaatgaagttgatgggttttcgtctgctggagtaggaataagttctttcctacgcagccgctcctgccgccgtggtcgctggagctttgcctctctaggccggcagcgcctctcctccatggtcctgtctgtcagcgctgttttgggagcccgccggtgaggccgggccacgctcagacacttcgatcgtcgagtctgtcactgggcatggcgggtcagttccgcagctacgtgtgggacccgctgctgatcctgtcgcagatcgtcctcatgcagaccgtgtattacggctcgctgggcctgtggctggcgctggtggacgggctagtgcgaagcagcccctcgctggaccagatgttcgacgccgagatcctgggcttttccacccctccaggccggctctccatgatgtccttcatcctcaacgccctcacctgtgccctgggcttgctgtacttcatccggcgaggaaagcagtgtctggatttcactgtcactgtccatttctttcacctcctgggctgctggttctacagctcccgtttcccctcggcgctgacctggtggctggtccaagccgtgtgcattgcactcatggctgtcatcggggagtacctgtgcatgcggacggagctcaaggagatacccctcaactcagcccctaaatccaatgtctagaatcaggccctttggacatcctgctgacacttgggccccttaacaccttgggctgctcagaccctccagatgaggtccagcccagatctgagaggaaccctggaaatgtgaagtctctgttggtgtgggagagatagtgagggcctgtcaaagaaggcaggtagcagtcagcatgacagctgcaagaatgacctctgtctgttgaagccttggtatctgagaggtcaggaaggggacctctttgagggtaataacagaattggaaccatgccactcttgagccacaatacctgtcaccagcctgttgttttaagagagaaaaaaaatcaaggatatctgattgga

SEQ ID NO: 356330 - DNA, 2854 bp, Homo sapiens
catgtgctcagttcgctatccggcaggtcttgtacctggttcaggaggttcaggcagaggttgcacccactacgcctgcgcaacctcagccccgcccctccgctgctttccccggaaacgtttctttcctgttctttcctacgcagccgctcctgccgccgtggtcgctggagctttgcctctctaggccggcagcgcctctcctccatggtcctgtctgtcagcgctgttttgggagcccgccggtgaggccgggccacgctcagacacttcgatcgtcgagtctgtcactgggcatggcgggtcagttccgcagctacgtgtgggacccgctgctgatcctgtcgcagatcgtcctcatgcagaccgtgtattacggctcgctgggcctgtggctggcgctggtggacgggctagtgcgaagcagcccctcgctggaccagatgttcgacgccgaggccggctctccatgatgtccttcatcctcaacgccctcacctgtgccctgggcttgctgtacttcatccggcgaggaaagcagtgtctggatttcactgtcactgtccatttctttcacctcctgggctgctggttctacagctcccgtttcccctcggcgctgacctggtggctggtccaagccgtgtgcattgcactcatggctgtcatcggggagtacctgtgcatgcggacggagctcaaggagatacccctcaactcagcccctaaatccaatgtctagaatcaggccctttggacatcctgctgacacttgggccccttaacaccttgggctgctcagaccctccagatgaggtccagcccagatctgagaggaaccctggaaatgtgaagtctctgttggtgtgggagagatagtgagggcctgtcaaagaaggcaggtagcagtcagcatgacagctgcaagaatgacctctgtctgttgaagccttggtatctgagaggtcaggaaggggacctctttgagggtaataacagaattggaaccatgccactcttgagccacaatacctgtcaccagcctgttgttttaagagagaaaaaaaatcaaggatatctgattggagcaaaccacttctttagtcatctgtcttacccccctgggacagctgttacctttgcagtgttgccgaatcacagcagttacctttgcagtgttgccgaatcacagcagttctgttggagaaacgcttggtttccggatccagagccacagaaagaaatgtaggtgtgaagtattaggctgctgtcagggagaggatggcagatggaggcatcaagcacaaggaaaatgcacaacctgtgccctgttatacacacgttcatgtgcacccaagaacctatgactttcttccagttccttctaccaggtccccatcctgctgccagctctcaacatagcaggccataggacccagagaagaatcccagcgttgctcaaagtctaaccatcataaagacactgcctgtcttctaggaatgaccaggcacccagctcccactggactccaattttttttcctgccttatttagaattctttggcgggaagggtatgatgggttcccagagacaagaagcccaaccttctggcctgggctgtgctgatagtgctgagggagataggaatttgctgctaagatttttctttggggtggagtttcctctgtgaggggcttgcagctatccttcctgtgtatacaaatacagtattttccatggttctgcctgcacttactttgtaatgccacggttgagattgagagagatcagcgcagccaggcaagggaactttaaagaattattaggccaccttctccctttcctggaccccagagtcattcctccatttggttaaaatactcagtgcagggaactcttacatcctgtctccttcacttgcagcgtcccctgctatgcctcaggtgaaccacataattcttgggtttccgttcctacttgctagtgatttctgaacatgttcaatggagcggcacacagtctagacccacttccgcattgaaaccttcactgttcctctttggtttcttcagagctttcccaagagagctgtcagttttcagctgtcagtaacacaaatgagtttatggtaacacaaatgagttttgctatctctctgagaagctcatctgacctcctgactctcagccctacagagtagggagttgatgctgacaggatgaaggtttaggaataaatatgcctgggaagagactgggaaggttctagggtgaggcacctcagtaactcatggtaccttggccaagttggaaggaagcagtttgttaatgaggcacagtaatcctggctgcagggtctaggaggtaagaccagctgggatgaccttccctgggttaatcaatttccctctagacaacacaaactgcaggcatgtgactaactttgaaagaacacccatcatgtggctgctgtcacccttgaccagccgtggtggtggttactccatctgtggttggagcgcctctttgggattcacttcaaggtcttgtgcctatttttctgcatatcttctgtgatgacaaatctctgtcccctgagtgttaatttgatttttagaaatggccaaaagtaacgtgatccaaactttttttcagtaatatggagactgagctgcatggtagttggggatcaaaaatatgtgaccttaatgagatttttatgatttctaaagtaacaataaaagcagtttttagagttgagttccagagagggcagggcaatggcagtgacatgtttgtcattttaataataaataacatctattgagtgcttaagaggtgtccagcagtgtg

SEQ ID NO: 356331 - DNA, 1387 bp, Homo sapiens
ttttgaaggatgggaaggggtgggctgcagcactggaggaagggaaccctccaccctgagatctctgtctctatcctatcctgtccctggccttctgaggcaagcggggccaattaaggggaaaacgtacctcctccatttgtgctgaaccaatccctccaacccctctcaggagggcatgatatggagagttgggcattggctgtgttccctgaatacagagtatctctcttgtggtgcctggaactggcatcccctttgtggagcttagggcaagccccgcctctgcatgagacttggtttgtgggacacacttggtttcagggaaggggaaagaggtcaccaagggcagaggtgtccaggccggagccaggggccccactgttgggatgctggctgcagtggggcgccccaagcccaggtcccctctgtcttctctttcgactttgcagctgtacttgttttgctcctctacccgcaggagctgacatggacccaaatcctcgggccgccctggagcgccagcagctccgccttcgggagcggcaaaaattcttcgaggacattttacagccagagacagagtttgtctttcctctgtcccatctgcatctcgagtcgcagagaccccccataggtagtatctcatccatggaagtgaatgtggacacactggagcaagtagaacttattgaccttggggacccggatgcagcagatgtgttcttgccttgcgaagatcctccaccaaccccccagtcgtctggggtggacaaccatttggaggagctgagcctgccggtgcctacatcagacaggaccacatctaggacctcctcctcctcctcctccgactcctccaccaacctgcatagcccaaatccaagtgatgatggagcagatacgcccttggcacagtcggatgaagaggaggctacagactgaccacgctggctattctccacatgagaccacaggcccagccagagcctgtcgggagaagaccagactctttacttgcagtaggcaccagaggtgggaaggatggtgggattgtgtacctttctaagaattaaccctctcctgctttactgctaattttttcctgctgcaaccctcccaccagtttttggcttactcctgagatatgatttgcaaatgaggagagagaagatgaggttggacaagatgccactgcttttcttagcactcttccctcccctaaaccatcccgtagtcttctaatacagtctctcagacaagtgtctctagatggatgtgaactccttaactcatcaagtaaggtggtactcaagccatgctgcctccttacatcctttttggaacagagcacggtataaataataaactaataataatatgccaa

SEQ ID NO: 356332 - DNA, 1254 bp, Homo sapiens
ttttgaaggatgggaaggggtgggctgcagcactggaggaagggaaccctccaccctgagatctctgtctctatcctatcctgtccctggccttctgaggcaagcggggccaattaaggggaaaacgtacctcctccatttgtgctgaaccaatccctccaacccctctcaggagggcatgatatggagagttgggcattggctgtgttccctgaatacagagtatctctcttgtggtgcctggaactggcatcccctttgtggagcttagggcaagccccgcctctgcatgagacttggtttgtgggacacacttggtttcagggaaggggaaagaggtcaccaagggcagaggtgtccaggccggagccaggggccccactgttgggatgctggctgcagtggggcgccccaagcccaggtcccctctgtcttctctttcgactttgcagctgtacttgttttgctcctctacccgcaggagctgacatggacccaaatcctcgggccgccctggagcgccagcagctccgccttcgggagcggcaaaaattcttcgaggacattttacagccagagacagagtttgtctttcctctgtcccatctgcatctcgagtcgcagagaccccccataggtagtatctcatccatggaagtgaatgtggacacactggagcaagtagaacttattgaccttggggacccggatgcagcagatgtgttcttgccttgcgaagatcctccaccaaccccccagtcgtctggggtggacaaccatttggaggagctgagcctgccgctacagactgaccacgctggctattctccacatgagaccacaggcccagccagagcctgtcgggagaagaccagactctttacttgcagtaggcaccagaggtgggaaggatggtgggattgtgtacctttctaagaattaaccctctcctgctttactgctaattttttcctgctgcaaccctcccaccagtttttggcttactcctgagatatgatttgcaaatgaggagagagaagatgaggttggacaagatgccactgcttttcttagcactcttccctcccctaaaccatcccgtagtcttctaatacagtctctcagacaagtgtctctagatggatgtgaactccttaactcatcaagtaaggtggtactcaagccatgctgcctccttacatcctttttggaacagagcacggtataaataataaactaataataatatgccaa

SEQ ID NO: 356333 - DNA, 842 bp, Homo sapiens
catgtgctcagttcgctatccggcaggtcttgtacctggttcaggaggttcaggcagaggttgcacccactacgcctgcgcaacctcagccccgcccctccgctgctttccccggaaacgtttctttcctgttctttcctacgcagccgctcctgccgccgtggtcgctggagctttgcctctctaggccggcagcgcctctcctccatggtcctgtctgtcagcgctgttttgggagcccgccggtgaggccgggccacgctcagacacttcgatcgtcgagtctgtcactgggcatggcgggtcagttccgcagctacgtgtgggacccgctgctgatcctgtcgcagatcgtcctcatgcagaccgtgtattacggctcgctgggcctgtggctggcgctggtggacgggctagtgcgaagcagcccctcgctggaccagatgttcgacgccgagatcctgggcttttccacccctccaggccggctctccatgatgtccttcatcctcaacgccctcacctgtgccctgggcttgctgtacttcatccggcgaggaaagcagtgtctggatttcactgtcactgtccatttctttcacctcctgggctgctggttctacagctcccgtttcccctcggcgctgacctggtggctggtccaagccgtgtgcattgcactcatggctgtcatcggggagtacctgtgcatgcggacggagctcaaggagataggaatttgctgctaagatttttctttggggtggagtttcctctgtgaggggcttgcagctatccttcctgtgtatacaaatacagtattttccatggttctgcctgca

SEQ ID NO: 356334 - DNA, 246 bp, Homo sapiens
acattataaatacacagtctcagagtcagtgttttctaccttgagactttatattacctacaatcccttaagcttctccctggaaatatcacctgtccaacatggaaattacatccaataagcatttataagtgatcctcttagcatcatctccacagaatttcaaagaaaatcttagggttctcaaattccttagcctttacctcctctttaggacacttttaacatggactcctgggtctctat

SEQ ID NO: 356335 - DNA, 2238 bp, Homo sapiens
ctagcggacgctgccacctgatcccatccaggcgctgagaggcaagccaccggcactcggcgcgcagggccccgggcaccctcggaccccgtgcggatttcgagacaagggtccagagatagcggcggccgcccccaacccgggccagaggcagagcccaggcgtgcggtgcttctcgggaacactggccctgctaccagagccgcaggatcccccatgagtgcctgtgaagggagtcctggatagtgaggccctggctggtccaggggtgggtactccgccatgccacccatcctccagcgcctgcagcaggccaccaagatgatgagccgccggaaaatcctgctgctggtgctagggtgcagcaccgtaagccttctcatccaccagggggcgcagctcagctggtaccccaagctgttccccttgagctgccctcctctgcggaactcgccgccgcgccccaagcacatgactgtggccttcctgaagactcacaagacggcaggcacgacggtgcagaacatcctgtttcgctttgccgagcgccacaacctgacggtggccctgccgcacccgagctgcgagcaccagttctgctacccccgcaacttctcggcgcacttcgtgcacccggccacgcggccgccgcacgtgctggccagccacctgcgcttcgaccgtgcggagctggagcgcctcatgccgcccagcaccgtctatgtcaccatcctgcgcgagccggccgccatgttcgagtcgctcttcagctactacaaccagtactgcccggccttccggcgcgtgcccaacgcctcgctcgaggccttcctgcgcgcgcccgaggcatactaccgcgctggcgagcacttcgccatgttcgcacacaacacgctggcctacgacctgggcggcgacaatgagcgcagcccgcgcgacgacgccgcctacctggcgggcctcatccgccaggtggaggaggttttctcgctcgtcatgatcgccgagtacttcgacgagtcgctagtgctgctgcggcgcctactggcctgggacctggacgacgtgctctacgccaagctcaacgcgcgcgccgccagctcgcgcctggccgccatccccgcggcgctggcgcgggcggcgcgcacctggaacgccctggacgccggcctctacgaccacttcaacgccaccttctggcgccacgtggcgcgcgcgggccgcgcgtgcgtggagcgcgaggcgcgcgagctgcgcgaggcccgccagcgcctactgcggcgctgcttcggggacgagccactgctgcggcctgccgcgcagatccgcaccaagcagctgcagccatggcagcccagccgcaaggtggacattatgggctatgacctgcccggcggcggcgccggcccggccaccgaggcctgcctcaagctggccatgcccgaggtccagtactcgaactacctgttgcgcaagcagaagcgccggggcggtgcgcgggctcggcccgagcccgtcctggacaatcccccgcctcggcccatccgagtgctgcctcgcggccctcaaggtccctgagctccgcaggcctccaggagtatgggtcctgccctgccctcccaggagtccagccaggggctgcctccatgtcctgcccccatgagagccctttcttttcaatgggcttgagtccctcgctgaactttggggtacgcctccctatctgagcccccgctcccgatcgtgggctgaaccttgccttcgggcacggcgctgataggctggatccagcgctgggccaccctctccttcccagctggttggtgattttgacaagaggcctgagggctgtccagaactgctcaccctgcctttttctgggggctgagcccccacaacctgtcttttccaagtggataagcccaggccccatggagagaggctcagccctagggaaaggctgctcttgctctccctcccagggcttgaggctccctatacttttctgtcttccaggttctaccctccccacagacctaagctgctcccagtctcccagaaccaagagttcttgggttgggatttttgtttggttggtttttcttttttttaataaaacatctttaaaatgtgcgagttgtatgtcagtcatagaagccggattccccacatttgaggatgaaacggatgcccaggaggagctgtggctggacccatgaggatgggggcctggactca

SEQ ID NO: 356336 - DNA, 379 bp, Homo sapiens
ctagcggacgctgccacctgatcccatccaggcgctgagaggcaagccaccggcactcggcgcgcagggccccgggcaccctcggaccccgtgcggatttcgagacaagggtccagagatagcggcggccgcccccaacccgggccagaggcagagcccaggcgtgcggtgtgagtactgcagtggccggcatggggttggaggggtgggagtggaccagaccgggatgggggccgagaggcgggcgggagagtgtcttgggggcctagtggttggaaagcatgaggaggggggcgctctacccctggaaagtgggagaagatagggtgagcgggccaatctggcctatcccctatggtgatcagatcccactggcagg

SEQ ID NO: 356337 - DNA, 2116 bp, Homo sapiens
atcccatctcctctgcccactgcaaacccgtctgccttcttctgccaggcttctcgggaacactggccctgctaccagagccgcaggatcccccatgagtgcctgtgaagggagtcctggatagtgaggccctggctggtccaggggtgggtactccgccatgccacccatcctccagcgcctgcagcaggccaccaagatgatgagccgccggaaaatcctgctgctggtgctagggtgcagcaccgtaagccttctcatccaccagggggcgcagctcagctggtaccccaagctgttccccttgagctgccctcctctgcggaactcgccgccgcgccccaagcacatgactgtggccttcctgaagactcacaagacggcaggcacgacggtgcagaacatcctgtttcgctttgccgagcgccacaacctgacggtggccctgccgcacccgagctgcgagcaccagttctgctacccccgcaacttctcggcgcacttcgtgcacccggccacgcggccgccgcacgtgctggccagccacctgcgcttcgaccgtgcggagctggagcgcctcatgccgcccagcaccgtctatgtcaccatcctgcgcgagccggccgccatgttcgagtcgctcttcagctactacaaccagtactgcccggccttccggcgcgtgcccaacgcctcgctcgaggccttcctgcgcgcgcccgaggcatactaccgcgctggcgagcacttcgccatgttcgcacacaacacgctggcctacgacctgggcggcgacaatgagcgcagcccgcgcgacgacgccgcctacctggcgggcctcatccgccaggtggaggaggttttctcgctcgtcatgatcgccgagtacttcgacgagtcgctagtgctgctgcggcgcctactggcctgggacctggacgacgtgctctacgccaagctcaacgcgcgcgccgccagctcgcgcctggccgccatccccgcggcgctggcgcgggcggcgcgcacctggaacgccctggacgccggcctctacgaccacttcaacgccaccttctggcgccacgtggcgcgcgcgggccgcgcgtgcgtggagcgcgaggcgcgcgagctgcgcgaggcccgccagcgcctactgcggcgctgcttcggggacgagccactgctgcggcctgccgcgcagatccgcaccaagcagctgcagccatggcagcccagccgcaaggtggacattatgggctatgacctgcccggcggcggcgccggcccggccaccgaggcctgcctcaagctggccatgcccgaggtccagtactcgaactacctgttgcgcaagcagaagcgccggggcggtgcgcgggctcggcccgagcccgtcctggacaatcccccgcctcggcccatccgagtgctgcctcgcggccctcaaggtccctgagctccgcaggcctccaggagtatgggtcctgccctgccctcccaggagtccagccaggggctgcctccatgtcctgcccccatgagagccctttcttttcaatgggcttgagtccctcgctgaactttggggtacgcctccctatctgagcccccgctcccgatcgtgggctgaaccttgccttcgggcacggcgctgataggctggatccagcgctgggccaccctctccttcccagctggttggtgattttgacaagaggcctgagggctgtccagaactgctcaccctgcctttttctgggggctgagcccccacaacctgtcttttccaagtggataagcccaggccccatggagagaggctcagccctagggaaaggctgctcttgctctccctcccagggcttgaggctccctatacttttctgtcttccaggttctaccctccccacagacctaagctgctcccagtctcccagaaccaagagttcttgggttgggatttttgtttggttggtttttcttttttttaataaaacatctttaaaatgtgcgagttgtatgtcagtcatagaagccggattccccacatttgaggatgaaacggatgcccaggaggagctgtggctggacccatgaggatgggggcctggactca

SEQ ID NO: 356338 - DNA, 336 bp, Homo sapiens
tgaaggtctaaaaatattggtcagtgtatcaggagtaaaatttggtttaaccgaaaaaaactggcctgccgcggtggctcacgcctgtaatcccagcactttgggaggccaaggcggtcagatcacttgaggtcaggggttcgagaccagcctgggcaacatggcgaaaccccatctctactaaaaatacaaaaaattagccgggcgtggtgctcaggcctgtaattccagctacctgggaggctgaggcatgagaattgcttgaacccgggaggtgaaagttgtagtgagctgagatcacaccactgcactccagcttgggtgacagagtgagac

SEQ ID NO: 356339 - DNA, 1085 bp, Homo sapiens
cggttctcaccgctgctatggaggcgctggccatgggttcccgggcgctgcggctctggctggtcgcacccggtggcgggatcaaatggagatttatagcaacatcgccagcttctcagctgtcaccgacagaattgacagaaatgcggaatgatctctttaataaagagaaagccaggcagttatcattaactccccgaactgagaagatagaagttaagcatgttgggaaaactgaccccggtactgtcttcgtgatgaataaaaacatttcaactccctacagttgtgccatgcatttaagcgagtggtattgcaggaagtccattctggctctggtggatggacagccttgggacatgtataagcctttaacaaagtcctgtgaaattaaatttcttactttcaaagattgtgatccaggagaagtgaataaggcatattggcgttcctgtgctatgatgatgggctgtgtgatagagagggcattcaaagatgaatatatggtcaatttggtcagagctccagaagttcctgtaatttctggtgccttctgttatgacgtagttttggatagcaaacttgatgagtggatgccaacaaaagagaacttacgttccttcacaaaggatgctcatgctttaatttataaagatcttccatttgaaactctggaagttgaagcaaaagtggcattggaaatatttcaacacagcaagtacaaagtagatttcatagaagagaaggcatctcagaaccctgagagaatagtcaagctacacagaataggtgacttcattgatgtgagtgagggccctcttattccaagaacaagtatttgtttccagtatgaagtgtcagcagttcacaatcttcaacccacccagccaagtctcatacgaagattccagggtgtgtctttacctgttcacttaagagcacattttacaatatgggataagctattggaaagatctcggaaaatggtaactgaagatcaaagtaaagcaacagaggaatgtacatctacctaataactttctaaaatttaaatatgtataataaaataaatgttttaaatataa

SEQ ID NO: 356340 - DNA, 669 bp, Homo sapiens
caggtaggaagaagagagtgaattcttgaatgctgtccttaggtatctgggtggagccctttaccaagatagatgatgcaggtaggacaggttttggggtgttgaattcagatttagccatgtctgtttgatgagtctgagtgacacagaatagaaatagggacatagagatatctatttagactaaatctgtaatatgttctattctaaatggaattatactccaaaagaaaataaactgatttaaaatagcttgttacagcacttcaggtgttttttcttacactaatgattttgttttacggctgaaaagtaaaatggccaacttgagaagcctaggtataatatgccttagattatatttttgaatggaattattgttctttacctgataatttatattggttacttggcctttaaatctttcttcttacctaactttctattctactatttaaggggaaagataaagggtcattataagagggctgtggaatgatttaaaatggtgggtgaagggtaaaactgaaagtgtttattaggaaagtaaagctattcatgtttttacaggtaactgaagatcaaagtaaagcaacagaggaatgtacatctacctaataactttctaaaatttaaatatgtataataaaataaatgttttaaatataa

SEQ ID NO: 356341 - DNA, 508 bp, Homo sapiens
  misc_feature (26)..(26): n is a, c, g, or t
  misc_feature (37)..(37): n is a, c, g, or t
  misc_feature (55)..(55): n is a, c, g, or t
  misc_feature (57)..(57): n is a, c, g, or t
taggcggccttgcgagcgtgtatcanaactacgtcantttggtaagctcagaagntnctgtaatttctggtgccttctgttatgacgtagttttggatagcaaacttgatgagtggatgccaacaaaagagaacttacgttccttcacaaaggatgctcatgctttaatttataaagatcttccatttgaaactctggaagttgaagcaaaagtggcattggaaatatttcaacacagcaagtacaaagtagatttcatagaagagaaggcatctcagaaccctgagagaatagtcaagctacacagaataggtgacttcattgatgtgagtgagggccctcttattccaagaacaagtatttgtttccagtatgaagtgtcagcagttcacaatcttcaacccacccagccaagtctcatacgaagattccagggtgtgtctttacctgttcacttaagagcacattttacaatatgggataacacgttcgcgagggggatcctcta

SEQ ID NO: 356342 - DNA, 1174 bp, Homo sapiens
cggttctcaccgctgctatggaggcgctggccatgggttcccgggcgctgcggctctggctggtcgcacccggtggcgggatcaaatggagatttatagcaacatcgccagcttctcagctgtcaccgacagaattgacagaaatgcggaatgatctctttaataaagagaaagccaggcagttatcattaactccccgaactgagaagatagaagttaagcatgttgggaaaactgaccccggtactgtcttcgtgatgaataaaaacatttcaactccctacagttgtgccatgcatttaagcgagtggtattgcaggaagtccattctggctctggtggatggacagccttgggacatgtataagcctttaacaaagtcctgtgaaattaaatttcttactttcaaagattgtgatccaggagaagtgaataaggcatattggcgttcctgtgctatgatgatgggctgtgtgatagagagggcattcaaagatgaatatatggtcaatttggtcagagctccagaagttcctgtaatttctggtgccttctgttatgacgtagttttggatagcaaacttgatgagtggatgccaacaaaagagaacttacgttccttcacaaaggatgctcatgctttaatttataaagatcttccatttgaaactctggaagttgaagcaaaagtggcattggaaatatttcaacacagcaagtacaaagtagatttcatagaagagaaggcatctcagaaccctgagagaatagtcaagctacacagaataggtgacttcattgatgtgagtgagggccctcttattccaagaacaagtatttgtttccagtatgaagtgtcagcagttcacaatcttcaacccacccagccaagtctcatacgaagattccagggtgtgtctttacctgttcacttaagagcacattttacaatatgggataagctattggaaagatctcggaaaatgactccatttcccattctccttctatttactacgcagtcattcttcactacctcgcctgagtcgtacctcctccatggaacagtctcagagtaactgaagatcaaagtaaagcaacagaggaatgtacatctacctaataactttctaaaatttaaatatgtataataaaataaatgttttaaatataa

SEQ ID NO: 356343 - DNA, 1302 bp, Homo sapiens
cggttctcaccgctgctatggaggcgctggccatgggttcccgggcgctgcggctctggctggtcgcacccggtggcgggatcaaatggagatttatagcaacatcgccagcttctcagctgtcaccgacagaattgacagaaatgcggaatgatctctttaataaagagaaagccaggcagttatcattaactccccgaactgagaagatagaagttaagcatgttgggaaaactgaccccggtactgtcttcgtgatgaataaaaacatttcaactccctacagttgtgccatgcatttaagcgagtggtattgcaggaagtccattctggctctggtggatggacagccttgggacatgtataagcctttaacaaagtcctgtgaaattaaatttcttactttcaaagattgtgatccaggagaagtgaataaggcatattggcgttcctgtgctatgatgatgggctgtgtgatagagagggcattcaaagatgaatatatggtcaatttggtcagagctccagaagttcctgtaatttctggtgccttctgttatgacgtagttttggatagcaaacttgatgagtggatgccaacaaaagagaacttacgttccttcacaaaggatgctcatgctttaatttataaagatcttccatttgaaactctggaagttgaagcaaaagtggcattggaaatatttcaacacagcaagtacaaagtagatttcatagaagagaaggcatctcagaaccctgagagaatagtcaagctacacagaataggtgacttcattgatgtgagtgagggccctcttattccaagaacaagtatttgtttccagtatgaagtgtcagcagttcacaatcttcaacccacccagccaagtctcatacgaagattccagggtgtgtctttacctgttcacttaagagtaagtaaagcttaaagttctaggtcttccaatttgggtatagatataattccggacttgattttataccagtttgaagaatataaacttttaatttttcttaagttatgtgacactaatattttataaactcaggtttatgattaaaaacaaagttgcccagggtgtaaatatacaattacaaaagaaacattagttgaaaaaattaaattgacatagcatttaaaaatttcaagttagcataggtgagggtacattgacagagggggtattagagtgcgtattggtaagacttcctggaatgccttttaagcttaaatttggcatgctcttccctctaattttaatgatccatcatgacccg

SEQ ID NO: 356344 - DNA, 461 bp, Homo sapiens
  misc_feature (47)..(47): n is a, c, g, or t
tgtgtgaagctctggtgtttgcagttcgacctagcaggatccctcanatttcaccggacaccgatctactgtcccggagagtttcaccggcatggtacaaagtagatttcatagaagagaaggcatctcagaaccctgagagaatagtcaagctacacagaataggtgacttcattgatgtgagtgagggccctcttattccaagaacaagtatttgtttccagtatgaagtgtcagcagttcacaatcttcaacccacccagccaagtctcatacgaagattccagggtgtgtctttacctgttcacttaagagcacattttacaatatgggataagctattggaaagatctcggaaaatggtaactgaagatcaaagtaaagcaacagaggaatgtacatctacctaataactttctaaaatttaaatatgtataataaaataaatgttttaaatataa

SEQ ID NO: 356345 - DNA, 380 bp, Homo sapiens
ttaagcgtttttttcttaaatgctcactgcaacctctgcctcccgggttcatgcgattgaagaaagcaaaaaagcagctatccccatgtagcacctttttttgctactatgatccacttttataaccacttatctaaattagtactgcctagctttttatttattttgttctaaaagctatataaagactctgtcctttttactttgacattactgcttcatttagttcatcgcaaatcttttcttttcaaggcacattttacaatatgggataagctattggaaagatctcggaaaatggtaagtgtttttgacagctattgagtactcttctataaagaaattcatcaaaattaaccaataacaaccaaaggggggaa

SEQ ID NO: 356346 - DNA, 1160 bp, Homo sapiens
cggttctcaccgctgctatggaggcgctggccatgggttcccgggcgctgcggctctggctggtcgcacccggtggcgggatcaaatggagatttatagcaacatcgccagcttctcagctgtcaccgacagaattgacagaaatgcggaatgatctctttaataaagagaaagccaggcagttatcattaactccccgaactgagaagatagaagttaagcatgttgggaaaactgaccccggtactgtcttcgtgatgaataaaaacatttcaactccctacagttgtgccatgcatttaagcgagtggtattgcaggaagtccattctggctctggtggatggacagccttgggacatgtataagcctttaacaaagtcctgtgaaattaaatttcttactttcaaagattgtgatccaggagaagtgaataaggcatattggcgttcctgtgctatgatgatgggctgtgtgatagagagggcattcaaagatgaatatatggtcaatttggtcagagctccagaagttcctgtaatttctggtgccttctgttatgacgtagttttggatagcaaacttgatgagtggatgccaacaaaagagaacttacgttccttcacaaaggatgctcatgctttaatttataaagatcttccatttgaaactctggaagttgaagcaaaagtggcattggaaatatttcaacacagcaagtacaaagtagatttcatagaagagaaggcatctcagaaccctgagagaatagtcaagctacacagaataggtgacttcattgatgtgagtgagggccctcttattccaagaacaagtatttgtttccagtatgaagtgtcagcagttcacaatcttcaacccacccagccaagtctcatacgaagattccagggtgtgtctttacctgttcacttaagagcacattttacaatatgggataagctattggaaagatctcggaaaatggtaactgaagatcaaagtaaagcaacagaggaatgtacatctacctaataactttctaaaatttaaatatgtataataaaataaatgttttaaatataaaaaaaaaaaaaaaaggaacaacaaaaaaaagaccgggcggaaatattagggggcggagaaaagagggaaaaagag

SEQ ID NO: 356347 - DNA, 1056 bp, Homo sapiens
cggttctcaccgctgctatggaggcgctggccatgggttcccgggcgctgcggctctggctggtcgcacccggtggcgggatcaaatggagatttatagcaacatcgccagcttctcagctgtcaccgacagaattgacagaaatgcggaatgatctctttaataaagagaaagccaggcagttatcattaactccccgaactgagaagatagaagttaagcatgttgggaaaactgaccccggtactgtcttcgtgatgaataaaaacatttcaactccctacagttgtgccatgcatttaagcgagtggtattgcaggaagtccattctggctctggtggatggacagccttgggacatgtataagcctttaacaaagtcctgtgaaattaaatttcttactttcaaagattgtgatccaggagaagtgaataaggcatattggcgttcctgtgctatgatgatgggctgtgtgatagagagggcattcaaagatgaatatatggtcaatttggtcagagctccagaagttcctgttttggatagcaaacttgatgagtggatgccaacaaaagagaacttacgttccttcacaaaggatgctcatgctttaatttataaagatcttccatttgaaactctggaagttgaagcaaaagtggcattggaaatatttcaacacagcaagtacacagtagattcttagaaagacggaaggcgtctccagaacctgagagaattgtcaaagtacacgaataggtgacttcattgatgtgagtgagggccctcttattccaagaacaagtatttgtttccagtatgaagtgtcagcagttcacaatcttcaacccacccagccaagtctcatacgaagattccagggtgtgtctttacctgttcacttaagagcacattttacaatatgggataagctattggaaagatctcggaaaatggtaactgaagatcaaagtaaagcaacagaggaatgtacatctacctaataactttctaaaatttaaatatgtataataaaataaatgttttaaatataa

SEQ ID NO: 356348 - DNA, 436 bp, Homo sapiens
caggagaatggcatgaacccaggaggcggagcttgcagtgagccgagatcacaccactgcactccagcctgggcgacagagtgagactccatctcaaaaaaaaaaaaaaaaaacttaagatggacacagctgactggacccccatcctgcctcacccatgggtgctgcaccccagacccatcctgccacttctatgtctctggaccacaggatggtggtggcattgcaggttggcaagtgggctgatggggtccgccctcctcactgctgagctcctcacctggacagtctcctggacgaggagtttccagctgctggctggagtctcaggccaaattgcagagggtcctccagggtcctgaagagcactggactaagagtctagtggttccagggccctgaccagtaggtgctcaataaatgtttgttgttgaat

SEQ ID NO: 356349 - DNA, 419 bp, Homo sapiens
gccccattcatgactgagaagcagctgagtggagccatggccacattcatgactgagaagcagctgagtggaggcatggccccggggtccccttgctgctgtgggctccctgtccctgggcaggagtgctggtgaggaggtggagccttttgaggggggccttccctcagctgtttccccacactggggggctgggccctgcctccccgttaccctccttccctgcaggcctggagcctgtagggctggactgaggttcaggtctccccccagctgtctcacccccactttgtccccactctagagcagggaggcagtgggggaggagttgtgtctcgtcttctgtctccatgtggtttttgggtgtttttcttgttgtgtcctggattccgataaaattaaagaaattgcttcctcaa

SEQ ID NO: 356350 - DNA, 669 bp, Homo sapiens
tgtctcgaatctacaaggtgggagcgggtgagaacccagcgactgcgcggctgaatgacagggagtagccccgccgcctccaacatggcagcttctatccagcgaagccgggtccccgcttccgggttccgtactgtcggccaggctacttccggcagcgcgatggctgggttcccgggactcgaacggaagttccggcgggggcggccgagggggaagagtgtgtctgcgggagaaagaggagaatcgcccaagcggcctcggaagtcccagggagtggaggcccccgccgtggagccgtgtggtgtatgtgtggtaacaccatgtctgtgcccctgctcaccgatgctgccaccgtgtctggagctgagcgggaaacggccgcggttatttttttacatggacttggagacacagggcacagctgggctgacgccctctccaccatccggctccctcacgtcaagtacatctgtccccatgccctaggatccctgtgacaagcctcccaggacgattcgatgggcagggatcccgttcttcatttcatgctcaatcaaggccttgactgtctctgctgccttcttgatgccacgcctcgtcctctggggcatctggactcagccccatcaggtcaaaccaggagggcagtgtaccgcgctcgaattg

SEQ ID NO: 356351 - DNA, 2378 bp, Homo sapiens
tgtctcgaatctacaaggtgggagcgggtgagaacccagcgactgcgcggctgaatgacagggagtagccccgccgcctccaacatggcagcttctatccagcgaagccgggtccccgcttccgggttccgtactgtcggccaggctacttccggcagcgcgatggctgggttcccgggactcgaacggaagttccggcgggggcggccgagggggaagagtgtgtctgcgggagaaagaggagaatcgcccaagcggcctcggaagtcccagggagtggaggcccccgccgtggagccgtgtggtgtatgtgtggtaacaccatgtctgtgcccctgctcaccgatgctgccaccgtgtctggagctgagcgggaaacggccgcggttatttttttacatggacttggagacacagggcacagctgggctgacgccctctccaccatccggctccctcacgtcaagtacatctgtccccatgcgcctaggatccctgtgaccctcaacatgaagatggtgatgccctcctggtttgacctgatggggctgagtccagatgccccagaggacgaggctggcatcaagaaggcagcagagaacatcaaggccttgattgagcatgaaatgaagaacgggatccctgccaatcgaatcgtcctgggaggcttttcacagggcggggccctgtccctctacacggccctcacctgcccccaccctctggctggcatcgtggcgttgagctgctggctgcctctgcaccgggccttcccccaggcagctaatggcagtgccaaggacctggccatactccagtgccatggggagctggaccccatggtgcccgtacggtttggggccctgacggctgagaagctccggtctgttgtcacacctgccagggtccagttcaagacatacccgggtgtcatgcacagctcctgtcctcaggagatggcagctgtgaaggaatttcttgagaagctgctgcctcctgtctaactagtcgctggccccagtgcagtaccccagctcatgggggactcagcaagcaagcgtggcaccatcttggatctgagccggtcgagcccctgtccccacccttcctgacctgtccttttcccacaggcctctgggggcaggtggcaaggcctggccgggccttccttcctggccttagccacctggctctgtctgcagcaggggcaggctgctttcttatccatttccctggaggcgggcccccctggcagcagtattggaggggctacaggcagctggagaaaggggcccagccgctgacccactcactcaggacctcactcactagccccgctttgggccccctcctgtgacctcagggtttggcccatggggccctcccaggcccctgccccaactgattctgcccagataatcgtgtctcctgcctccactcagctgcttctcagtcatgaatgtggccatggccccggggtccccttgctgctgtgggctccctgtccctgggcaggagtgctggtgaggaggtggagccttttgaggggggccttccctcagctgtttccccacactggggggctgggccctgcctccccgttaccctccttccctgcaggcctggagcctgtagggctggactgaggttcaggtctccccccagctgtctcacccccactttgtccccactctagagcagggaggcagtgggggaggagttgtgtctcgtcttctgtctccatgtggtttttgggtgtttttcttgttgtgtcctggattccgataaaattaaagaaattgcttcctcaaaaaaaaaaaaaaaaaaaaaaaaaaaaaaaaaaaaaaaaaaaaaaaaaaaaaaaaaaaaaaaaaaaaaaaagaaaaaaaaaaaaaaaaaaaagggagggggggcgagccggcagtaaaataatccgctcaccccggggggacggacacatcactcataaaccacaacaccgcactttctctaaacacaaggagggcccccacaaaaggaggagtagtaataaatataacaacagcagccgacgcccggcccggaataaaaaaaaacacagaagctgcgtgatggtgagagaaaaaaaacatgtattgcattggtgcgtatgtattttcgttagagggaagaaagaacacaacacatctctgggggggggggggagaaaaataaatatgtagggaagacaaaaatccaccgaaagaatataattatactgtgtgcgggaggaaaaatactatatacaatgaggggtgtaatatattagtatgaggtaaaaaaccgtaaactatttgttgctgtcggaaaaaaaaaattgtggtgcaggaggtaaaaatgtaatgaaacaaaaatatagg

SEQ ID NO: 356352 - DNA, 1647 bp, Homo sapiens
tgtctcgaatctacaaggtgggagcgggtgagaacccagcgactgcgcggctgaatgacagggagtagccccgccgcctccaacatggcagcttctatccagcgaagccgggtccccgcttccgggttccgtactgtcggccaggctacttccggcagcgcgatggctgggttcccgggactcgaacggaagttccggcgggggcggccgagggggaagagtgtgtctgcgggagaaagaggagaatcgcccaagcggcctcggaagtcccagggagtggaggcccccgccgtggagccgtgtggtgtatgtgtggtaacaccatgtctgtgcccctgctcaccgatgctgccaccgtgtctggagctgagcgggaaacggccgcggttatttttttacatggacttggagacacagggcacagctgggctgacgccctctccaccatccggctccctcacgtcaagtacatctgtccccatgcgcctaggatccctgtgaccctcaacatgaagatggtgatgccctcctggtttgacctgatggggctgagtccagatgccccagaggacgaggctggcatcaagaaggcagcagagaacatcaaggccttgattgagcatgaaatgaagaacgggatccctgccaatcgaatcgtcctgggaggcttttcacagggcggggccctgtccctctacacggccctcacctgcccccaccctctggctggcatcgtggcgttgagctgctggctgcctctgcaccgggccttcccccaggcagctaatggcagtgccaaggacctggccatactccagtgccatggggagctggaccccatggtgcccgtacggtttggggccctgacggctgagaagctccggtctgttgtcacacctgccagggtccagttcaagacatacccgggtgtcatgcacagctcctgtcctcaggagatggcagctgtgaaggaatttcttgagaagctgctgcctcctgtctaactagtcgctggccccagtgcagtaccccagctcatgggggactcagcaagcaagcgtggcaccatcttggatctgagccggtcgagcccctgtccccacccttcctgacctgtccttttcccacaggcctctgggggcaggtggcaaggcctggccgggccttccttcctggccttagccacctggctctgtctgcagcaggggcaggctgctttcttatccatttccctggaggcgggcccccctggcagcagtattggaggggctacaggcagctggagaaaggggcccagccgctgacccactcactcaggacctcactcactagccccgctttgggccccctcctgtgacctcagggtttggcccatggggccctcccaggcccctgccccaactgattctgcccagataatcgtgtctcctctccccgttaccctccttccctgcaggcctggagcctgtagggctggactgaggttcaggtctccccccagctgtctcacccccactttgtccccactctagagcagggaggcagtgggggaggagttgtgtctcgtcttctgtctccatgtggtttttgggtgtttttcttgttgtgtcctggattccgataaaattaaagaaattgcttcctcaa

SEQ ID NO: 356353 - DNA, 1390 bp, Homo sapiens
  misc_feature (1294)..(1294): n is a, c, g, or t
  misc_feature (1297)..(1297): n is a, c, g, or t
  misc_feature (1308)..(1308): n is a, c, g, or t
  misc_feature (1317)..(1317): n is a, c, g, or t
  misc_feature (1321)..(1321): n is a, c, g, or t
  misc_feature (1324)..(1325): n is a, c, g, or t
  misc_feature (1386)..(1386): n is a, c, g, or t
tgtctcgaatctacaaggtgggagcgggtgagaacccagcgactgcgcggctgaatgacagggagtagccccgccgcctccaacatggcagcttctatccagcgaagccgggtccccgcttccgggttccgtactgtcggccaggctacttccggcagcgcgatggctgggttcccgggactcgaacggaagttccggcgggggcggccgagggggaagagtgtgtctgcgggagaaagaggagaatcgcccaagcggcctcggaagtcccagggagtggaggcccccgccgtggagccgtgtggtgtatgtgtggtaacaccatgtctgtgcccctgctcaccgatgctgccaccgtgtctggagctgagcgggaaacggccgcggttatttttttacatggacttggagacacagggcacagctgggctgacgccctctccaccatccggctccctcacgtcaagtacatctgtccccatgcgcctaggatccctgtgaccctcaacatgaagatggtgatgccctcctggtttgacctgatggggctgagtccagatgccccagaggacgaggctggcatcaagaaggcagcagagaacatcaaggccttgattgagcatgaaatgaagaacgggatccctgccaatcgaatcgtcctgggaggcttttcacagggcggggccctgtccctctacacggccctcacctgcccccaccctctggctggcatcgtggcgttgagctgctggctgcctctgcaccgggccttcccccaggcagctaatggcagtgccaaggacctggccatactccagtgccatggggagctggaccccatggtgcccgtacggtttggggccctgacggctgagaagctccggtctgttgtcacacctgccagggtccagttcaagacatacccgggtgtcatgcacagctcctgtcctcaggagatggcagctgtgaaggaatttcttgagaagctgctgcctcctgtctaactagtcgctggccccagtgcagtaccccagctcatgggggactcagcaagcaagcgtggcaccatcttggatctgagccggtcgagcccctgtccccacccttcctgacctgtccttttcccacaggcctctgggggcaggtggcaaggcctggccgggccttccttcctggccttagccacctggctctgtctgcagcaggggcaggctgctttcttatccatttccctggaggcgggcccccctggcagcagtattggaggggctacaggcagctggagaaagggcancgntgacaataatnagacttatnatanccnntttggccctctgtactcaggtttgccatgggctccaagcctgcccaatgatttgcaaaatntttt

SEQ ID NO: 356354 - DNA, 1597 bp, Homo sapiens
  misc_feature (20)..(20): n is a, c, g, or t
attagctagtacgagctggnttaagaggagaatcgcccaagcggcctcggaagtcccagggagtggaggcccccgccgtggagccgtgtggtgtatgtgtggtaacaccatgtctgtgcccctgctcaccgatgctgccaccgtgtctggagctgagcgggaaacggccgcggttatttttttacatggacttggagacacagggcacagctgggctgacgccctctccaccatccggctccctcacgtcaagtacatctgtccccatgcgcctaggatccctgtgaccctcaacatgaagatggtgatgccctcctggtttgacctgatggggctgagtccagatgccccagaggacgaggctggcatcaagaaggcagcagagaacatcaaggccttgattgagcatgaaatgaagaacgggatccctgccaatcgaatcgtcctgggaggcttttcacagggcggggccctgtccctctacacggccctcacctgcccccaccctctggctggcatcgtggcgttgagctgctggctgcctctgcaccgggccttcccccaggcagctaatggcagtgccaaggacctggccatactccagtgccatggggagctggaccccatggtgcccgtacggtttggggccctgacggctgagaagctccggtctgttgtcacacctgccagggtccagttcaagacatacccgggtgtcatgcacagctcctgtcctcaggagatggcagctgtgaaggaatttcttgagaagctgctgcctcctgtctaactagtcgctggccccagtgcagtaccccagctcatgggggactcagcaagcaagcgtggcaccatcttggatctgagccggtcgagcccctgtccccacccttcctgacctgtccttttcccacaggcctctgggggcaggtggcaaggcctggccgggccttccttcctggccttagccacctggctctgtctgcagcaggggcaggctgctttcttatccatttccctggaggcgggcccccctggcagcagtattggaggggctacaggcagctggagaaaggggcccagccgctgacccactcactcaggacctcactcactagccccgctttgggccccctcctgtgacctcagggtttggcccatggggccctcccaggcccctgccccaactgattctgcccagataatcgtgtctcctgcctccactcagctgcttctcagtcatgaatgtggccatggccccggggtccccttgctgctgtgggctccctgtccctgggcaggagtgctggtgaggaggtggagccttttgaggggggccttccctcagctgtttccccacactggggggctgggccctgcctccccgttaccctccttccctgcaggcctggagcctgtagggctggactgaggttcaggtctccccccagctgtctcacccccactttgtccccactctagagcagggaggcagtgggggaggagttgtgtctcgtcttctgtctccatgtggtttttgggtgtttttcttgttgtgtcctggattccgataaaattaaagaaattgcttcctcaa

SEQ ID NO: 356355 - DNA, 1672 bp, Homo sapiens
  misc_feature (5)..(5): n is a, c, g, or t
  misc_feature (7)..(7): n is a, c, g, or t
  misc_feature (9)..(9): n is a, c, g, or t
  misc_feature (12)..(12): n is a, c, g, or t
atcgncntncgntttgcagtcagtggcagcagcagcaggacagaacctgggtgctgtgtggggctgatggcctggtggctcattgggcagggagtgtgtcctgtgcctggttttgctcttgaccgccgccccgatgtatgcaggcccccgccgtggagccgtgtggtgtatgtgtggtaacaccatgtctgtgcccctgctcaccgatgctgccaccgtgtctggagctgagcgggaaacggccgcggttatttttttacatggacttggagacacagggcacagctgggctgacgccctctccaccatccggctccctcacgtcaagtacatctgtccccatgcgcctaggatccctgtgaccctcaacatgaagatggtgatgccctcctggtttgacctgatggggctgagtccagatgccccagaggacgaggctggcatcaagaaggcagcagagaacatcaaggccttgattgagcatgaaatgaagaacgggatccctgccaatcgaatcgtcctgggaggcttttcacagggcggggccctgtccctctacacggccctcacctgcccccaccctctggctggcatcgtggcgttgagctgctggctgcctctgcaccgggccttcccccaggcagctaatggcagtgccaaggacctggccatactccagtgccatggggagctggaccccatggtgcccgtacggtttggggccctgacggctgagaagctccggtctgttgtcacacctgccagggtccagttcaagacatacccgggtgtcatgcacagctcctgtcctcaggagatggcagctgtgaaggaatttcttgagaagctgctgcctcctgtctaactagtcgctggccccagtgcagtaccccagctcatgggggactcagcaagcaagcgtggcaccatcttggatctgagccggtcgagcccctgtccccacccttcctgacctgtccttttcccacaggcctctgggggcaggtggcaaggcctggccgggccttccttcctggccttagccacctggctctgtctgcagcaggggcaggctgctttcttatccatttccctggaggcgggcccccctggcagcagtattggaggggctacaggcagctggagaaaggggcccagccgctgacccactcactcaggacctcactcactagccccgctttgggccccctcctgtgacctcagggtttggcccatggggccctcccaggcccctgccccaactgattctgcccagataatcgtgtctcctgcctccactcagctgcttctcagtcatgaatgtggccatggccccggggtccccttgctgctgtgggctccctgtccctgggcaggagtgctggtgaggaggtggagccttttgaggggggccttccctcagctgtttccccacactggggggctgggccctgcctccccgttaccctccttccctgcaggcctggagcctgtagggctggactgaggttcaggtctccccccagctgtctcacccccactttgtccccactctagagcagggaggcagtgggggaggagttgtgtctcgtcttctgtctccatgtggtttttgggtgtttttcttgttgtgtcctggattccgataaaattaaagaaattgcttcctcaa

SEQ ID NO: 356356 - DNA, 1469 bp, Homo sapiens
cgctcggtccggattggggagacaggaaggcttcccctaggtccgttatttttttacatggacttggagacacagggcacagctgggctgacgccctctccaccatccggctccctcacgtcaagtacatctgtccccatgcgcctaggatccctgtgaccctcaacatgaagatggtgatgccctcctggtttgacctgatggggctgagtccagatgccccagaggacgaggctggcatcaagaaggcagcagagaacatcaaggccttgattgagcatgaaatgaagaacgggatccctgccaatcgaatcgtcctgggaggcttttcacagggcggggccctgtccctctacacggccctcacctgcccccaccctctggctggcatcgtggcgttgagctgctggctgcctctgcaccgggccttcccccaggcagctaatggcagtgccaaggacctggccatactccagtgccatggggagctggaccccatggtgcccgtacggtttggggccctgacggctgagaagctccggtctgttgtcacacctgccagggtccagttcaagacatacccgggtgtcatgcacagctcctgtcctcaggagatggcagctgtgaaggaatttcttgagaagctgctgcctcctgtctaactagtcgctggccccagtgcagtaccccagctcatgggggactcagcaagcaagcgtggcaccatcttggatctgagccggtcgagcccctgtccccacccttcctgacctgtccttttcccacaggcctctgggggcaggtggcaaggcctggccgggccttccttcctggccttagccacctggctctgtctgcagcaggggcaggctgctttcttatccatttccctggaggcgggcccccctggcagcagtattggaggggctacaggcagctggagaaaggggcccagccgctgacccactcactcaggacctcactcactagccccgctttgggccccctcctgtgacctcagggtttggcccatggggccctcccaggcccctgccccaactgattctgcccagataatcgtgtctcctgcctccactcagctgcttctcagtcatgaatgtggccatggccccggggtccccttgctgctgtgggctccctgtccctgggcaggagtgctggtgaggaggtggagccttttgaggggggccttccctcagctgtttccccacactggggggctgggccctgcctccccgttaccctccttccctgcaggcctggagcctgtagggctggactgaggttcaggtctccccccagctgtctcacccccactttgtccccactctagagcagggaggcagtgggggaggagttgtgtctcgtcttctgtctccatgtggtttttgggtgtttttcttgttgtgtcctggattccgataaaattaaagaaattgcttcctcaa

SEQ ID NO: 356357 - DNA, 1544 bp, Homo sapiens
gcgtggtcaagccagggctcgtttgcagtcagtggcagcagcagcaggcccccgccgtggagccgtgtggtgtatgtgtggtaacaccatgtctgtgcccctgctcaccgatgctgccaccgtgtctggagctgagcgggaaacggccgcggcacagctgggctgacgccctctccaccatccggctccctcacgtcaagtacatctgtccccatgcgcctaggatccctgtgaccctcaacatgaagatggtgatgccctcctggtttgacctgatggggctgagtccagatgccccagaggacgaggctggcatcaagaaggcagcagagaacatcaaggccttgattgagcatgaaatgaagaacgggatccctgccaatcgaatcgtcctgggaggcttttcacagggcggggccctgtccctctacacggccctcacctgcccccaccctctggctggcatcgtggcgttgagctgctggctgcctctgcaccgggccttcccccaggcagctaatggcagtgccaaggacctggccatactccagtgccatggggagctggaccccatggtgcccgtacggtttggggccctgacggctgagaagctccggtctgttgtcacacctgccagggtccagttcaagacatacccgggtgtcatgcacagctcctgtcctcaggagatggcagctgtgaaggaatttcttgagaagctgctgcctcctgtctaactagtcgctggccccagtgcagtaccccagctcatgggggactcagcaagcaagcgtggcaccatcttggatctgagccggtcgagcccctgtccccacccttcctgacctgtccttttcccacaggcctctgggggcaggtggcaaggcctggccgggccttccttcctggccttagccacctggctctgtctgcagcaggggcaggctgctttcttatccatttccctggaggcgggcccccctggcagcagtattggaggggctacaggcagctggagaaaggggcccagccgctgacccactcactcaggacctcactcactagccccgctttgggccccctcctgtgacctcagggtttggcccatggggccctcccaggcccctgccccaactgattctgcccagataatcgtgtctcctgcctccactcagctgcttctcagtcatgaatgtggccatggccccggggtccccttgctgctgtgggctccctgtccctgggcaggagtgctggtgaggaggtggagccttttgaggggggccttccctcagctgtttccccacactggggggctgggccctgcctccccgttaccctccttccctgcaggcctggagcctgtagggctggactgaggttcaggtctccccccagctgtctcacccccactttgtccccactctagagcagggaggcagtgggggaggagttgtgtctcgtcttctgtctccatgtggtttttgggtgtttttcttgttgtgtcctggattccgataaaattaaagaaattgcttcctcaa

SEQ ID NO: 356358 - DNA, 1740 bp, Homo sapiens
tgtctcgaatctacaaggtgggagcgggtgagaacccagcgactgcgcggctgaatgacagggagtagccccgccgcctccaacatggcagcttctatccagcgaagccgggtccccgcttccgggttccgtactgtcggccaggctacttccggcagcgcgatggctgggttcccgggactcgaacggaagttccggcgggggcggccgagggggaagagtgtgtctgcgggagaaagaggagaatcgcccaagcggcctcggaagtcccagggagtggaggcccccgccgtggagccgtgtggtgtatgtgtggtaacaccatgtctgtgcccctgctcaccgatgctgccaccgtgtctggagctgagcgggaaacggccgcggttatttttttacatggacttggagacacagggcacagctgggctgacgccctctccaccatccggctccctcacgtcaagtacatctgtccccatgcgcctaggatccctgtgaccctcaacatgaagatggtgatgccctcctgtcaaggccttgattgagcatgaaatgaagaacgggatccctgccaatcgaatcgtcctgggaggcttttcacagggcggggccctgtccctctacacggccctcacctgcccccaccctctggctggcatcgtggcgttgagctgctggctgcctctgcaccgggccttcccccaggcagctaatggcagtgccaaggacctggccatactccagtgccatggggagctggaccccatggtgcccgtacggtttggggccctgacggctgagaagctccggtctgttgtcacacctgccagggtccagttcaagacatacccgggtgtcatgcacagctcctgtcctcaggagatggcagctgtgaaggaatttcttgagaagctgctgcctcctgtctaactagtcgctggccccagtgcagtaccccagctcatgggggactcagcaagcaagcgtggcaccatcttggatctgagccggtcgagcccctgtccccacccttcctgacctgtccttttcccacaggcctctgggggcaggtggcaaggcctggccgggccttccttcctggccttagccacctggctctgtctgcagcaggggcaggctgctttcttatccatttccctggaggcgggcccccctggcagcagtattggaggggctacaggcagctggagaaaggggcccagccgctgacccactcactcaggacctcactcactagccccgctttgggccccctcctgtgacctcagggtttggcccatggggccctcccaggcccctgccccaactgattctgcccagataatcgtgtctcctgcctccactcagctgcttctcagtcatgaatgtggccatggccccggggtccccttgctgctgtgggctccctgtccctgggcaggagtgctggtgaggaggtggagccttttgaggggggccttccctcagctgtttccccacactggggggctgggccctgcctccccgttaccctccttccctgcaggcctggagcctgtagggctggactgaggttcaggtctccccccagctgtctcacccccactttgtccccactctagagcagggaggcagtgggggaggagttgtgtctcgtcttctgtctccatgtggtttttgggtgtttttcttgttgtgtcctggattccgataaaattaaagaaattgcttcctcaa

SEQ ID NO: 356359 - DNA, 1686 bp, Homo sapiens
tgtctcgaatctacaaggtgggagcgggtgagaacccagcgactgcgcggctgaatgacagggagtagccccgccgcctccaacatggcagcttctatccagcgaagccgggtccccgcttccgggttccgtactgtcggccaggctacttccggcagcgcgatggctgggttcccgggactcgaacggaagttccggcgggggcggccgagggggaagagtgtgtctgcgggagaaagaggagaatcgcccaagcggcctcggaagtcccagggagtggaggcccccgccgtggagccgtgtggtgtatgtgtggtaacaccatgtctgtgcccctgctcaccgatgctgccaccgtgtctggagctgagcgggaaacggccgcggttatttttttacatggacttggagacacagggcacagctgggctgacgccctctccaccatccggctccctcacgtcaagtacatctgtccccatgcgcctaggatccctgtgaccctcaacatgaagatggtgatgccctcctggtttgacctgatggggctgagtccagatgccccagaggacgaggctggcatcaagaaggcagcagagaacatcaaggccttgattgagcatgaaatgaagaacgggatccctgccaatcgaatcgtcctgggaggcttttcacagggcggggccctgtccctctacacggccctcacctgcccccaccctctggctggcatcgtggcgttgagctgctggctgcctctgcaccgggccttcccccagggtccagttcaagacatacccgggtgtcatgcacagctcctgtcctcaggagatggcagctgtgaaggaatttcttgagaagctgctgcctcctgtctaactagtcgctggccccagtgcagtaccccagctcatgggggactcagcaagcaagcgtggcaccatcttggatctgagccggtcgagcccctgtccccacccttcctgacctgtccttttcccacaggcctctgggggcaggtggcaaggcctggccgggccttccttcctggccttagccacctggctctgtctgcagcaggggcaggctgctttcttatccatttccctggaggcgggcccccctggcagcagtattggaggggctacaggcagctggagaaaggggcccagccgctgacccactcactcaggacctcactcactagccccgctttgggccccctcctgtgacctcagggtttggcccatggggccctcccaggcccctgccccaactgattctgcccagataatcgtgtctcctgcctccactcagctgcttctcagtcatgaatgtggccatggccccggggtccccttgctgctgtgggctccctgtccctgggcaggagtgctggtgaggaggtggagccttttgaggggggccttccctcagctgtttccccacactggggggctgggccctgcctccccgttaccctccttccctgcaggcctggagcctgtagggctggactgaggttcaggtctccccccagctgtctcacccccactttgtccccactctagagcagggaggcagtgggggaggagttgtgtctcgtcttctgtctccatgtggtttttgggtgtttttcttgttgtgtcctggattccgataaaattaaagaaattgcttcctcaa

SEQ ID NO: 356360 - DNA, 865 bp, Homo sapiens
tgtctcgaatctacaaggtgggagcgggtgagaacccagcgactgcgcggctgaatgacagggagtagccccgccgcctccaacatggcagcttctatccagcgaagccgggtccccgcttccgggttccgtactgtcggccaggctacttccggcagcgcgatggctgggttcccgggactcgaacggaagttccggcgggggcggccgagggggaagagtgtgtctgcgggagaaagaggagaatcgcccaagcggcctcggaagtcccagggagtggaggcccccgccgtggagccgtgtggtgtatgtgtggtaacaccatgtctgtgcccctgctcaccgatgctgccaccgtgtctggagctgagcgggaaacggccgcggttatttttttacatggacttggagacacagggcacagctgggctgacgccctctccaccatccggctccctcacgtcaagtacatctgtccccatgcgcctaggatccctgtgaccctcaacatgaagatggtgatgccctcctggtttgacctgatggggctgagtccagatgccccagaggacgaggctggcatcaagaaggcagcagagaacatcaaggccttgattgagcatgaaatgaagaacgggatccctgccaatcgaatcgtcctgggaggcttttcacagggcggggccctgtccctctacacggccctcacctgcccccacctgtctcacccccactttgtccccactctagagcagggaggcagtgggggaggagttgtgtctcgtcttctgtctccatgtggtttttgggtgtttttcttgttgtgtcctggattccgataaaattaaagaaattgcttcctcaa

SEQ ID NO: 356361 - DNA, 675 bp, Homo sapiens
aactataggcataggtacgaggctgggtgttaatcggccgagagaggagaatcgcccaagcggcctcggaagtcccagggagtggaggcccccgccgtggagccgtgtggtgtatgtgtggtaacaccatgtctgtgcccctgctcaccgatgctgccaccgtgtctggagctgagcgggaaacggccgcggttatttttttacatggacttggagacacagggtaagtgactgaggggggtgctccttaaggaggggtctggcccggcagcggactggagaggcttctcttcctaccacatcggagccttttctcccgtccctcctacaggcacagctgggctgacgccctctccaccatccggctccctcacgtcaagtacatctgtccccatgccgtgagtgtcaccccagcaagggaggggctgaggctggggatcatctgggggtggtcctgtcatcccaggcctgttctctcctgtcagttgcatcctggggcttgggctcagggcaagtcagaagtggcattttcagcctgagctcctgtggagcccccaggagtggggtccagcaccagcccccagccctagggcctcctagacctgagctctcctagaacccacacctcccttcgccccttccccaagtactcaccgactacctgggagccctcat

SEQ ID NO: 356362 - DNA, 1811 bp, Homo sapiens
tgtctcgaatctacaaggtgggagcgggtgagaacccagcgactgcgcggctgaatgacagggagtagccccgccgcctccaacatggcagcttctatccagcgaagccgggtccccgcttccgggttccgtactgtcggccaggctacttccggcagcgcgatggctgggttcccgggactcgaacggaagttccggcgggggcggccgagggggaagagtgtgtctgcgggagaaagaggagaatcgcccaagcggcctcggaagtcccagggagtggaggcccccgccgtggagccgtgtggtgtatgtgtggtaacaccatgtctgtgcccctgctcaccgatgctgccaccgtgtctggagctgagcgggaaacggccgcggttatttttttacatggacttggagacacagggcacagctgggctgacgccctctccaccatccggctccctcacgtcaagtacatctgtccccatgcgcctaggatccctgtgaccctcaacatgaagatggtgatgccctcctggtttgacctgatggggctgagtccagatgccccagaggacgaggctggcatcaagaaggcagcagagaacatcaaggccttgattgagcatgaaatgaagaacgggatccctgccaatcgaatcgtcctgggaggcttttcacagggcggggccctgtccctctacacggccctcacctgcccccaccctctggctggcatcgtggcgttgagctgctggctgcctctgcaccgggccttcccccaggcagctaatggcagtgccaaggacctggccatactccagtgccatggggagctggaccccatggtgcccgtacggtttggggccctgacggctgagaagctccggtctgttgtcacacctgccagggtccagttcaagacatacccgggtgtcatgcacagctcctgtcctcaggagatggcagctgtgaaggaatttcttgagaagctgctgcctcctgtctaactagtcgctggccccagtgcagtaccccagctcatgggggactcagcaagcaagcgtggcaccatcttggatctgagccggtcgagcccctgtccccacccttcctgacctgtccttttcccacaggcctctgggggcaggtggcaaggcctggccgggccttccttcctggccttagccacctggctctgtctgcagcaggggcaggctgctttcttatccatttccctggaggcgggcccccctggcagcagtattggaggggctacaggcagctggagaaaggggcccagccgctgacccactcactcaggacctcactcactagccccgctttgggccccctcctgtgacctcagggtttggcccatggggccctcccaggcccctgccccaactgattctgcccagataatcgtgtctcctgcctccactcagctgcttctcagtcatgaatgtggccatggccccggggtccccttgctgctgtgggctccctgtccctgggcaggagtgctggtgaggaggtggagccttttgaggggggccttccctcagctgtttccccacactggggggctgggccctgcctccccgttaccctccttccctgcaggcctggagcctgtagggctggactgaggttcaggtctccccccagctgtctcacccccactttgtccccactctagagcagggaggcagtgggggaggagttgtgtctcgtcttctgtctccatgtggtttttgggtgtttttcttgttgtgtcctggattccgataaaattaaagaaattgcttcctcaa

SEQ ID NO: 356363 - DNA, 1567 bp, Homo sapiens
tgtctcgaatctacaaggtgggagcgggtgagaacccagcgactgcgcggctgaatgacagggagtagccccgccgcctccaacatggcagcttctatccagcgaagccgggtccccgcttccgggttccgtactgtcggccaggctacttccggcagcgcgatggctgggttcccgggactcgaacggaagttccggcgggggcggccgagggggaagagtgtgtctgcgggagaaagaggagaatcgcccaagcggcctcggaagtcccagggagtggaggcccccgccgtggagccgtgtggtgtatgtgtggtaacaccatgtctgtgcccctgctcaccgatgctgccaccgtgtctggagctgagcgggaaacggccgcggttatttttttacatggacttggagacacagggcacagctgggctgacgccctctccaccatccggctccctcacgtcaagtacatctgtccccatgcgcctaggatccctgtgaccctcaacatgaagatggtgatgccctcctggtttgacctgatggggctgagtccagatgccccagaggacgaggctggcatcaagaaggcagcagagaacatcaaggccttgattgagcatgaaatgaagaacgggatccctgccaatcgaatcgtcctgggaggcttttcacagggcggggccctgtccctctacacggccctcacctgcccccaccctctggctggcatcgtggcgttgagctgctggctgcctctgcaccgggccttcccccaggcagctaatggcagtgccaaggacctggccatactccagtgccatggggagctggaccccatggtgcccgtacggtttggggccctgacggctgagaagctccggtctgttgtcacacctgccagggtccagttcaagacatacccgggtgtcatgcacagctcctgtcctcaggagatggcagctgtgaaggaatttcttgagaagctgctgcctcctgtctaactagtcgctggccccagtgcagtaccccagctcatgggggactcagcaagcaagcgtggcaccatcttggatctgagccggtcgagcccctgtccccacccttcctgacctgtccttttcccacaggcctctgggggcaggtggcaaggcctggccgggccttccttcctggccttagccacgcctccactcagctgcttctcagtcatgaatgtggccatggccccggggtccccttgctgctgtgggctccctgtccctgggcaggagtgctggtgaggaggtggagccttttgaggggggccttccctcagctgtttccccacactggggggctgggccctgcctccccgttaccctccttccctgcaggcctggagcctgtagggctggactgaggttcaggtctccccccagctgtctcacccccactttgtccccactctagagcagggaggcagtgggggaggagttgtgtctcgtcttctgtctccatgtggtttttgggtgtttttcttgttgtgtcctggattccgataaaattaaagaaattgcttcctcaa

SEQ ID NO: 356364 - DNA, 1600 bp, Homo sapiens
tgtctcgaatctacaaggtgggagcgggtgagaacccagcgactgcgcggctgaatgacagggagtagccccgccgcctccaacatggcagcttctatccagcgaagccgggtccccgcttccgggttccgtactgtcggccaggctacttccggcagcgcgatggctgggttcccgggactcgaacggaagttccggcgggggcggccgagggggaagagtgtgtctgcgggagaaagaggagaatcgcccaagcggcctcggaagtcccagggagtggaggcccccgccgtggagccgtgtggtgtatgtgtggtaacaccatgtctgtgcccctgctcaccgatgctgccaccgtgtctggagctgagcgggaaacggccgcggttatttttttacatggacttggagacacagggcacagctgggctgacgccctctccaccatccggctccctcacgtcaagtacatctgtccccatgcgcctaggatccctgtgaccctcaacatgaagatggtgatgccctcctggtttgacctgatggggctgagtccagatgccccagaggacgaggctggcatcaagaaggcagcagagaacatcaaggccttgattgagcatgaaatgaagaacgggatccctgccaatcgaatcgtcctgggaggcttttcacagggcggggccctgtccctctacacggccctcacctgcccccaccctctggctggcatcgtggcgttgagctgctggctgcctctgcaccgggccttcccccaggcagctaatggcagtgccaaggacctggccatactccagtgccatggggagctggaccccatggtgcccgtacggtttggggccctgacggctgagaagctccggtctgttgtcacacctgccagggtccagttcaagacatacccgggtgtcatgcacagctcctgtcctcaggagatggcagctgtgaaggaatttcttgagaagctgctgcctcctgtctaactagtcgctggccccagtgcagtaccccagctcatgggggactcagcaagcaagcgtggcaccatcttggatctgagccggtcgagcccctgtccccacccttcctgacctgtccttttcccacaggcctctgggggcaggtggcaaggcctggccgggccttccttcctggccttagccacctggctctgtctgcagcaggggcaggctgctttcttatccatttccctggaggcgggcccccctggcagcagtattggaggggctacaggcagctggagaaaggggcccagccgctgacccactcactcaggacgtggagccttttgaggggggccttccctcagctgtttccccacactggggggctgggccctgcctccccgttaccctccttccctgcaggcctggagcctgtagggctggactgaggttcaggtctccccccagctgtctcacccccactttgtccccactctagagcagggaggcagtgggggaggagttgtgtctcgtcttctgtctccatgtggtttttgggtgtttttcttgttgtgtcctggattccgataaaattaaagaaattgcttcctcaa

SEQ ID NO: 356365 - DNA, 1616 bp, Homo sapiens
aactataggcataggtacgaggctgggtgttaatcggccgagagaggagaatcgcccaagcggcctcggaagtcccagggagtggaggcccccgccgtggagccgtgtggtgtatgtgtggtaacaccatgtctgtgcccctgctcaccgatgctgccaccgtgtctggagctgagcgggaaacggccgcggttatttttttacatggacttggagacacagggcacagctgggctgacgccctctccaccatccggctccctcacgtcaagtacatctgtccccatgcgcctaggatccctgtgaccctcaacatgaagatggtgatgccctcctggtttgacctgatggggctgagtccagatgccccagaggacgaggctggcatcaagaaggcagcagagaacatcaaggccttgattgagcatgaaatgaagaacgggatccctgccaatcgaatcgtcctgggaggcttttcacagggcggggccctgtccctctacacggccctcacctgcccccaccctctggctggcatcgtggcgttgagctgctggctgcctctgcaccgggccttcccccaggcagctaatggcagtgccaaggacctggccatactccagtgccatggggagctggaccccatggtgcccgtacggtttggggccctgacggctgagaagctccggtctgttgtcacacctgccagggtccagttcaagacatacccgggtgtcatgcacagctcctgtcctcaggagatggcagctgtgaaggaatttcttgagaagctgctgcctcctgtctaactagtcgctggccccagtgcagtaccccagctcatgggggactcagcaagcaagcgtggcaccatcttggatctgagccggtcgagcccctgtccccacccttcctgacctgtccttttcccacaggcctctgggggcaggtggcaaggcctggccgggccttccttcctggccttagccacctggctctgtctgcagcaggggcaggctgctttcttatccatttccctggaggcgggcccccctggcagcagtattggaggggctacaggcagctggagaaaggggcccagccgctgacccactcactcaggacctcactcactagccccgctttgggccccctcctgtgacctcagggtttggcccatggggccctcccaggcccctgccccaactgattctgcccagataatcgtgtctcctgcctccactcagctgcttctcagtcatgaatgtggccatggccccggggtccccttgctgctgtgggctccctgtccctgggcaggagtgctggtgaggaggtggagccttttgaggggggccttccctcagctgtttccccacactggggggctgggccctgcctccccgttaccctccttccctgcaggcctggagcctgtagggctggactgaggttcaggtctccccccagctgtctcacccccactttgtccccactctagagcagggaggcagtgggggaggagttgtgtctcgtcttctgtctccatgtggtttttgggtgtttttcttgttgtgtcctggattccgataaaattaaagaaattgcttcctcaa

SEQ ID NO: 356366 - DNA, 1588 bp, Homo sapiens
tattcattccgggctggcgtttaatttaccattcttgccgtagtctccaatgagtagaggcccccgccgtggagccgtgtggtgtatgtgtggtaacaccatgtctgtgcccctgctcaccgatgctgccaccgtgtctggagctgagcgggaaacggccgcggttatttttttacatggacttggagacacagggcacagctgggctgacgccctctccaccatccggctccctcacgtcaagtacatctgtccccatgcgcctaggatccctgtgaccctcaacatgaagatggtgatgccctcctggtttgacctgatggggctgagtccagatgccccagaggacgaggctggcatcaagaaggcagcagagaacatcaaggccttgattgagcatgaaatgaagaacgggatccctgccaatcgaatcgtcctgggaggcttttcacagggcggggccctgtccctctacacggccctcacctgcccccaccctctggctggcatcgtggcgttgagctgctggctgcctctgcaccgggccttcccccaggcagctaatggcagtgccaaggacctggccatactccagtgccatggggagctggaccccatggtgcccgtacggtttggggccctgacggctgagaagctccggtctgttgtcacacctgccagggtccagttcaagacatacccgggtgtcatgcacagctcctgtcctcaggagatggcagctgtgaaggaatttcttgagaagctgctgcctcctgtctaactagtcgctggccccagtgcagtaccccagctcatgggggactcagcaagcaagcgtggcaccatcttggatctgagccggtcgagcccctgtccccacccttcctgacctgtccttttcccacaggcctctgggggcaggtggcaaggcctggccgggccttccttcctggccttagccacctggctctgtctgcagcaggggcaggctgctttcttatccatttccctggaggcgggcccccctggcagcagtattggaggggctacaggcagctggagaaaggggcccagccgctgacccactcactcaggacctcactcactagccccgctttgggccccctcctgtgacctcagggtttggcccatggggccctcccaggcccctgccccaactgattctgcccagataatcgtgtctcctgcctccactcagctgcttctcagtcatgaatgtggccatggccccggggtccccttgctgctgtgggctccctgtccctgggcaggagtgctggtgaggaggtggagccttttgaggggggccttccctcagctgtttccccacactggggggctgggccctgcctccccgttaccctccttccctgcaggcctggagcctgtagggctggactgaggttcaggtctccccccagctgtctcacccccactttgtccccactctagagcagggaggcagtgggggaggagttgtgtctcgtcttctgtctccatgtggtttttgggtgtttttcttgttgtgtcctggattccgataaaattaaagaaattgcttcctcaa

SEQ ID NO: 356367 - DNA, 1779 bp, Homo sapiens
tgtctcgaatctacaaggtgggagcgggtgagaacccagcgactgcgcggctgaatgacagggagtagccccgccgcctccaacatggcagcttctatccagcgaagccgggtccccgcttccgggttccgtactgtcggccaggctacttccggcagcgcgatggctgggttcccgggactcgaacggaagttccggcgggggcggccgagggggaagagtgtgtctgcgggagaaagaggagaatcgcccaagcggcctcggaagtcccagggagtggaggcccccgccgtggagccgtgtggtgtatgtgtggtaacaccatgtctgtgcccctgctcaccgatgctgccaccgtgtctggagctgagcgggaaacggccgcggcacagctgggctgacgccctctccaccatccggctccctcacgtcaagtacatctgtccccatgcgcctaggatccctgtgaccctcaacatgaagatggtgatgccctcctggtttgacctgatggggctgagtccagatgccccagaggacgaggctggcatcaagaaggcagcagagaacatcaaggccttgattgagcatgaaatgaagaacgggatccctgccaatcgaatcgtcctgggaggcttttcacagggcggggccctgtccctctacacggccctcacctgcccccaccctctggctggcatcgtggcgttgagctgctggctgcctctgcaccgggccttcccccaggcagctaatggcagtgccaaggacctggccatactccagtgccatggggagctggaccccatggtgcccgtacggtttggggccctgacggctgagaagctccggtctgttgtcacacctgccagggtccagttcaagacatacccgggtgtcatgcacagctcctgtcctcaggagatggcagctgtgaaggaatttcttgagaagctgctgcctcctgtctaactagtcgctggccccagtgcagtaccccagctcatgggggactcagcaagcaagcgtggcaccatcttggatctgagccggtcgagcccctgtccccacccttcctgacctgtccttttcccacaggcctctgggggcaggtggcaaggcctggccgggccttccttcctggccttagccacctggctctgtctgcagcaggggcaggctgctttcttatccatttccctggaggcgggcccccctggcagcagtattggaggggctacaggcagctggagaaaggggcccagccgctgacccactcactcaggacctcactcactagccccgctttgggccccctcctgtgacctcagggtttggcccatggggccctcccaggcccctgccccaactgattctgcccagataatcgtgtctcctgcctccactcagctgcttctcagtcatgaatgtggccatggccccggggtccccttgctgctgtgggctccctgtccctgggcaggagtgctggtgaggaggtggagccttttgaggggggccttccctcagctgtttccccacactggggggctgggccctgcctccccgttaccctccttccctgcaggcctggagcctgtagggctggactgaggttcaggtctccccccagctgtctcacccccactttgtccccactctagagcagggaggcagtgggggaggagttgtgtctcgtcttctgtctccatgtggtttttgggtgtttttcttgttgtgtcctggattccgataaaattaaagaaattgcttcctcaa

SEQ ID NO: 356368 - DNA, 1366 bp, Homo sapiens
ctcctgagcatgatgggccctctggctctctttccccaggcctaggatccctgtgaccctcaacatgaagatggtgatgccctcctggtttgacctgatggggctgagtccagatgccccagaggacgaggctggcatcaagaaggcagcagagaacatcaaggccttgattgagcatgaaatgaagaacgggatccctgccaatcgaatcgtcctgggaggcttttcacagggcggggccctgtccctctacacggccctcacctgcccccaccctctggctggcatcgtggcgttgagctgctggctgcctctgcaccgggccttcccccaggcagctaatggcagtgccaaggacctggccatactccagtgccatggggagctggaccccatggtgcccgtacggtttggggccctgacggctgagaagctccggtctgttgtcacacctgccagggtccagttcaagacatacccgggtgtcatgcacagctcctgtcctcaggagatggcagctgtgaaggaatttcttgagaagctgctgcctcctgtctaactagtcgctggccccagtgcagtaccccagctcatgggggactcagcaagcaagcgtggcaccatcttggatctgagccggtcgagcccctgtccccacccttcctgacctgtccttttcccacaggcctctgggggcaggtggcaaggcctggccgggccttccttcctggccttagccacctggctctgtctgcagcaggggcaggctgctttcttatccatttccctggaggcgggcccccctggcagcagtattggaggggctacaggcagctggagaaaggggcccagccgctgacccactcactcaggacctcactcactagccccgctttgggccccctcctgtgacctcagggtttggcccatggggccctcccaggcccctgccccaactgattctgcccagataatcgtgtctcctgcctccactcagctgcttctcagtcatgaatgtggccatggccccggggtccccttgctgctgtgggctccctgtccctgggcaggagtgctggtgaggaggtggagccttttgaggggggccttccctcagctgtttccccacactggggggctgggccctgcctccccgttaccctccttccctgcaggcctggagcctgtagggctggactgaggttcaggtctccccccagctgtctcacccccactttgtccccactctagagcagggaggcagtgggggaggagttgtgtctcgtcttctgtctccatgtggtttttgggtgtttttcttgttgtgtcctggattccgataaaattaaagaaattgcttcctcaa

SEQ ID NO: 356369 - DNA, 1618 bp, Homo sapiens
tgtctcgaatctacaaggtgggagcgggtgagaacccagcgactgcgcggctgaatgacagggagtagccccgccgcctccaacatggcagcttctatccagcgaagccgggtccccgcttccgggttccgtactgtcggccaggctacttccggcagcgcgatggctgggttcccgggactcgaacggaagttccggcgggggcggccgagggggaagagtgtgtctgcgggagaaagaggagaatcgcccaagcggcctcggaagtcccagggagtggaggcccccgccgtggagccgtgtggtgtatgtgtggtaacaccatgtctgtgcccctgctcaccgatgctgccaccgtgtctggagctgagcgggaaacggccgcggttatttttttacatggacttggagacacagggcacagctgggctgacgccctctccaccatccggctccctcacgtcaagtacatctgtccccatgcggcggggccctgtccctctacacggccctcacctgcccccaccctctggctggcatcgtggcgttgagctgctggctgcctctgcaccgggccttcccccaggcagctaatggcagtgccaaggacctggccatactccagtgccatggggagctggaccccatggtgcccgtacggtttggggccctgacggctgagaagctccggtctgttgtcacacctgccagggtccagttcaagacatacccgggtgtcatgcacagctcctgtcctcaggagatggcagctgtgaaggaatttcttgagaagctgctgcctcctgtctaactagtcgctggccccagtgcagtaccccagctcatgggggactcagcaagcaagcgtggcaccatcttggatctgagccggtcgagcccctgtccccacccttcctgacctgtccttttcccacaggcctctgggggcaggtggcaaggcctggccgggccttccttcctggccttagccacctggctctgtctgcagcaggggcaggctgctttcttatccatttccctggaggcgggcccccctggcagcagtattggaggggctacaggcagctggagaaaggggcccagccgctgacccactcactcaggacctcactcactagccccgctttgggccccctcctgtgacctcagggtttggcccatggggccctcccaggcccctgccccaactgattctgcccagataatcgtgtctcctgcctccactcagctgcttctcagtcatgaatgtggccatggccccggggtccccttgctgctgtgggctccctgtccctgggcaggagtgctggtgaggaggtggagccttttgaggggggccttccctcagctgtttccccacactggggggctgggccctgcctccccgttaccctccttccctgcaggcctggagcctgtagggctggactgaggttcaggtctccccccagctgtctcacccccactttgtccccactctagagcagggaggcagtgggggaggagttgtgtctcgtcttctgtctccatgtggtttttgggtgtttttcttgttgtgtcctggattccgataaaattaaagaaattgcttcctcaa

SEQ ID NO: 356370 - DNA, 644 bp, Homo sapiens
  misc_feature (283)..(283): n is a, c, g, or t
  misc_feature (289)..(291): n is a, c, g, or t
aactataggcataggtacgaggctgggtgttaatcggccgagagaggagaatcgcccaagcggcctcggaagtcccagggagtggaggcccccgccgtggagccgtgtggtgtatgtgtggtaacaccatgtctgtgcccctgctcaccgatgctgccaccgtgtctggagctgagcgggaaacggccgcgtatttttttacatggactctgcgcagcaccaccaaggggcccacatgcccttggggccctggcgaacgccccccttccatccccaccccaantccggnnnctccctcaaaaaaaccccccccggggggggcgccccccaatttttttccccccaaaaaaaaaaacccgggggctctttttttaaaacccaaacttcctgggtatcccccaaaattgggccgcctaggcatccctgtgcaccctcaacatgaagatggtgatgccctcctggtttgacctgatggggctgagtccagatgccccaggaggcacgaggctggggcaattccaaaaagggcaaacaaggggggggcccaaaaagggccccacaaaggcaaaacgcggaaaaaaaccccaaagtttccaaaaacggggggccccccctttttggcaaattctgggaacgccaacttg

SEQ ID NO: 356371 - DNA, 1108 bp, Homo sapiens
ttcccgagtatcgcgagaagcgcgcttagtctgcacgccgaggtccgcgctgtgtcccgtgttttctgcgtgagaggaaaagatgctagaaccacaggagaatggcgtgattgacctaccagattatgagcatgtagaagatgaaacttttcctcctttcccacctccagcctctccagagagacaagatggtgaaggaactgagcctgatgaagagtcaggaaatggagcacctgttcctgtacctccaaagagaacagttaaaagaaatatacccaagctggatgctcagagattaatttcagagagaggacttccagccttaaggcatgtatttgataaggcaaaattcaaaggtaaaggtcatgaggctgaagacttgaagatgctaatcagacacatggagcactgggcacataggctattccctaaactgcagtttgaggattttattgacagagttgaatacctgggaagtaaaaaggaagttcagacctgtttaaaacgaattcgacttgatctccctattttacatgaagattttgttagcaataatgatgaagttgcggagaataatgaacatgatgtcacttctactgaattagatccctttctgacaaacttatctgaaagtgagatgtttgcttctgagttaagtagaagcctaacagaagagcaacaacaaagaattgagagaaataaacaactggccttggaaagaaggcaggcaaagctgctgagtaatagtcagaccctaggaaatgatatgttaatgaatacacccagggcacacacggttgaagaggttaatactgatgaggatcaaaaggaggagtcaaatggattaaacgaagacattctggacaatccatgtaatgatgctattgccaatactttaaatgaagaggaaacactgctggaccagtcttttaaaaatgtgcaacagcaacttgatgctacatccagaaatattactgaagctagataagtttccattaagagaaaatgtatctgttaagtcatcgtcctgcaagcttggcgttactatgtattttttcttcttggagtgaaaatccttagatagtaaaactgttatagattattgttt

SEQ ID NO: 356372 - DNA, 821 bp, Homo sapiens
actgcctgggggcggggtccgtcgcggacgccgtggcgccctctgtcgccccgaggcaagcaggtggacccagctgagaagaagtctgtgtcgctgtgtggtgagctctccaggccaggtgccgcgcggcctccacctctgcggtcctttgccgtgtgtactgcgagagtgaagaccattctcattaatcagactgtcgacattccagaaaatgtcaacattactctgaagggacacacagttatcgtgaatggccccagaggaaccctgcggagggacttcaatcacatcaatgtagaactcagtcttcttggaaagaaaaaaaaagaggctctggttgacaaatggtggggtaacagaaaagaactggctaccgttcggactatttgtagtcatgtacagaacatgatcaagggtgttacactgggcttccgttacaagatgaggtctgtgtatgcttacttccccatcatcgtcgttatcccggagaatgggtctgttgttgaaatccgaaatttcttgggtgaaaaatacatccgcagggtgcggatgagaccaggtgttgcttgttcagtatctcaagcccagaaagatgaattaatctttgaaggaaatgacatcgagcttgtttcaaattcagcggctttgattcagcaagccacaacagtttaaaacaaggatatcaggaaatttttgaatggtatctatgtctctgaaaaaggaactgttcagcaggatgatgacataagatctaagagttatccagctacagaaagaagacgccagatgactcctaagacctacttgtgatatttaaatga

SEQ ID NO: 356373 - DNA, 204 bp, Homo sapiens
actgcctgggggcggggtccgtcgcggacgccgtggcgccctctgtcgccccgaggcaagcaggtggacccagctgagaagaagtctgtgtcgctgtgtggtgagctctccaggccaggtgccgcgcggcctccacctctgcgtgtcaaagacattaggtgtacagaacaaaggaaacgtgtacagaacaaaggaaacatctac

SEQ ID NO: 356374 - DNA, 1177 bp, Homo sapiens
actgcctgggggcggggtccgtcgcggacgccgtggcgccctctgtcgccccgaggcaagcaggtggacccagctgagaagaagtctgtgtcgctgtgtggtgagctctccaggccaggtgccgcgcggcctccacctctgcgaggaaaagatgctagaaccacaggagaatggcgtgattgacctaccagattatgagcatgtagaagatgaaacttttcctcctttcccacctccagcctctccagagagacaagatggtgaaggaactgagcctgatgaagagtcaggaaatggagcacctgttcctgtacctccaaagagaacagttaaaagaaatatacccaagctggatgctcagagattaatttcagagagaggacttccagccttaaggcatgtatttgataaggcaaaattcaaaggtaaaggtcatgaggctgaagacttgaagatgctaatcagacacatggagcactgggcacataggctattccctaaactgcagtttgaggattttattgacagagttgaatacctgggaagtaaaaaggaagttcagacctgtttaaaacgaattcgacttgatctccctattttacatgaagattttgttagcaataatgatgaagttgcggagaataatgaacatgatgtcacttctactgaattagatccctttctgacaaacttatctgaaagtgagatgtttgcttctgagttaagtagaagcctaacagaagagcaacaacaaagaattgagagaaataaacaactggccttggaaagaaggcaggcaaagctgctgagtaatagtcagaccctaggaaatgatatgttaatgaatacacccagggcacacacggttgaagaggttaatactgatgaggatcaaaaggaggagtcaaatggattaaacgaagacattctggacaatccatgtaatgatgctattgccaatactttaaatgaagaggaaacactgctggaccagtcttttaaaaatgtgcaacagcaacttgatgctacatccagaaatattactgaagctagataagtttccattaagagaaaatgtatctgttaagtcatcgtcctgcaagcttggcgttactatgtattttttcttcttggagtgaaaatccttagatagtaaaactgttatagattattgttt

SEQ ID NO: 356375 - DNA, 1293 bp, Homo sapiens
actgcctgggggcggggtccgtcgcggacgccgtggcgccctctgtcgccccgaggcaagcaggtggacccagctgagaagaagtctgtgtcgctgtgtgaggaaaagatgctagaaccacaggagaatggcgtgattgacctaccagattatgagcatgtagaagatgaaacttttcctcctttcccacctccagcctctccagagagacaagatggtgaaggaactgagcctgatgaagagtcaggaaatggagcacctgttcctgtacctccaaagagaacagttaaaagaaatatacccaagctggatgctcagagattaatttcagagagaggacttccagccttaaggcatgtatttgataaggcaaaattcaaaggtaaaggtcatgaggctgaagacttgaagatgctaatcagacacatggagcactgggcacataggctattccctaaactgcagtttgaggattttattgacagagttgaatacctgggaagtaaaaaggaagttcagacctgtttaaaacgaattcgacttgatctccctattttacatgaagattttgttagcaataatgatgaagttgcggagaataatgaacatgatgtcacttctactgaattagatccctttctgacaaacttatctgaaagtgagatgtttgcttctgagttaagtagaagcctaacagaagagcaacaacaaagaattgagagaaataaacaactggccttggaaagaaggcaggcaaagctgctgagtaatagtcagaccctaggaaatgatatgttaatgaatacacccagggcacacacggttgaagaggttaatactgatgaggatcaaaaggaggagtcaaatggattaaacgaagacattctggacaatccatgtaatgatgctattgccaatactttaaatgaagaggaaacactgctggaccagtcttttaaaaatgtgcaacagcaacttgatgctacatccagaaatattactgaagctagataagtttccattaagagaaaatgtatctgttaagtcatcgtcctgcaagcttggcgttactatgtattttttcttcttggagtgaaaatccttagatagtaaaactgttatagattattgtttaaaatctgataatctggtatttatttataattatgcttgtcactttagttaaatctatttgttctctttagtgtttgtttttatataggtatttcttcataaaatgattaggaggtaataagcacaaaaacaaaaaaaaactggcctcgatggactaca

SEQ ID NO: 356376 - DNA, 1363 bp, Homo sapiens
aagctccataaatcacttcattagcggcacaagcgcactaagtctgtgagacatggggtctgggctggtgtcctagggatatcctgggttgagacggaattgcattgcgtaattacatccaaccagagtagaaaatagagcgctgccagtgtgagccatacccgagactgtatcgtagacaactgtatcacaagatagagaagcttcttgcacgtgctctattcacctaggcattcctagtacatactacgcgaagatcacgaacgacggagtggctgatagtgaaactctgaagcgctcgcactggacacagtcaggaaatggagcacctgttcctgtacctccaaagagaacagttaaaagaaatatacccaagctggatgctcagagattaatttcagagagaggacttccagccttaaggcatgtatttgataaggcaaaattcaaaggtaaaggtcatgaggctgaagacttgaagatgctaatcagacacatggagcactgggcacataggctattccctaaactgcagtttgaggattttattgacagagttgaatacctgggaagtaaaaaggaagttcagacctgtttaaaacgaattcgacttgatctccctattttacatgaagattttgttagcaataatgatgaagttgcggagaataatgaacatgatgtcacttctactgaattagatccctttctgacaaacttatctgaaagtgagatgtttgcttctgagttaagtagaagcctaacagaagagcaacaacaaagaattgagagaaataaacaactggccttggaaagaaggcaggcaaagctgctgagtaatagtcagaccctaggaaatgatatgttaatgaatacacccagggcacacacggttgaagaggttaatactgatgaggatcaaaaggaggagtcaaatggattaaacgaagacattctggacaatccatgtaatgatgctattgccaatactttaaatgaagaggaaacactgctggaccagtcttttaaaaatgtgcaacagcaacttgatgctacatccagaaatattactgaagctagataagtttccattaagagaaaatgtatctgttaagtcatcgtcctgcaagcttggcgttactatgtattttttcttcttggagtgaaaatccttagatagtaaaactgttatagattattgtttaaaatctgataatctggtatttatttataattatgcttgtcactttagttaaatctatttgttctctttagtgtttgtttttatataggtatttcttcataaaatgattaggaggtaataagcacaaaaacaaaaaaaaactggcctcgatggactaca

SEQ ID NO: 356377 - DNA, 359 bp, Homo sapiens
aaaatgtgcaacagcaacttgatgctacatccagaaatattactgaagctagataagtttccattaagagaaaatgtatctgttaagtcatcgtcctgcaagcttggcgttactatgtattttttcttcttggagtgaaaatccttagatagtaaaactgttatagattattgtttaaaatctgataatctggtatttatttataattatgcttgtcactttagttaaatctatttgttctctttagtgtttgtttttatataggtatttcttcataaaatgattaggaggtaataagcagtttctgctgctggtctgtcattgaatgccttgttttcactaagttgggaggttttgtt

SEQ ID NO: 356378 - DNA, 937 bp, Homo sapiens
  misc_feature (790)..(790): n is a, c, g, or t
  misc_feature (792)..(792): n is a, c, g, or t
  misc_feature (795)..(796): n is a, c, g, or t
  misc_feature (798)..(799): n is a, c, g, or t
  misc_feature (806)..(806): n is a, c, g, or t
  misc_feature (810)..(810): n is a, c, g, or t
  misc_feature (816)..(816): n is a, c, g, or t
  misc_feature (829)..(829): n is a, c, g, or t
ttcccgagtatcgcgagaagcgcgcttagtctgcacgccgaggtccgcgctgtgtcccgtgttttctgcgtgagaggaaaagatgctagaaccacaggagaatggcgtgattgacctaccagattatgagcatgtagaagatgaaacttttcctcctttcccacctccagcctctccagagagacaagatggtgaaggaactgagcctgatgaagagtcaggaaatggagcacctgttcctgtacctccaaagagaacagttaaaagaaatatacccaagctggatgctcagagattaatttcagagagaggacttccagccttaaggcatgtatttgataaggcaaaattcaaaggtaaaggtcatgaggctgaagacttgaagatgctaatcagacacatggagcactgggcacataggctattccctaaactgcagtttgaggattttattgacagagttgaatacctgggaagtaaaaaggaagttcagacctgtttaaaacgaattcgacttgatctccctattttacatgaagattttgttagcaataatgatgaagttgcggagaataatgaacatgatgtcacttctactgaattagatccctttctgacaaacttatctgaaagtgagatgtttgcttctgagttaagtagaagcctaacagaagagcaacaacaaagaattgagagaaataaacaactggccttggaaagaaggcaggcaaagctgctgagtaatagtcagaccctaggaaatgattgtttgataccccgggcacacggngnagnntnntggtggntcangggggncatggttagaganttggacctggtgtgtttgcctttatggagaacggcgcgtttaaggcgtgtgtcaattaggattaaaatgccaggggttttgggagagttaaaagggggggtgggtggc

SEQ ID NO: 356379 - DNA, 778 bp, Homo sapiens
actgcctgggggcggggtccgtcgcggacgccgtggcgccctctgtcgccccgaggcaagcaggtggacccagctgagaagaagtctgtgtcgctgtgtggtcctttgccgtgtgtactgcgagagtgaagaccattctcattaatcagactgtcgacattccagaaaatgtcaacattactctgaagggacacacagttatcgtgaatggccccagaggaaccctgcggagggacttcaatcacatcaatgtagaactcagtcttcttggaaagaaaaaaaaagaggctctggttgacaaatggtggggtaacagaaaagaactggctaccgttcggactatttgtagtcatgtacagaacatgatcaagggtgttacactgggcttccgttacaagatgaggtctgtgtatgcttacttccccatcatcgtcgttatcccggagaatgggtctgttgttgaaatccgaaatttcttgggtgaaaaatacatccgcagggtgcggatgagaccaggtgttgcttgttcagtatctcaagcccagaaagatgaattaatctttgaaggaaatgacatcgagcttgtttcaaattcagcggctttgattcagcaagccacaacagtttaaaacaaggatatcaggaaatttttgaatggtatctatgtctctgaaaaaggaactgttcagcaggatgatgacataagatctaagagttatccagctacagaaagaagacgccagatgactcctaagacctacttgtgatatttaaatga

SEQ ID NO: 356380 - DNA, 1267 bp, Homo sapiens
ttcccgagtatcgcgagaagcgcgcttagtctgcacgccgaggtccgcgctgtgtcccgtgttttctgcgtgagaggaaaagatgctagaaccacaggagaatggcgtgattgacctaccagattatgagcatgtagaagatgaaacttttcctcctttcccacctccagcctctccagagagacaagatggtgaaggaactgagcctgatgaagagtcaggaaatggagcacctgttcctgtacctccaaagagaacagttaaaagaaatatacccaagctggatgctcagagattaatttcagagagaggacttccagccttaaggcatgtatttgataaggcaaaattcaaaggtaaaggtcatgaggctgaagacttgaagatgctaatcagacacatggagcactgggcacataggctattccctaaactgcagtttgaggattttattgacagagttgaatacctgggaagtaaaaaggaagttcagacctgtttaaaacgaattcgacttgatctccctattttacatgaagattttgttagcaataatgatgaagttgcggagaataatgaacatgatgtcacttctactgaattagatccctttctgacaaacttatctgaaagtgagatgtttgcttctgagttaagtagaagcctaacagaagagcaacaacaaagaattgagagaaataaacaactggccttggaaagaaggcaggcaaagctgctgagtaatagtcagaccctaggaaatgatatgttaatgaatacacccagggcacacacggttgaagaggttaatactgatgaggatcaaaaggaggagtcaaatggattaaacgaagacattctggacaatccatgtaatgatgctattgccaatactttaaatgaagaggaaacactgctggaccagtcttttaaaaatgtgcaacagcaacttgatgctacatccagaaatattactgaagctagataagtttccattaagagaaaatgtatctgttaagtcatcgtcctgcaagcttggcgttactatgtattttttcttcttggagtgaaaatccttagatagtaaaactgttatagattattgtttaaaatctgataatctggtatttatttataattatgcttgtcactttagttaaatctatttgttctctttagtgtttgtttttatataggtatttcttcataaaatgattaggaggtaataagcacaaaaacaaaaaaaaactggcctcgatggactaca

SEQ ID NO: 356381 - DNA, 1523 bp, Homo sapiens
actgcctgggggcggggtccgtcgcggacgccgtggcgccctctgtcgccccgaggcaagcaggtggacccagctgagaagaagtctgtgtcgctgtgtggtgagctctccaggccaggtgccgcgcggcctccacctctgcggtaaccggcctgcccccgacccctgtccccaagccgagccgtgttgacgaaaatgaaataacaaaataaataaggaaaaggaccccttcctgtgtccagaggagaggcagcgtggggaataggaaacttgtcgagaggctcctttgagcccaacaaactgacgcatataaattttgtttgtttaatgaggaaaagatgctagaaccacaggagaatggcgtgattgacctaccagattatgagcatgtagaagatgaaacttttcctcctttcccacctccagcctctccagagagacaagatggtgaaggaactgagcctgatgaagagtcaggaaatggagcacctgttcctgtacctccaaagagaacagttaaaagaaatatacccaagctggatgctcagagattaatttcagagagaggacttccagccttaaggcatgtatttgataaggcaaaattcaaaggtaaaggtcatgaggctgaagacttgaagatgctaatcagacacatggagcactgggcacataggctattccctaaactgcagtttgaggattttattgacagagttgaatacctgggaagtaaaaaggaagttcagacctgtttaaaacgaattcgacttgatctccctattttacatgaagattttgttagcaataatgatgaagttgcggagaataatgaacatgatgtcacttctactgaattagatccctttctgacaaacttatctgaaagtgagatgtttgcttctgagttaagtagaagcctaacagaagagcaacaacaaagaattgagagaaataaacaactggccttggaaagaaggcaggcaaagctgctgagtaatagtcagaccctaggaaatgatatgttaatgaatacacccagggcacacacggttgaagaggttaatactgatgaggatcaaaaggaggagtcaaatggattaaacgaagacattctggacaatccatgtaatgatgctattgccaatactttaaatgaagaggaaacactgctggaccagtcttttaaaaatgtgcaacagcaacttgatgctacatccagaaatattactgaagctagataagtttccattaagagaaaatgtatctgttaagtcatcgtcctgcaagcttggcgttactatgtattttttcttcttggagtgaaaatccttagatagtaaaactgttatagattattgtttaaaatctgataatctggtatttatttataattatgcttgtcactttagttaaatctatttgttctctttagtgtttgtttttatataggtatttcttcataaaatgattaggaggtaataagcacaaaaacaaaaaaaaactggcctcgatggactaca

SEQ ID NO: 356382 - DNA, 769 bp, Homo sapiens
gcagacagatcgaatcgagccggtaccccctagttttagaagtttcaatagcaataatgatgaagttgcggagaataatgaacatgatgtcacttctactgaattagatccctttctgacaaacttatctgaaagtgagatgtttgcttctgagttaagtagaagcctaacagaagagcaacaacaaagaattgagagaaataaacaactggccttggaaagaaggcaggcaaagctgctgagtaatagtcagaccctaggaaatgatatgttaatgaatacacccagggcacacacggttgaagaggttaatactgatgaggatcaaaaggaggagtcaaatggattaaacgaagacattctggacaatccatgtaatgatgctattgccaatactttaaatgaagaggaaacactgctggaccagtcttttaaaaatgtgcaacagcaacttgatgctacatccagaaatattactgaagctagataagtttccattaagagaaaatgtatctgttaagtcatcgtcctgcaagcttggcgttactatgtattttttcttcttggagtgaaaatccttagatagtaaaactgttatagattattgtttaaaatctgataatctggtatttatttataattatgcttgtcactttagttaaatctatttgttctctttagtgtttgtttttatataggtatttcttcataaaatgattaggaggtaataagcacaaaaacaaaaaaaaactggcctcgatggactaca

SEQ ID NO: 356383 - DNA, 258 bp, Homo sapiens
aatagcttatgccttttaatgcaaattcttggtgaatttaggagcgcgtcttctttttcctttaaaacgcacttgcaactgctgcgaatgagacgcgtgcattcagaccaacctgagtctgtcccttccacgctgcagtcctcaaacttggccccaacaaactatttctattcgttttgcctgttttctcctttaggttgaaaagctgacagcgggccccagacactgagggggcgccttcccagcttggcttcccct

SEQ ID NO: 356384 - DNA, 312 bp, Homo sapiens
gatttgacttttcaatgttttaagatccttcccagctctgaatttttatgattataacattgtagcttatctgccacttttcttgacattcttgcatctgataggaacttttagtagtatatccttagattggcatttcatttactggaactgattagtgtcaaatgcaaacttaaacatttcactctaaacctccagtcttaaatgtaagactcctaccctttatttcctagctttaatgagatctctatccattaattcatttatacactttttttttttaagagatgtgctctcgctctattgcccaga

SEQ ID NO: 356385 - DNA, 438 bp, Homo sapiens
caacgacaaaataaaaatgatctctctcacctctcagcttggagatacagaccatttactgggctgcttcctgacccctgtctgcaaccccacctaaaggactgcccacgccaaaggcagacgcgaatccgctcaacacaagttgaccaagtttttcgcctggctaagcggcaggggcgtcccctcctccctgcgccacctccccaccgactggcttcccctgacatttctcatgcgccccaccctgggcagtttgctttgacatttcagtgcctcattgctcaagctaccagcacgggcgtagccgacgccgggagagcccacagagtgcgagctccatggtgcctgtcaccagcccccgccaagggtcataaagcctggcaggagccgcggcgaacccgggagcggcggcgtcgcgggcaggctgcaggcggccgc

SEQ ID NO: 356386 - DNA, 648 bp, Homo sapiens
  misc_feature (504)..(504): n is a, c, g, or t
  misc_feature (509)..(509): n is a, c, g, or t
  misc_feature (514)..(514): n is a, c, g, or t
  misc_feature (532)..(532): n is a, c, g, or t
  misc_feature (627)..(627): n is a, c, g, or t
  misc_feature (648)..(648): n is a, c, g, or t
agcctcttcttcctgggggaactctgttcttcatccaaacctttgatcaccctcagagattgtccagaaggtacgaaatggtcagcggccatatttccggccaagcattgaccggacccaactgaatgaagagctagttttgctgatggagcgatgttgggctcaggacccagctgagcggccagactttggacagattaagggcttcattcggcgctttaacaagtgagagggcattatggggcaggggcttcccagggatagaagactcattagtcctagtgcatgaagtggggcaggtgggaccagagggtgggttggataggaagtcctgggaatcttcagaatcttagagcaagtgccttatcctggcctccctctagggagggtggcaccagcatattggacaacctcctgctgcgcatggaacagtatgccaataacttggagaagctggtggaggaacgcacacaggcctatctgagggggagagctgacagctgngcttngcagngtccattactcagtgcantgtgctcacagattgcagagaagcacccatgcagagtgcactcttatgactgatactgcttgtgcataatgcaacttgtgctcaggtagagctgngcgtgtcatgaaaccttatan

SEQ ID NO: 356387 - DNA, 4158 bp, Homo sapiens
cggccacataagatattatctacacaaaagcttatttaggaatgaccaatgagctcaacttaaatttattagaaatctgattagcattataaatcaactgacttttaggagcataggctttggcgctacagggatctggcttgaacctcattgaggccactgattggtgagtgaccttaagcaagtctctttaccttgttagggcacaatttcctctcggaattgtgaaatgggtttaattacaccagcttacatcccaaccatcagcaagtcctcttgtatgtaaccatctccaacacagaaaggggatctgcccatgttctaccatcctcacctttctccaagccactacaacctctcacaacagccttccaattggtctccctaaactcttatcccccctacaccccgttctcagtcctcagtccttgccctaggctggtagcccactccttgcccgccccccgccttcctcccatctccccctcctctccccggcccccagcaccttctgcatcccagcctacctagcctactcctcctcttcctggccctcttccccaggctccaggctggggggtgctcgcgtctcccctgtaggccagagcagccccaagttctgggggcggtggggctgctgctttatccccatggcgctgccatcacttctgctgttggtggcagccctggcaggtggggtgcgtcctcccggggcgcggaacctgacgctggcggtggtgctgccagaacacaacctgagctatgcctgggcctggccacgggtgggacccgctgtggcactagctgtggaggctctgggccgggcactgcccgtggacctgcggtttgtcagctccgaactggaaggcgcctgctctgagtacctggcaccgctgagcgctgtggacctcaagctgtaccatgaccccgacctgctgttaggtcccggttgcgtgtaccctgctgcctctgtggcccgctttgcctcccactggcgccttcccctgctgactgcgggtgctgtggcctctggtttttcggctaagaatgaccattatcgtaccctggttcgcactggcccctctgctcccaagctgggtgagtttgtggtgacactacacgggcacttcaattggactgcccgtgctgccttgctgtacctggatgctcgcacagatgaccggcctcactacttcaccatcgagggcgtctttgaggccctgcagggcagcaacctcagtgtgcagcaccaggtgtatgcccgagagccagggggccccgagcaggccacccacttcatccgggccaacgggcgcattgtgtatatctgcggccctctggagatgctgcatgagatcctgcttcaggcccagagggagaatctgaccaatggggattatgtcttcttttacctggatgtctttggggagagtctccgtgcaggccccacacgtgctacaggccggccctggcaggacaatcgcacccgggaacaggcccaggccctcagagaggcctttcagactgtattggtgatcacgtaccgagaacccccaaatcctgagtatcaggaattccagaatcgtctgctgataagagcccgggaagactttggtgtggagctgggcccttccctgatgaacctcatcgctggctgcttctatgatgggatcctgctatatgctgaagtcctgaatgagacaatacaggaaggaggcacccgggaggatggacttcgaattgtggaaaagatgcagggacgaagatatcacggtgtaactgggctggttgtcatggacaagaacaatgaccgagagactgactttgtcctctgggccatgggagacctggattctggggactttcagcctgcagcccactactcgggagctgagaagcagatttggtggacgggacggcctattccctgggtgaagggggctcctccctcggacaatcccccctgtgcctttgacttggacgacccatcctgtgataaaactccactttcaaccctggcaattgtggctctgggcacaggaatcaccttcatcatgtttggtgtttccagcttcctaattttccgaaagctgatgctggagaaggagctggctagcatgttgtggcgtattcgctgggaagaactgcagtttggcaactcagagcgttatcacaaaggtgcaggcagtcgcctcacactgtcgctgcggggatccagttacggctcgctcatgacagcccatgggaaataccagatctttgccaacaccggtcacttcaagggaaatgttgtcgccatcaaacatgtgaataagaagcgcattgagctgacccggcaggttctgtttgaactcaaacatatgagagatgttcagttcaaccatctcactcgcttcattggcgcctgcatagaccctcccaacatttgcattgtcactgaatactgtcctcgtgggagtttacaggatattctagaaaatgacagcatcaacttggactggatgtttcgttattcactcattaatgaccttgttaagggcatggcctttctccacaacagcattatttcatcgcatgggagtctcaagtcctccaactgtgtggtggatagtcgttttgtgctcaaaatcacagactatggcctggccagcttccgatcaactgctgaacctgatgacagccatgccctctatgccaagaagctgtggactgccccagaactgctcagtgggaaccccttgccaaccacaggcatgcagaaggctgacgtctatagctttgggatcatcctgcaggagatagcacttcgcagtggtcctttctacttggagggcctggacctcagccccaaagagattgtccagaaggtacgaaatggtcagcggccatatttccggccaagcattgaccggacccaactgaatgaagagctagttttgctgatggagcgatgttgggctcaggacccagctgagcggccagactttggacagattaagggcttcattcggcgctttaacaaggagggtggcaccagcatattggacaacctcctgctgcgcatggaacagtatgccaataacttggagaagctggtggaggaacgcacacaggcctatctggaggaaaaacgcaaggctgaagctctgctctaccaaatcctaccccattcagtggcagagcagttaaaacggggagagactgtacaggctgaggcctttgacagtgttaccatctacttcagtgacattgttggcttcacagcattgtcagcagagagcacccccatgcaggtagtgacacttcttaatgacctgtatacctgctttgatgccataattgacaactttgatgtctacaaggtggagacgattggggatgcttacatggtggtatctggcctcccaggccgaaatggtcaacgccatgcaccagaaattgctcgtatggccctagcattactagatgcagtttcttcctttcgcatccgccaccgaccccatgaccagctgaggctacgcataggggtccatactggtaaggctgactctcactccagccctagtctccacctttcccagactctcccaacctgtttcttctcaaagggccagtctgtgctggggttgttggcctgaagatgccccgttattgtctttttggagacacagtgaacactgcttctcgaatggagtctaatggtcaagcgctgaagatccatgtctcctctaccaccaaggatgccctagatgagctaggatgcttccagctagagcttcggggggatgtggaaatgaagggaaaaggaaagatgcgaacatactggctcttaggagagcggaaaggacctcctggactcctgtaaacccccattctttccaagtcagatagtcttctgctgctggtacctgggtgggcaatggccaccatgtctgcacacaccagaaatggacattttcatatgcaatggaaaacagccacaaaaaaacctaccttatatggaagttgtagccctctgcagctcagccctgtacatatacctgtccctctctggcttggtccccttcctccctactttctgtaaatatctgtatctaaaccagaatattttggtcaaatataaaacaataataaaaaaagttctgatgtcaaaatgtg

SEQ ID NO: 356388 - DNA, 4015 bp, Homo sapiens
cggccacataagatattatctacacaaaagcttatttaggaatgaccaatgagctcaacttaaatttattagaaatctgattagcattataaatcaactgacttttaggagcataggctttggcgctacagggatctggcttgaacctcattgaggccactgattggtgagtgaccttaagcaagtctctttaccttgttagggcacaatttcctctcggaattgtgaaatgggtttaattacaccagcttacatcccaaccatcagcaagtcctcttgtatgtaaccatctccaacacagaaaggggatctgcccatgttctaccatcctcacctttctccaagccactacaacctctcacaacagccttccaattggtctccctaaactcttatcccccctacaccccgttctcagtcctcagtccttgccctaggctggtagcccactccttgcccgccccccgccttcctcccatctccccctcctctccccggcccccagcaccttctgcatcccagcctacctagcctactcctcctcttcctggccctcttccccaggctccaggctggggggtgctcgcgtctcccctgtaggccagagcagccccaagttctgggggcggtggggctgctgctttatccccatggcgctgccatcacttctgctgttggtggcagccctggcaggtggggtgcgtcctcccggggcgcggaacctgacgctggcggtggtgctgccagaacacaacctgagctatgcctgggcctggccacgggtgggacccgctgtggcactagctgtggaggctctgggccgggcactgcccgtggacctgcggtttgtcagctccgaactggaaggcgcctgctctgagtacctggcaccgctgagcgctgtggacctcaagctgtaccatgaccccgacctgctgttaggtcccggttgcgtgtaccctgctgcctctgtggcccgctttgcctcccactggcgccttcccctgctgactgcgggtgctgtggcctctggtttttcggctaagaatgaccattatcgtaccctggttcgcactggcccctctgctcccaagctgggtgagtttgtggtgacactacacgggcacttcaattggactgcccgtgctgccttgctgtacctggatgctcgcacagatgaccggcctcactacttcaccatcgagggcgtctttgaggccctgcagggcagcaacctcagtgtgcagcaccaggtgtatgcccgagagccagggggccccgagcaggccacccacttcatccgggccaacgggcgcattgtgtatatctgcggccctctggagatgctgcatgagatcctgcttcaggcccagagggagaatctgaccaatggggattatgtcttcttttacctggatgtctttggggagagtctccgtgcaggccccacacgtgctacaggccggccctggcaggacaatcgcacccgggaacaggcccaggccctcagagaggcctttcagactgtattggtgatcacgtaccgagaacccccaaatcctgagtatcaggaattccagaatcgtctgctgataagagcccgggaagactttggtgtggagctgggcccttccctgatgaacctcatcgctggctgcttctatgatgggatcctgctatatgctgaagtcctgaatgagacaatacaggaaggaggcacccgggaggatggacttcgaattgtggaaaagatgcagggacgaagatatcacggtgtaactgggctggttgtcatggacaagaacaatgaccgagagactgactttgtcctctgggccatgggagacctggattctggggactttcagcctgcagcccactactcgggagctgagaagcagatttggtggacgggacggcctattccctgggtgaagggggctcctccctcggacaatcccccctgtgcctttgacttggacgacccatcctgtgataaaactccactttcaaccctggcaattgtggctctgggcacaggaatcaccttcatcatgtttggtgtttccagcttcctaattttccgaaagctgatgctggagaaggagctggctagcatgttgtggcgtattcgctgggaagaactgcagtttggcaactcagagcgttatcacaaaggtgcaggcagtcgcctcacactgtcgctgcggggatccagttacggctcgctcatgacagcccatgggaaataccagatctttgccaacaccggtcacttcaagggaaatgttgtcgccatcaaacatgtgaataagaagcgcattgagctgacccggcaggttctgtttgaactcaaacatatgagagatgttcagttcaaccatctcactcgcttcattggcgcctgcatagaccctcccaacatttgcattgtcactgaatactgtcctcgtgggagtttacagggcatggcctttctccacaacagcattatttcatcgcatgggagtctcaagtcctccaactgtgtggtggatagtcgttttgtgctcaaaatcacagactatggcctggccagcttccgatcaactgctgaacctgatgacagccatgccctctatgccaagaagctgtggactgccccagaactgctcagtgggaaccccttgccaaccacaggcatgcagaaggctgacgtctatagctttgggatcatcctgcaggagatagcacttcgcagtggtcctttctacttggagggcctggacctcagccccaaagagattgtccagaaggtacgaaatggtcagcggccatatttccggccaagcattgaccggacccaactgaatgaagagctagttttgctgatggagcgatgttgggctcaggacccagctgagcggccagactttggacagattaagggcttcattcggcgctttaacaaggagggtggcaccagcatattggacaacctcctgctgcgcatggaacagtatgccaataacttggagaagctggtggaggaacgcacacaggcctatctggaggaaaaacgcaaggctgaagctctgctctaccaaatcctaccccattcagtggcagagcagttaaaacggggagagactgtacaggctgaggcctttgacagtgttaccatctacttcagtgacattgttggcttcacagcattgtcagcagagagcacccccatgcaggtagtgacacttcttaatgacctgtatacctgctttgatgccataattgacaactttgatgtctacaaggtggagacgattggggatgcttacatggtggtatctggcctcccaggccgaaatggtcaacgccatgcaccagaaattgctcgtatggccctagcattactagatgcagtttcttcctttcgcatccgccaccgaccccatgaccagctgaggctacgcataggggtccatactgggccagtctgtgctggggttgttggcctgaagatgccccgttattgtctttttggagacacagtgaacactgcttctcgaatggagtctaatggtcaagcgctgaagatccatgtctcctctaccaccaaggatgccctagatgagctaggatgcttccagctagagcttcggggggatgtggaaatgaagggaaaaggaaagatgcgaacatactggctcttaggagagcggaaaggacctcctggactcctgtaaacccccattctttccaagtcagatagtcttctgctgctggtacctgggtgggcaatggccaccatgtctgcacacaccagaaatggacattttcatatgcaatggaaaacagccacaaaaaaacctaccttatatggaagttgtagccctctgcagctcagccctgtacatatacctgtccctctctggcttggtccccttcctccctactttctgtaaatatctgtatctaaaccagaatattttggtcaaatataaaacaataataaaaaaagttctgatgtcaaaatgtg

SEQ ID NO: 356389 - DNA, 904 bp, Homo sapiens
tccagcagagaaggatgattaatgatggtgtcaagcttgtctccctctactttttcccatccccatggatatagatagaggtgaccttttaatccccctctcaatcaggtggagacgattggggatgcttacatggtggtatctggcctcccaggccgaaatggtcaacgccatgcaccagaaattgctcgtatggccctagcattactagatgcagtttcttcctttcgcatccgccaccgaccccatgaccagctgaggctacgcataggggtccatactggtaaggctgactctcactccagccctagtctccacctttcccagactctcccaacctgtttcttctcaaagggccagtctgtgctggggttgttggcctgaagatgccccgttattgtctttttggagacacagtgaacactgcttctcgaatggagtctaatggtcaagcgctgaagatccatgtctcctctaccaccaaggatgccctagatgagctaggatgcttccagctagagcttcggggggatgtggaaatgaagggaaaaggaaagatgcgaacatactggctcttaggagagcggaaaggacctcctggactcctgtaaacccccattctttccaagtcagatagtcttctgctgctggtacctgggtgggcaatggccaccatgtctgcacacaccagaaatggacattttcatatgcaatggaaaacagccacaaaaaaacctaccttatatggaagttgtagccctctgcagctcagccctgtacatatacctgtccctctctggcttggtccccttcctccctactttctgtaaatatctgtatctaaaccagaatattttggtcaaatataaaacaataataaaaaaagttctgatgtcaaaatgtg

SEQ ID NO: 356390 - DNA, 4402 bp, Homo sapiens
cggccacataagatattatctacacaaaagcttatttaggaatgaccaatgagctcaacttaaatttattagaaatctgattagcattataaatcaactgacttttaggagcataggctttggcgctacagggatctggcttgaacctcattgaggccactgattggtgagtgaccttaagcaagtctctttaccttgttagggcacaatttcctctcggaattgtgaaatgggtttaattacaccagcttacatcccaaccatcagcaagtcctcttgtatgtaaccatctccaacacagaaaggggatctgcccatgttctaccatcctcacctttctccaagccactacaacctctcacaacagccttccaattggtctccctaaactcttatcccccctacaccccgttctcagtcctcagtccttgccctaggctggtagcccactccttgcccgccccccgccttcctcccatctccccctcctctccccggcccccagcaccttctgcatcccagcctacctagcctactcctcctcttcctggccctcttccccaggctccaggctggggggtgctcgcgtctcccctgtaggccagagcagccccaagttctgggggcggtggggctgctgctttatccccatggcgctgccatcacttctgctgttggtggcagccctggcaggtggggtgcgtcctcccggggcgcggaacctgacgctggcggtggtgctgccagaacacaacctgagctatgcctgggcctggccacgggtgggacccgctgtggcactagctgtggaggctctgggccgggcactgcccgtggacctgcggtttgtcagctccgaactggaaggcgcctgctctgagtacctggcaccgctgagcgctgtggacctcaagctgtaccatgaccccgacctgctgttaggtcccggttgcgtgtaccctgctgcctctgtggcccgctttgcctcccactggcgccttcccctgctgactgcgggtgctgtggcctctggtttttcggctaagaatgaccattatcgtaccctggttcgcactggcccctctgctcccaagctgggtgagtttgtggtgacactacacgggcacttcaattggactgcccgtgctgccttgctgtacctggatgctcgcacagatgaccggcctcactacttcaccatcgagggcgtctttgaggccctgcagggcagcaacctcagtgtgcagcaccaggtgtatgcccgagagccagggggccccgagcaggccacccacttcatccgggccaacgggcgcattgtgtatatctgcggccctctggagatgctgcatgagatcctgcttcaggcccagagggagaatctgaccaatggggattatgtcttcttttacctggatgtctttggggagagtctccgtgcaggccccacacgtgctacaggccggccctggcaggacaatcgcacccgggaacaggcccaggccctcagagaggcctttcagactgtattggtgatcacgtaccgagaacccccaaatcctgagtatcaggaattccagaatcgtctgctgataagagcccgggaagactttggtgtggagctgggcccttccctgatgaacctcatcgctggctgcttctatgatgggatcctgctatatgctgaagtcctgaatgagacaatacaggaaggaggcacccgggaggatggacttcgaattgtggaaaagatgcagggacgaagatatcacggtgtaactgggctggttgtcatggacaagaacaatgaccgagagactgactttgtcctctgggccatgggagacctggattctggggactttcagcctgcagcccactactcgggagctgagaagcagatttggtggacgggacggcctattccctgggtgaagggggctcctccctcggacaatcccccctgtgcctttgacttggacgacccatcctgtgataaaactccactttcaaccctggcaattgtggctctgggcacaggaatcaccttcatcatgtttggtgtttccagcttcctaattttccgaaagctgatgctggagaaggagctggctagcatgttgtggcgtattcgctgggaagaactgcagtttggcaactcagagcgttatcacaaaggtgcaggcagtcgcctcacactgtcgctgcggggatccagttacggctcgctcatgacagcccatgggaaataccagatctttgccaacaccggtcacttcaagggaaatgttgtcgccatcaaacatgtgaataagaagcgcattgagctgacccggcaggttctgtttgaactcaaacatatgagagatgttcagttcaaccatctcactcgcttcattggcgcctgcatagaccctcccaacatttgcattgtcactgaatactgtcctcgtgggagtttacaggatattctagaaaatgacagcatcaacttggactggatgtttcgttattcactcattaatgaccttgttaagggcatggcctttctccacaacagcattatttcatcgcatgggagtctcaagtcctccaactgtgtggtggatagtcgttttgtgctcaaaatcacagactatggcctggccagcttccgatcaactgctgaacctgatgacagccatgccctctatgccaagaagctgtggactgccccagaactgctcagtgggaaccccttgccaaccacaggcatgcagaaggctgacgtctatagctttgggatcatcctgcaggagatagcacttcgcagtggtcctttctacttggagggcctggacctcagccccaaagagattgtccagaaggtacgaaatggtcagcggccatatttccggccaagcattgaccggacccaactgaatgaagagctagttttgctgatggagcgatgttgggctcaggacccagctgagcggccagactttggacagattaagggcttcattcggcgctttaacaaggagggtggcaccagcatattggacaacctcctgctgcgcatggaacagtatgccaataacttggagaagctggtggaggaacgcacacaggcctatctggaggaaaaacgcaaggctgaagctctgctctaccaaatcctaccccattcagtggcagagcagttaaaacggggagagactgtacaggctgaggcctttgacagtgttaccatctacttcagtgacattgttggcttcacagcattgtcagcagagagcacccccatgcaggtagtgacacttcttaatgacctgtatacctgctttgatgccataattgacaactttgatgtctacaaggtggagacgattggggatgcttacatggtggtatctggcctcccaggccgaaatggtcaacgccatgcaccagaaattgctcgtatggccctagcattactagatgcagtttcttcctttcgcatccgccaccgaccccatgaccagctgaggctacgcataggggtccatactggtaaggctgactctcactccagccctagtctccacctttcccagactctcccaacctgtttcttctcaaagggccagtctgtgctggggttgttggcctgaagatgccccgttattgtctttttggagacacagtgaacactgcttctcgaatggagtctaatggtcaaggtaagacattagccctcaaccccactgttggcctcaatttatcttgcccttttcttcttttcataatccctccaatttcttaatctgagagaccacagttccttagtgtcgcatcctcgggcatattttggttctaatagatatgcattgggaggttgggcatattttggtcctaatagatatgcattgggagcttcccagggatggttggtcgggcacggtgctatacagtatcaccaattatttgattgccttttctttgattcctcattccaccatcctccccattccacccaccccagcgctgaagatccatgtctcctctaccaccaaggatgccctagatgagctaggatgcttccagctagagcttcggggggatgtggaaatgaagggaaaaggaaagatgcgaacatactggctcttaggagagcggaaaggacctcctggactcctgtaaacccccattctttccaagtcagatagtcttctgctgctggtacctgggtgggcaatggccaccatgtctgcacacaccagaaatggacattttcatatgcaatggaaaacagccacactgtccctctctggcttggtccccttcctccctactttctgtaaatatctgtatctaaaccagaatattttggtcaaatataaaacaataataaaaaaagttctgatgtcaaaatgtg

SEQ ID NO: 356391 - DNA, 4087 bp, Homo sapiens
cggccacataagatattatctacacaaaagcttatttaggaatgaccaatgagctcaacttaaatttattagaaatctgattagcattataaatcaactgacttttaggagcataggctttggcgctacagggatctggcttgaacctcattgaggccactgattggtgagtgaccttaagcaagtctctttaccttgttagggcacaatttcctctcggaattgtgaaatgggtttaattacaccagcttacatcccaaccatcagcaagtcctcttgtatgtaaccatctccaacacagaaaggggatctgcccatgttctaccatcctcacctttctccaagccactacaacctctcacaacagccttccaattggtctccctaaactcttatcccccctacaccccgttctcagtcctcagtccttgccctaggctggtagcccactccttgcccgccccccgccttcctcccatctccccctcctctccccggcccccagcaccttctgcatcccagcctacctagcctactcctcctcttcctggccctcttccccaggctccaggctggggggtgctcgcgtctcccctgtaggccagagcagccccaagttctgggggcggtggggctgctgctttatccccatggcgctgccatcacttctgctgttggtggcagccctggcaggtggggtgcgtcctcccggggcgcggaacctgacgctggcggtggtgctgccagaacacaacctgagctatgcctgggcctggccacgggtgggacccgctgtggcactagctgtggaggctctgggccgggcactgcccgtggacctgcggtttgtcagctccgaactggaaggcgcctgctctgagtacctggcaccgctgagcgctgtggacctcaagctgtaccatgaccccgacctgctgttaggtcccggttgcgtgtaccctgctgcctctgtggcccgctttgcctcccactggcgccttcccctgctgactgcgggtgctgtggcctctggtttttcggctaagaatgaccattatcgtaccctggttcgcactggcccctctgctcccaagctgggtgagtttgtggtgacactacacgggcacttcaattggactgcccgtgctgccttgctgtacctggatgctcgcacagatgaccggcctcactacttcaccatcgagggcgtctttgaggccctgcagggcagcaacctcagtgtgcagcaccaggtgtatgcccgagagccagggggccccgagcaggccacccacttcatccgggccaacgggcgcattgtgtatatctgcggccctctggagatgctgcatgagatcctgcttcaggcccagagggagaatctgaccaatggggattatgtcttcttttacctggatgtctttggggagagtctccgtgcaggccccacacgtgctacaggccggccctggcaggacaatcgcacccgggaacaggcccaggccctcagagaggcctttcagactgtattggtgatcacgtaccgagaacccccaaatcctgagtatcaggaattccagaatcgtctgctgataagagcccgggaagactttggtgtggagctgggcccttccctgatgaacctcatcgctggctgcttctatgatgggatcctgctatatgctgaagtcctgaatgagacaatacaggaaggaggcacccgggaggatggacttcgaattgtggaaaagatgcagggacgaagatatcacggtgtaactgggctggttgtcatggacaagaacaatgaccgagagactgactttgtcctctgggccatgggagacctggattctggggactttcagcctgcagcccactactcgggagctgagaagcagatttggtggacgggacggcctattccctgggtgaagggggctcctccctcggacaatcccccctgtgcctttgacttggacgacccatcctgtgataaaactccactttcaaccctggcaattgtggctctgggcacaggaatcaccttcatcatgtttggtgtttccagcttcctaattttccgaaagctgatgctggagaaggagctggctagcatgttgtggcgtattcgctgggaagaactgcagtttggcaactcagagcgttatcacaaaggtgcaggcagtcgcctcacactgtcgctgcggggatccagttacggctcgctcatgacagcccatgggaaataccagatctttgccaacaccggtcacttcaagggaaatgttgtcgccatcaaacatgtgaataagaagcgcattgagctgacccggcaggttctgtttgaactcaaacatatgagagatgttcagttcaaccatctcactcgcttcattggcgcctgcatagaccctcccaacatttgcattgtcactgaatactgtcctcgtgggagtttacaggatattctagaaaatgacagcatcaacttggactggatgtttcgttattcactcattaatgaccttgttaagggcatggcctttctccacaacagcattatttcatcgcatgggagtctcaagtcctccaactgtgtggtggatagtcgttttgtgctcaaaatcacagactatggcctggccagcttccgatcaactgctgaacctgatgacagccatgccctctatgccaagaagctgtggactgccccagaactgctcagtgggaaccccttgccaaccacaggcatgcagaaggctgacgtctatagctttgggatcatcctgcaggagatagcacttcgcagtggtcctttctacttggagggcctggacctcagccccaaagagattgtccagaaggtacgaaatggtcagcggccatatttccggccaagcattgaccggacccaactgaatgaagagctagttttgctgatggagcgatgttgggctcaggacccagctgagcggccagactttggacagattaagggcttcattcggcgctttaacaaggagggtggcaccagcatattggacaacctcctgctgcgcatggaacagtatgccaataacttggagaagctggtggaggaacgcacacaggcctatctggaggaaaaacgcaaggctgaagctctgctctaccaaatcctaccccattcagtggcagagcagttaaaacggggagagactgtacaggctgaggcctttgacagtgttaccatctacttcagtgacattgttggcttcacagcattgtcagcagagagcacccccatgcaggtagtgacacttcttaatgacctgtatacctgctttgatgccataattgacaactttgatgtctacaaggtggagacgattggggatgcttacatggtggtatctggcctcccaggccgaaatggtcaacgccatgcaccagaaattgctcgtatggccctagcattactagatgcagtttcttcctttcgcatccgccaccgaccccatgaccagctgaggctacgcataggggtccatactgggccagtctgtgctggggttgttggcctgaagatgccccgttattgtctttttggagacacagtgaacactgcttctcgaatggagtctaatggtcaagcgctgaagatccatgtctcctctaccaccaaggatgccctagatgagctaggatgcttccagctagagcttcggggggatgtggaaatgaagggaaaaggaaagatgcgaacatactggctcttaggagagcggaaaggacctcctggactcctgtaaacccccattctttccaagtcagatagtcttctgctgctggtacctgggtgggcaatggccaccatgtctgcacacaccagaaatggacattttcatatgcaatggaaaacagccacaaaaaaacctaccttatatggaagttgtagccctctgcagctcagccctgtacatatacctgtccctctctggcttggtccccttcctccctactttctgtaaatatctgtatctaaaccagaatattttggtcaaatataaaacaataataaaaaaagttctgatgtcaaaatgtg

SEQ ID NO: 356392 - DNA, 4460 bp, Homo sapiens
cggccacataagatattatctacacaaaagcttatttaggaatgaccaatgagctcaacttaaatttattagaaatctgattagcattataaatcaactgacttttaggagcataggctttggcgctacagggatctggcttgaacctcattgaggccactgattggtgagtgaccttaagcaagtctctttaccttgttagggcacaatttcctctcggaattgtgaaatgggtttaattacaccagcttacatcccaaccatcagcaagtcctcttgtatgtaaccatctccaacacagaaaggggatctgcccatgttctaccatcctcacctttctccaagccactacaacctctcacaacagccttccaattggtctccctaaactcttatcccccctacaccccgttctcagtcctcagtccttgccctaggctggtagcccactccttgcccgccccccgccttcctcccatctccccctcctctccccggcccccagcaccttctgcatcccagcctacctagcctactcctcctcttcctggccctcttccccaggctccaggctggggggtgctcgcgtctcccctgtaggccagagcagccccaagttctgggggcggtggggctgctgctttatccccatggcgctgccatcacttctgctgttggtggcagccctggcaggtggggtgcgtcctcccggggcgcggaacctgacgctggcggtggtgctgccagaacacaacctgagctatgcctgggcctggccacgggtgggacccgctgtggcactagctgtggaggctctgggccgggcactgcccgtggacctgcggtttgtcagctccgaactggaaggcgcctgctctgagtacctggcaccgctgagcgctgtggacctcaagctgtaccatgaccccgacctgctgttaggtcccggttgcgtgtaccctgctgcctctgtggcccgctttgcctcccactggcgccttcccctgctgactgcgggtgctgtggcctctggtttttcggctaagaatgaccattatcgtaccctggttcgcactggcccctctgctcccaagctgggtgagtttgtggtgacactacacgggcacttcaattggactgcccgtgctgccttgctgtacctggatgctcgcacagatgaccggcctcactacttcaccatcgagggcgtctttgaggccctgcagggcagcaacctcagtgtgcagcaccaggtgtatgcccgagagccagggggccccgagcaggccacccacttcatccgggccaacgggcgcattgtgtatatctgcggccctctggagatgctgcatgagatcctgcttcaggcccagagggagaatctgaccaatggggattatgtcttcttttacctggatgtctttggggagagtctccgtgcaggccccacacgtgctacaggccggccctggcaggacaatcgcacccgggaacaggcccaggccctcagagaggcctttcagactgtattggtgatcacgtaccgagaacccccaaatcctgagtatcaggaattccagaatcgtctgctgataagagcccgggaagactttggtgtggagctgggcccttccctgatgaacctcatcgctggctgcttctatgatgggatcctgctatatgctgaagtcctgaatgagacaatacaggaaggaggcacccgggaggatggacttcgaattgtggaaaagatgcagggacgaagatatcacggtgtaactgggctggttgtcatggacaagaacaatgaccgagagactgactttgtcctctgggccatgggagacctggattctggggactttcagcctgcagcccactactcgggagctgagaagcagatttggtggacgggacggcctattccctgggtgaagggggctcctccctcggacaatcccccctgtgcctttgacttggacgacccatcctgtgataaaactccactttcaaccctggcaattgtggctctgggcacaggaatcaccttcatcatgtttggtgtttccagcttcctaattttccgaaagctgatgctggagaaggagctggctagcatgttgtggcgtattcgctgggaagaactgcagtttggcaactcagagcgttatcacaaaggtgcaggcagtcgcctcacactgtcgctgcggggatccagttacggctcgctcatgacagcccatgggaaataccagatctttgccaacaccggtcacttcaagggaaatgttgtcgccatcaaacatgtgaataagaagcgcattgagctgacccggcaggttctgtttgaactcaaacatatgagagatgttcagttcaaccatctcactcgcttcattggcgcctgcatagaccctcccaacatttgcattgtcactgaatactgtcctcgtgggagtttacaggatattctagaaaatgacagcatcaacttggactggatgtttcgttattcactcattaatgaccttgttaagggcatggcctttctccacaacagcattatttcatcgcatgggagtctcaagtcctccaactgtgtggtggatagtcgttttgtgctcaaaatcacagactatggcctggccagcttccgatcaactgctgaacctgatgacagccatgccctctatgccaagaagctgtggactgccccagaactgctcagtgggaaccccttgccaaccacaggcatgcagaaggctgacgtctatagctttgggatcatcctgcaggagatagcacttcgcagtggtcctttctacttggagggcctggacctcagccccaaagagattgtccagaaggtacgaaatggtcagcggccatatttccggccaagcattgaccggacccaactgaatgaagagctagttttgctgatggagcgatgttgggctcaggacccagctgagcggccagactttggacagattaagggcttcattcggcgctttaacaaggagggtggcaccagcatattggacaacctcctgctgcgcatggaacagtatgccaataacttggagaagctggtggaggaacgcacacaggcctatctggaggaaaaacgcaaggctgaagctctgctctaccaaatcctaccccattcagtggcagagcagttaaaacggggagagactgtacaggctgaggcctttgacagtgttaccatctacttcagtgacattgttggcttcacagcattgtcagcagagagcacccccatgcaggtagtgacacttcttaatgacctgtatacctgctttgatgccataattgacaactttgatgtctacaaggtggagacgattggggatgcttacatggtggtatctggcctcccaggccgaaatggtcaacgccatgcaccagaaattgctcgtatggccctagcattactagatgcagtttcttcctttcgcatccgccaccgaccccatgaccagctgaggctacgcataggggtccatactggtaaggctgactctcactccagccctagtctccacctttcccagactctcccaacctgtttcttctcaaagggccagtctgtgctggggttgttggcctgaagatgccccgttattgtctttttggagacacagtgaacactgcttctcgaatggagtctaatggtcaaggtaagacattagccctcaaccccactgttggcctcaatttatcttgcccttttcttcttttcataatccctccaatttcttaatctgagagaccacagttccttagtgtcgcatcctcgggcatattttggttctaatagatatgcattgggaggttgggcatattttggtcctaatagatatgcattgggagcttcccagggatggttggtcgggcacggtgctatacagtatcaccaattatttgattgccttttctttgattcctcattccaccatcctccccattccacccaccccagcgctgaagatccatgtctcctctaccaccaaggatgccctagatgagctaggatgcttccagctagagcttcggggggatgtggaaatgaagggaaaaggaaagatgcgaacatactggctcttaggagagcggaaaggacctcctggactcctgtaaacccccattctttccaagtcagatagtcttctgctgctggtacctgggtgggcaatggccaccatgtctgcacacaccagaaatggacattttcatatgcaatggaaaacagccacaaaaaaacctaccttatatggaagttgtagccctctgcagctcagccctgtacatatacctgtccctctctggcttggtccccttcctccctactttctgtaaatatctgtatctaaaccagaatattttggtcaaatataaaacaataataaaaaaagttctgatgtcaaaatgtg

SEQ ID NO: 356393 - DNA, 3449 bp, Homo sapiens
cggccacataagatattatctacacaaaagcttatttaggaatgaccaatgagctcaacttaaatttattagaaatctgattagcattataaatcaactgacttttaggagcataggctttggcgctacagggatctggcttgaacctcattgaggccactgattggtgagtgaccttaagcaagtctctttaccttgttagggcacaatttcctctcggaattgtgaaatgggtttaattacaccagcttacatcccaaccatcagcaagtcctcttgtatgtaaccatctccaacacagaaaggggatctgcccatgttctaccatcctcacctttctccaagccactacaacctctcacaacagccttccaattggtctccctaaactcttatcccccctacaccccgttctcagtcctcagtccttgccctaggctggtagcccactccttgcccgccccccgccttcctcccatctccccctcctctccccggcccccagcaccttctgcatcccagcctacctagcctactcctcctcttcctggccctcttccccaggctccaggctggggggtgctcgcgtctcccctgtaggccagagcagccccaagttctgggggcggtggggctgctgctttatccccatggcgctgccatcacttctgctgttggtggcagccctggcaggtggggtgcgtcctcccggggcgcggaacctgacgctggcggtggtgctgccagaacacaacctgagctatgcctgggcctggccacgggtgggacccgctgtggcactagctgtggaggctctgggccgggcactgcccgtggacctgcggtttgtcagctccgaactggaaggcgcctgctctgagtacctggcaccgctgagcgctgtggacctcaagctgtaccatgaccccgacctgctgttaggtcccggttgcgtgtaccctgctgcctctgtggcccgctttgcctcccactggcgccttcccctgctgactgcgggtgctgtggcctctggtttttcggctaagaatgaccattatcgtaccctggttcgcactggcccctctgctcccaagctgggtgagtttgtggtgacactacacgggcacttcaattggactgcccgtgctgccttgctgtacctggatgctcgcacagatgaccggcctcactacttcaccatcgagggcgtctttgaggccctgcagggcagcaacctcagtgtgcagcaccaggtgtatgcccgagagccagggggccccgagcaggccacccacttcatccgggccaacgggcgcattgtgtatatctgcggccctctggagatgctgcatgagatcctgcttcaggcccagagggagaatctgaccaatggggattatgtcttcttttacctggatgtctttggggagagtctccgtgcaggccccacacgtgctacaggccggccctggcaggacaatcgcacccgggaacaggcccaggccctcagagaggcctttcagactgtattggtgatcacgtaccgagaacccccaaatcctgagtatcaggaattccagaatcgtctgctgataagagcccgggaagactttggtgtggagctgggcccttccctgatgaacctcatcgctggctgcttctatgatgggatcctgctatatgctgaagtcctgaatgagacaatacaggaaggaggcacccgggaggatggacttcgaattgtggaaaagatgcagggacgaagatatcacggtgtaactgggctggttgtcatggacaagaacaatgaccgagagactgactttgtcctctgggccatgggagacctggattctggggactttcagcctgcagcccactactcgggagctgagaagcagatttggtggacgggacggcctattccctgggtgaagggggctcctccctcggacaatcccccctgtgcctttgacttggacgacccatcctgtgataaaactccactttcaaccctggcaattgtggctctgggcacaggaatcaccttcatcatgtttggtgtttccagcttcctaattttccgaaagctgatgctggagaaggagctggctagcatgttgtggcgtattcgctgggaagaactgcagtttggcaactcagagcgttatcacaaaggtgcaggcagtcgcctcacactgtcgctgcggggatccagttacggctcgctcatgacagcccatgggaaataccagatctttgccaacaccggtcacttcaagggaaatgttgtcgccatcaaacatgtgaataagaagcgcattgagctgacccggcaggttctgtttgaactcaaacatatgagagatgttcagttcaaccatctcactcgcttcattggcgcctgcatagaccctcccaacatttgcattgtcactgaatactgtcctcgtgggagtttacaggatattctagaaaatgacagcatcaacttggactggatgtttcgttattcactcattaatgaccttgttaagggcatggcctttctccacaacagcattatttcatcgcatgggagtctcaagtcctccaactgtgtggtggatagtcgttttgtgctcaaaatcacagactatggcctggccagcttccgatcaactgctgaacctgatgacagccatgccctctatgccaagaagctgtggactgccccagaactgctcagtgggaaccccttgccaaccacaggcatgcagaaggctgacgtctatagctttgggatcatcctgcaggagatagcacttcgcagtggtcctttctacttggagggcctggacctcagccccaaagagattgtccagaaggtacgaaatggtcagcggccatatttccggccaagcattgaccggacccaactgaatgaagagctagttttgctgatggagcgatgttgggctcaggacccagctgagcggccagactttggacagattaagggcttcattcggcgctttaacaaggagggtggcaccagcatattggacaacctcctgctgcgcatggaacagtatgccaataacttggagaagctggtggaggaacgcacacaggcctatctggaggaaaaacgcaaggctgaagctctgctctaccaaatcctaccccattcagtggcagagcagttaaaacggggagagactgtacaggctgaggcctttgacagtgttaccatctacttcagtgacattgttggcttcacagcattgtcagcagagagcacccccatgcaggtagtgacacttcttaatgacctgtatacctgctttgatgccataattgacaactttgatgtctacaagctactttctgtaaatatctgtatctaaaccagaatattttggtcaaatataaaacaataataaaaaaagttctgatgtcaaaatgtg

SEQ ID NO: 356394 - DNA, 247 bp, Homo sapiens
caatattatagtagagtggttaagtgaattggaggtagaaaatgaagtcagcaaaatattataatagactggttaaagtagattcctggctctctcactctgtgctgaagtttccttatctataataaaatagggataatagtacttactttgtaagagtattgattaggtgaatacaatgaaaatatgaaaatgcttaaaacagtacctggcagatataaatttaaaaaaaaatcattgacttctt

SEQ ID NO: 356395 - DNA, 346 bp, Homo sapiens
tatggggcaagtggttcatatagttaagtgattgtatatatatatatatatatatgtattccagtgtagaaagtattggctgggtctgtaatcaagtattccacagaagtgccttcataggtgctgaaacaggattatgagagtgacagacacaggactgaagacagggagaaaatgtgcatggctgtgagaatatattgctttgattctttgacttctcatgatatatgaaaacaaataaagtgggggggggtgacttcaataatatcacgaacatatttaaaatgaaattctgagcatggagaaaaatttcaaattctggtacaaacaaatattctaaaaatat

SEQ ID NO: 356396 - DNA, 5112 bp, Homo sapiens
tgaaatatggagaatagtcttagatgtgtttgggtacccaagctggcttttgtactcttcggagcttccttgctcagcgcgcatcttcaagtaaccggttttcaaattaaagctttcacagcactgcgcttcctctcagaaccttctgatgccgtcacaatgcggggaggaaatgtcctcctcgactgctccgcggagtccgaccgaggagttccagtgatcaagtggaagaaagatggcattcatctggccttgggaatggatgaaaggaagcagcaactttcaaatgggtctctgctgatacaaaacatacttcattccagacaccacaagccagatgagggactttaccaatgtgaggcatctttaggagattctggctcaattattagtcggacagcaaaagttgcagtagcaggaccactgaggttcctttcacagacagaatctgtcacagccttcatgggagacacagtgctactcaagtgtgaagtcattggggagcccatgccaacaatccactggcagaagaaccaacaagacctgactccaatcccaggtgactcccgagtggtggtcttgccctctggagcattgcagatcagccgactccaaccgggggacattggaatttaccgatgctcagctcgaaatccagccagctcaagaacaggaaatgaagcagaagtcagaattttatcagatccaggactgcatagacagctgtattttctgcaaagaccatccaatgtagtagccattgaaggaaaagatgctgtcctggaatgttgtgtttctggctatcctccaccaagttttacctggttacgaggcgaggaagtcatccaactcaggtctaaaaagtattctttattgggtggaagcaacttgcttatctccaatgtgacagatgatgacagtggaatgtatacctgtgttgtcacatataaaaatgagaatattagtgcctctgcagagctcacagtcttggttccgccatggtttttaaatcatccttccaacctgtatgcctatgaaagcatggatattgagtttgaatgtacagtctctggaaagcctgtgcccactgtgaattggatgaagaatggagatgtggtcattcctagtgattattttcagatagtgggaggaagcaacttacggatacttggggtggtgaagtcagatgaaggcttttatcaatgtgtggctgaaaatgaggctggaaatgcccagaccagtgcacagctcattgtccctaagcctgcaatcccaagctccagtgtcctcccttcggctcccagagatgtggtccctgtcttggtttccagccgatttgtccgtctcagctggcgcccacctgcagaagcgaaagggaacattcaaactttcacggtctttttctccagagaaggtgacaacagggaacgagcattgaatacaacacagcctgggtcccttcagctcactgtgggaaacctgaagccagaagccatgtacacctttcgagttgtggcttacaatgaatggggaccgggagagagttctcaacccatcaaggtggccacacagcctgagttgcaagttccagggccagtagaaaacctgcaagctgtatctacctcacctacctcaattcttattacctgggaaccccctgcctatgcaaacggtccagtccaaggttacagattgttctgcactgaggtgtccacaggaaaagaacagaatatagaggttgatggactatcttataaactggaaggcctgaaaaaattcaccgaatatagtcttcgattcttagcttataatcgctatggtccgggcgtctctactgatgatataacagtggttacactttctgacgtgccaagtgccccgcctcagaacgtctccctggaagtggtcaattcaagaagtatcaaagttagctggctgcctcctccatcaggaacacaaaatggatttattaccggctataaaattcgacacagaaagacgacccgcaggggtgagatggaaacactggagccaaacaacctctggtacctattcacaggactggagaaaggaagtcagtacagtttccaggtgtcagccatgacagtcaatggtactggaccaccttccaactggtatactgcagagactccagagaatgatctagatgaatctcaagttcctgatcaaccaagctctcttcatgtgaggccccagactaactgcatcatcatgagttggactcctcccttgaacccaaacatcgtggtgcgaggttatattatcggttatggcgttgggagcccttacgctgagacagtgcgtgtggacagcaagcagcgatattattccattgagaggttagagtcaagttcccattatgtaatctccctaaaagcttttaacaatgccggagaaggagttcctctttatgaaagtgccaccaccaggtctataaccgatcccactgacccagttgattattatcctttgcttgatgatttccccacctcggtcccagatctctccacccccatgctcccaccagtaggtgtacaggctgtggctcttacccatgatgctgtgagggtcagctgggcagacaactctgtccctaagaaccaaaagacgtctgaggtgcgactttacaccgtccggtggagaaccagcttttctgcaagtgcaaaatacaagtcagaagacacaacatctctaagttacacagcaacaggcctcaaaccaaacacaatgtatgaattctcggtcatggtaacaaaaaacagaaggtccagtacttggagcatgactgcacatgccaccacgtatgaagcagcccccacctctgctcccaaggacttgacagtcattactagggaagggaagcctcgtgccgtcattgtgagttggcagcctcccttggaagccaatgggaaaattactgcttacatcttattttataccttggacaagaacatcccaattgatgactggattatggaaacaatcagtggtgataggcttactcatcaaatcatggatctcaaccttgatactatgtattactttcgaattcaagcacgaaattcaaaaggagtggggccactctctgatcctatcctcttcaggactctgaaagtggaacaccctgacaaaatggctaatgaccaaggtcgtcatggagatggaggttattggccagttgatactaatttgattgatagaagcaccctaaatgagccgccaattggacaaatgcaccccccgcatggcagtgtcactcctcagaagaacagcaacctgcttgtgatcattgtggtcaccgttggtgtcatcacagtgctggtagtggtcatcgtggctgtgatttgcacccgacgctcttcagcccagcagagaaagaaacgggccacccacagtgctggcaaaaggaagggcagccagaaggacctccgaccccctgatctttggatccatcatgaagaaatggagatgaaaaatattgaaaagccatctggcactgaccctgcaggaagggactctcccatccaaagttgccaagacctcacaccagtcagccacagccagtcagaaacccaactgggaagcaaaagcacctctcattcaggtcaagacactgaggaagcagggagctctatgtccactctggagaggtcgctggctgcacgccgagccccccgggccaagctcatgattcccatggatgcccagtccaacaatcctgctgtcgtgagcgccatcccggtgccaacgctagaaagtgcccagtacccaggaatcctcccgtctcccacctgtggatatccccacccgcagttcactctccggcctgtgccattcccaacactctcagtggaccgaggtttcggagcaggaagaagtcagtcagtgagtgaaggaccaactacccaacaaccacctatgctgcccccatctcagcctgagcattctagcagcgaggaggcaccaagcagaaccatccccacagcttgtgttcgaccaactcacccactccgcagctttgctaatcctttgctacctccaccaatgagtgcaatagaaccgaaagtcccttacacaccacttttgtctcagccagggcccactcttcctaagacccatgtgaaaacagcctcccttgggttggctggaaaagcaagatcccctttgcttcctgtgtctgtgccaacagcccctgaagtgtctgaggagagccacaaaccaacagaggattcagccaatgtgtatgaacaggatgatctgagtgaacaaatggcaagtttggaaggactcatgaagcagcttaatgccatcacaggctcagccttttaacatgtatttctgaatggatgaggtgaattttccgggaactttgcagcataccaattacccataaacagcacacctgtgtccaagaactctaaccagtgtacaggtcacccatcaggaccactcagttaaggaagatcctgaagcagttcagaaggaataagcattccttctttcacaggcatcaggaattgtcaaatgatgattatgagttccctaaacaaaagcaaagatgcattttcactgcaatgtcaaagtttaagctgctagaatagtcatgggcctttgtcactgcagtgaccacactgtcataactaatacctatgttttcctttgtcaaggcctgttgtttaatgtgtaggtctagtcttacaaaatgcaagtgcattatttaagcctgtaccatgccatggcaaaccagtgcaagctcactattttgttttcaacttaaacatacaaagcacccatgggaatctctcatgccatagcaccaaaggattggatgttttccttacagcacaaaaagtaaatagtaaacaaacaaaaggcagagaatgcttatgtttgtaactcagtcattcatcttgcacaagtggtggatattagtgagtggctaaaaattcacctattttggcaagtatttgtaaatccacccttggttaatatgtatgtctggagtccaggaatataaaaatctgcaactagtggcattctgccagcagcagtacatttctggaaagaggatataatatgcaatcttctcag

SEQ ID NO: 356397 - DNA, 571 bp, Homo sapiens
tctaactctccagtcaacgaaaacattcctctctcagctgctctggtgggtcatccaggctcacagtgaatgttcccggcaagaaagtgccttcctgctttccaaagaagtccttttcaaggtggcggagcactgaatagtacagaattcatcagtatattgagttcagatcctatctataacttaggtacttttgttttcctgttttaaagataacattaagaacctgctgttttttcctctatagaatctggcatttacagcactttctcatcgatcacaccactgagtgttaccattcctattttacagagggaaatgtgaggctgagaaagtttggacaacatagccatggcagtttataactcaaagtatatggatggatgacactcgctagagagttgcaacagccgatgcagctgtccccaggccccaaactcacttatatttcctgaaacaccaggaaaagcatcttttatttttatatgagagccctaagagattattttcatcttattcaaaaatgaaaagattttatttaattaaaaaatctatttctattatcttaaaa

SEQ ID NO: 356398 - DNA, 3280 bp, Homo sapiens
tgaaatatggagaatagtcttagatgtgtttgggtacccaagctggcttttgtactcttcggagcttccttgctcagcgcgcatcttcaagtaaccggttttcaaattaaagctttcacagcactgcgcttcctctcagaaccttctgatgccgtcacaatgcggggaggaaatgtcctcctcgactgctccgcggagtccgaccgaggagttccagtgatcaagtggaagaaagatggcattcatctggccttgggaatggatgaaaggaagcagcaactttcaaatgggtctctgctgatacaaaacatacttcattccagacaccacaagccagatgagggactttaccaatgtgaggcatctttaggagattctggctcaattattagtcggacagcaaaagttgcagtagcaggaccactgaggttcctttcacagacagaatctgtcacagccttcatgggagacacagtgctactcaagtgtgaagtcattggggagcccatgccaacaatccactggcagaagaaccaacaagacctgactccaatcccaggtgactcccgagtggtggtcttgccctctggagcattgcagatcagccgactccaaccgggggacattggaatttaccgatgctcagctcgaaatccagccagctcaagaacaggaaatgaagcagaagtcagaattttatcagatccaggactgcatagacagctgtattttctgcaaagaccatccaatgtagtagccattgaaggaaaagatgctgtcctggaatgttgtgtttctggctatcctccaccaagttttacctggttacgaggcgaggaagtcatccaactcaggtctaaaaagtattctttattgggtggaagcaacttgcttatctccaatgtgacagatgatgacagtggaatgtatacctgtgttgtcacatataaaaatgagaatattagtgcctctgcagagctcacagtcttggttccgccatggtttttaaatcatccttccaacctgtatgcctatgaaagcatggatattgagtttgaatgtacagtctctggaaagcctgtgcccactgtgaattggatgaagaatggagatgtggtcattcctagtgattattttcagatagtgggaggaagcaacttacggatacttggggtggtgaagtcagatgaaggcttttatcaatgtgtggctgaaaatgaggctggaaatgcccagaccagtgcacagctcattgtccctaagcctgcaatcccaagctccagtgtcctcccttcggctcccagagatgtggtccctgtcttggtttccagccgatttgtccgtctcagctggcgcccacctgcagaagcgaaagggaacattcaaactttcacggtctttttctccagagaaggtgacaacagggaacgagcattgaatacaacacagcctgggtcccttcagctcactgtgggaaacctgaagccagaagccatgtacacctttcgagttgtggcttacaatgaatggggaccgggagagagttctcaacccatcaaggtggccacacagcctgagttgcaagttccagggccagtagaaaacctgcaagctgtatctacctcacctacctcaattcttattacctgggaaccccctgcctatgcaaacggtccagtccaaggttacagattgttctgcactgaggtgtccacaggaaaagaacagaatatagaggttgatggactatcttataaactggaaggcctgaaaaaattcaccgaatatagtcttcgattcttagcttataatcgctatggtccgggcgtctctactgatgatataacagtggttacactttctgacgtgccaagtgccccgcctcagaacgtctccctggaagtggtcaattcaagaagtatcaaagttagctggctgcctcctccatcaggaacacaaaatggatttattaccggctataaaattcgacacagaaagacgacccgcaggggtgagatggaaacactggagccaaacaacctctggtacctattcacaggactggagaaaggaagtcagtacagtttccaggtgtcagccatgacagtcaatggtactggaccaccttccaactggtatactgcagagactccagagaatgatctagatgaatctcaagttcctgatcaaccaagctctcttcatgtgaggccccagactaactgcatcatcatgagttggactcctcccttgaacccaaacatcgtggtgcgaggttatattatcggttatggcgttgggagcccttacgctgagacagtgcgtgtggacagcaagcagcgatattattccattgagaggttagagtcaagttcccattatgtaatctccctaaaagcttttaacaatgccggagaaggagttcctctttatgaaagtgccaccaccaggtctataaccgatctctccacccccatgctcccaccagtaggtgtacaggctgtggctcttacccatgatgctgtgagggtcagctgggcagacaactctgtccctaagaaccaaaagacgtctgaggtgcgactttacaccgtccggtggagaaccagcttttctgcaagtgcaaaatacaagtcagaagacacaacatctctaagttacacagcaacaggcctcaaaccaaacacaatgtatgaattctcggtcatggtaacaaaaaacagaaggtccagtacttggagcatgactgcacatgccaccacgtatgaagcagcccccacctctgctcccaaggacttgacagtcattactagggaagggaagcctcgtgccgtcattgtgagttggcagcctcccttggaagccaatgggaaaattactgcttacatcttattttataccttggacaagaacatcccaattgatgactggattatggaaacaatcagtggtgataggcttactcatcaaatcatggatctcaaccttgatactatgtattactttcgaattcaagcacgaaattcaaaaggagtggggccactctctgatcctatcctcttcaggactctgaaagtggaacaccctgacaaaatggctaatgaccaagacactggcgtgacgattaatcttgttaatgaagttctgcttggctgaggctgcggctctgataaggaagatgtaaattttcttgagaggaaattgttttgtctccattctgaaggaccaattaaaatgtcaagcttctttgtatgaaataaatttttagtctctgtctgca

SEQ ID NO: 356399 - DNA, 5009 bp, Homo sapiens
tgtcttcccctccccccccccccattcccttcgctgtccccttccgcccccttggttttcaaattaaagctttcacagcactgcgcttcctctcagaaccttctgatgccgtcacaatgcggggaggaaatgtcctcctcgactgctccgcggagtccgaccgaggagttccagtgatcaagtggaagaaagatggcattcatctggccttgggaatggatgaaaggaagcagcaactttcaaatgggtctctgctgatacaaaacatacttcattccagacaccacaagccagatgagggactttaccaatgtgaggcatctttaggagattctggctcaattattagtcggacagcaaaagttgcagtagcaggaccactgaggttcctttcacagacagaatctgtcacagccttcatgggagacacagtgctactcaagtgtgaagtcattggggagcccatgccaacaatccactggcagaagaaccaacaagacctgactccaatcccaggtgactcccgagtggtggtcttgccctctggagcattgcagatcagccgactccaaccgggggacattggaatttaccgatgctcagctcgaaatccagccagctcaagaacaggaaatgaagcagaagtcagaattttatcagatccaggactgcatagacagctgtattttctgcaaagaccatccaatgtagtagccattgaaggaaaagatgctgtcctggaatgttgtgtttctggctatcctccaccaagttttacctggttacgaggcgaggaagtcatccaactcaggtctaaaaagtattctttattgggtggaagcaacttgcttatctccaatgtgacagatgatgacagtggaatgtatacctgtgttgtcacatataaaaatgagaatattagtgcctctgcagagctcacagtcttggttccgccatggtttttaaatcatccttccaacctgtatgcctatgaaagcatggatattgagtttgaatgtacagtctctggaaagcctgtgcccactgtgaattggatgaagaatggagatgtggtcattcctagtgattattttcagatagtgggaggaagcaacttacggatacttggggtggtgaagtcagatgaaggcttttatcaatgtgtggctgaaaatgaggctggaaatgcccagaccagtgcacagctcattgtccctaagcctgcaatcccaagctccagtgtcctcccttcggctcccagagatgtggtccctgtcttggtttccagccgatttgtccgtctcagctggcgcccacctgcagaagcgaaagggaacattcaaactttcacggtctttttctccagagaaggtgacaacagggaacgagcattgaatacaacacagcctgggtcccttcagctcactgtgggaaacctgaagccagaagccatgtacacctttcgagttgtggcttacaatgaatggggaccgggagagagttctcaacccatcaaggtggccacacagcctgagttgcaagttccagggccagtagaaaacctgcaagctgtatctacctcacctacctcaattcttattacctgggaaccccctgcctatgcaaacggtccagtccaaggttacagattgttctgcactgaggtgtccacaggaaaagaacagaatatagaggttgatggactatcttataaactggaaggcctgaaaaaattcaccgaatatagtcttcgattcttagcttataatcgctatggtccgggcgtctctactgatgatataacagtggttacactttctgacgtgccaagtgccccgcctcagaacgtctccctggaagtggtcaattcaagaagtatcaaagttagctggctgcctcctccatcaggaacacaaaatggatttattaccggctataaaattcgacacagaaagacgacccgcaggggtgagatggaaacactggagccaaacaacctctggtacctattcacaggactggagaaaggaagtcagtacagtttccaggtgtcagccatgacagtcaatggtactggaccaccttccaactggtatactgcagagactccagagaatgatctagatgaatctcaagttcctgatcaaccaagctctcttcatgtgaggccccagactaactgcatcatcatgagttggactcctcccttgaacccaaacatcgtggtgcgaggttatattatcggttatggcgttgggagcccttacgctgagacagtgcgtgtggacagcaagcagcgatattattccattgagaggttagagtcaagttcccattatgtaatctccctaaaagcttttaacaatgccggagaaggagttcctctttatgaaagtgccaccaccaggtctataaccgatctctccacccccatgctcccaccagtaggtgtacaggctgtggctcttacccatgatgctgtgagggtcagctgggcagacaactctgtccctaagaaccaaaagacgtctgaggtgcgactttacaccgtccggtggagaaccagcttttctgcaagtgcaaaatacaagtcagaagacacaacatctctaagttacacagcaacaggcctcaaaccaaacacaatgtatgaattctcggtcatggtaacaaaaaacagaaggtccagtacttggagcatgactgcacatgccaccacgtatgaagcagcccccacctctgctcccaaggacttgacagtcattactagggaagggaagcctcgtgccgtcattgtgagttggcagcctcccttggaagccaatgggaaaattactgcttacatcttattttataccttggacaagaacatcccaattgatgactggattatggaaacaatcagtggtgataggcttactcatcaaatcatggatctcaaccttgatactatgtattactttcgaattcaagcacgaaattcaaaaggagtggggccactctctgatcctatcctcttcaggactctgaaagtggaacaccctgacaaaatggctaatgaccaaggtcgtcatggagatggaggttattggccagttgatactaatttgattgatagaagcaccctaaatgagccgccaattggacaaatgcaccccccgcatggcagtgtcactcctcagaagaacagcaacctgcttgtgatcattgtggtcaccgttggtgtcatcacagtgctggtagtggtcatcgtggctgtgatttgcacccgacgctcttcagcccagcagagaaagaaacgggccacccacagtgctggcaaaaggaagggcagccagaaggacctccgaccccctgatctttggatccatcatgaagaaatggagatgaaaaatattgaaaagccatctggcactgaccctgcaggaagggactctcccatccaaagttgccaagacctcacaccagtcagccacagccagtcagaaacccaactgggaagcaaaagcacctctcattcaggtcaagacactgaggaagcagggagctctatgtccactctggagaggtcgctggctgcacgccgagccccccgggccaagctcatgattcccatggatgcccagtccaacaatcctgctgtcgtgagcgccatcccggtgccaacgctagaaagtgcccagtacccaggaatcctcccgtctcccacctgtggatatccccacccgcagttcactctccggcctgtgccattcccaacactctcagtggaccgaggtttcggagcaggaagaagtcagtcagtgagtgaaggaccaactacccaacaaccacctatgctgcccccatctcagcctgagcattctagcagcgaggaggcaccaagcagaaccatccccacagcttgtgttcgaccaactcacccactccgcagctttgctaatcctttgctacctccaccaatgagtgcaatagaaccgaaagtcccttacacaccacttttgtctcagccagggcccactcttcctaagacccatgtgaaaacagcctcccttgggttggctggaaaagcaagatcccctttgcttcctgtgtctgtgccaacagcccctgaagtgtctgaggagagccacaaaccaacagaggattcagccaatgtgtatgaacaggatgatctgagtgaacaaatggcaagtttggaaggactcatgaagcagcttaatgccatcacaggctcagccttttaacatgtatttctgaatggatgaggtgaattttccgggaactttgcagcataccaattacccataaacagcacacctgtgtccaagaactctaaccagtgtacaggtcacccatcaggaccactcagttaaggaagatcctgaagcagttcagaaggaataagcattccttctttcacaggcatcaggaattgtcaaatgatgattatgagttccctaaacaaaagcaaagatgcattttcactgcaatgtcaaagtttaagctgctagaatagtcatgggcctttgtcactgcagtgaccacactgtcataactaatacctatgttttcctttgtcaaggcctgttgtttaatgtgtaggtctagtcttacaaaatgcaagtgcattatttaagcctgtaccatgccatggcaaaccagtgcaagctcactattttgttttcaacttaaacatacaaagcacccatgggaatctctcatgccatagcaccaaaggattggatgttttccttacagcacaaaaagtaaatagtaaacaaacaaaaggcagagaatgcttatgtttgtaactcagtcattcatcttgcacaagtggtggatattagtgagtggctaaaaattcacctattttggcaagtatttgtaaatccacccttggttaatatgtatgtctggagtccaggaatataaaaatctgcaactagtggcattctgccagcagcagtacatttctggaaagaggatataatatgcaatcttctcag

SEQ ID NO: 356400 - DNA, 1111 bp, Homo sapiens
tgtcttcccctccccccccccccattcccttcgctgtccccttccgcccccttggttttcaaattaaagctttcacagcactgcgcttcctctcagaaccttctgatgccgtcacaatgcggggaggaaatgtcctcctcgactgctccgcggagtccgaccgaggagttccagtgatcaagtggaagaaagatggcattcatctggccttgggaatggatgaaaggaagcagcaactttcaaatgggtctctgctgatacaaaacatacttcattccagacaccacaagccagatgagggactttaccaatgtgaggcatctttaggagattctggctcaattattagtcggacagcaaaagttgcagtagcaggaccactgaggttcctttcacagacagaatctgtcacagccttcatgggagacacagtgctactcaagtgtgaagtcattggggagcccatgccaacaatccactggcagaagaaccaacaagacctgactccaatcccaggtgactcccgagtggtggtcttgccctctggagcattgcagatcagccgactccaaccgggggacattggaatttaccgatgctcagctcgaaatccagccagctcaagaacaggaaatgaagcagaagtcagaattttatcagatccaggactgcatagacagctgtattttctgcaaagaccatccaatgtagtagccattgaaggaaaagatgctgtcctggaatgttgtgtttctggctatcctccaccaagttttacctggttacgaggcgaggaagtcatccaactcaggtctaaaaagtattctttattgggtggaagcaacttgcttatctccaatgtgacagatgatgacagtggaatgtatacctgtgttgtcacatataaaaatgagaatattagtgcctctgcagagctcacagtcttggtaatcatcgataaagtattggtggacaccttttgggtataaggattgcactaggttctgggaagactacagaaacatctgaaacctggcttcagtgggcttcgtataattacaattcgtaaaatcagttggcctaatactgtctgaataaacttttatttaaa

SEQ ID NO: 356401 - DNA, 681 bp, Homo sapiens
tgtcttcccctccccccccccccattcccttcgctgtccccttccgcccccttggttttcaaattaaagctttcacagcactgcgcttcctctcagaaccttctgatgccgtcacaatgcggggaggaaatgtcctcctcgactgctccgcggagtccgaccgaggagttccagtgatcaagtggaagaaagatggcattcatctggccttgggaatggatgaaaggaagcagcaactttcaaatgggtctctgctgatacaaaacatacttcattccagacaccacaagccagatgagggactttaccaatgtgaggcatctttaggagattctggctcaattattagtcggacagcaaaagttgcagtagcagaggagcaaatataaaaattttgcctaaaagggcaacttcatcctgtgcagcagtctggaaaatgtatcccagggcccttgaatacgctcaaaattctatttgggaaggtttggttacagtgcaaagctttccattttacatttatagagatattgtttattttcaaatgataagcagaaaattaaattgctctgactctgtaattcttaatgacttaatgatcttcatttagctaaatgttcccattgttttgtagttaaagcatgagagaaagaaaaaataagaaataaatgtggtcttataagt

SEQ ID NO: 356402 - DNA, 5052 bp, Homo sapiens
tgaaatatggagaatagtcttagatgtgtttgggtacccaagctggcttttgtactcttcggagcttccttgctcagcgcgcatcttcaagtaaccggttttcaaattaaagctttcacagcactgcgcttcctctcagaaccttctgatgccgtcacaatgcggggaggaaatgtcctcctcgactgctccgcggagtccgaccgaggagttccagtgatcaagtggaagaaagatggcattcatctggccttgggaatggatgaaaggaagcagcaactttcaaatgggtctctgctgatacaaaacatacttcattccagacaccacaagccagatgagggactttaccaatgtgaggcatctttaggagattctggctcaattattagtcggacagcaaaagttgcagtagcaggaccactgaggttcctttcacagacagaatctgtcacagccttcatgggagacacagtgctactcaagtgtgaagtcattggggagcccatgccaacaatccactggcagaagaaccaacaagacctgactccaatcccaggtgactcccgagtggtggtcttgccctctggagcattgcagatcagccgactccaaccgggggacattggaatttaccgatgctcagctcgaaatccagccagctcaagaacaggaaatgaagcagaagtcagaattttatcagatccaggactgcatagacagctgtattttctgcaaagaccatccaatgtagtagccattgaaggaaaagatgctgtcctggaatgttgtgtttctggctatcctccaccaagttttacctggttacgaggcgaggaagtcatccaactcaggtctaaaaagtattctttattgggtggaagcaacttgcttatctccaatgtgacagatgatgacagtggaatgtatacctgtgttgtcacatataaaaatgagaatattagtgcctctgcagagctcacagtcttggttccgccatggtttttaaatcatccttccaacctgtatgcctatgaaagcatggatattgagtttgaatgtacagtctctggaaagcctgtgcccactgtgaattggatgaagaatggagatgtggtcattcctagtgattattttcagatagtgggaggaagcaacttacggatacttggggtggtgaagtcagatgaaggcttttatcaatgtgtggctgaaaatgaggctggaaatgcccagaccagtgcacagctcattgtccctaagcctgcaatcccaagctccagtgtcctcccttcggctcccagagatgtggtccctgtcttggtttccagccgatttgtccgtctcagctggcgcccacctgcagaagcgaaagggaacattcaaactttcacggtctttttctccagagaaggtgacaacagggaacgagcattgaatacaacacagcctgggtcccttcagctcactgtgggaaacctgaagccagaagccatgtacacctttcgagttgtggcttacaatgaatggggaccgggagagagttctcaacccatcaaggtggccacacagcctgagttgcaagttccagggccagtagaaaacctgcaagctgtatctacctcacctacctcaattcttattacctgggaaccccctgcctatgcaaacggtccagtccaaggttacagattgttctgcactgaggtgtccacaggaaaagaacagaatatagaggttgatggactatcttataaactggaaggcctgaaaaaattcaccgaatatagtcttcgattcttagcttataatcgctatggtccgggcgtctctactgatgatataacagtggttacactttctgacgtgccaagtgccccgcctcagaacgtctccctggaagtggtcaattcaagaagtatcaaagttagctggctgcctcctccatcaggaacacaaaatggatttattaccggctataaaattcgacacagaaagacgacccgcaggggtgagatggaaacactggagccaaacaacctctggtacctattcacaggactggagaaaggaagtcagtacagtttccaggtgtcagccatgacagtcaatggtactggaccaccttccaactggtatactgcagagactccagagaatgatctagatgaatctcaagttcctgatcaaccaagctctcttcatgtgaggccccagactaactgcatcatcatgagttggactcctcccttgaacccaaacatcgtggtgcgaggttatattatcggttatggcgttgggagcccttacgctgagacagtgcgtgtggacagcaagcagcgatattattccattgagaggttagagtcaagttcccattatgtaatctccctaaaagcttttaacaatgccggagaaggagttcctctttatgaaagtgccaccaccaggtctataaccgatctctccacccccatgctcccaccagtaggtgtacaggctgtggctcttacccatgatgctgtgagggtcagctgggcagacaactctgtccctaagaaccaaaagacgtctgaggtgcgactttacaccgtccggtggagaaccagcttttctgcaagtgcaaaatacaagtcagaagacacaacatctctaagttacacagcaacaggcctcaaaccaaacacaatgtatgaattctcggtcatggtaacaaaaaacagaaggtccagtacttggagcatgactgcacatgccaccacgtatgaagcagcccccacctctgctcccaaggacttgacagtcattactagggaagggaagcctcgtgccgtcattgtgagttggcagcctcccttggaagccaatgggaaaattactgcttacatcttattttataccttggacaagaacatcccaattgatgactggattatggaaacaatcagtggtgataggcttactcatcaaatcatggatctcaaccttgatactatgtattactttcgaattcaagcacgaaattcaaaaggagtggggccactctctgatcctatcctcttcaggactctgaaagtggaacaccctgacaaaatggctaatgaccaaggtcgtcatggagatggaggttattggccagttgatactaatttgattgatagaagcaccctaaatgagccgccaattggacaaatgcaccccccgcatggcagtgtcactcctcagaagaacagcaacctgcttgtgatcattgtggtcaccgttggtgtcatcacagtgctggtagtggtcatcgtggctgtgatttgcacccgacgctcttcagcccagcagagaaagaaacgggccacccacagtgctggcaaaaggaagggcagccagaaggacctccgaccccctgatctttggatccatcatgaagaaatggagatgaaaaatattgaaaagccatctggcactgaccctgcaggaagggactctcccatccaaagttgccaagacctcacaccagtcagccacagccagtcagaaacccaactgggaagcaaaagcacctctcattcaggtcaagacactgaggaagcagggagctctatgtccactctggagaggtcgctggctgcacgccgagccccccgggccaagctcatgattcccatggatgcccagtccaacaatcctgctgtcgtgagcgccatcccggtgccaacgctagaaagtgcccagtacccaggaatcctcccgtctcccacctgtggatatccccacccgcagttcactctccggcctgtgccattcccaacactctcagtggaccgaggtttcggagcaggaagaagtcagtcagtgagtgaaggaccaactacccaacaaccacctatgctgcccccatctcagcctgagcattctagcagcgaggaggcaccaagcagaaccatccccacagcttgtgttcgaccaactcacccactccgcagctttgctaatcctttgctacctccaccaatgagtgcaatagaaccgaaagtcccttacacaccacttttgtctcagccagggcccactcttcctaagacccatgtgaaaacagcctcccttgggttggctggaaaagcaagatcccctttgcttcctgtgtctgtgccaacagcccctgaagtgtctgaggagagccacaaaccaacagaggattcagccaatgtgtatgaacaggatgatctgagtgaacaaatggcaagtttggaaggactcatgaagcagcttaatgccatcacaggctcagccttttaacatgtatttctgaatggatgaggtgaattttccgggaactttgcagcataccaattacccataaacagcacacctgtgtccaagaactctaaccagtgtacaggtcacccatcaggaccactcagttaaggaagatcctgaagcagttcagaaggaataagcattccttctttcacaggcatcaggaattgtcaaatgatgattatgagttccctaaacaaaagcaaagatgcattttcactgcaatgtcaaagtttaagctgctagaatagtcatgggcctttgtcactgcagtgaccacactgtcataactaatacctatgttttcctttgtcaaggcctgttgtttaatgtgtaggtctagtcttacaaaatgcaagtgcattatttaagcctgtaccatgccatggcaaaccagtgcaagctcactattttgttttcaacttaaacatacaaagcacccatgggaatctctcatgccatagcaccaaaggattggatgttttccttacagcacaaaaagtaaatagtaaacaaacaaaaggcagagaatgcttatgtttgtaactcagtcattcatcttgcacaagtggtggatattagtgagtggctaaaaattcacctattttggcaagtatttgtaaatccacccttggttaatatgtatgtctggagtccaggaatataaaaatctgcaactagtggcattctgccagcagcagtacatttctggaaagaggatataatatgcaatcttctcag

SEQ ID NO: 356403 - DNA, 4399 bp, Homo sapiens
tgaaatatggagaatagtcttagatgtgtttgggtacccaagctggcttttgtactcttcggagcttccttgctcagcgcgcatcttcaagtaaccggttttcaaattaaagctttcacagcactgcgcttcctctcagaaccttctgatgccgtcacaatgcggggaggaaatgtcctcctcgactgctccgcggagtccgaccgaggagttccagtgatcaagtggaagaaagatggcattcatctggccttgggaatggatgaaaggaagcagcaactttcaaatgggtctctgctgatacaaaacatacttcattccagacaccacaagccagatgagggactttaccaatgtgaggcatctttaggagattctggctcaattattagtcggacagcaaaagttgcagtagcaggaccactgaggttcctttcacagacagaatctgtcacagccttcatgggagacacagtgctactcaagtgtgaagtcattggggagcccatgccaacaatccactggcagaagaaccaacaagacctgactccaatcccaggtgactcccgagtggtggtcttgccctctggagcattgcagatcagccgactccaaccgggggacattggaatttaccgatgctcagctcgaaatccagccagctcaagaacaggaaatgaagcagaagtcagaattttatcagatccaggactgcatagacagctgtattttctgcaaagaccatccaatgtagtagccattgaaggaaaagatgctgtcctggaatgttgtgtttctggctatcctccaccaagttttacctggttacgaggcgaggaagtcatccaactcaggtctaaaaagtattctttattgggtggaagcaacttgcttatctccaatgtgacagatgatgacagtggaatgtatacctgtgttgtcacatataaaaatgagaatattagtgcctctgcagagctcacagtcttggttccgccatggtttttaaatcatccttccaacctgtatgcctatgaaagcatggatattgagtttgaatgtacagtctctggaaagcctgtgcccactgtgaattggatgaagaatggagatgtggtcattcctagtgattattttcagatagtgggaggaagcaacttacggatacttggggtggtgaagtcagatgaaggcttttatcaatgtgtggctgaaaatgaggctggaaatgcccagaccagtgcacagctcattgtccctaagcctgcaatcccaagctccagtgtcctcccttcggctcccagagatgtggtccctgtcttggtttccagccgatttgtccgtctcagctggcgcccacctgcagaagcgaaagggaacattcaaactttcacggtctttttctccagagaaggtgacaacagggaacgagcattgaatacaacacagcctgggtcccttcagctcactgtgggaaacctgaagccagaagccatgtacacctttcgagttgtggcttacaatgaatggggaccgggagagagttctcaacccatcaaggtggccacacagcctgagttgcaagttccagggccagtagaaaacctgcaagctgtatctacctcacctacctcaattcttattacctgggaaccccctgcctatgcaaacggtccagtccaaggttacagattgttctgcactgaggtgtccacaggaaaagaacagaatatagaggttgatggactatcttataaactggaaggcctgaaaaaattcaccgaatatagtcttcgattcttagcttataatcgctatggtccgggcgtctctactgatgatataacagtggttacactttctgacgtgccaagtgccccgcctcagaacgtctccctggaagtggtcaattcaagaagtatcaaagttagctggctgcctcctccatcaggaacacaaaatggatttattaccggctataaaattcgacacagaaagacgacccgcaggggtgagatggaaacactggagccaaacaacctctggtacctattcacaggactggagaaaggaagtcagtacagtttccaggtgtcagccatgacagtcaatggtactggaccaccttccaactggtatactgcagagactccagagaatgatctagatgaatctcaagttcctgatcaaccaagctctcttcatgtgaggccccagactaactgcatcatcatgagttggactcctcccttgaacccaaacatcgtggtgcgaggttatattatcggttatggcgttgggagcccttacgctgagacagtgcgtgtggacagcaagcagcgatattattccattgagaggttagagtcaagttcccattatgtaatctccctaaaagcttttaacaatgccggagaaggagttcctctttatgaaagtgccaccaccaggtctataaccgatctctccacccccatgctcccaccagtaggtgtacaggctgtggctcttacccatgatgctgtgagggtcagctgggcagacaactctgtccctaagaaccaaaagacgtctgaggtgcgactttacaccgtccggtggagaaccagcttttctgcaagtgcaaaatacaagtcagaagacacaacatctctaagttacacagcaacaggcctcaaaccaaacacaatgtatgaattctcggtcatggtaacaaaaaacagaaggtccagtacttggagcatgactgcacatgccaccacgtatgaagcagcccccacctctgctcccaaggacttgacagtcattactagggaagggaagcctcgtgccgtcattgtgagttggcagcctcccttggaagccaatgggaaaattactgcttacatcttattttataccttggacaagaacatcccaattgatgactggattatggaaacaatcagtggtgataggcttactcatcaaatcatggatctcaaccttgatactatgtattactttcgaattcaagcacgaaattcaaaaggagtggggccactctctgatcctatcctcttcaggactctgaaagtggaacaccctgacaaaatggctaatgaccaaggtcgtcatggagatggaggttattggccagttgatactaatttgattgatagaagcaccctaaatgagccgccaattggacaaatgcaccccccgcatggcagtgtcactcctcagaagaacagcaacctgcttgtgatcattgtggtcaccgttggtgtcatcacagtgctggtagtggtcatcgtggctgtgatttgcacccgacgctcttcagcccagcagagaaagaaacgggccacccacagtgctggcaaaaggaagggcagccagaaggacctccgaccccctgatctttggatccatcatgaagaaatggagatgaaaaatattgaaaagccatctggcactgaccctgcaggaagggactctcccatccaaagttgccaagacctcacaccagtcagccacagccagtcagaaacccaactgggaagcaaaagcacctctcattcaggtcaagacactgaggaagcagggagctctatgtccactctggagaggtcgctggctgcacgccgagccccccgggccaagctcatgattcccatggatgcccagtccaacaatcctgctgtcgtgagcgccatcccggtgccaacgctagaaagtgcccagtacccaggaatcctcccgtctcccacctgtggatatccccacccgcagttcactctccggcctgtgccattcccaacactctcagtggaccgaggtttcggagcaggaagaagtcagtcagtgagtgaaggaccaactacccaacaaccacctatgctgcccccatctcagcctgagcattctagcagcgaggaggcaccaagcagaaccatccccacagcttgtgttcgaccaactcacccactccgcagctttgctaatcctttgctacctccaccaatgagtgcaatagaaccgaaagtcccttacacaccacttttgtctcagccagggcccactcttcctaagacccatgtgaaaacagcctcccttgggttggctggaaaagcaagatcccctttgcttcctgtgtctgtgccaacagcccctgaagtgtctgaggagagccacaaaccaacagaggattcagccaatgtaagggcatctttaaaattcatgcttcatcaagggacagattgactggcgctgtgtaatagcatctaaaccaatgagtactgtccattcaccccaggccaccccaggccaccccaggccattgttgttcttattgttgtttgttcctttgttttcctgcacttaaatatgaagaggaaataaaagctatgaaaaaaaa

SEQ ID NO: 356404 - DNA, 636 bp, Homo sapiens
tgtcttcccctccccccccccccattcccttcgctgtccccttccgcccccttggttttcaaattaaagctttcacagcactgcgcttcctctcagaaccttctgatgccgtcacaatgcggggaggaaatgtcctcctcgactgctccgcggagtccgaccgaggagttccagtgatcaagtggaagaaagatggcattcatctggccttgggaatggatgaaaggaagcagcaactttcaaatgggtctctgctgatacaaaacatacttcattccagacaccacaagccagatgagggactttaccaatgtgaggcatctttaggagattctggctcaattattagtcggacagcaaaagttgcagtagcagagagggaaatgtgaggctgagaaagtttggacaacatagccatggcagtttataactcaaagtatatggatggatgacactcgctagagagttgcaacagccgatgcagctgtccccaggccccaaactcacttatatttcctgaaacaccaggaaaagcatcttttatttttatatgagagccctaagagattattttcatcttattcaaaaatgaaaagattttatttaattaaaaaatctatttctattatcttaaaa

SEQ ID NO: 356405 - DNA, 479 bp, Homo sapiens
actcatgacagcaatgtagttatagatctgattttctttcagcaactatgctggcattaaacttaacaggcaaggtgtgcccctcctgagactgagttttcctcagtgtggaatgcttaagcttctgagaagccttagatgaaagctccctacgtaatggctgggggtgctgcccaacattcagtagagccccaggaagtttctgttgaatgaatgaatgaagtagctgtgtttttctccccccttttccactttctgctcccacctccaagcaaattagtgtatgcgtcctttcaaatttggtcaaatacctaaaacaatgtgagcaaatcctggtagagtgagcttcagcaagtgcatgtcctctaaccaaaattaagaaacgtgccaccaacatggcacatgtatacatatgtaacaaactctgacattgtgcacatgtaccctaaaacttaaagtataataataataaaaaaaaa

SEQ ID NO: 356406 - DNA, 576 bp, Homo sapiens
  misc_feature (109)..(109): n is a, c, g, or t
gtcctagcttcgccaatggtcctgcctgtcctagcctcgccagtgtcctagcctcgccagtgtcactagcctcgccagtgtcctagcctcgccagtgtcctagcctcgncagtgaacctaagagtgagaactacacctacatttggtggctaaatggtcagagcctccctgtcagtcccagggtaaagcgacccattgaaaacaggatcctcattctacccaatgtcacgagaaatgaaacaggaccttatcaatgtgaaatacgggaccgatatggtggcatccgcagtgacccagtcaccctgaatgtcctctatggtccagacctccccagcatttacccttcattcacctattaccgttcaggagaaaacctctacttgtcctgcttcgcggaatctaacccaccggcagagtatttttggacaattaatgggaagtttcagcaatcaggacaaaagctctctatcccccaaattactacaaagcatagagggctctatacttgctctgttcgtaactcagccactggcaaggctaggacactggcgaggctagacactggcgaggctagga

SEQ ID NO: 356407 - DNA, 295 bp, Homo sapiens
  misc_feature (1)..(1): n is a, c, g, or t
  misc_feature (3)..(3): n is a, c, g, or t
ngngaaggaggaaggacagcacagcctacagccgtgctcaggaagtttctggatcctaggctcagctccacagaggagaacacgcaggcgcagagaccatggggcccctctcagcccctccctgcacacagcacatcacctggaagggggtcctgctcacagcatgactttttaaaagtcatggaacttgtctatcgccggccatgtcatacattgaagtatgacaggacggacggatagcggcggacttcagatagtggagagggttaacatagtcggtaacagtctcgtagat

SEQ ID NO: 356408 - DNA, 1899 bp, Homo sapiens
  misc_feature (1)..(1): n is a, c, g, or t
  misc_feature (3)..(3): n is a, c, g, or t
  misc_feature (1644)..(1644): n is a, c, g, or t
  misc_feature (1691)..(1691): n is a, c, g, or t
  misc_feature (1696)..(1696): n is a, c, g, or t
  misc_feature (1699)..(1699): n is a, c, g, or t
  misc_feature (1710)..(1710): n is a, c, g, or t
  misc_feature (1712)..(1712): n is a, c, g, or t
  misc_feature (1714)..(1714): n is a, c, g, or t
  misc_feature (1719)..(1719): n is a, c, g, or t
  misc_feature (1722)..(1722): n is a, c, g, or t
  misc_feature (1724)..(1724): n is a, c, g, or t
  misc_feature (1726)..(1726): n is a, c, g, or t
  misc_feature (1730)..(1730): n is a, c, g, or t
  misc_feature (1746)..(1746): n is a, c, g, or t
ngngaaggaggaaggacagcacagcctacagccgtgctcaggaagtttctggatcctaggctcagctccacagaggagaacacgcaggcgcagagaccatggggcccctctcagcccctccctgcacacagcacatcacctggaagggggtcctgctcacagcatcacttttaaacttctggaacctgcctatcactgctcaagtcacgattgaagccctgccacccaaagtttccgaggggaaggatgttcttctacttgtccacaatttgcctcagaatcttgctggctacatctggtacaaaggacaactgatggacctctaccattacattacatcatatgtagtagacggtcaaataaatatatatgggcctgcatacactggacgagaaacagtatattccaatgcatccctgctgatccagaatgtcacccgggaagacgcaggatcctacaccttacacatcataaagcgaggtgataggactagaggagtaactggatatttcaccttcaacttatacctgaagctgcccaagccctacatcaccatcaacaactcaaaacccagggagaataaggatgtcttagccttcacctgtgaacctaagagtgagaactacacctacatttggtggctaaatggtcagagcctcccggtcagtcccagggtaaagcaacccattgaaaacaggatcctcattctacccagtgtcacgagaaatgaaacaggaccctatgaatgtgaaatacgggaccgagatggtggcatgcacagtgacccagtcaccctgaatgtcctctatggtccagacctccccagcatttacccttcattcacctattaccgttcaggagaaaacctctacttgtcctgcttcgcggaatctaacccaccggcagagtatttttggacaattaatgggaagtttcagcaatcaggacaaaagctctctatcccccaaattactacaaagcatagagggctctatacttgctctgttcgtaactcagccactggcaaggaaagctccaaatccatgacagtcgaagtctctgctccttcaggaataggacgtcttcctctccttaatccaatatagcagccgtgaagtcatttctgtatttcaggaagactggcagacagttgctttgattcttcctcaaactacttacaatcacctacagtccaaaattgctttttcttcaaggagatttatggaaaagactctgacaaggactcttgaatacaagttcctgataacttcaagatcataccactggactaagaactttcaaaattttaatgaacaggctgataccttcatgaaattctagacaaagaagaaaaaaactccatgttattggactaaataatcaaaagcataatgttttcataattttctatttgaaaatgtgctgattctttgaatgttttattctccagatttatgaactttttttcttgagcaattggtaaagtatacttttgtaaacaaaaattgaaacatttgcttttgctctctatctgagtgccccagaattgggaaactattcatgagtattcatatgtttatggtaataaagttatctgcacaagttcaaaaaaaaaaaacaaacaacaaaaaaaaatttttgggnggcttgggccttggaaaaggtttcttaaaaccatttgtttgggggcnggggngcncattgggttantntnacacnggncnanaggngtcccagagaaaaccncggggcgagaacatagggctgtggattctccccccatataaaaaaacggcgcgggggacaacgcgaagcctttctggaccaaattccaagatgggattcgggggaccaaggggggtcctcccaagagggactccagggagccgaataaatagc

SEQ ID NO: 356409 - DNA, 2007 bp, Homo sapiens
  misc_feature (1)..(1): n is a, c, g, or t
  misc_feature (3)..(3): n is a, c, g, or t
  misc_feature (1752)..(1752): n is a, c, g, or t
  misc_feature (1799)..(1799): n is a, c, g, or t
  misc_feature (1804)..(1804): n is a, c, g, or t
  misc_feature (1807)..(1807): n is a, c, g, or t
  misc_feature (1818)..(1818): n is a, c, g, or t
  misc_feature (1820)..(1820): n is a, c, g, or t
  misc_feature (1822)..(1822): n is a, c, g, or t
  misc_feature (1827)..(1827): n is a, c, g, or t
  misc_feature (1830)..(1830): n is a, c, g, or t
  misc_feature (1832)..(1832): n is a, c, g, or t
  misc_feature (1834)..(1834): n is a, c, g, or t
  misc_feature (1838)..(1838): n is a, c, g, or t
  misc_feature (1854)..(1854): n is a, c, g, or t
ngngaaggaggaaggacagcacagcctacagccgtgctcaggaagtttctggatcctaggctcagctccacagaggagaacacgcaggcgcagagaccatggggcccctctcagcccctccctgcacacagcacatcacctggaagggggtcctgctcacagcatcacttttaaacttctggaacctgcctatcactgctcaagtcacgattgaagccctgccacccaaagtttccgaggggaaggatgttcttctacttgtccacaatttgcctcagaatcttgctggctacatctggtacaaaggacaactgatggacctctaccattacattacatcatatgtagtagacggtcaaataaatatatatgggcctgcatacactggacgagaaacagtatattccaatgcatccctgctgatccagaatgtcacccgggaagacgcaggatcctacaccttacacatcataaagcgaggtgataggactagaggagtaactggatatttcaccttcaacttatacctgaagctgcccaagccctacatcaccatcaacaactcaaaacccagggagaataaggatgtcttagccttcacctgtgaacctaagagtgagaactacacctacatttggtggctaaatggtcagagcctcccggtcagtcccagggtaaagcaacccattgaaaacaggatcctcattctacccagtgtcacgagaaatgaaacaggaccctatgaatgtgaaatacgggaccgagatggtggcatgcacagtgacccagtcaccctgaatgtcctctatggtccagacctccccagcatttacccttcattcacctattaccgttcaggagaaaacctctacttgtcctgcttcgcggaatctaacccaccggcagagtatttttggacaattaatgggaagtttcagcaatcaggacaaaagctctctatcccccaaattactacaaagcatagagggctctatacttgctctgttcgtaactcagccactggcaaggaaagctccaaatccatgacagtcgaagtctctgctccttcaggaataggacgtcttcctctccttaatccaatatagcagccgtgaagtcatttctgtatttcaggaagactggcagacagttgctttgattcttcctcaaactacttacaatcacctacagtccaaaattgctttttcttcaaggagatttatggaaaagactctgacaaggactcttgaatacaagttcctgataacttcaagatcataccactggactaagaactttcaaaattttaatgaacaggctgataccttcatgaaattctagacaaagaagaaaaaaactccatgttattggactaaataatcaaaagcataatgttttcataattttctatttgaaaatgtgctgattctttgaatgttttattctccagatttatgaactttttttcttgagcaattggtaaagtatacttttgtaaacaaaaattgaaacatttgcttttgctctctatctgagtgccccagaattgggaaactattcatgagtattcatatgtttatggtaataaagttatctgcacaagttcaaaaacaaaaaacaacaaaaacaacgaaaaacaacaaaaacataaaaaagtcgaaacacaaaacacacacaaaaaaagaccaaaaaaaacaccaacaagggacaacacaaaaaaaaaaaacaaacaacaaaaaaaaatttttgggnggcttgggccttggaaaaggtttcttaaaaccatttgtttgggggcnggggngcncattgggttantntnacacnggncnanaggngtcccagagaaaaccncggggcgagaacatagggctgtggattctccccccatataaaaaaacggcgcgggggacaacgcgaagcctttctggaccaaattccaagatgggattcgggggaccaaggggggtcctcccaagagggactccagggagccgaataaatagc

SEQ ID NO: 356410 - DNA, 1831 bp, Homo sapiens
  misc_feature (1)..(1): n is a, c, g, or t
  misc_feature (3)..(3): n is a, c, g, or t
  misc_feature (1576)..(1576): n is a, c, g, or t
  misc_feature (1623)..(1623): n is a, c, g, or t
  misc_feature (1628)..(1628): n is a, c, g, or t
  misc_feature (1631)..(1631): n is a, c, g, or t
  misc_feature (1642)..(1642): n is a, c, g, or t
  misc_feature (1644)..(1644): n is a, c, g, or t
  misc_feature (1646)..(1646): n is a, c, g, or t
  misc_feature (1651)..(1651): n is a, c, g, or t
  misc_feature (1654)..(1654): n is a, c, g, or t
  misc_feature (1656)..(1656): n is a, c, g, or t
  misc_feature (1658)..(1658): n is a, c, g, or t
  misc_feature (1662)..(1662): n is a, c, g, or t
  misc_feature (1678)..(1678): n is a, c, g, or t
ngngaaggaggaaggacagcacagcctacagccgtgctcaggaagtttctggatcctaggctcagctccacagaggagaacacgcaggcgcagagaccatggggcccctctcagcccctccctgcacacagcacatcacctggaagggggtcctgctcacagcatcacttttaaacttctggaacctgcctatcactgctcaagtcacgattgaagccctgccacccaaagtttccgaggggaaggatgttcttctacttgtccacaatttgcctcagaatcttgctggctacatctggtacaaaggacaactgatggacctctaccattacattacatcatatgtagtagacggtcaaataaatatatatgggcctgcatacactggacgagaaacagtatattccaatgcatccctgctgatccagaatgtcacccgggaagacgcaggatcctacaccttacacatcataaagcgaggtgataggactagaggagtaactggatatttcaccttcaacttatacctgaagctgcccaagccctacatcaccatcaacaactcaaaacccagggagaataaggatgtcttagccttcacctgtgaacctaagagtgagaactacacctacatttggtggctaaatggtcagagcctcccggtcagtcccagggtaaagcaacccattgaaaacaggatcctcattctacccagtgtcacgagaaatgaaacaggaccctatgaatgtgaaatacgggaccgagatggtggcatgcacagtgacccagtcaccctgaatgtcctctatggtccagacctccccagcatttacccttcattcacctattaccgttcaggagaaaacctctacttgtcctgcttcgcggaatctaacccaccggcagagtatttttggacaattaatgggaagtttcagcaatcaggacaaaagctctctatcccccaaattactacaaagcatagagggctctatacttgctctgttcgtaactcagccactggcaaggaaagctccaaatccatgacagtcgaagtctctgctccttcaggaataggacgtcttcctctccttaatccaatatagcagccgtgaagtcatttctgtatttcaggaagactggcaggagatttatggaaaagactctgacaaggactcttgaatacaagttcctgataacttcaagatcataccactggactaagaactttcaaaattttaatgaacaggctgataccttcatgaaattctagacaaagaagaaaaaaactccatgttattggactaaataatcaaaagcataatgttttcataattttctatttgaaaatgtgctgattctttgaatgttttattctccagatttatgaactttttttcttgagcaattggtaaagtatacttttgtaaacaaaaattgaaacatttgcttttgctctctatctgagtgccccagaattgggaaactattcatgagtattcatatgtttatggtaataaagttatctgcacaagttcaaaaaaaaaaaacaaacaacaaaaaaaaatttttgggnggcttgggccttggaaaaggtttcttaaaaccatttgtttgggggcnggggngcncattgggttantntnacacnggncnanaggngtcccagagaaaaccncggggcgagaacatagggctgtggattctccccccatataaaaaaacggcgcgggggacaacgcgaagcctttctggaccaaattccaagatgggattcgggggaccaaggggggtcctcccaagagggactccagggagccgaataaatagc

SEQ ID NO: 356411 - DNA, 1326 bp, Homo sapiens
  misc_feature (1071)..(1071): n is a, c, g, or t
  misc_feature (1118)..(1118): n is a, c, g, or t
  misc_feature (1123)..(1123): n is a, c, g, or t
  misc_feature (1126)..(1126): n is a, c, g, or t
  misc_feature (1137)..(1137): n is a, c, g, or t
  misc_feature (1139)..(1139): n is a, c, g, or t
  misc_feature (1141)..(1141): n is a, c, g, or t
  misc_feature (1146)..(1146): n is a, c, g, or t
  misc_feature (1149)..(1149): n is a, c, g, or t
  misc_feature (1151)..(1151): n is a, c, g, or t
  misc_feature (1153)..(1153): n is a, c, g, or t
  misc_feature (1157)..(1157): n is a, c, g, or t
  misc_feature (1173)..(1173): n is a, c, g, or t
gggagaataaggatgtcttagccttcacctgtgaacctaagagtgagaactacacctacatttggtggctaaacggtcagagcctccccgtcagtcccggggtaaagcgacccattgaaaacaggatactcattctacccagtgtcacgagaaatgaaacaggaccctatcaatgtgaaatacgggaccgatatggtggcctccgcagtaacccagtcatcctaaatgtcctctatggtccagacctccccagcatttacccttcattcacctattaccgttcaggagaaaacctctacttgtcctgcttcgcggaatctaacccaccggcagagtatttttggacaattaatgggaagtttcagcaatcaggacaaaagctctctatcccccaaattactacaaagcatagagggctctatacttgctctgttcgtaactcagccactggcaaggaaagctccaaatccatgacagtcgaagtctctgctccttcaggaataggacgtcttcctctccttaatccaatatagcagccgtgaagtcatttctgtatttcaggaagactggcagacagttgctttgattcttcctcaaactacttacaatcacctacagtccaaaattgctttttcttcaaggagatttatggaaaagactctgacaaggactcttgaatacaagttcctgataacttcaagatcataccactggactaagaactttcaaaattttaatgaacaggctgataccttcatgaaattctagacaaagaagaaaaaaactccatgttattggactaaataatcaaaagcataatgttttcataattttctatttgaaaatgtgctgattctttgaatgttttattctccagatttatgaactttttttcttgagcaattggtaaagtatacttttgtaaacaaaaattgaaacatttgcttttgctctctatctgagtgccccagaattgggaaactattcatgagtattcatatgtttatggtaataaagttatctgcacaagttcaaaaaaaaaaaacaaacaacaaaaaaaaatttttgggnggcttgggccttggaaaaggtttcttaaaaccatttgtttgggggcnggggngcncattgggttantntnacacnggncnanaggngtcccagagaaaaccncggggcgagaacatagggctgtggattctccccccatataaaaaaacggcgcgggggacaacgcgaagcctttctggaccaaattccaagatgggattcgggggaccaaggggggtcctcccaagagggactccagggagccgaataaatagc

SEQ ID NO: 356412 - DNA, 1357 bp, Homo sapiens
  misc_feature (1)..(1): n is a, c, g, or t
  misc_feature (3)..(3): n is a, c, g, or t
ngngaaggaggaaggacagcacagcctacagccgtgctcaggaagtttctggatcctaggctcagctccacagaggagaacacgcaggcgcagagaccatggggcccctctcagcccctccctgcacacagcacatcacctggaagggggtcctgctcacagcatcacttttaaacttctggaacctgcctatcactgctcaagtcacgattgaagccctgccacccaaagtttccgaggggaaggatgttcttctacttgtccacaatttgcctcagaatcttgctggctacatctggtacaaaggacaactgatggacctctaccattacattacatcatatgtagtagacggtcaaataaatatatatgggcctgcatacactggacgagaaacagtatattccaatgcatccctgctgatccagaatgtcacccgggaagacgcaggatcctacaccttacacatcataaagcgaggtgataggactagaggagtaactggatatttcaccttcaacttatacctgaagctgcccaagccctacatcaccatcaacaactcaaaacccagggagaataaggatgtcttagccttcacctgtgaacctaagagtgagaactacacctacatttggtggctaaatggtcagagcctcccggtcagtcccagggtaaagcaacccattgaaaacaggatcctcattctacccagtgtcacgagaaatgaaacaggaccctatgaatgtgaaatacgggaccgagatggtggcatgcacagtgacccagtcaccctgaatgtcctctatggtccagacctccccagcatttacccttcattcacctattaccgttcaggagaaaacctctacttgtcctgcttcgcggaatctaacccaccggcagagtatttttggacaattaatgggaagtttcagcaatcaggacaaaagctctctatcccccaaattactacaaagcatagagggctctatacttgctctgttcgtaactcagccactggcaaggaaagctccaaatccatgacagtcgaagtctctgctccttcaggaataggacgtcttcctctccttaatccaatatagcagccgtgaagtcatttctgtatttcaggaagactggcagacagttgctttgattcttcctcaaactacttacaatcacctacagtccaaaattgctttttcttcaaggagatttatggaaaagactctgacaaggactcttgaatacaagttcctgataacttcaagatcataccactggactaagaactttcaaaattttaatgaacaggctgataccatccttggttctcttagtacggtcgcaggta

SEQ ID NO: 356413 - DNA, 1650 bp, Homo sapiens
  misc_feature (1395)..(1395): n is a, c, g, or t
  misc_feature (1442)..(1442): n is a, c, g, or t
  misc_feature (1447)..(1447): n is a, c, g, or t
  misc_feature (1450)..(1450): n is a, c, g, or t
  misc_feature (1461)..(1461): n is a, c, g, or t
  misc_feature (1463)..(1463): n is a, c, g, or t
  misc_feature (1465)..(1465): n is a, c, g, or t
  misc_feature (1470)..(1470): n is a, c, g, or t
  misc_feature (1473)..(1473): n is a, c, g, or t
  misc_feature (1475)..(1475): n is a, c, g, or t
  misc_feature (1477)..(1477): n is a, c, g, or t
  misc_feature (1481)..(1481): n is a, c, g, or t
  misc_feature (1497)..(1497): n is a, c, g, or t
actgactacttgtgggagagaaggaaaaaaagctaagtgcaaagaatcaagcctgatatgttagtttttaccaactgagatgcacccaagatgggattagacatacaagataatttatcagggaggacacctgtgagggaatgtggggcagacatgaaggcagtatgggagaacccacagaccactatgcagagctgattcctgtgaaaaagaaagagaaagaagttttaggtaccaatgcagttctaagagtttttgcaaggctgagggggagtcctccaaccagtcaccctttagagttaaagagagcctcagagaactaggcttgctttcacgcccttcctgggagcctgtgggaaagaagctttctgtgcaaaggaggtgatgaatgtgaaatgcacggacgtgggccttctgtcaatcagctccctgccatggagacctgacagagtctcattcatggctgccacaacagagagactgagaaaaagatgcaaccatgaaaaggtgaaaaggtggtaagttctaatgacatagaaaatagcaatcagcctttcttatgtctgaaagccttccaaaatatctgagtgcagtagagatttgacagaggactgatcaccatcctagaaacatggtgagagggaaaaaaaaaactgcaagaatataatcatctcccatcaatttcccaagaggaataatgtagtacttgaagaaacaattatagagtacctcatgctacatgcctcttcctgaggctcccccatgtaaaataacatcaccttcattccttctttacttttctttccatgacagctccttcaggaataggacgtcttcctctccttaatccaatatagcagccgtgaagtcatttctgtatttcaggaagactggcagacagttgctttgattcttcctcaaactacttacaatcacctacagtccaaaattgctttttcttcaaggagatttatggaaaagactctgacaaggactcttgaatacaagttcctgataacttcaagatcataccactggactaagaactttcaaaattttaatgaacaggctgataccttcatgaaattctagacaaagaagaaaaaaactccatgttattggactaaataatcaaaagcataatgttttcataattttctatttgaaaatgtgctgattctttgaatgttttattctccagatttatgaactttttttcttgagcaattggtaaagtatacttttgtaaacaaaaattgaaacatttgcttttgctctctatctgagtgccccagaattgggaaactattcatgagtattcatatgtttatggtaataaagttatctgcacaagttcaaaaaaaaaaaacaaacaacaaaaaaaaatttttgggnggcttgggccttggaaaaggtttcttaaaaccatttgtttgggggcnggggngcncattgggttantntnacacnggncnanaggngtcccagagaaaaccncggggcgagaacatagggctgtggattctccccccatataaaaaaacggcgcgggggacaacgcgaagcctttctggaccaaattccaagatgggattcgggggaccaaggggggtcctcccaagagggactccagggagccgaataaatagc

SEQ ID NO: 356414 - DNA, 1931 bp, Homo sapiens
  misc_feature (1)..(1): n is a, c, g, or t
  misc_feature (3)..(3): n is a, c, g, or t
  misc_feature (1676)..(1676): n is a, c, g, or t
  misc_feature (1723)..(1723): n is a, c, g, or t
  misc_feature (1728)..(1728): n is a, c, g, or t
  misc_feature (1731)..(1731): n is a, c, g, or t
  misc_feature (1742)..(1742): n is a, c, g, or t
  misc_feature (1744)..(1744): n is a, c, g, or t
  misc_feature (1746)..(1746): n is a, c, g, or t
  misc_feature (1751)..(1751): n is a, c, g, or t
  misc_feature (1754)..(1754): n is a, c, g, or t
  misc_feature (1756)..(1756): n is a, c, g, or t
  misc_feature (1758)..(1758): n is a, c, g, or t
  misc_feature (1762)..(1762): n is a, c, g, or t
  misc_feature (1778)..(1778): n is a, c, g, or t
ngngaaggaggaaggacagcacagcctacagccgtgctcaggaagtttctggatcctaggctcagctccacagaggagaacacgcaggcgcagagaccatggggcccctctcagcccctccctgcacacagcacatcacctggaagggggtcctgctcacagcatcacttttaaacttctggaacctgcctatcactgctcaagtcacgattgaagccctgccacccaaagtttccgaggggaaggatgttcttctacttgtccacaatttgcctcagaatcttgctggctacatctggtacaaaggacaactgatggacctctaccattacattacatcatatgtagtagacggtcaaataaatatatatgggcctgcatacactggacgagaaacagtatattccaatgcatccctgctgatccagaatgtcacccgggaagacgcaggatcctacaccttacacatcataaagcgaggtgataggactagaggagtaactggatatttcaccttcaacttatacctgaagctgcccaagccctacatcaccatcaacaactcaaaacccagggagaataaggatgtcttagccttcacctgtgaacctaagagtgagaactacacctacatttggtggctaaatggtcagagcctcccggtcagtcccagggtaaagcaacccattgaaaacaggatcctcattctacccagtgtcacgagaaatgaaacaggaccctatgaatgtgaaatacgggaccgagatggtggcatgcacagtgacccagtcaccctgaatgtcctctatggtccagacctccccagcatttacccttcattcacctattaccgttcaggagaaaacctctacttgtcctgcttcgcggaatctaacccaccggcagagtatttttggacaattaatgggaagtttcagcaatcaggacaaaagctctctatcccccaaattactacaaagcatagagggctctatacttgctctgttcgtaactcagccactggcaaggaaagctccaaatccatgacagtcgaagtctctgtttgtccagaagtggaattgctggatcaaatgctccttcaggaataggacgtcttcctctccttaatccaatatagcagccgtgaagtcatttctgtatttcaggaagactggcagacagttgctttgattcttcctcaaactacttacaatcacctacagtccaaaattgctttttcttcaaggagatttatggaaaagactctgacaaggactcttgaatacaagttcctgataacttcaagatcataccactggactaagaactttcaaaattttaatgaacaggctgataccttcatgaaattctagacaaagaagaaaaaaactccatgttattggactaaataatcaaaagcataatgttttcataattttctatttgaaaatgtgctgattctttgaatgttttattctccagatttatgaactttttttcttgagcaattggtaaagtatacttttgtaaacaaaaattgaaacatttgcttttgctctctatctgagtgccccagaattgggaaactattcatgagtattcatatgtttatggtaataaagttatctgcacaagttcaaaaaaaaaaaacaaacaacaaaaaaaaatttttgggnggcttgggccttggaaaaggtttcttaaaaccatttgtttgggggcnggggngcncattgggttantntnacacnggncnanaggngtcccagagaaaaccncggggcgagaacatagggctgtggattctccccccatataaaaaaacggcgcgggggacaacgcgaagcctttctggaccaaattccaagatgggattcgggggaccaaggggggtcctcccaagagggactccagggagccgaataaatagc

SEQ ID NO: 356415 - DNA, 1815 bp, Homo sapiens
  misc_feature (1)..(1): n is a, c, g, or t
  misc_feature (3)..(3): n is a, c, g, or t
  misc_feature (1560)..(1560): n is a, c, g, or t
  misc_feature (1607)..(1607): n is a, c, g, or t
  misc_feature (1612)..(1612): n is a, c, g, or t
  misc_feature (1615)..(1615): n is a, c, g, or t
  misc_feature (1626)..(1626): n is a, c, g, or t
  misc_feature (1628)..(1628): n is a, c, g, or t
  misc_feature (1630)..(1630): n is a, c, g, or t
  misc_feature (1635)..(1635): n is a, c, g, or t
  misc_feature (1638)..(1638): n is a, c, g, or t
  misc_feature (1640)..(1640): n is a, c, g, or t
  misc_feature (1642)..(1642): n is a, c, g, or t
  misc_feature (1646)..(1646): n is a, c, g, or t
  misc_feature (1662)..(1662): n is a, c, g, or t
ngngaaggaggaaggacagcacagcctacagccgtgctcaggaagtttctggatcctaggctcagctccacagaggagaacacgcaggcgcagagaccatggggcccctctcagcccctccctgcacacagcacatcacctggaagggggtcctgctcacagcatcacttttaaacttctggaacctgcctatcactgctcaagtcacgattgaagccctgccacccaaagtttccgaggggaaggatgttcttctacttgtccacaatttgcctcagaatcttgctggctacatctggtacaaaggacaactgatggacctctaccattacattacatcatatgtagtagacggtcaaataaatatatatgggcctgcatacactggacgagaaacagtatattccaatgcatccctgctgatccagaatgtcacccgggaagacgcaggatcctacaccttacacatcataaagcgaggtgataggactagaggagtaactggatatttcaccttcaacttatacctgaagctgcccaagccctacatcaccatcaacaactcaaaacccagggagaataaggatgtcttagccttcacctgtgaacctaagagtgagaactacacctacatttggtggctaaatggtcagagcctcccggtcagtcccagggtaaagcaacccattgaaaacaggatcctcattctacccagtgtcacgagaaatgaaacaggaccctatgaatgtgaaatacgggaccgagatggtggcatgcacagtgacccagtcaccctgaatgtcctctatggtccagacctccccagcatttacccttcattcacctattaccgttcaggagaaaacctctacttgtcctgcttcgcggaatctaacccaccggcagagtatttttggacaattaatgggaagtttcagcaatcaggacaaaagctctctatcccccaaattactacaaagcatagagggctctatacttgctctgttcgtaactcagccactggcaaggaaagctccaaatccatgacagtcgaagtctctgacagttgctttgattcttcctcaaactacttacaatcacctacagtccaaaattgctttttcttcaaggagatttatggaaaagactctgacaaggactcttgaatacaagttcctgataacttcaagatcataccactggactaagaactttcaaaattttaatgaacaggctgataccttcatgaaattctagacaaagaagaaaaaaactccatgttattggactaaataatcaaaagcataatgttttcataattttctatttgaaaatgtgctgattctttgaatgttttattctccagatttatgaactttttttcttgagcaattggtaaagtatacttttgtaaacaaaaattgaaacatttgcttttgctctctatctgagtgccccagaattgggaaactattcatgagtattcatatgtttatggtaataaagttatctgcacaagttcaaaaaaaaaaaacaaacaacaaaaaaaaatttttgggnggcttgggccttggaaaaggtttcttaaaaccatttgtttgggggcnggggngcncattgggttantntnacacnggncnanaggngtcccagagaaaaccncggggcgagaacatagggctgtggattctccccccatataaaaaaacggcgcgggggacaacgcgaagcctttctggaccaaattccaagatgggattcgggggaccaaggggggtcctcccaagagggactccagggagccgaataaatagc

SEQ ID NO: 356416 - DNA, 892 bp, Homo sapiens
  misc_feature (637)..(637): n is a, c, g, or t
  misc_feature (684)..(684): n is a, c, g, or t
  misc_feature (689)..(689): n is a, c, g, or t
  misc_feature (692)..(692): n is a, c, g, or t
  misc_feature (703)..(703): n is a, c, g, or t
  misc_feature (705)..(705): n is a, c, g, or t
  misc_feature (707)..(707): n is a, c, g, or t
  misc_feature (712)..(712): n is a, c, g, or t
  misc_feature (715)..(715): n is a, c, g, or t
  misc_feature (717)..(717): n is a, c, g, or t
  misc_feature (719)..(719): n is a, c, g, or t
  misc_feature (723)..(723): n is a, c, g, or t
  misc_feature (739)..(739): n is a, c, g, or t
cataactcagccactggcaaggaaatctccaaatccatgacagtcaaagtctctgctccttcaggaataggacgtcttcctctccttaatccaatatagcagccgtgaagtcatttctgtatttcaggaagactggcagacagttgctttgattcttcctcaaactacttacaatcacctacagtccaaaattgctttttcttcaaggagatttatggaaaagactctgacaaggactcttgaatacaagttcctgataacttcaagatcataccactggactaagaactttcaaaattttaatgaacaggctgataccttcatgaaattctagacaaagaagaaaaaaactccatgttattggactaaataatcaaaagcataatgttttcataattttctatttgaaaatgtgctgattctttgaatgttttattctccagatttatgaactttttttcttgagcaattggtaaagtatacttttgtaaacaaaaattgaaacatttgcttttgctctctatctgagtgccccagaattgggaaactattcatgagtattcatatgtttatggtaataaagttatctgcacaagttcaaaaaaaaaaaacaaacaacaaaaaaaaatttttgggnggcttgggccttggaaaaggtttcttaaaaccatttgtttgggggcnggggngcncattgggttantntnacacnggncnanaggngtcccagagaaaaccncggggcgagaacatagggctgtggattctccccccatataaaaaaacggcgcgggggacaacgcgaagcctttctggaccaaattccaagatgggattcgggggaccaaggggggtcctcccaagagggactccagggagccgaataaatagc

SEQ ID NO: 356417 - DNA, 1290 bp, Homo sapiens
actgactacttgtgggagagaaggaaaaaaagctaagtgcaaagaatcaagcctgatatgttagtttttaccaactgagatgcacccaagatgggattagacatacaagataatttatcagggaggacacctgtgagggaatgtggggcagacatgaaggcagtatgggagaacccacagaccactatgcagagctgattcctgtgaaaaagaaagagaaagaagttttaggtaccaatgcagttctaagagtttttgcaaggctgagggggagtcctccaaccagtcaccctttagagttaaagagagcctcagagaactaggcttgctttcacgcccttcctgggagcctgtgggaaagaagctttctgtgcaaaggaggtgatgaatgtgaaatgcacggacgtgggccttctgtcaatcagctccctgccatggagacctgacagagtctcattcatggctgccacaacagagagactgagaaaaagatgcaaccatgaaaaggtgaaaaggtggtaagttctaatgacatagaaaatagcaatcagcctttcttatgtctgaaagccttccaaaatatctgagtgcagtagagatttgacagaggactgatcaccatcctagaaacatggtgagagggaaaaaaaaaactgcaagaatataatcatctcccatcaatttcccaagaggaataatgtagtacttgaagaaacaattatagagtacctcatgctacatgcctcttcctgaggctcccccatgtaaaataacatcaccttcattccttctttacttttctttccatgacagctccttcaggaataggacgtcttcctctccttaatccaatatagcagccgtgaagtcatttctgtatttcaggaagactggcaggagatttatggaaaagactctgacaaggactcttgaatacaagttcctgataacttcaagatcataccactggactaagaactttcaaaattttaatgaacaggctgataccttcatgaaattctagacaaagaagaaaaaaactccatgttattggactaaataatcaaaagcataatgttttcataattttctatttgaaaatgtgctgattctttgaatgttttattctccagatttatgaactttttttcttgagcaattggtaaagtatacttttgtaaacaaaaattgaaacatttgcttttgctctctatctgagtgccccagaattgggaaactattcatgagtattcatatgtttatggtaataaagttatctgcacaagttca

SEQ ID NO: 356418 - DNA, 1209 bp, Homo sapiens
  misc_feature (1)..(1): n is a, c, g, or t
  misc_feature (3)..(3): n is a, c, g, or t
  misc_feature (1149)..(1149): n is a, c, g, or t
  misc_feature (1179)..(1179): n is a, c, g, or t
ngngaaggaggaaggacagcacagcctacagccgtgctcaggaagtttctggatcctaggctcagctccacagaggagaacacgcaggcgcagagaccatggggcccctctcagcccctccctgcacacagcacatcacctggaagggggtcctgctcacagcatcacttttaaacttctggaacctgcctatcactgctcaagtcacgattgaagccctgccacccaaagtttccgaggggaaggatgttcttctacttgtccacaatttgcctcagaatcttgctggctacatctggtacaaaggacaactgatggacctctaccattacattacatcatatgtagtagacggtcaaataaatatatatgggcctgcatacactggacgagaaacagtatattccaatgcatccctgctgatccagaatgtcacccgggaagacgcaggatcctacaccttacacatcataaagcgaggtgataggactagaggagtaactggatatttcaccttcaacttatacctgaagctgcccaagccctacatcaccatcaacaactcaaaacccagggagaataaggatgtcttagccttcacctgtgaacctaagagtgagaactacacctacatttggtggctaaatggtcagagcctcccggtcagtcccagggtaaagcaacccattgaaaacaggatcctcattctacccagtgtcacgagaaatgaaacaggaccctatgaatgtgaaatacgggaccgagatggtggcatgcacagtgacccagtcaccctgaatgtcctctatggtccagacctccccagcatttacccttcattcacctattaccgttcaggagaaaacctctacttgtcctgcttcgcggaatctaacccaccggcagagtatttttggacaattaatgggaagtttcagcaatcaggacaaaagctctctatcccccaaattactacaaagcatagagggctctatacttgctctgttcgtaactcagccactggcaaggaaagctccaaatccatgacagtcgaagtctctgctccttcaggaataggacgtcttcctctccttaatccaatatagcagccgtgaagtcatttctgtatttcaggaagactggcagacngttgctttgattcttcctcaaatactaacnatcacatcacgggggatcctctggaacagc

SEQ ID NO: 356419 - DNA, 1734 bp, Homo sapiens
  misc_feature (1)..(1): n is a, c, g, or t
  misc_feature (3)..(3): n is a, c, g, or t
ngngaaggaggaaggacagcacagcctacagccgtgctcaggaagtttctggatcctaggctcagctccacagaggagaacacgcaggcgcagagaccatggggcccctctcagcccctccctgcacacagcacatcacctggaagggggtcctgctcacagcatcacttttaaacttctggaacctgcctatcactgctcaagtcacgattgaagccctgccacccaaagtttccgaggggaaggatgttcttctacttgtccacaatttgcctcagaatcttgctggctacatctggtacaaaggacaactgatggacctctaccattacattacatcatatgtagtagacggtcaaataaatatatatgggcctgcatacactggacgagaaacagtatattccaatgcatccctgctgatccagaatgtcacccgggaagacgcaggatcctacaccttacacatcataaagcgaggtgataggactagaggagtaactggatatttcaccttcaacttatacctgaagctgcccaagccctacatcaccatcaacaactcaaaacccagggagaataaggatgtcttagccttcacctgtgaacctaagagtgagaactacacctacatttggtggctaaatggtcagagcctcccggtcagtcccagggtaaagcaacccattgaaaacaggatcctcattctacccagtgtcacgagaaatgaaacaggaccctatgaatgtgaaatacgggaccgagatggtggcatgcacagtgacccagtcaccctgaatgtcctctatggtccagacctccccagcatttacccttcattcacctattaccgttcaggagaaaacctctacttgtcctgcttcgcggaatctaacccaccggcagagtatttttggacaattaatgggaagtttcagcaatcaggacaaaagctctctatcccccaaattactacaaagcatagagggctctatacttgctctgttcgtaactcagccactggcaaggaaagctccaaatccatgacagtcgaagtctctgctccttcaggaataggacgtcttcctctccttaatccaatatagcagccgtgaagtcatttctgtatttcaggaagactggcaggcaacatctgacctcatggagaacggagactttaggattaacatgtgaacctgagactcagaacacaacctatgtgtggttgagatcttttcctgatgaccagttcatgtgttcaaaaaacatacagaaatgaagaaggcaaggtccctaccccaggagacataaagcctaagacaggaaatgagacctgaaaataatcatgataccaaaatagaaaaaattgaatgccacaagaaatcagagaaatctgatgggaaatagagctacacattggaatcactggaaagcatttttaaaagtggatgctcaagccccacccattagttccagtttaaaggtctggagagggaccaaggcattggtaatttttaagtcttccttgacactactaacatgtaacaaggatggagaactcttgttgtaataggtagaacttaaaactaaatgaatgattttcagctagaagtactggaattacctaaggacctttttcaacatacataagactatacatttttggccctatttatgaatgggctacaccaagaactcagtaatcctcttgagaaacagaagctgaatggaaaa

SEQ ID NO: 356420 - DNA, 1068 bp, Homo sapiens
  misc_feature (1)..(1): n is a, c, g, or t
  misc_feature (3)..(3): n is a, c, g, or t
ngngaaggaggaaggacagcacagcctacagccgtgctcaggaagtttctggatcctaggctcagctccacagaggagaacacgcaggcgcagagaccatggggcccctctcagcccctccctgcacacagcacatcacctggaagggggtcctgctcacagcatcacttttaaacttctggaacctgcctatcactgctcaagtcacgattgaagccctgccacccaaagtttccgaggggaaggatgttcttctacttgtccacaatttgcctcagaatcttgctggctacatctggtacaaaggacaactgatggacctctaccattacattacatcatatgtagtagacggtcaaataaatatatatgggcctgcatacactggacgagaaacagtatattccaatgcatccctgctgatccagaatgtcacccgggaagacgcaggatcctacaccttacacatcataaagcgaggtgataggactagaggagtaactggatatttcaccttcaacttatacctgaagctgcccaagccctacatcaccatcaacaactcaaaacccagggagaataaggatgtcttagccttcacctgtgaacctaagagtgagaactacacctacatttggtggctaaatggtcagagcctcccggtcagtcccagggtaaagcaacccattgaaaacaggatcctcattctacccagtgtcacgagaaatgaaacaggaccctatgaatgtgaaatacgggaccgagatggtggcatgcacagtgacccagtcaccctgaatgtcctctatggtccagacctccccagcatttacccttcattcacctattaccgttcaggagaaaacctctacttgtcctgcttcgcggaatctaacccaccggcagagtatttttggacaattaatgggaagtttcagcaatcaggacaaaagctctctatcccccaaattactacaaagcatagagggctctatacttgctctgttcgtaactcagccactggcaaggctaggacactggcgaggctagacactggcgaggctagga

SEQ ID NO: 356421 - DNA, 746 bp, Homo sapiens
attctttgaatgttttattctccagatttatgaactttttttcttgagcaattggtaaagtatacttttgtaaacaaaaattgaaacatttgcttttgctctctatctgagtgccccagaattgggaaactattcatgagtattcatatgtttatggtaataaagttatctgcacaagttcagtaaggatctgctctctttataacaggacacatttgaaaacattggttatattaccaaggctttgactgcgatgttatatttgagaatatatatagaataaacccatagggaatgcaggcaaagtctgaagtgggccttggtttggcttcctagtttcaagaggtttttggaagtttaatctgagattcttattaaaaacttctagcaaagagaagtttaaaaagagcctctattgtccattgctactctttccgcacttagctaaaaaatctgggcaagttcggtgagactcaacctattttgcaaacaaattcatcctactggaattatctttggtaaaaatagagactcctatagacagaaaaactatgttgaaaagaaaaactgtagtacacctgttaccagattgaaccactgttcattatctctgagtatttataatccactggtagactggactggaccctgaattcttttagttcttccaattcaattttctccaatgaaatcattaagaacaagagcggctctgttcctgaagccatataagttggaggtggaca

SEQ ID NO: 356422 - DNA, 1607 bp, Homo sapiens
  misc_feature (1)..(1): n is a, c, g, or t
  misc_feature (3)..(3): n is a, c, g, or t
ngngaaggaggaaggacagcacagcctacagccgtgctcaggaagtttctggatcctaggctcagctccacagaggagaacacgcaggcgcagagaccatggggcccctctcagcccctccctgcacacagcacatcacctggaagggggtcctgctcacagcatcacttttaaacttctggaacctgcctatcactgctcaagtcacgattgaagccctgccacccaaagtttccgaggggaaggatgttcttctacttgtccacaatttgcctcagaatcttgctggctacatctggtacaaaggacaactgatggacctctaccattacattacatcatatgtagtagacggtcaaataaatatatatgggcctgcatacactggacgagaaacagtatattccaatgcatccctgctgatccagaatgtcacccgggaagacgcaggatcctacaccttacacatcataaagcgaggtgataggactagaggagtaactggatatttcaccttcaacttatacctgaagctgcccaagccctacatcaccatcaacaactcaaaacccagggagaataaggatgtcttagccttcacctgtgaacctaagagtgagaactacacctacatttggtggctaaatggtcagagcctcccggtcagtcccagggtaaagcaacccattgaaaacaggatcctcattctacccagtgtcacgagaaatgaaacaggaccctatgaatgtgaaatacgggaccgagatggtggcatgcacagtgacccagtcaccctgaatgtcctctatggtccagacctccccagcatttacccttcattcacctattaccgttcaggagaaaacctctacttgtcctgcttcgcggaatctaacccaccggcagagtatttttggacaattaatgggaagtttcagcaatcaggacaaaagctctctatcccccaaattactacaaagcatagagggctctatacttgctctgttcgtaactcagccactggcaaggaaagctccaaatccatgacagtcgaagtctctgctccttcaggaataggacgtcttcctctccttaatccaatatagcagccgtgaagtcatttctgtatttcaggaagactggcagacagttgctttgattcttcctcaaactacttacaatcacctacagtccaaaattgctttttcttcaaggagatttatggaaaagactctgacaaggactcttgaatacaagttcctgataacttcaagatcataccactggactaagaactttcaaaattttaatgaacaggctgataccttcatgaaattctagacaaagaagaaaaaaactccatgttattggactaaataatcaaaagcataatgttttcataattttctatttgaaaatgtgctgattctttgaatgttttattctccagatttatgaactttttttcttgagcaattggtaaagtatacttttgtaaacaaaaattgaaacatttgcttttgctctctatctgagtgccccagaattgggaaactattcatgagtattcatatgtttatggtaataaagttatctgcacaagttca

SEQ ID NO: 356423 - DNA, 718 bp, Homo sapiens
  misc_feature (1)..(1): n is a, c, g, or t
  misc_feature (3)..(3): n is a, c, g, or t
ngngaaggaggaaggacagcacagcctacagccgtgctcaggaagtttctggatcctaggctcagctccacagaggagaacacgcaggcgcagagaccatggggcccctctcagcccctccctgcacacagcacatcacctggaagggggtcctgctcacagcatcacttttaaacttctggaacctgcctatcactgctcaagtcacgattgaagccctgccacccaaagtttccgaggggaaggatgttcttctacttgtccacaatttgcctcagaatcttgctggctacatctggtacaaaggacaactgatggacctctaccattacattacatcatatgtagtagacggtcaaataaatatatatgggcctgcatacactggacgagaaacagtatattccaatgcatccctgctgatccagaatgtcacccgggaagacgcaggatcctacaccttacacatcataaagcgaggtgataggactagaggagtaactggatatttcaccttcaacttataccaccctgctccagcacaggcccagcgagagacacacactcaggagctctcacataacaaatgaaggaatggaatgaagaaatgaatgatccaaaacctctttagagactggatgttggatgcagaatcctaggaggttctagccacacctgtcccttgtccttcagaggctgacatccatgtttcatcccc

SEQ ID NO: 356424 - DNA, 1539 bp, Homo sapiens
  misc_feature (1)..(1): n is a, c, g, or t
  misc_feature (3)..(3): n is a, c, g, or t
ngngaaggaggaaggacagcacagcctacagccgtgctcaggaagtttctggatcctaggctcagctccacagaggagaacacgcaggcgcagagaccatggggcccctctcagcccctccctgcacacagcacatcacctggaagggggtcctgctcacagcatcacttttaaacttctggaacctgcctatcactgctcaagtcacgattgaagccctgccacccaaagtttccgaggggaaggatgttcttctacttgtccacaatttgcctcagaatcttgctggctacatctggtacaaaggacaactgatggacctctaccattacattacatcatatgtagtagacggtcaaataaatatatatgggcctgcatacactggacgagaaacagtatattccaatgcatccctgctgatccagaatgtcacccgggaagacgcaggatcctacaccttacacatcataaagcgaggtgataggactagaggagtaactggatatttcaccttcaacttatacctgaagctgcccaagccctacatcaccatcaacaactcaaaacccagggagaataaggatgtcttagccttcacctgtgaacctaagagtgagaactacacctacatttggtggctaaatggtcagagcctcccggtcagtcccagggtaaagcaacccattgaaaacaggatcctcattctacccagtgtcacgagaaatgaaacaggaccctatgaatgtgaaatacgggaccgagatggtggcatgcacagtgacccagtcaccctgaatgtcctctatggtccagacctccccagcatttacccttcattcacctattaccgttcaggagaaaacctctacttgtcctgcttcgcggaatctaacccaccggcagagtatttttggacaattaatgggaagtttcagcaatcaggacaaaagctctctatcccccaaattactacaaagcatagagggctctatacttgctctgttcgtaactcagccactggcaaggaaagctccaaatccatgacagtcgaagtctctgctccttcaggaataggacgtcttcctctccttaatccaatatagcagccgtgaagtcatttctgtatttcaggaagactggcaggagatttatggaaaagactctgacaaggactcttgaatacaagttcctgataacttcaagatcataccactggactaagaactttcaaaattttaatgaacaggctgataccttcatgaaattctagacaaagaagaaaaaaactccatgttattggactaaataatcaaaagcataatgttttcataattttctatttgaaaatgtgctgattctttgaatgttttattctccagatttatgaactttttttcttgagcaattggtaaagtatacttttgtaaacaaaaattgaaacatttgcttttgctctctatctgagtgccccagaattgggaaactattcatgagtattcatatgtttatggtaataaagttatctgcacaagttca

SEQ ID NO: 356425 - DNA, 1407 bp, Homo sapiens
  misc_feature (109)..(109): n is a, c, g, or t
  misc_feature (1152)..(1152): n is a, c, g, or t
  misc_feature (1199)..(1199): n is a, c, g, or t
  misc_feature (1204)..(1204): n is a, c, g, or t
  misc_feature (1207)..(1207): n is a, c, g, or t
  misc_feature (1218)..(1218): n is a, c, g, or t
  misc_feature (1220)..(1220): n is a, c, g, or t
  misc_feature (1222)..(1222): n is a, c, g, or t
  misc_feature (1227)..(1227): n is a, c, g, or t
  misc_feature (1230)..(1230): n is a, c, g, or t
  misc_feature (1232)..(1232): n is a, c, g, or t
  misc_feature (1234)..(1234): n is a, c, g, or t
  misc_feature (1238)..(1238): n is a, c, g, or t
  misc_feature (1254)..(1254): n is a, c, g, or t
gtcctagcttcgccaatggtcctgcctgtcctagcctcgccagtgtcctagcctcgccagtgtcactagcctcgccagtgtcctagcctcgccagtgtcctagcctcgncagtgaacctaagagtgagaactacacctacatttggtggctaaatggtcagagcctccctgtcagtcccagggtaaagcgacccattgaaaacaggatcctcattctacccaatgtcacgagaaatgaaacaggaccttatcaatgtgaaatacgggaccgatatggtggcatccgcagtgacccagtcaccctgaatgtcctctatggtccagacctccccagcatttacccttcattcacctattaccgttcaggagaaaacctctacttgtcctgcttcgcggaatctaacccaccggcagagtatttttggacaattaatgggaagtttcagcaatcaggacaaaagctctctatcccccaaattactacaaagcatagagggctctatacttgctctgttcgtaactcagccactggcaaggaaagctccaaatccatgacagtcgaagtctctgctccttcaggaataggacgtcttcctctccttaatccaatatagcagccgtgaagtcatttctgtatttcaggaagactggcagacagttgctttgattcttcctcaaactacttacaatcacctacagtccaaaattgctttttcttcaaggagatttatggaaaagactctgacaaggactcttgaatacaagttcctgataacttcaagatcataccactggactaagaactttcaaaattttaatgaacaggctgataccttcatgaaattctagacaaagaagaaaaaaactccatgttattggactaaataatcaaaagcataatgttttcataattttctatttgaaaatgtgctgattctttgaatgttttattctccagatttatgaactttttttcttgagcaattggtaaagtatacttttgtaaacaaaaattgaaacatttgcttttgctctctatctgagtgccccagaattgggaaactattcatgagtattcatatgtttatggtaataaagttatctgcacaagttcaaaaaaaaaaaacaaacaacaaaaaaaaatttttgggnggcttgggccttggaaaaggtttcttaaaaccatttgtttgggggcnggggngcncattgggttantntnacacnggncnanaggngtcccagagaaaaccncggggcgagaacatagggctgtggattctccccccatataaaaaaacggcgcgggggacaacgcgaagcctttctggaccaaattccaagatgggattcgggggaccaaggggggtcctcccaagagggactccagggagccgaataaatagc

SEQ ID NO: 356426 - DNA, 1365 bp, Homo sapiens
  misc_feature (1)..(1): n is a, c, g, or t
  misc_feature (3)..(3): n is a, c, g, or t
  misc_feature (1110)..(1110): n is a, c, g, or t
  misc_feature (1157)..(1157): n is a, c, g, or t
  misc_feature (1162)..(1162): n is a, c, g, or t
  misc_feature (1165)..(1165): n is a, c, g, or t
  misc_feature (1176)..(1176): n is a, c, g, or t
  misc_feature (1178)..(1178): n is a, c, g, or t
  misc_feature (1180)..(1180): n is a, c, g, or t
  misc_feature (1185)..(1185): n is a, c, g, or t
  misc_feature (1188)..(1188): n is a, c, g, or t
  misc_feature (1190)..(1190): n is a, c, g, or t
  misc_feature (1192)..(1192): n is a, c, g, or t
  misc_feature (1196)..(1196): n is a, c, g, or t
  misc_feature (1212)..(1212): n is a, c, g, or t
ngngaaggaggaaggacagcacagcctacagccgtgctcaggaagtttctggatcctaggctcagctccacagaggagaacacgcaggcgcagagaccatggggcccctctcagcccctccctgcacacagcacatcacctggaagggggtcctgctcacagcatcacttttaaacttctggaacctgcctatcactgctcaagtcacgattgaagccctgccacccaaagtttccgaggggaaggatgttcttctacttgtccacaatttgcctcagaatcttgctggctacatctggtacaaaggacaactgatggacctctaccattacattacatcatatgtagtagacggtcaaataaatatatatgggcctgcatacactggacgagaaacagtatattccaatgcatccctgctgatccagaatgtcacccgggaagacgcaggatcctacaccttacacatcataaagcgaggtgataggactagaggagtaactggatatttcaccttcaacttataccctccttcaggaataggacgtcttcctctccttaatccaatatagcagccgtgaagtcatttctgtatttcaggaagactggcagacagttgctttgattcttcctcaaactacttacaatcacctacagtccaaaattgctttttcttcaaggagatttatggaaaagactctgacaaggactcttgaatacaagttcctgataacttcaagatcataccactggactaagaactttcaaaattttaatgaacaggctgataccttcatgaaattctagacaaagaagaaaaaaactccatgttattggactaaataatcaaaagcataatgttttcataattttctatttgaaaatgtgctgattctttgaatgttttattctccagatttatgaactttttttcttgagcaattggtaaagtatacttttgtaaacaaaaattgaaacatttgcttttgctctctatctgagtgccccagaattgggaaactattcatgagtattcatatgtttatggtaataaagttatctgcacaagttcaaaaaaaaaaaacaaacaacaaaaaaaaatttttgggnggcttgggccttggaaaaggtttcttaaaaccatttgtttgggggcnggggngcncattgggttantntnacacnggncnanaggngtcccagagaaaaccncggggcgagaacatagggctgtggattctccccccatataaaaaaacggcgcgggggacaacgcgaagcctttctggaccaaattccaagatgggattcgggggaccaaggggggtcctcccaagagggactccagggagccgaataaatagc

SEQ ID NO: 356427 - DNA, 1523 bp, Homo sapiens
  misc_feature (1)..(1): n is a, c, g, or t
  misc_feature (3)..(3): n is a, c, g, or t
ngngaaggaggaaggacagcacagcctacagccgtgctcaggaagtttctggatcctaggctcagctccacagaggagaacacgcaggcgcagagaccatggggcccctctcagcccctccctgcacacagcacatcacctggaagggggtcctgctcacagcatcacttttaaacttctggaacctgcctatcactgctcaagtcacgattgaagccctgccacccaaagtttccgaggggaaggatgttcttctacttgtccacaatttgcctcagaatcttgctggctacatctggtacaaaggacaactgatggacctctaccattacattacatcatatgtagtagacggtcaaataaatatatatgggcctgcatacactggacgagaaacagtatattccaatgcatccctgctgatccagaatgtcacccgggaagacgcaggatcctacaccttacacatcataaagcgaggtgataggactagaggagtaactggatatttcaccttcaacttatacctgaagctgcccaagccctacatcaccatcaacaactcaaaacccagggagaataaggatgtcttagccttcacctgtgaacctaagagtgagaactacacctacatttggtggctaaatggtcagagcctcccggtcagtcccagggtaaagcaacccattgaaaacaggatcctcattctacccagtgtcacgagaaatgaaacaggaccctatgaatgtgaaatacgggaccgagatggtggcatgcacagtgacccagtcaccctgaatgtcctctatggtccagacctccccagcatttacccttcattcacctattaccgttcaggagaaaacctctacttgtcctgcttcgcggaatctaacccaccggcagagtatttttggacaattaatgggaagtttcagcaatcaggacaaaagctctctatcccccaaattactacaaagcatagagggctctatacttgctctgttcgtaactcagccactggcaaggaaagctccaaatccatgacagtcgaagtctctgacagttgctttgattcttcctcaaactacttacaatcacctacagtccaaaattgctttttcttcaaggagatttatggaaaagactctgacaaggactcttgaatacaagttcctgataacttcaagatcataccactggactaagaactttcaaaattttaatgaacaggctgataccttcatgaaattctagacaaagaagaaaaaaactccatgttattggactaaataatcaaaagcataatgttttcataattttctatttgaaaatgtgctgattctttgaatgttttattctccagatttatgaactttttttcttgagcaattggtaaagtatacttttgtaaacaaaaattgaaacatttgcttttgctctctatctgagtgccccagaattgggaaactattcatgagtattcatatgtttatggtaataaagttatctgcacaagttca

SEQ ID NO: 356428 - DNA, 1830 bp, Homo sapiens
  misc_feature (1)..(1): n is a, c, g, or t
  misc_feature (3)..(3): n is a, c, g, or t
  misc_feature (1519)..(1520): n is a, c, g, or t
  misc_feature (1524)..(1524): n is a, c, g, or t
  misc_feature (1526)..(1526): n is a, c, g, or t
  misc_feature (1531)..(1531): n is a, c, g, or t
  misc_feature (1538)..(1538): n is a, c, g, or t
  misc_feature (1549)..(1549): n is a, c, g, or t
  misc_feature (1551)..(1551): n is a, c, g, or t
  misc_feature (1567)..(1569): n is a, c, g, or t
  misc_feature (1573)..(1573): n is a, c, g, or t
  misc_feature (1578)..(1578): n is a, c, g, or t
  misc_feature (1583)..(1583): n is a, c, g, or t
  misc_feature (1587)..(1588): n is a, c, g, or t
  misc_feature (1592)..(1595): n is a, c, g, or t
  misc_feature (1598)..(1599): n is a, c, g, or t
  misc_feature (1603)..(1603): n is a, c, g, or t
  misc_feature (1608)..(1608): n is a, c, g, or t
  misc_feature (1610)..(1610): n is a, c, g, or t
  misc_feature (1614)..(1614): n is a, c, g, or t
  misc_feature (1616)..(1616): n is a, c, g, or t
  misc_feature (1626)..(1626): n is a, c, g, or t
  misc_feature (1630)..(1631): n is a, c, g, or t
  misc_feature (1647)..(1648): n is a, c, g, or t
ngngaaggaggaaggacagcacagcctacagccgtgctcaggaagtttctggatcctaggctcagctccacagaggagaacacgcaggcgcagagaccatggggcccctctcagcccctccctgcacacagcacatcacctggaagggggtcctgctcacagcatcacttttaaacttctggaacctgcctatcactgctcaagtcacgattgaagccctgccacccaaagtttccgaggggaaggatgttcttctacttgtccacaatttgcctcagaatcttgctggctacatctggtacaaaggacaactgatggacctctaccattacattacatcatatgtagtagacggtcaaataaatatatatgggcctgcatacactggacgagaaacagtatattccaatgcatccctgctgatccagaatgtcacccgggaagacgcaggatcctacaccttacacatcataaagcgaggtgataggactagaggagtaactggatatttcaccttcaacttatacctgaagctgcccaagccctacatcaccatcaacaactcaaaacccagggagaataaggatgtcttagccttcacctgtgaacctaagagtgagaactacacctacatttggtggctaaatggtcagagcctcccggtcagtcccagggtaaagcaacccattgaaaacaggatcctcattctacccagtgtcacgagaaatgaaacaggaccctatgaatgtgaaatacgggaccgagatggtggcatgcacagtgacccagtcaccctgaatgtcctctatggtccagacctccccagcatttacccttcattcacctattaccgttcaggagaaaacctctacttgtcctgcttcgcggaatctaacccaccggcagagtatttttggacaattaatgggaagtttcagcaatcaggacaaaagctctctatcccccaaattactacaaagcatagagggctctatacttgctctgttcgtaactcagccactggcaaggaaagctccaaatccatgacagtcgaagtctctggtaagtggatcccagcatccttggcaatagggttttaggtggagtctacctggctttcagagaagagttaggaaaacatttttattcccagcctgtgtcccatgggcacaagcaaatcccaaattctcctcctgaacccttccaatttgtctctacagactctcttctccttgtttttctgttttctcatggctgaccttgtgtctggcctaagaaagttagggagggggctttatcagccctgagccctatgtggtagaggaggcttcacagagggatgagaaggagagtcctcaagatcaagttgcttctcgatgtcaccaacacatccccttctgccatgtctttgtttccttgtacctattccatgagctacaaggaacatctgaggctctgaaacaagctcacacttttcccccaaatgagacgaggaagccccttgggtgagggaggaccnncccncnccccnccccccnccctcgccccncncccccccgcgcgaccnnncccnccccncccancccnncccnnnnccnncacnccccnanaaananccctcgcgcncccnnccccgaattccgcccnnatcgagctgccagttgaagccaagcctcccccgggccaggctgcagggaaataagaagagagggagcctcagggaagactcctgcgttgcgtcctggctctgaagtcaccggttgtatgaggttgtgggcacagcatgtgggacacagcacggaggatagtgactgatgcagagctggagaa

SEQ ID NO: 356429 - DNA, 619 bp, Homo sapiens
  misc_feature (1)..(1): n is a, c, g, or t
  misc_feature (3)..(3): n is a, c, g, or t
ngngaaggaggaaggacagcacagcctacagccgtgctcaggaagtttctggatcctaggctcagctccacagaggagaacacgcaggcgcagagaccatggggcccctctcagcccctccctgcacacagcacatcacctggaagggggtcctgctcacagcatcacttttaaacttctggaacctgcctatcactgctcaagtcacgattgaagccctgccacccaaagtttccgaggggaaggatgttcttctacttgtccacaatttgcctcagaatcttgctggctacatctggtacaaaggacaactgatggacctctaccattacattacatcatatgtagtagacggtcaaataaatatatatgggcctgcatacactggacgagaaacagtatattccaatgcatccctgctgatccagaatgtcacccgggaagacgcaggatcctacaccttacacatcataaagcgaggtgataggactagaggagtaactggagaaaatccacacagacatggggaaaaggtgcaaatttcacaaagacattagcctcaaccatgaattaattttttttcccatcaacattataacaaagtaacattatctgagca

SEQ ID NO: 356430 - DNA, 1123 bp, Homo sapiens
tgccccggcaaccgcgccgcccgcggcacgttccggccgctcaccccgcccaagggccgtgcgtacgtgcgtcgtctctatggtggcggcggatttggagggaccctacgaaccaggagtcaggcgagccgatctggggctgcaggtgttacctctgatctaggccgggggcttcagggatccgagccgagggagaaagccttgggggcttcatcacacttatttggctcgcgggcttggggccatcgggtggtcctgtgtcatccccattcctcctctgcgattcccccgtcgccccaaaacagccctgggactcccctgtcttgctcctcgagaccctcccccatcaccgtcctctgggcaccccatcctatgacccagtctcaggcatcttccgaaatgctcgatgatagccgccctcgggcatctccgctgcgtctgtttgtagcgcgcctggtgattcggctgcacccccacacaggatgttccgctgggagcgctccattcccctgcgaggctcggccgccgccctgtgcaacaacctcagtgtgctgcagctgccggctcgcaacctcacgtattttggcgtggttcatggaccaagcgcccagcttctcagcgctgctcctgagggtgtgcccttggcccagcgccagctccacgctaaggagggtgctggagtgagtcccccacttatcactcaggtgaggcatggagctgggagtgatgttgctgaacccagtcctacccccagccttttctctccaaaccttcaggagcaggcatgtcctaacctcagaatctccccaggcatgtcctaacctcagaatctcccctctcctgccgggcgcggtggctcacgcctgtaatcccaacactttgggaggctgagacgggcacttgaggccaggagttcgagaccagcctggccaacatggtgaaacctcttctctactaagaatacaaaaaaaattaaccgggtgtggtggcgtgcacctgtaatcccagctacttgggtggctgaggcaggagaatcgcttgaacccaggaggctgaggttgcagtgagccgagatggcgccactgcactccagcctgggccacagagcaagactccgtcccca

SEQ ID NO: 356431 - DNA, 1541 bp, Homo sapiens
tgccccggcaaccgcgccgcccgcggcacgttccggccgctcaccccgcccaagggccgtgcgtacgtgcgtcgtctctatggtggcggcggatttggagggaccctacgaaccaggagtcaggcgagccgatctggggctgcaggtgttacctctgatctaggccgggggcttcagggatccgagccgagggagaaagccttgggggcttcatcacacttatttggctcgcgggcttggggccatcgggtggtcctgtgtcatccccattcctcctctgcgattcccccgtcgccccaaaacagccctgggactcccctgtcttgctcctcgagaccctcccccatcaccgtcctctgggcaccccatcctatgacccagtctcaggcatcttccgaaatgctcgatgatagccgccctcgggcatctccgctgcgtctgtttgtagcgcgcctggtgattcggctgcacccccacacaggatgttccgctgggagcgctccattcccctgcgaggctcggccgccgccctgtgcaacaacctcagtgtgctgcagctgccggctcgcaacctcacgtattttggcgtggttcatggaccaagcgcccagcttctcagcgctgctcctgagggtgtgcccttggcccagcgccagctccacgctaaggagggtgctggagtgagtcccccacttatcactcaggtccactggtgtgtcctccccttccgagtgctgctggtactcacctcacatcgaggaatacagatgtacgagtccaatggctacaccatggtctactggcatgcactggactctggagatgcctccccagtacaggctgtgtttgcccggggaattgctgccagtggccacttcatctgtgtgggaacgtggtcaggccgggtgctggtgtttgacatcccagcaaagggtcccaacattgtactgagcgaggagctggctgggcaccagatgccaatcacagacattgccaccgagcctgcccagggacaggattgtgtggctgacatggtgacggcagatgactcaggcttgctgtgtgtctggcggtcagggccagaattcacattattgacccgcattccaggatttggagttccgtgcccctctgtgcagctgtggcaggggatcatagcagcaggctatgggaacggacaagtgcatctatatgaggccactacaggaaatctacatgtccagatcaatgcccatgcccgggccatctgcgccctggacctggcttctgaggtgggcaagctactctctgcaggtgaggacacctttgtgcatatctggaagctgagcagaaacccagagagtggctacattgaggtggaacactgtcatggtgagtgtgtcgccgacacccagctgtgtggtgctcgattttgtgattcctcaggcaactcctttgctgtgactggctatgaccttgcggagatccggagattcagcagtgtgtgagaagagcagccttcctttgtccctgtggtattcataaagtacccgctccaccca

SEQ ID NO: 356432 - DNA, 982 bp, Homo sapiens
tgccccggcaaccgcgccgcccgcggcacgttccggccgctcaccccgcccaagggccgtgcgtacgtgcgtcgtctctatggtggcggcggatttggagggaccctacgaaccaggagtcaggcgagccgatctggggctgcaggtccactggtgtgtcctccccttccgagtgctgctggtactcacctcacatcgaggaatacagatgtacgagtccaatggctacaccatggtctactggcatgcactggactctggagatgcctccccagtacaggctgtgtttgcccggggaattgctgccagtggccacttcatctgtgtgggaacgtggtcaggccgggtgctggtgtttgacatcccagcaaagggtcccaacattgtactgagcgaggagctggctgggcaccagatgccaatcacagacattgccaccgagcctgcccagggacaggattgtgtggctgacatggtgacggcagatgactcaggcttgctgtgtgtctggcggtcagggccagaattcacattattgacccgcattccaggatttggagttccgtgcccctctgtgcagctgtggcaggggatcatagcagcaggctatgggaacggacaagtgcatctatatgaggccactacaggaaatctacatgtccagatcaatgcccatgcccgggccatctgcgccctggacctggcttctgaggtgggcaagctactctctgcaggtgaggacacctttgtgcatatctggaagctgagcagaaacccagagagtggctacattgaggtggaacactgtcatggtgagtgtgtcgccgacacccagctgtgtggtgctcgattttgtgattcctcaggcaactcctttgctgtgactggctatgaccttgcggagatccggagattcagcagtgtgtgagaagagcagccttcctttgtccctgtggtattcataaagtacccgctccaccca

SEQ ID NO: 356433 - DNA, 1021 bp, Homo sapiens
tgccccggcaaccgcgccgcccgcggcacgttccggccgctcaccccgcccaagggccgtgcgtacgtgcgtcgtctctatggtggcggcggatttggagggaccctacgaaccaggagtcaggcgagccgatctggggctgcaggatgttccgctgggagcgctccattcccctgcgaggctcggccgccgccctgtgcaacaacctcagtgtgctgcagctgccggctcgcaacctcacgtattttggcgtggttcatggaccaagcgcccagcttctcagcgctgctcctgagggtgtgcccttggcccagcgccagctccacgctaaggagggtgctggagtgagtcccccacttatcactcaggaacgtggtcaggccgggtgctggtgtttgacatcccagcaaagggtcccaacattgtactgagcgaggagctggctgggcaccagatgccaatcacagacattgccaccgagcctgcccagggacaggattgtgtggctgacatggtgacggcagatgactcaggcttgctgtgtgtctggcggtcagggccagaattcacattattgacccgcattccaggatttggagttccgtgcccctctgtgcagctgtggcaggggatcatagcagcaggctatgggaacggacaagtgcatctatatgaggccactacaggaaatctacatgtccagatcaatgcccatgcccgggccatctgcgccctggacctggcttctgaggtgggcaagctactctctgcaggtgaggacacctttgtgcatatctggaagctgagcagaaacccagagagtggctacattgaggtggaacactgtcatggtgagtgtgtcgccgacacccagctgtgtggtgctcgattttgtgattcctcaggcaactcctttgctgtgactggctatgaccttgcggagatccggagattcagcagtgtgtgagaagagcagccttcctttgtccctgtggtattcataaagtacccgctccaccca

SEQ ID NO: 356434 - DNA, 978 bp, Homo sapiens
cctcttgagaacagggtgtatattttcttattcatattctccattgtacctggcatagggctaggcccataggttgtgttggctgcctggtgttgggggtgcaggggcccagggtctagtcatgactgtgactggttcactacgagacctccagaaggtcacgacactgtggcctcagttttatcatccatccagtgaggcaattatgcaccccctcctaatgttattgggggatgggactccatgaagaaattcaaggaaagcagttcatgcttcccaagggaaccctggtggtaggggtggtttctgatgggtctagctagtgagagctccacaccttgccctttccctggagaggcaaagatgcacacactgcctcccttcccctcctgccctgtatacaggaccatagcaggggagaaagggaagggttgatcttgcctttcccttcaggattgtgtggctgacatggtgacggcagatgactcaggcttgctgtgtgtctggcggtcagggccagaattcacattattgacccgcattccaggatttggagttccgtgcccctctgtgcagctgtggcaggggatcatagcagcaggctatgggaacggacaagtgcatctatatgaggccactacaggaaatctacatgtccagatcaatgcccatgcccgggccatctgcgccctggacctggcttctgaggtgggcaagctactctctgcaggtgaggacacctttgtgcatatctggaagctgagcagaaacccagagagtggctacattgaggtggaacactgtcatggtgagtgtgtcgccgacacccagctgtgtggtgctcgattttgtgattcctcaggcaactcctttgctgtgactggctatgaccttgcggagatccggagattcagcagtgtgtgagaagagcagccttcctttgtccctgtggtattcataaagtacccgctccaccca

SEQ ID NO: 356435 - DNA, 448 bp, Homo sapiens
caggaccatagcaggggagaaagggaagggttgatcttgcctttcccttcaggattgtgtggctgacatggtgacggcagatgactcaggcttgctgtgtgtctggcggtcagggccagaattcacattattgacccgcattccaggatttgggtaggtgaggcagaaagggtagagggcttcctgagatagcttcaggctggggagtaggatttgatctgggcaaaacaaagttgggtgtcacccttgcagagttccgtgcccctctgtgcagctgtggcaggggatcatagcagcaggctatgggaacggacaagtgcatctatatgaggccactacaggaaatctacatgtccagatcaatgcccatgcccgggccatctgcgccctggacctggcttctgaggtgggcaaggtaagtctcctcctctgtacctacatacccttt

SEQ ID NO: 356436 - DNA, 504 bp, Homo sapiens
tgatctgggcaaaacaaagttgggtgtcacccttgcagagttccgtgcccctctgtgcagctgtggcaggggatcatagcagcaggctatgggaacggacaagtgcatctatatgaggccactacaggaaatctacatgtccagatcaatgcccatgcccgggccatctgcgccctggacctggcttctgaggtgggcaaggtaagtctcctcctctgtacctacataccctttttcctggcagtggaatgttgagagaacaccacaggcttgtctttgcaactcagtgtagccccctcccctggggcacctggactggggattccagcttatagctgtcccgtcagggcattctgactccccctcttcctcctccacagctactctctgcaggtgaggacacctttgtgcatatctggaagctgagcagaaacccagagagtggctacattgaggtatgtgtcatggggtgggtggaatgggggggcccaagcatggggcagc

SEQ ID NO: 356437 - DNA, 1205 bp, Homo sapiens
tgccccggcaaccgcgccgcccgcggcacgttccggccgctcaccccgcccaagggccgtgcgtacgtgcgtcgtctctatggtggcggcggatttggagggaccctacgaaccaggagtcaggcgagccgatctggggctgcaggatgttccgctgggagcgctccattcccctgcgaggctcggccgccgccctgtgcaacaacctcagtgtgctgcagctgccggctcgcaacctcacgtattttggcgtggttcatggaccaagcgcccagcttctcagcgctgctcctgagggtgtgcccttggcccagcgccagctccacgctaaggagggtgctggagtgagtcccccacttatcactcaggtccactggtgtgtcctccccttccgagtgctgctggtactcacctcacatcgaggaatacagatgtacgagtccaatggctacaccatggtctactggcatgcactggactctggagatgcctccccagtacaggctgtgtttgcccggggaattgctgccagtggccacttcatctgtgtgggaacgtggtcaggccgggtgctggtgtttgacatcccagcaaagggtcccaacattgtactgagcgaggagctggctgggcaccagatgccaatcacagacattgccaccgagcctgcccagggacaggattgtgtggctgacatggtgacggcagatgactcaggcttgctgtgtgtctggcggtcagggccagaattcacattattgacccgcattccaggatttggagttccgtgcccctctgtgcagctgtggcaggggatcatagcagcaggctatgggaacggacaagtgcatctatatgaggccactacaggaaatctacatgtccagatcaatgcccatgcccgggccatctgcgccctggacctggcttctgaggtgggcaagctactctctgcaggtgaggacacctttgtgcatatctggaagctgagcagaaacccagagagtggctacattgaggtggaacactgtcatggtgagtgtgtcgccgacacccagctgtgtggtgctcgattttgtgattcctcaggcaactcctttgctgtgactggctatgaccttgcggagatccggagattcagcagtgtgtgagaagagcagccttcctttgtccctgtggtattcataaagtacccgctccaccca

SEQ ID NO: 356438 - DNA, 1911 bp, Homo sapiens
tgccccggcaaccgcgccgcccgcggcacgttccggccgctcaccccgcccaagggccgtgcgtacgtgcgtcgtctctatggtggcggcggatttggagggaccctacgaaccaggagtcaggcgagccgatctggggctgcaggatgttccgctgggagcgctccattcccctgcgaggctcggccgccgccctgtgcaacaacctcagtgtgctgcagctgccggctcgcaacctcacgtattttggcgtggttcatggaccaagcgcccagcttctcagcgctgctcctgagggtgtgcccttggcccagcgccagctccacgctaaggagggtgctggagtgagtcccccacttatcactcaggtccactggtgtgtcctccccttccgagtgctgctggtactcacctcacatcgaggaatacagatgtacgagtccaatggctacaccatggtctactggcatgcactggactctggagatgcctccccagtacaggctgtgtttgcccggggaattgctgccagtggccacttcatctgtgtgggaacgtggtcaggccgggtgctggtgtttgacatcccagcaaagggtcccaacattgtactgagcgaggagctggctgggcaccagatgccaatcacagacattgccaccgagcctgcccagggacaggattgtgtggctgacatggtgacggcagatgactcaggcttgctgtgtgtctggcggtcagggccagaattcacattattgacccgcattccaggatttggagttccgtgcccctctgtgcagctgtggcaggggatcatagcagcaggctatgggaacggacaagtgcatctatatgaggccactacaggaaatctacatgtccagatcaatgcccatgcccgggccatctgcgccctggacctggcttctgaggtgggcaagctactctctgcaggtgaggacacctttgtgcatatctggaagctgagcagaaacccagagagtggctacattgaggtggaacactgtcatggtgagtgtgtcgccgacacccagctgtgtggtgctcgattttgtgattcctcaggcaactcctttgctgtgactggctatgaccttgcggagatccggagattcagcagtgtgtgagaagagcagccttcctttgtccctgtggtattcataaagtacccgctccacccaaaaaaaaaaaaaaaaaaaaaaaaaaaaaaaaaaaaaaaaaaaaaaaaaaaaaaaaaaaaaaaaaaaaaggggggggggggcaaaatctccgcggggggcggaccaccgttgagtcagacccggatggtgtgttatgtcaacacaagggggggggcccaatgggggcgggggtcgcatctaaattacacgacgagagcggccggcggcgatgaaaacacaacacggtggcgagagcgcgggaaacaaccgccggagccagagggcatcctggcgaacgaggcagagaccacaactaggcgggcgggggaccgaggcacacggggggccacaccaccaaccaaggaagatccaaaggcgcgacggggacaaaacactatcgggcggtgcatagagggggaccaccaccaagcggaacaatctccgggggggcggaagaaccttggcccagcgagcgattagtggccggcacaattatacccgagcgcgggtgaccgagaaaaccgcagcaacccatgaaacacagccgggcataaaacagactgacacagtggcgagcaatgcagcagacagaagacaacaaggaggagaagacacaacggacagacgcaatgcaagacgccaacaacagagacagcggacacacacagtcgacaacagcggacgcgcaggaccatgaacagaaacaaccagcaagagagaacacgag

SEQ ID NO: 356439 - DNA, 1183 bp, Homo sapiens
tgccccggcaaccgcgccgcccgcggcacgttccggccgctcaccccgcccaagggccgtgcgtacgtgcgtcgtctctatggtggcggcggatttggagggaccctacgaaccaggagtcaggatgttccgctgggagcgctccattcccctgcgaggctcggccgccgccctgtgcaacaacctcagtgtgctgcagctgccggctcgcaacctcacgtattttggcgtggttcatggaccaagcgcccagcttctcagcgctgctcctgagggtgtgcccttggcccagcgccagctccacgctaaggagggtgctggagtgagtcccccacttatcactcaggtccactggtgtgtcctccccttccgagtgctgctggtactcacctcacatcgaggaatacagatgtacgagtccaatggctacaccatggtctactggcatgcactggactctggagatgcctccccagtacaggctgtgtttgcccggggaattgctgccagtggccacttcatctgtgtgggaacgtggtcaggccgggtgctggtgtttgacatcccagcaaagggtcccaacattgtactgagcgaggagctggctgggcaccagatgccaatcacagacattgccaccgagcctgcccagggacaggattgtgtggctgacatggtgacggcagatgactcaggcttgctgtgtgtctggcggtcagggccagaattcacattattgacccgcattccaggatttggagttccgtgcccctctgtgcagctgtggcaggggatcatagcagcaggctatgggaacggacaagtgcatctatatgaggccactacaggaaatctacatgtccagatcaatgcccatgcccgggccatctgcgccctggacctggcttctgaggtgggcaagctactctctgcaggtgaggacacctttgtgcatatctggaagctgagcagaaacccagagagtggctacattgaggtggaacactgtcatggtgagtgtgtcgccgacacccagctgtgtggtgctcgattttgtgattcctcaggcaactcctttgctgtgactggctatgaccttgcggagatccggagattcagcagtgtgtgagaagagcagccttcctttgtccctgtggtattcataaagtacccgctccaccca

SEQ ID NO: 356440 - DNA, 1110 bp, Homo sapiens
tgccccggcaaccgcgccgcccgcggcacgttccggccgctcaccccgcccaagggccgtgcgtacgtgcgtcgtctctatggtggcggcggatttggagggaccctacgaaccaggagtcaggcgagccgatctggggctgcaggtccactggtgtgtcctccccttccgagtgctgctggtactcacctcacatcgaggaatacaggataaaaatagtacctacatcccagatttgttttgaggattaaatgggctaaggctaacacggatatgtgaagtactcagcagaggtcagttgggttatgccccctggttcttgccccggtcttccagatgtacgagtccaatggctacaccatggtctactggcatgcactggactctggagatgcctccccagtacaggctgtgtttgcccggggaattgctgccagtggccacttcatctgtgtgggaacgtggtcaggccgggtgctggtgtttgacatcccagcaaagggtcccaacattgtactgagcgaggagctggctgggcaccagatgccaatcacagacattgccaccgagcctgcccagggacaggattgtgtggctgacatggtgacggcagatgactcaggcttgctgtgtgtctggcggtcagggccagaattcacattattgacccgcattccaggatttggagttccgtgcccctctgtgcagctgtggcaggggatcatagcagcaggctatgggaacggacaagtgcatctatatgaggccactacaggaaatctacatgtccagatcaatgcccatgcccgggccatctgcgccctggacctggcttctgaggtgggcaagctactctctgcaggtgaggacacctttgtgcatatctggaagctgagcagaaacccagagagtggctacattgaggtggaacactgtcatggtgagtgtgtcgccgacacccagctgtgtggtgctcgattttgtgattcctcaggcaactcctttgctgtgactggctatgaccttgcggagatccggagattcagcagtgtgtgagaagagcagccttcctttgtccctgtggtattcataaagtacccgctccaccca

SEQ ID NO: 356441 - DNA, 1783 bp, Homo sapiens
cctcttgagaacagggtgtatattttcttattcatattctccattgtacctggcatagggctaggcccataggttgtgttggctgcctggtgttgggggtgcaggggcccagggtctagtcatgactgtgactggttcactacgagacctccagaaggtcacgacactgtggcctcagttttatcatccatccagtgaggcaattatgcaccccctcctaatgttattgggggatgggactccatgaagaaattcaaggaaagcagttcatgcttcccaagggaaccctggtggtaggggtggtttctgatgggtctagctagtgagagctccacaccttgccctttccctggagaggcaaagatgcacacactgcctcccttcccctcctgccctgtatacaggaccatagcaggggagaaagggaagggttgatcttgcctttcccttcaggattgtgtggctgacatggtgacggcagatgactcaggcttgctgtgtgtctggcggtcagggccagaattcacattattgacccgcattccaggatttgggtaggtgaggcagaaagggtagagggcttcctgagatagcttcaggctggggagtaggatttgatctgggcaaaacaaagttgggtgtcacccttgcagagttccgtgcccctctgtgcagctgtggcaggggatcatagcagcaggctatgggaacggacaagtgcatctatatgaggccactacaggaaatctacatgtccagatcaatgcccatgcccgggccatctgcgccctggacctggcttctgaggtgggcaagctactctctgcaggtgaggacacctttgtgcatatctggaagctgagcagaaacccagagagtggctacattgaggtggaacactgtcatggtgagtgtgtcgccgacacccagctgtgtggtgctcgattttgtgattcctcaggcaactcctttgctgtgactggctatgaccttgcggagatccggagattcagcagtgtgtgagaagagcagccttcctttgtccctgtggtattcataaagtacccgctccacccaaaaaaaaaaaaaaaaaaaaaaaaaaaaaaaaaaaaaaaaaaaaaaaaaaaaaaaaaaaaaaaaaaaaaggggggggggggcaaaatctccgcggggggcggaccaccgttgagtcagacccggatggtgtgttatgtcaacacaagggggggggcccaatgggggcgggggtcgcatctaaattacacgacgagagcggccggcggcgatgaaaacacaacacggtggcgagagcgcgggaaacaaccgccggagccagagggcatcctggcgaacgaggcagagaccacaactaggcgggcgggggaccgaggcacacggggggccacaccaccaaccaaggaagatccaaaggcgcgacggggacaaaacactatcgggcggtgcatagagggggaccaccaccaagcggaacaatctccgggggggcggaagaaccttggcccagcgagcgattagtggccggcacaattatacccgagcgcgggtgaccgagaaaaccgcagcaacccatgaaacacagccgggcataaaacagactgacacagtggcgagcaatgcagcagacagaagacaacaaggaggagaagacacaacggacagacgcaatgcaagacgccaacaacagagacagcggacacacacagtcgacaacagcggacgcgcaggaccatgaacagaaacaaccagcaagagagaacacgag

SEQ ID NO: 356442 - DNA, 1197 bp, Homo sapiens
tgagatggagtttcgctctcattgcccaggctgtagtgcagtggtgcgatctcagctcaccttgaacctccgccttctgggttcaagcgattctcctgcctcagcctcccgagtagctgggattacaggcgtgtgccaccacacccagttaattttgtattttttttagtagagacgggggtttcaccatgttggtcaggctggtcttgaactcctgatctcaggtgatccacccgccttggtctcccagagtgctgggattacaagagtgagccactgcgcctggccaaaattttgtttttaaattagcctggcgtggtgggtgcgtgcctatagtcccagctatttgggaggcggaggtggaggcgggaggacgcttgagcccaggagtttgagtgagccatgattgcgccactgcagcctgggtgacagccccaccctgtctctcaattttatttattaatttttttttgagacacagtctcgctctgtcgcccaggctggagtgcagtggcgcgatctcggcttactgcaacctccgcctcccgggttcaagcagttctcctgcctcagcctcccgagtagctgggattacaggcgcacaccaccacatccggctaattttgtatttttagtagagacgggctttttccgtgttggtcaggctggtcttgaattcccaacctcagatgatctgcccaccttggtctccccaagtgctgggattaaaggtgtgagccactgtgcccagcccagtatttttttgtttgtttttaccgagatggagtcccgccccattgcccaggctagagtgcagtggcgtgatctcagtacactgcaacctccacttcccaggttcaagcgattctcctgcctcagcctcctgagcagttgggattacaggcacgcacttccacacctggcttacttttgtatttttagtagagacggggtttcaccatgttggccaggctggtctccaattcctgaccccaagggatccaccttaggcctggccgccaacattctgaaccttgtcttttctctgtcatgtattcaaagtccacgctggaaactccaatttcaggtcccttcagttttttgtccgttgtctttcgttctttgtccacgttgcccgtcccttgtgaactggatgctgtgtgtgagcaccagggactgaaaagctccagtgcagtg

SEQ ID NO: 356443 - DNA, 643 bp, Homo sapiens
cggccgagtcctgccctgcagcattctcccctgtggccactgtgctgactgggccggtggtccccagggagcgcatgaacctgaaggtgcccatctacttctccacggggctgaccgagaaggccaaccactactacaagctgttcatcccctggaccaaccagaagatccgcaagacttttgtgcagaggaacatgtttgagttcaagcacatcaaggccttcgaccgggcttttgctgacaacccaggaccgatggttgtgtttgccacgccaggaatgctgcacgctgggcagtccctgcagatcttccggaaatgggccggaaacgaaaagaacatgggtgagggcatggtgaggtgtgggaatctggaagctggaggccgacgggttgtccttccacccatgctgtctctgagctctcactggcttggcctcgtgctggccaagggacgtggctgctgctgctggggaacgggggcgatgtccgcctggagctgctcagtctctgtgacacagcttgtccacctcgggcagaacagccccagcccagccctggacagtcttgtgccaaaacctgagccctttggagtctgcagctaggcttggtcgggcgccgctggcaggtggaaacagcttccagg

SEQ ID NO: 356444 - DNA, 1843 bp, Homo sapiens
accggaagttgcagcgaggtggttgcgcctgcgcagtgcatcaccgcaggcgggcctcgcgggtccgggagcgcggcggagacgatgcctgagatcagagtcacgcccttgggggccggccaggacgtgggccgaagctgcatcctggtctccattgcgggcaagaatgtcatgctggactgtggaatgcacatgggcttcaatgacgacgtagatgatgagctggagatcaaggcctactatgcaggccacgtgctgggggcagccatgttccagattaaagtgggctcagagtctgtggtctacacgggtgattataacatgaccccagaccgacacttaggagctgcctggattgacaagtgccgccccaacctgctcatcacagagtccacgtacgccacgaccatccgtgactccaagcgctgccgggagcgagacttcctgaagaaagtccacgagaccgtggagcgtggtgggaaggtgctgatacctgtgttcgcgctgggccgcgcccaggagctctgcatcctcctggagaccttctgggagcgcatgaacctgaaggtgcccatctacttctccacggggctgaccgagaaggccaaccactactacaagctgttcatcccctggaccaaccagaagatccgcaagacttttgtgcagaggaacatgtttgagttcaagcacatcaaggccttcgaccgggcttttgctgacaacccaggaccgatggttgtgtttgccacgccaggaatgctgcacgctgggcagtccctgcagatcttccggaaatgggccggaaacgaaaagaacatggtcatcatgcccggctactgcgtgcagggcaccgtcggccacaagatcctcagcgggcagcggaagctcgagatggaggggcggcaggtgctggaggtcaagatgcaggtggagtacatgtcattcagcgcacacgcggacgccaagggcatcatgcagctggtgggccaggcagagccggagagcgtgctgctggtgcatggcgaggccaagaagatggagttcctgaagcagaagatcgagcaggagctccgggtcaactgctacatgccggccaatggcgagacggtgacgctgcccacaagccccagcatccccgtaggcatctcgctggggctgctgaagcgggagatggcgcaggggctgctccctgaggccaagaagcctcggctcctgcacggcaccctgatcatgaaggacagcaacttccggctggtgtcctcagagcaagccctcaaagagctgggtctggctgagcaccagctgcgcttcacctgccgcgtgcacctgcatgacacacgcaaggagcaggagacggcattgcgcgtctacagccacctcaagagcgtcctgaaggaccactgtgtgcagcacctcccggacggctctgtgactgtggagtccgtcctcctccaggccgccgccccttctgaggacccaggcaccaaggtgctgctggtctcctggacctaccaggacgaggagctggggagcttcctcacatctctgctgaagaagggcctcccccaggcccccagctgaggccggcaactcacccagccgccacctctgccctctcccagctggacagaccctgggcctgcacttcaggactgtgggtgccctgggtgaacagaccctgcaggtcccatccctggggacagaggccttgtgtcacctgcctgcccaggcagctgtttgcagctgaagaaacaaactggtctccaggctgtcttgcctttattcctggttagggcaggtggtcctagacagcagtttccagtaaaagctgaacaaaaga

SEQ ID NO: 356445 - DNA, 2011 bp, Homo sapiens
accggaagttgcagcgaggtggttgcgcctgcgcagtgcatcaccgcaggcgggcctcgcgggtccgggagcgcggcggagacgatgcctgagatcagagtcacgcccttgggggccggccaggacgtgggccgaagctgcatcctggtctccattgcgggcaagaatgtcatgctggactgtggaatgcacatgggcttcaatgacgaccgacgcttccctgacttctcctacatcacccagaacggccgcctaacagacttcctggactgtgtgatcattagccacttccacctggaccactgcggggcactcccctacttcagcgagatggtgggctacgacggccccatctacatgactcaccccacccaggccatctgccccatcttgctggaggactaccgcaagatcgccgtagacaagaagggcgaggccaacttcttcacctcccagatgatcaaagactgcatgaagaaggtggtggctgtccacctccaccagacggtccagattaaagtgggctcagagtctgtggtctacacgggtgattataacatgaccccagaccgacacttaggagctgcctggattgacaagtgccgccccaacctgctcatcacagagtccacgtacgccacgaccatccgtgactccaagcgctgccgggagcgagacttcctgaagaaagtccacgagaccgtggagcgtggtgggaaggtgctgatacctgtgttcgcgctgggccgcgcccaggagctctgcatcctcctggagaccttctgggagcgcatgaacctgaaggtgcccatctacttctccacggggctgaccgagaaggccaaccactactacaagctgttcatcccctggaccaaccagaagatccgcaagacttttgtgcagaggaacatgtttgagttcaagcacatcaaggccttcgaccgggcttttgctgacaacccaggaccgatggttgtgtttgccacgccaggaatgctgcacgctgggcagtccctgcagatcttccggaaatgggccggaaacgaaaagaacatggtcatcatgcccggctactgcgtgcagggcaccgtcggccacaagatcctcagcgggcagcggaagctcgagatggaggggcggcaggtgctggaggtcaagatgcaggtggagtacatgtcattcagcgcacacgcggacgccaagggcatcatgcagctggtgggccaggcagagccggagagcgtgctgctggtgcatggcgaggccaagaagatggagttcctgaagcagaagatcgagcaggagctccgggtcaactgctacatgccggccaatggcgagacggtgacgctgcccacaagccccagcatccccgtaggcatctcgctggggctgctgaagcgggagatggcgcaggggctgctccctgaggccaagaagcctcggctcctgcacggcaccctgatcatgaaggacagcaacttccggctggtgtcctcagagcaagccctcaaagagctgggtctggctgagcaccagctgcgcttcacctgccgcgtgcacctgcatgacacacgcaaggagcaggagacggcattgcgcgtctacagccacctcaagagcgtcctgaaggaccactgtgtgcagcacctcccggacggctctgtgactgtggagtccgtcctcctccaggccgccgccccttctgaggacccaggcaccaaggtgctgctggtctcctggacctaccaggacgaggagctggggagcttcctcacatctctgctgaagaagggcctcccccaggcccccagctgaggccggcaactcacccagccgccacctctgccctgtcccatccctggggacagaggccttgtgtcacctgcctgcccaggcagctgtttgcagctgaagaaacaaactggtctccaggctgtcttgcctttattcctggttagggcaggtggtcctagacagcagtttccagtaaaagctgaacaaaaga

SEQ ID NO: 356446 - DNA, 3542 bp, Homo sapiens
accggaagttgcagcgaggtggttgcgcctgcgcagtgcatcaccgcaggcgggcctcgcgggtccgggagcgcggcggagacgatgcctgagatcagagtcacgcccttgggggccggccaggacgtgggccgaagctgcatcctggtctccattgcgggcaagaatgtcatgctggactgtggaatgcacatgggcttcaatgacgacgtgagtcccttgggcaggaggcccagaggctgggagagccggccatccacagctggaccctgggcctcagagccgggacagtggggtggtgggcagcagtggttgtgcttggatggctgcaccctgtggggagcagggatgggtgggcctggccgaggtgagcccctgcatggtggggtccccctgtgctggcgctgagccccagccccggggtcctgtaggctggactccgtgagaccctgggctcagcttccagctcacatctgtcagtgaggttgggggtaacctcggcccctccggatgctgtgagcagccaggggtcctggtgccacctgcgggatgggagtgcccagcctgagtctgcacatagaaccccccttcctgggggcccctccctggggcatgggtggccccagatgctgcctggagaccactgtgcaacctgaaacccccacatccttcctagcgacgcttccctgacttctcctacatcacccagaacggccgcctaacagacttcctggactgtgtgatcattaggtgggttcctgttgggggccttgagggtcccatgtctgtgcctgtggggcttgggccaccttgcttggtctcggcagcgtttggcaaggggcctgtgccatccttgatcctcagggggcttctaggccccaggatctgctccctgcctgccttactggtcacacacatggcctggtctctgtctgttcttccggccctgccctctgaaccctactttctgaacccggccctccaggcttcaccctctctgatgccttcactgtctcaggatctttaaaccccactgtcttgttggcgattccagagtcccgagtctgccctgaccccagcctttagggttcagcagctcatgacccgctggtctgggtggcctcgtctggacggccacagcactcctgctggccccctgcccttccctgccctgtcctcccagcagccaggcccgtgaagcctggagaagccccttctcctctccggaggcagtgtcctcagctgcccctgagcccctcgtggttgtggtttcttctcagacacggtggggtccccaatgccttcctggggcttgccaggcgctgcccttgccctcaggtctgtgccaccttcacctgcagctccactcagcctgtcctgactgcctgaaaagccagcggctcccctatgcgcggttccctcagcagctttgcattgtctcgcgagcatgtcgccgtcaccgacgtgttcaatttcccgtttgcttattgccttgctagactttgagactgaaagttccagggagacagttttgtgtttgctcattactgactcttcggtactcgggatgaggcctggcgcacagcaggcgaatgaaggggccagtgacccacaagcccagagcgggggtgaaggctggggcagggtgggcccaggctgacctgtgctgcgtccccctagccacttccacctggaccactgcggggcactcccctacttcagcgagatggtgggctacgacggccccatctacatgactcaccccacccaggccatctgccccatcttgctggaggactaccgcaagatcgccgtagacaagaagggcgaggccaacttcttcacctcccagatgatcaaagactgcatgaagaaggtggtggctgtccacctccaccagacggtccaggtagatgatgagctggagatcaaggcctactatgcaggccacgtgctgggggcagccatgttccagattaaagtgggctcagagtctgtggtctacacgggtgattataacatgaccccagaccgacacttaggagctgcctggattgacaagtgccgccccaacctgctcatcacagagtccacgtacgccacgaccatccgtgactccaagcgctgccgggagcgagacttcctgaagaaagtccacgagaccgtggagcgtggtgggaaggtgctgatacctgtgttcgcgctgggccgcgcccaggagctctgcatcctcctggagaccttctgggagcgcatgaacctgaaggtgcccatctacttctccacggggctgaccgagaaggccaaccactactacaagctgttcatcccctggaccaaccagaagatccgcaagacttttgtgcagaggaacatgtttgagttcaagcacatcaaggccttcgaccgggcttttgctgacaacccaggaccgatggttgtgtttgccacgccaggaatgctgcacgctgggcagtccctgcagatcttccggaaatgggccggaaacgaaaagaacatggtcatcatgcccggctactgcgtgcagggcaccgtcggccacaagatcctcagcgggcagcggaagctcgagatggaggggcggcaggtgctggaggtcaagatgcaggtggagtacatgtcattcagcgcacacgcggacgccaagggcatcatgcagctggtgggccaggcagagccggagagcgtgctgctggtgcatggcgaggccaagaagatggagttcctgaagcagaagatcgagcaggagctccgggtcaactgctacatgccggccaatggcgagacggtgacgctgcccacaagccccagcatccccgtaggcatctcgctggggctgctgaagcgggagatggcgcaggggctgctccctgaggccaagaagcctcggctcctgcacggcaccctgatcatgaaggacagcaacttccggctggtgtcctcagagcaagccctcaaagagctgggtctggctgagcaccagctgcgcttcacctgccgcgtgcacctgcatgacacacgcaaggagcaggagacggcattgcgcgtctacagccacctcaagagcgtcctgaaggaccactgtgtgcagcacctcccggacggctctgtgactgtggagtccgtcctcctccaggccgccgccccttctgaggacccaggcaccaaggtgctgctggtctcctggacctaccaggacgaggagctggggagcttcctcacatctctgctgaagaagggcctcccccaggcccccagctgaggccggcaactcacccagccgccacctctgccctctcccagctggacagaccctgggcctgcacttcaggactgtgggtgccctgggtgaacagaccctgcaggtcccatccctggggacagaggccttgtgtcacctgcctgcccaggcagctgtttgcagctgaagaaacaaactggtctccaggctgtcttgcctttattcctggttagggcaggtggtcctagacagcagtttccagtaaaagctgaacaaaaga

SEQ ID NO: 356447 - DNA, 4616 bp, Homo sapiens
accggaagttgcagcgaggtggttgcgcctgcgcagtgcatcaccgcaggcgggcctcgcgggtccgggagcgcggcggagacgatgcctgagatcagagtcacgcccttgggggccggccaggacgtgggccgaagctgcatcctggtctccattgcgggcaagaatgtcatgctggactgtggaatgcacatgggcttcaatgacgacgtgagtcccttgggcaggaggcccagaggctgggagagccggccatccacagctggaccctgggcctcagagccgggacagtggggtggtgggcagcagtggttgtgcttggatggctgcaccctgtggggagcagggatgggtgggcctggccgaggtgagcccctgcatggtggggtccccctgtgctggcgctgagccccagccccggggtcctgtaggctggactccgtgagaccctgggctcagcttccagctcacatctgtcagtgaggttgggggtaacctcggcccctccggatgctgtgagcagccaggggtcctggtgccacctgcgggatgggagtgcccagcctgagtctgcacatagaaccccccttcctgggggcccctccctggggcatgggtggccccagatgctgcctggagaccactgtgcaacctgaaacccccacatccttcctagcgacgcttccctgacttctcctacatcacccagaacggccgcctaacagacttcctggactgtgtgatcattaggtgggttcctgttgggggccttgagggtcccatgtctgtgcctgtggggcttgggccaccttgcttggtctcggcagcgtttggcaaggggcctgtgccatccttgatcctcagggggcttctaggccccaggatctgctccctgcctgccttactggtcacacacatggcctggtctctgtctgttcttccggccctgccctctgaaccctactttctgaacccggccctccaggcttcaccctctctgatgccttcactgtctcaggatctttaaaccccactgtcttgttggcgattccagagtcccgagtctgccctgaccccagcctttagggttcagcagctcatgacccgctggtctgggtggcctcgtctggacggccacagcactcctgctggccccctgcccttccctgccctgtcctcccagcagccaggcccgtgaagcctggagaagccccttctcctctccggaggcagtgtcctcagctgcccctgagcccctcgtggttgtggtttcttctcagacacggtggggtccccaatgccttcctggggcttgccaggcgctgcccttgccctcaggtctgtgccaccttcacctgcagctccactcagcctgtcctgactgcctgaaaagccagcggctcccctatgcgcggttccctcagcagctttgcattgtctcgcgagcatgtcgccgtcaccgacgtgttcaatttcccgtttgcttattgccttgctagactttgagactgaaagttccagggagacagttttgtgtttgctcattactgactcttcggtactcgggatgaggcctggcgcacagcaggcgaatgaaggggccagtgacccacaagcccagagcgggggtgaaggctggggcagggtgggcccaggctgacctgtgctgcgtccccctagccacttccacctggaccactgcggggcactcccctacttcagcgagatggtgggctacgacggccccatctacatgactcaccccacccaggccatctgccccatcttgctggaggactaccgcaagatcgccgtagacaagaagggcgaggccaacttcttcacctcccagatgatcaaagactgcatgaagaaggtggtggctgtccacctccaccagacggtccagaggtcaggttcccagggccacagctggcacagtcactgcccacccccacaccaaccatgccctccgcccgttctacacagtttctggaaggctggggcctcagggtgagcccaccccacctcactcttgcgtccagcaccgtggggacaccaggaggcgtcagcgcgaggatgcgggtcccagaccagactgggcgccgacccgggagagcacgtgcagggtgggggtatgcactggcttacgaacccaccaggctctgtccgagcggcattgaaatggccagagtgggacaggctggtgccctcagagcgcttggagcggccagagactcgctggagctcccggggtgttgccgggcagggaggcaggggctggaggggagatgggccagctctggagggtgcctggttctgggtgtgggtcagggaagaagtgaaggttaaatcagcgagtgacaggtgaaattccatttctgacaaagattatgggtttgtctgtgtctcactcgaatctctgggtattgcttttatatttcttgaaattatattaggtacctatgtattttggaacatttaattttctgattgaacttgtcaaaatgaagtatgtttatcttttttgttgtgaaactttaatttttttttttttttgacagtgtctcactttgttacccaggctggagtgtgatcttggctcactgcagcctcggcctcccgggttgaggtgatctcccacctcggcctcccaagtagctgggactacaagcatgtgcccatacgcccagctaatttattttggtattttttgtagagatgggtatgtgttgctaaggctctcgaactcctgggctgggctccagggatcctcccacctcagcctctcaaagtgctcggattacaggcatccactgcgcctggccaaaattttgtttttaaattagcctggcgtggtgggtgcgtgcctatagtcccagctatttgggaggcggaggtggaggcgggaggacgcttgagcccaggagtttgagtgagccatgattgcgccactgcagcctgggtgacagccccaccctgtctctcaattttatttattaatttttttttgagacacagtctcgctctgtcgcccaggctggagtgcagtggcgcgatctcggcttactgcaacctccgcctcccgggttcaagcagttctcctgcctcagcctcccgagtagctgggattacaggcgcacaccaccacatccggctaattttgtatttttagtagagacgggctttttccgtgttggtcaggctggtcttgaattcccaacctcagatgatctgcccaccttggtctccccaagtgctgatacctgtgttcgcgctgggccgcgcccaggagctctgcatcctcctggagaccttctgggagcgcatgaacctgaaggtgcccatctacttctccacggggctgaccgagaaggccaaccactactacaagctgttcatcccctggaccaaccagaagatccgcaagacttttgtgcagaggaacatgtttgagttcaagcacatcaaggccttcgaccgggcttttgctgacaacccaggaccgatggttgtgtttgccacgccaggaatgctgcacgctgggcagtccctgcagatcttccggaaatgggccggaaacgaaaagaacatggtcatcatgcccggctactgcgtgcagggcaccgtcggccacaagatcctcagcgggcagcggaagctcgagatggaggggcggcaggtgctggaggtcaagatgcaggtggagtacatgtcattcagcgcacacgcggacgccaagggcatcatgcagctggtgggccaggcagagccggagagcgtgctgctggtgcatggcgaggccaagaagatggagttcctgaagcagaagatcgagcaggagctccgggtcaactgctacatgccggccaatggcgagacggtgacgctgcccacaagccccagcatccccgtaggcatctcgctggggctgctgaagcgggagatggcgcaggggctgctccctgaggccaagaagcctcggctcctgcacggcaccctgatcatgaaggacagcaacttccggctggtgtcctcagagcaagccctcaaagagctgggtctggctgagcaccagctgcgcttcacctgccgcgtgcacctgcatgacacacgcaaggagcaggagacggcattgcgcgtctacagccacctcaagagcgtcctgaaggaccactgtgtgcagcacctcccggacggctctgtgactgtggagtccgtcctcctccaggccgccgccccttctgaggacccaggcaccaaggtgctgctggtctcctggacctaccaggacgaggagctggggagcttcctcacatctctgctgaagaagggcctcccccaggcccccagctgaggccggcaactcacccagccgccacctctgccctctcccagctggacagaccctgggcctgcacttcaggactgtgggtgccctgggtgaacagaccctgcaggtcccatccctggggacagaggccttgtgtcacctgcctgcccaggcagctgtttgcagctgaagaaacaaactggtctccaggctgtcttgcctttattcctggttagggcaggtggtcctagacagcagtttccagtaaaagctgaacaaaaga

SEQ ID NO: 356448 - DNA, 1555 bp, Homo sapiens
ggtgggtgctctagccgaagttgattgtcacttgacccccagaaccgacacttaggagctgcctggattgacaagtgccgccccaacctgctcatcacagagtccacgtacgccacgaccatccgtgactccaagcgctgccgggagcgagacttcctgaagaaagtccacgagaccgtggagcgtggtgggaaggtgctgatacctgtgttcgcgctgggccgcgcccaggagctctgcatcctcctggagaccttctgggagcgcatgaacctgaaggtgcccatctacttctccacggggctgaccgagaaggccaaccactactacaagctgttcatcccctggaccaaccagaagatccgcaagacttttgtgcagaggaacatgtttgagttcaagcacatcaaggccttcgaccgggcttttgctgacaacccaggaccgatggttgtgtttgccacgccaggaatgctgcacgctgggcagtccctgcagatcttccggaaatgggccggaaacgaaaagaacatggtcatcatgcccggctactgcgtgcagggcaccgtcggccacaagatcctcagcgggcagcggaagctcgagatggaggggcggcaggtgctggaggtcaagatgcaggtggagtacatgtcattcagcgcacacgcggacgccaagggcatcatgcagctggtgggccaggcagagccggagagcgtgctgctggtgcatggcgaggccaagaagatggagttcctgaagcagaagatcgagcaggagctccgggtcaactgctacatgccggccaatggcgagacggtgacgctgcccacaagccccagcatccccgtaggcatctcgctggggctgctgaagcgggagatggcgcaggggctgctccctgaggccaagaagcctcggctcctgcacggcaccctgatcatgaaggacagcaacttccggctggtgtcctcagagcaagccctcaaagagctgggtctggctgagcaccagctgcgcttcacctgccgcgtgcacctgcatgacacacgcaaggagcaggagacggcattgcgcgtctacagccacctcaagagcgtcctgaaggaccactgtgtgcagcacctcccggacggctctgtgactgtggagtccgtcctcctccaggccgccgccccttctgaggacccaggcaccaaggtgctgctggtctcctggacctaccaggacgaggagctggggagcttcctcacatctctgctgaagaagggcctcccccaggcccccagctgaggccggcaactcacccagccgccacctctgccctctcccagctggacagaccctgggcctgcacttcaggactgtgggtgccctgggtgaacagaccctgcaggtcccatccctggggacagaggccttgtgtcacctgcctgcccaggcagctgtttgcagctgaagaaacaaactggtctccaggctgtcttgcctttattcctggttagggcaggtggtcctagacagcagtttccagtaaaagctgaacaaaaga

SEQ ID NO: 356449 - DNA, 3881 bp, Homo sapiens
accggaagttgcagcgaggtggttgcgcctgcgcagtgcatcaccgcaggcgggcctcgcgggtccgggagcgcggcggagacgatgcctgagatcagagtcacgcccttgggggccggccaggacgtgggccgaagctgcatcctggtctccattgcgggcaagaatgtcatgctggactgtggaatgcacatgggcttcaatgacgacgtgagtcccttgggcaggaggcccagaggctgggagagccggccatccacagctggaccctgggcctcagagccgggacagtggggtggtgggcagcagtggttgtgcttggatggctgcaccctgtggggagcagggatgggtgggcctggccgaggtgagcccctgcatggtggggtccccctgtgctggcgctgagccccagccccggggtcctgtaggctggactccgtgagaccctgggctcagcttccagctcacatctgtcagtgaggttgggggtaacctcggcccctccggatgctgtgagcagccaggggtcctggtgccacctgcgggatgggagtgcccagcctgagtctgcacatagaaccccccttcctgggggcccctccctggggcatgggtggccccagatgctgcctggagaccactgtgcaacctgaaacccccacatccttcctagcgacgcttccctgacttctcctacatcacccagaacggccgcctaacagacttcctggactgtgtgatcattaggtgggttcctgttgggggccttgagggtcccatgtctgtgcctgtggggcttgggccaccttgcttggtctcggcagcgtttggcaaggggcctgtgccatccttgatcctcagggggcttctaggccccaggatctgctccctgcctgccttactggtcacacacatggcctggtctctgtctgttcttccggccctgccctctgaaccctactttctgaacccggccctccaggcttcaccctctctgatgccttcactgtctcaggatctttaaaccccactgtcttgttggcgattccagagtcccgagtctgccctgaccccagcctttagggttcagcagctcatgacccgctggtctgggtggcctcgtctggacggccacagcactcctgctggccccctgcccttccctgccctgtcctcccagcagccaggcccgtgaagcctggagaagccccttctcctctccggaggcagtgtcctcagctgcccctgagcccctcgtggttgtggtttcttctcagacacggtggggtccccaatgccttcctggggcttgccaggcgctgcccttgccctcaggtctgtgccaccttcacctgcagctccactcagcctgtcctgactgcctgaaaagccagcggctcccctatgcgcggttccctcagcagctttgcattgtctcgcgagcatgtcgccgtcaccgacgtgttcaatttcccgtttgcttattgccttgctagactttgagactgaaagttccagggagacagttttgtgtttgctcattactgactcttcggtactcgggatgaggcctggcgcacagcaggcgaatgaaggggccagtgacccacaagcccagagcgggggtgaaggctggggcagggtgggcccaggctgacctgtgctgcgtccccctagccacttccacctggaccactgcggggcactcccctacttcagcgagatggtgggctacgacggccccatctacatgactcaccccacccaggccatctgccccatcttgctggaggactaccgcaagatcgccgtagacaagaagggcgaggccaacttcttcacctcccagatgatcaaagactgcatgaagaaggtggtggctgtccacctccaccagacggtccaggtagatgatgagctggagatcaaggcctactatgcaggccacgtgctgggggcagccatgttccagattaaagtgggctcagagtctgtggtctacacgggtgattataacatgaccccagaccgacacttaggagctgcctggattgacaagtgccgccccaacctgctcatcacagagtccacgtacgccacgaccatccgtgactccaagcgctgccgggagcgagacttcctgaagaaagtccacgagaccgtggagcgtggtgggaaggtgctgatacctgtgttcgcgctgggccgcgcccaggagctctgcatcctcctggagaccttctgggagcgcatgaacctgaaggtgcccatctacttctccacggggctgaccgagaaggccaaccactactacaagctgttcatcccctggaccaaccagaagatccgcaagacttttgtgcagaggaacatgtttgagttcaagcacatcaaggccttcgaccgggcttttgctgacaacccaggaccgatggttgtgtttgccacgccaggaatgctgcacgctgggcagtccctgcagatcttccggaaatgggccggaaacgaaaagaacatggtcatcatgcccggctactgcgtgcagggcaccgtcggccacaagatcctcagcgggcagcggaagctcgagatggaggggcggcaggtgctggaggtcaagatgcaggtggagtacatgtcattcagcgcacacgcggacgccaagggcatcatgcagctggtgggccaggcagagccggagagcgtgctgctggtgcatggcgaggccaagaagatggagttcctgaagcagaagatcgagcaggagctccgggtcaactgctacatgccggccaatggcgagacggtgacgctgcccacaagccccagcatccccgtaggcatctcgctggggctgctgaagcgggagatggcgcaggggctgctccctgaggccaagaagcctcggctcctgcacggcaccctgatcatgaaggacagcaacttccggctggtgtcctcagagcaagccctcaaagagctgggtctggctgagcaccagctgcgcttcacctgccgcgtgcacctgcatgacacacgcaaggagcaggagacggcattgcgcgtctacagccacctcaagagcgtcctgaaggaccactgtgtgcagcacctcccggacggctctgtgactgtggagtccgtcctcctccaggccgccgccccttctgaggacccaggcaccaaggtgctgctggtctcctggacctaccaggacgaggagctggggagcttcctcacatctctgctgaagaagggcctcccccaggcccccagctgaggccggcaactcacccagccgccacctctgccctctcccagctggacagaccctgggcctgcacttcaggactgtgggtgccctgggtgaacagaccctgcaggtcccatccctggggacagaggccttgtgtcacctgcctgcccaggcagctgtttgcagctgaagaaacaaactggtctccaggctgtcttgcctttattcctggttagggcaggtggtcctagacagcagtttccagtaaaagctgaacaaaagactacttggtactctcttcttggtgtacatggctgtgtcctgcactgtgccccatcccgcctgggacagagacgggcatccagggtgctgggacccgggcagggaggctactgtggagaccaggcagcagtgctgtgggccccaagcagctgtgactgccctggcttgaccagcacagggttgggcctggtgtggcctaactttggcttgagtgtccagggtcatccgtggctcccgaactgtggcccctgcagggtgcaggaggcagcacctcgaggttcccgtacagcactgacttgaggaataagccgtgggctggggctacacgtgtctggtgctt

SEQ ID NO: 356450 - DNA, 4701 bp, Homo sapiens
accggaagttgcagcgaggtggttgcgcctgcgcagtgcatcaccgcaggcgggcctcgcgggtccgggagcgcggcggagacgatgcctgagatcagagtcacgcccttgggggccggccaggacgtgggccgaagctgcatcctggtctccattgcgggcaagaatgtcatgctggactgtggaatgcacatgggcttcaatgacgacgtgagtcccttgggcaggaggcccagaggctgggagagccggccatccacagctggaccctgggcctcagagccgggacagtggggtggtgggcagcagtggttgtgcttggatggctgcaccctgtggggagcagggatgggtgggcctggccgaggtgagcccctgcatggtggggtccccctgtgctggcgctgagccccagccccggggtcctgtaggctggactccgtgagaccctgggctcagcttccagctcacatctgtcagtgaggttgggggtaacctcggcccctccggatgctgtgagcagccaggggtcctggtgccacctgcgggatgggagtgcccagcctgagtctgcacatagaaccccccttcctgggggcccctccctggggcatgggtggccccagatgctgcctggagaccactgtgcaacctgaaacccccacatccttcctagcgacgcttccctgacttctcctacatcacccagaacggccgcctaacagacttcctggactgtgtgatcattaggtgggttcctgttgggggccttgagggtcccatgtctgtgcctgtggggcttgggccaccttgcttggtctcggcagcgtttggcaaggggcctgtgccatccttgatcctcagggggcttctaggccccaggatctgctccctgcctgccttactggtcacacacatggcctggtctctgtctgttcttccggccctgccctctgaaccctactttctgaacccggccctccaggcttcaccctctctgatgccttcactgtctcaggatctttaaaccccactgtcttgttggcgattccagagtcccgagtctgccctgaccccagcctttagggttcagcagctcatgacccgctggtctgggtggcctcgtctggacggccacagcactcctgctggccccctgcccttccctgccctgtcctcccagcagccaggcccgtgaagcctggagaagccccttctcctctccggaggcagtgtcctcagctgcccctgagcccctcgtggttgtggtttcttctcagacacggtggggtccccaatgccttcctggggcttgccaggcgctgcccttgccctcaggtctgtgccaccttcacctgcagctccactcagcctgtcctgactgcctgaaaagccagcggctcccctatgcgcggttccctcagcagctttgcattgtctcgcgagcatgtcgccgtcaccgacgtgttcaatttcccgtttgcttattgccttgctagactttgagactgaaagttccagggagacagttttgtgtttgctcattactgactcttcggtactcgggatgaggcctggcgcacagcaggcgaatgaaggggccagtgacccacaagcccagagcgggggtgaaggctggggcagggtgggcccaggctgacctgtgctgcgtccccctagccacttccacctggaccactgcggggcactcccctacttcagcgagatggtgggctacgacggccccatctacatgactcaccccacccaggccatctgccccatcttgctggaggactaccgcaagatcgccgtagacaagaagggcgaggccaacttcttcacctcccagatgatcaaagactgcatgaagaaggtggtggctgtccacctccaccagacggtccagaggtcaggttcccagggccacagctggcacagtcactgcccacccccacaccaaccatgccctccgcccgttctacacagtttctggaaggctggggcctcagggtgagcccaccccacctcactcttgcgtccagcaccgtggggacaccaggaggcgtcagcgcgaggatgcgggtcccagaccagactgggcgccgacccgggagagcacgtgcagggtgggggtatgcactggcttacgaacccaccaggctctgtccgagcggcattgaaatggccagagtgggacaggctggtgccctcagagcgcttggagcggccagagactcgctggagctcccggggtgttgccgggcagggaggcaggggctggaggggagatgggccagctctggagggtgcctggttctgggtgtgggtcagggaagaagtgaaggttaaatcagcgagtgacaggtgaaattccatttctgacaaagattatgggtttgtctgtgtctcactcgaatctctgggtattgcttttatatttcttgaaattatattaggtacctatgtattttggaacatttaattttctgattgaacttgtcaaaatgaagtatgtttatcttttttgttgtgaaactttaatttttttttttttttgacagtgtctcactttgttacccaggctggagtgtgatcttggctcactgcagcctcggcctcccgggttgaggtgatctcccacctcggcctcccaagtagctgggactacaagcatgtgcccatacgcccagctaatttattttggtattttttgtagagatgggtatgtgttgctaaggctctcgaactcctgggctgggctccagggatcctcccacctcagcctctcaaagtgctcggattacaggcatccactgcgcctggccaaaattttgtttttaaattagcctggcgtggtgggtgcgtgcctatagtcccagctatttgggaggcggaggtggaggcgggaggacgcttgagcccaggagtttgagtgagccatgattgcgccactgcagcctgggtgacagccccaccctgtctctcaattttatttattaatttttttttgagacacagtctcgctctgtcgcccaggctggagtgcagtggcgcgatctcggcttactgcaacctccgcctcccgggttcaagcagttctcctgcctcagcctcccgagtagctgggattacaggcgcacaccaccacatccggctaattttgtatttttagtagagacgggctttttccgtgttggtcaggctggtcttgaattcccaacctcagatgatctgcccaccttggtctccccaagtgctgatacctgtgttcgcgctgggccgcgcccaggagctctgcatcctcctggagaccttctgggagcgcatgaacctgaaggtgcccatctacttctccacggggctgaccgagaaggccaaccactactacaagctgttcatcccctggaccaaccagaagatccgcaagacttttgtgcagaggaacatgtttgagttcaagcacatcaaggccttcgaccgggcttttgctgacaacccaggaccgatggttgtgtttgccacgccaggaatgctgcacgctgggcagtccctgcagatcttccggaaatgggccggaaacgaaaagaacatggtcatcatgcccggctactgcgtgcagggcaccgtcggccacaagatcctcagcgggcagcggaagctcgagatggaggggcggcaggtggtgagtctcgaccccgcactgggctggcagggccgaggggcacctcctggtggtaaccactgtccacgccccgtggcctctgtagctggaggtcaagatgcaggtggagtacatgtcattcagcgcacacgcggacgccaagggcatcatgcagctggtgggccaggcagagccggagagcgtgctgctggtgcatggcgaggccaagaagatggagttcctgaagcagaagatcgagcaggagctccgggtcaactgctacatgccggccaatggcgagacggtgacgctgcccacaagccccagcatccccgtaggcatctcgctggggctgctgaagcgggagatggcgcaggggctgctccctgaggccaagaagcctcggctcctgcacggcaccctgatcatgaaggacagcaacttccggctggtgtcctcagagcaagccctcaaagagctgggtctggctgagcaccagctgcgcttcacctgccgcgtgcacctgcatgacacacgcaaggagcaggagacggcattgcgcgtctacagccacctcaagagcgtcctgaaggaccactgtgtgcagcacctcccggacggctctgtgactgtggagtccgtcctcctccaggccgccgccccttctgaggacccaggcaccaaggtgctgctggtctcctggacctaccaggacgaggagctggggagcttcctcacatctctgctgaagaagggcctcccccaggcccccagctgaggccggcaactcacccagccgccacctctgccctctcccagctggacagaccctgggcctgcacttcaggactgtgggtgccctgggtgaacagaccctgcaggtcccatccctggggacagaggccttgtgtcacctgcctgcccaggcagctgtttgcagctgaagaaacaaactggtctccaggctgtcttgcctttattcctggttagggcaggtggtcctagacagcagtttccagtaaaagctgaacaaaaga

SEQ ID NO: 356451 - DNA, 3705 bp, Homo sapiens
accggaagttgcagcgaggtggttgcgcctgcgcagtgcatcaccgcaggcgggcctcgcgggtccgggagcgcggcggagacgatgcctgagatcagagtcacgcccttgggggccggccaggacgtgggccgaagctgcatcctggtctccattgcgggcaagaatgtcatgctggactgtggaatgcacatgggcttcaatgacgacgtgagtcccttgggcaggaggcccagaggctgggagagccggccatccacagctggaccctgggcctcagagccgggacagtggggtggtgggcagcagtggttgtgcttggatggctgcaccctgtggggagcagggatgggtgggcctggccgaggtgagcccctgcatggtggggtccccctgtgctggcgctgagccccagccccggggtcctgtaggctggactccgtgagaccctgggctcagcttccagctcacatctgtcagtgaggttgggggtaacctcggcccctccggatgctgtgagcagccaggggtcctggtgccacctgcgggatgggagtgcccagcctgagtctgcacatagaaccccccttcctgggggcccctccctggggcatgggtggccccagatgctgcctggagaccactgtgcaacctgaaacccccacatccttcctagcgacgcttccctgacttctcctacatcacccagaacggccgcctaacagacttcctggactgtgtgatcattaggtgggttcctgttgggggccttgagggtcccatgtctgtgcctgtggggcttgggccaccttgcttggtctcggcagcgtttggcaaggggcctgtgccatccttgatcctcagggggcttctaggccccaggatctgctccctgcctgccttactggtcacacacatggcctggtctctgtctgttcttccggccctgccctctgaaccctactttctgaacccggccctccaggcttcaccctctctgatgccttcactgtctcaggatctttaaaccccactgtcttgttggcgattccagagtcccgagtctgccctgaccccagcctttagggttcagcagctcatgacccgctggtctgggtggcctcgtctggacggccacagcactcctgctggccccctgcccttccctgccctgtcctcccagcagccaggcccgtgaagcctggagaagccccttctcctctccggaggcagtgtcctcagctgcccctgagcccctcgtggttgtggtttcttctcagacacggtggggtccccaatgccttcctggggcttgccaggcgctgcccttgccctcaggtctgtgccaccttcacctgcagctccactcagcctgtcctgactgcctgaaaagccagcggctcccctatgcgcggttccctcagcagctttgcattgtctcgcgagcatgtcgccgtcaccgacgtgttcaatttcccgtttgcttattgccttgctagactttgagactgaaagttccagggagacagttttgtgtttgctcattactgactcttcggtactcgggatgaggcctggcgcacagcaggcgaatgaaggggccagtgacccacaagcccagagcgggggtgaaggctggggcagggtgggcccaggctgacctgtgctgcgtccccctagccacttccacctggaccactgcggggcactcccctacttcagcgagatggtgggctacgacggccccatctacatgactcaccccacccaggccatctgccccatcttgctggaggactaccgcaagatcgccgtagacaagaagggcgaggccaacttcttcacctcccagatgatcaaagactgcatgaagaaggtggtggctgtccacctccaccagacggtccaggtagatgatgagctggagatcaaggcctactatgcaggccacgtgctgggggcagccatgttccagattaaagtgggctcagagtctgtggtctacacgggtgattataacatgaccccagaccgacacttaggagctgcctggattgacaagtgccgccccaacctgctcatcacagagtccacgtacgccacgaccatccgtgactccaagcgctgccgggagcgagacttcctgaagaaagtccacgagaccgtggagcgtggtgggaaggtgctgatacctgtgttcgcgctgggccgcgcccaggagctctgcatcctcctggagaccttctgggagcgcatgaacctgaaggtgcccatctacttctccacggggctgaccgagaaggccaaccactactacaagctgttcatcccctggaccaaccagaagatccgcaagacttttgtgcagaggaacatgtttgagttcaagcacatcaaggccttcgaccgggcttttgctgacaacccaggaccgatggttgtgtttgccacgccaggaatgctgcacgctgggcagtccctgcagatcttccggaaatgggccggaaacgaaaagaacatggtcatcatgcccggctactgcgtgcagggcaccgtcggccacaagatcctcagcgggcagcggaagctcgagatggaggggcggcaggtgctggaggtcaagatgcaggtggagtacatgtcattcagcgcacacgcggacgccaagggcatcatgcagctggtgggccaggcagagccggagagcgtgctgctggtgcatggcgaggccaagaagatggagttcctgaagcagaagatcgagcaggagctccgggtcaactgctacatgccggccaatggcgagacggtgacgctgcccacaagccccagcatccccgtaggcatctcgctggggctgctgaagcgggagatggcgcagggtatgcgggctgggcagggcagggcagggtgctcggggcaggcggctgggagcggccctcacattgatggctcctgccacctcctccgcagggctgctccctgaggccaagaagcctcggctcctgcacggcaccctgatcatgaaggacagcgtgagtgccaggacggtctctggaggggggagggccgctgctgcgctcactgacctgtccctgccccacagaaacttccggctggtgtcctcagagcaagccctcaaagagctgggtctggctgagcaccagctgcgcttcacctgccgcgtgcacctgcatgacacacgcaaggagcaggagacggcattgcgcgtctacagccacctcaagagcgtcctgaaggaccactgtgtgcagcacctcccggacggctctgtgactgtggagtccgtcctcctccaggccgccgccccttctgaggacccaggcaccaaggtgctgctggtctcctggacctaccaggacgaggagctggggagcttcctcacatctctgctgaagaagggcctcccccaggcccccagctgaggccggcaactcacccagccgccacctctgccctctcccagctggacagaccctgggcctgcacttcaggactgtgggtgccctgggtgaacagaccctgcaggtcccatccctggggacagaggccttgtgtcacctgcctgcccaggcagctgtttgcagctgaagaaacaaactggtctccaggctgtcttgcctttattcctggttagggcaggtggtcctagacagcagtttccagtaaaagctgaacaaaaga

SEQ ID NO: 356452 - DNA, 4403 bp, Homo sapiens
accggaagttgcagcgaggtggttgcgcctgcgcagtgcatcaccgcaggcgggcctcgcgggtccgggagcgcggcggagacgatgcctgagatcagagtcacgcccttgggggccggccaggacgtgggccgaagctgcatcctggtctccattgcgggcaagaatgtcatgctggactgtggaatgcacatgggcttcaatgacgacgtgagtcccttgggcaggaggcccagaggctgggagagccggccatccacagctggaccctgggcctcagagccgggacagtggggtggtgggcagcagtggttgtgcttggatggctgcaccctgtggggagcagggatgggtgggcctggccgaggtgagcccctgcatggtggggtccccctgtgctggcgctgagccccagccccggggtcctgtaggctggactccgtgagaccctgggctcagcttccagctcacatctgtcagtgaggttgggggtaacctcggcccctccggatgctgtgagcagccaggggtcctggtgccacctgcgggatgggagtgcccagcctgagtctgcacatagaaccccccttcctgggggcccctccctggggcatgggtggccccagatgctgcctggagaccactgtgcaacctgaaacccccacatccttcctagcgacgcttccctgacttctcctacatcacccagaacggccgcctaacagacttcctggactgtgtgatcattaggtgggttcctgttgggggccttgagggtcccatgtctgtgcctgtggggcttgggccaccttgcttggtctcggcagcgtttggcaaggggcctgtgccatccttgatcctcagggggcttctaggccccaggatctgctccctgcctgccttactggtcacacacatggcctggtctctgtctgttcttccggccctgccctctgaaccctactttctgaacccggccctccaggcttcaccctctctgatgccttcactgtctcaggatctttaaaccccactgtcttgttggcgattccagagtcccgagtctgccctgaccccagcctttagggttcagcagctcatgacccgctggtctgggtggcctcgtctggacggccacagcactcctgctggccccctgcccttccctgccctgtcctcccagcagccaggcccgtgaagcctggagaagccccttctcctctccggaggcagtgtcctcagctgcccctgagcccctcgtggttgtggtttcttctcagacacggtggggtccccaatgccttcctggggcttgccaggcgctgcccttgccctcaggtctgtgccaccttcacctgcagctccactcagcctgtcctgactgcctgaaaagccagcggctcccctatgcgcggttccctcagcagctttgcattgtctcgcgagcatgtcgccgtcaccgacgtgttcaatttcccgtttgcttattgccttgctagactttgagactgaaagttccagggagacagttttgtgtttgctcattactgactcttcggtactcgggatgaggcctggcgcacagcaggcgaatgaaggggccagtgacccacaagcccagagcgggggtgaaggctggggcagggtgggcccaggctgacctgtgctgcgtccccctagccacttccacctggaccactgcggggcactcccctacttcagcgagatggtgggctacgacggccccatctacatgactcaccccacccaggccatctgccccatcttgctggaggactaccgcaagatcgccgtagacaagaagggcgaggccaacttcttcacctcccagatgatcaaagactgcatgaagaaggtggtggctgtccacctccaccagacggtccagaggtcaggttcccagggccacagctggcacagtcactgcccacccccacaccaaccatgccctccgcccgttctacacagtttctggaaggctggggcctcagggtgagcccaccccacctcactcttgcgtccagcaccgtggggacaccaggaggcgtcagcgcgaggatgcgggtcccagaccagactgggcgccgacccgggagagcacgtgcagggtgggggtatgcactggcttacgaacccaccaggctctgtccgagcggcattgaaatggccagagtgggacaggctggtgccctcagagcgcttggagcggccagagactcgctggagctcccggggtgttgccgggcagggaggcaggggctggaggggagatgggccagctctggagggtgcctggttctgggtgtgggtcagggaagaagtgaaggttaaatcagcgagtgacaggtgaaattccatttctgacaaagattatgggtttgtctgtgtctcactcgaatctctgggtattgcttttatatttcttgaaattatattaggtacctatgtattttggaacatttaattttctgattgaacttgtcaaaatgaagtatgtttatcttttttgttgtgaaactttaatttttttttttttttgacagtgtctcactttgttacccaggctggagtgtgatcttggctcactgcagcctcggcctcccgggttgaggtgatctcccacctcggcctcccaagtagctgggactacaagcatgtgcccatacgcccagctaatttattttggtattttttgtagagatgggtatgtgttgctaaggctctcgaactcctgggctgggctccagggatcctcccacctcagcctctcaaagtgctcggattacaggcatccactgcgcctggccaaaattttgtttttaaattagcctggcgtggtgggtgcgtgcctatagtcccagctatttgggaggcggaggtggaggcgggaggacgcttgagcccaggagtttgagtgagccatgattgcgccactgcagcctgggtgacagccccaccctgtctctcaattttatttattaatttttttttgagacacagtctcgctctgtcgcccaggctggagtgcagtggcgcgatctcggcttactgcaacctccgcctcccgggttcaagcagttctcctgcctcagcctcccgagtagctgggattacaggcgcacaccaccacatccggctaattttgtatttttagtagagacgggctttttccgtgttggtcaggctggtcttgaattcccaacctcagatgatctgcccaccttggtctccccaagtgctgatacctgtgttcgcgctgggccgcgcccaggagctctgcatcctcctggagaccttctgggagcgcatgaacctgaaggtgcccatctacttctccacggggctgaccgagaaggccaaccactactacaagctgttcatcccctggaccaaccagaagatccgcaagacttttgtgcagaggaacatgtttgagttcaagcacatcaaggccttcgaccgggcttttgctgacaacccaggaccgatggttgtgtttgccacgccaggaatgctgcacgctgggcagtccctgcagatcttccggaaatgggccggaaacgaaaagaacatgaagatggagttcctgaagcagaagatcgagcaggagctccgggtcaactgctacatgccggccaatggcgagacggtgacgctgcccacaagccccagcatccccgtaggcatctcgctggggctgctgaagcgggagatggcgcaggggctgctccctgaggccaagaagcctcggctcctgcacggcaccctgatcatgaaggacagcaacttccggctggtgtcctcagagcaagccctcaaagagctgggtctggctgagcaccagctgcgcttcacctgccgcgtgcacctgcatgacacacgcaaggagcaggagacggcattgcgcgtctacagccacctcaagagcgtcctgaaggaccactgtgtgcagcacctcccggacggctctgtgactgtggagtccgtcctcctccaggccgccgccccttctgaggacccaggcaccaaggtgctgctggtctcctggacctaccaggacgaggagctggggagcttcctcacatctctgctgaagaagggcctcccccaggcccccagctgaggccggcaactcacccagccgccacctctgccctctcccagctggacagaccctgggcctgcacttcaggactgtgggtgccctgggtgaacagaccctgcaggtcccatccctggggacagaggccttgtgtcacctgcctgcccaggcagctgtttgcagctgaagaaacaaactggtctccaggctgtcttgcctttattcctggttagggcaggtggtcctagacagcagtttccagtaaaagctgaacaaaaga

SEQ ID NO: 356453 - DNA, 3464 bp, Homo sapiens
accggaagttgcagcgaggtggttgcgcctgcgcagtgcatcaccgcaggcgggcctcgcgggtccgggagcgcggcggagacgatgcctgagatcagagtcacgcccttgggggccggccaggacgtgggccgaagctgcatcctggtctccattgcgggcaagaatgtcatgctggactgtggaatgcacatgggcttcaatgacgacgtgagtcccttgggcaggaggcccagaggctgggagagccggccatccacagctggaccctgggcctcagagccgggacagtggggtggtgggcagcagtggttgtgcttggatggctgcaccctgtggggagcagggatgggtgggcctggccgaggtgagcccctgcatggtggggtccccctgtgctggcgctgagccccagccccggggtcctgtaggctggactccgtgagaccctgggctcagcttccagctcacatctgtcagtgaggttgggggtaacctcggcccctccggatgctgtgagcagccaggggtcctggtgccacctgcgggatgggagtgcccagcctgagtctgcacatagaaccccccttcctgggggcccctccctggggcatgggtggccccagatgctgcctggagaccactgtgcaacctgaaacccccacatccttcctagcgacgcttccctgacttctcctacatcacccagaacggccgcctaacagacttcctggactgtgtgatcattaggtgggttcctgttgggggccttgagggtcccatgtctgtgcctgtggggcttgggccaccttgcttggtctcggcagcgtttggcaaggggcctgtgccatccttgatcctcagggggcttctaggccccaggatctgctccctgcctgccttactggtcacacacatggcctggtctctgtctgttcttccggccctgccctctgaaccctactttctgaacccggccctccaggcttcaccctctctgatgccttcactgtctcaggatctttaaaccccactgtcttgttggcgattccagagtcccgagtctgccctgaccccagcctttagggttcagcagctcatgacccgctggtctgggtggcctcgtctggacggccacagcactcctgctggccccctgcccttccctgccctgtcctcccagcagccaggcccgtgaagcctggagaagccccttctcctctccggaggcagtgtcctcagctgcccctgagcccctcgtggttgtggtttcttctcagacacggtggggtccccaatgccttcctggggcttgccaggcgctgcccttgccctcaggtctgtgccaccttcacctgcagctccactcagcctgtcctgactgcctgaaaagccagcggctcccctatgcgcggttccctcagcagctttgcattgtctcgcgagcatgtcgccgtcaccgacgtgttcaatttcccgtttgcttattgccttgctagactttgagactgaaagttccagggagacagttttgtgtttgctcattactgactcttcggtactcgggatgaggcctggcgcacagcaggcgaatgaaggggccagtgacccacaagcccagagcgggggtgaaggctggggcagggtgggcccaggctgacctgtgctgcgtccccctagccacttccacctggaccactgcggggcactcccctacttcagcgagatggtgggctacgacggccccatctacatgactcaccccacccaggccatctgccccatcttgctggaggactaccgcaagatcgccgtagacaagaagggcgaggccaacttcttcacctcccagatgatcaaagactgcatgaagaaggtggtggctgtccacctccaccagacggtccaggtagatgatgagctggagatcaaggcctactatgcaggccacgtgctgggggcagccatgttccagattaaagtgggctcagagtctgtggtctacacgggtgattataacatgaccccagaccgacacttaggagctgcctggattgacaagtgccgccccaacctgctcatcacagagtccacgtacgccacgaccatccgtgactccaagcgctgccgggagcgagacttcctgaagaaagtccacgagaccgtggagcgtggtgggaaggtgctgatacctgtgttcgcgctgggccgcgcccaggagctctgcatcctcctggagaccttctgggagcgcatgaacctgaaggtgcccatctacttctccacggggctgaccgagaaggccaaccactactacaagctgttcatcccctggaccaaccagaagatccgcaagacttttgtgcagaggaacatgtttgagttcaagcacatcaaggccttcgaccgggcttttgctgacaacccaggaccgatggttgtgtttgccacgccaggaatgctgcacgctgggcagtccctgcagatcttccggaaatgggccggaaacgaaaagaacatggtcatcatgcccggctactgcgtgcagggcaccgtcggccacaagatcctcagcgggcagcggaagctcgagatggaggggcggcaggtgctggaggtcaagatgcaggtggagtacatgtcattcagcgcacacgcggacgccaagggcatcatgcagctggtgggccaggcagagccggagagcgtgctgctggtgcatggcgaggccaagaagatggagttcctgaagcagaagatcgagcaggagctccgggtcaactgctacatgccggccaatggcgagacggtgacgctgcccacaagccccagcatccccgtaggcatctcgctggggctgctgaagcgggagatggcgcaggggctgctccctgaggccaagaagcctcggctcctgcacggcaccctgatcatgaaggacagcaacttccggctggtgtcctcagagcaagccctcaaagagctgggtctggctgagcaccagctgcgcttcacctgccgcgtgcacctgcatgacacacgcaaggagcaggagacggcattgcgcgtctacagccacctcaagagcccttctgaggacccaggcaccaaggtgctgctggtctcctggacctaccaggacgaggagctggggagcttcctcacatctctgctgaagaagggcctcccccaggcccccagctgaggccggcaactcacccagccgccacctctgccctctcccagctggacagaccctgggcctgcacttcaggactgtgggtgccctgggtgaacagaccctgcaggtcccatccctggggacagaggccttgtgtcacctgcctgcccaggcagctgtttgcagctgaagaaacaaactggtctccaggctgtcttgcctttattcctggttagggcaggtggtcctagacagcagtttccagtaaaagctgaacaaaaga

SEQ ID NO: 356454 - DNA, 4859 bp, Homo sapiens
accggaagttgcagcgaggtggttgcgcctgcgcagtgcatcaccgcaggcgggcctcgcgggtccgggagcgcggcggagacgatgcctgagatcagagtcacgcccttgggggccggccaggacgtgggccgaagctgcatcctggtctccattgcgggcaagaatgtcatgctggactgtggaatgcacatgggcttcaatgacgacgtgagtcccttgggcaggaggcccagaggctgggagagccggccatccacagctggaccctgggcctcagagccgggacagtggggtggtgggcagcagtggttgtgcttggatggctgcaccctgtggggagcagggatgggtgggcctggccgaggtgagcccctgcatggtggggtccccctgtgctggcgctgagccccagccccggggtcctgtaggctggactccgtgagaccctgggctcagcttccagctcacatctgtcagtgaggttgggggtaacctcggcccctccggatgctgtgagcagccaggggtcctggtgccacctgcgggatgggagtgcccagcctgagtctgcacatagaaccccccttcctgggggcccctccctggggcatgggtggccccagatgctgcctggagaccactgtgcaacctgaaacccccacatccttcctagcgacgcttccctgacttctcctacatcacccagaacggccgcctaacagacttcctggactgtgtgatcattaggtgggttcctgttgggggccttgagggtcccatgtctgtgcctgtggggcttgggccaccttgcttggtctcggcagcgtttggcaaggggcctgtgccatccttgatcctcagggggcttctaggccccaggatctgctccctgcctgccttactggtcacacacatggcctggtctctgtctgttcttccggccctgccctctgaaccctactttctgaacccggccctccaggcttcaccctctctgatgccttcactgtctcaggatctttaaaccccactgtcttgttggcgattccagagtcccgagtctgccctgaccccagcctttagggttcagcagctcatgacccgctggtctgggtggcctcgtctggacggccacagcactcctgctggccccctgcccttccctgccctgtcctcccagcagccaggcccgtgaagcctggagaagccccttctcctctccggaggcagtgtcctcagctgcccctgagcccctcgtggttgtggtttcttctcagacacggtggggtccccaatgccttcctggggcttgccaggcgctgcccttgccctcaggtctgtgccaccttcacctgcagctccactcagcctgtcctgactgcctgaaaagccagcggctcccctatgcgcggttccctcagcagctttgcattgtctcgcgagcatgtcgccgtcaccgacgtgttcaatttcccgtttgcttattgccttgctagactttgagactgaaagttccagggagacagttttgtgtttgctcattactgactcttcggtactcgggatgaggcctggcgcacagcaggcgaatgaaggggccagtgacccacaagcccagagcgggggtgaaggctggggcagggtgggcccaggctgacctgtgctgcgtccccctagccacttccacctggaccactgcggggcactcccctacttcagcgagatggtgggctacgacggccccatctacatgactcaccccacccaggccatctgccccatcttgctggaggactaccgcaagatcgccgtagacaagaagggcgaggccaacttcttcacctcccagatgatcaaagactgcatgaagaaggtggtggctgtccacctccaccagacggtccagaggtcaggttcccagggccacagctggcacagtcactgcccacccccacaccaaccatgccctccgcccgttctacacagtttctggaaggctggggcctcagggtgagcccaccccacctcactcttgcgtccagcaccgtggggacaccaggaggcgtcagcgcgaggatgcgggtcccagaccagactgggcgccgacccgggagagcacgtgcagggtgggggtatgcactggcttacgaacccaccaggctctgtccgagcggcattgaaatggccagagtgggacaggctggtgccctcagagcgcttggagcggccagagactcgctggagctcccggggtgttgccgggcagggaggcaggggctggaggggagatgggccagctctggagggtgcctggttctgggtgtgggtcagggaagaagtgaaggttaaatcagcgagtgacaggtgaaattccatttctgacaaagattatgggtttgtctgtgtctcactcgaatctctgggtattgcttttatatttcttgaaattatattaggtacctatgtattttggaacatttaattttctgattgaacttgtcaaaatgaagtatgtttatcttttttgttgtgaaactttaatttttttttttttttgacagtgtctcactttgttacccaggctggagtgtgatcttggctcactgcagcctcggcctcccgggttgaggtgatctcccacctcggcctcccaagtagctgggactacaagcatgtgcccatacgcccagctaatttattttggtattttttgtagagatgggtatgtgttgctaaggctctcgaactcctgggctgggctccagggatcctcccacctcagcctctcaaagtgctcggattacaggcatccactgcgcctggccaaaattttgtttttaaattagcctggcgtggtgggtgcgtgcctatagtcccagctatttgggaggcggaggtggaggcgggaggacgcttgagcccaggagtttgagtgagccatgattgcgccactgcagcctgggtgacagccccaccctgtctctcaattttatttattaatttttttttgagacacagtctcgctctgtcgcccaggctggagtgcagtggcgcgatctcggcttactgcaacctccgcctcccgggttcaagcagttctcctgcctcagcctcccgagtagctgggattacaggcgcacaccaccacatccggctaattttgtatttttagtagagacgggctttttccgtgttggtcaggctggtcttgaattcccaacctcagatgatctgcccaccttggtctccccaagtgctgatacctgtgttcgcgctgggccgcgcccaggagctctgcatcctcctggagaccttctgggagcgcatgaacctgaaggtgcccatctacttctccacggggctgaccgagaaggccaaccactactacaagctgttcatcccctggaccaaccagaagatccgcaagacttttgtgcagaggaacatgtttgagttcaagcacatcaaggccttcgaccgggcttttgctgacaacccaggaccgatggttgtgtttgccacgccaggaatgctgcacgctgggcagtccctgcagatcttccggaaatgggccggaaacgaaaagaacatggtcatcatgcccggctactgcgtgcagggcaccgtcggccacaagatcctcagcgggcagcggaagctcgagatggaggggcggcaggtggtgagtctcgaccccgcactgggctggcagggccgaggggcacctcctggtggtaaccactgtccacgccccgtggcctctgtagctggaggtcaagatgcaggtggagtacatgtcattcagcgcacacgcggacgccaagggcatcatgcagctggtgggccaggcagagccggagagcgtgctgctggtgcatggcgaggccaagaagatggagttcctgaagcagaagatcgagcaggagctccgtaggcagccgggcgggcggcgtggggcccacctcgggtcagcacgggcagcctgggctgaggctctctcttcccccggggtccaggggtcaactgctacatgccggccaatggcgagacggtgacgctgcccacaagccccagcatccccgtaggcatctcgctggggctgctgaagcgggagatggcgcaggggctgctccctgaggccaagaagcctcggctcctgcacggcaccctgatcatgaaggacagcgtgagtgccaggacggtctctggaggggggagggccgctgctgcgctcactgacctgtccctgccccacagaaacttccggctggtgtcctcagagcaagccctcaaagagctgggtctggctgagcaccagctgcgcttcacctgccgcgtgcacctgcatgacacacgcaaggagcaggagacggcattgcgcgtctacagccacctcaagagcgtcctgaaggaccactgtgtgcagcacctcccggacggctctgtgactgtggagtccgtcctcctccaggccgccgccccttctgaggacccaggcaccaaggtgctgctggtctcctggacctaccaggacgaggagctggggagcttcctcacatctctgctgaagaagggcctcccccaggcccccagctgaggccggcaactcacccagccgccacctctgccctctcccagctggacagaccctgggcctgcacttcaggactgtgggtgccctgggtgaacagaccctgcaggtcccatccctggggacagaggccttgtgtcacctgcctgcccaggcagctgtttgcagctgaagaaacaaactggtctccaggctgtcttgcctttattcctggttagggcaggtggtcctagacagcagtttccagtaaaagctgaacaaaaga

SEQ ID NO: 356455 - DNA, 992 bp, Homo sapiens
gttcgttcagctcggtacccctcctcagcagacgcagctcgagatggaggggcggcaggtgctggaggtcaagatgcaggtggagtacatgtcattcagcgcacacgcggacgccaagggcatcatgcagctggtgggccaggcagagccggagagcgtgctgctggtgcatggcgaggccaagaagatggagttcctgaagcagaagatcgagcaggagctccgggtcaactgctacatgccggccaatggcgagacggtgacgctgcccacaagccccagcatccccgtaggcatctcgctggggctgctgaagcgggagatggcgcaggggctgctccctgaggccaagaagcctcggctcctgcacggcaccctgatcatgaaggacagcaacttccggctggtgtcctcagagcaagccctcaaagagctgggtctggctgagcaccagctgcgcttcacctgccgcgtgcacctgcatgacacacgcaaggagcaggagacggcattgcgcgtctacagccacctcaagagcgtcctgaaggaccactgtgtgcagcacctcccggacggctctgtgactgtggagtccgtcctcctccaggccgccgccccttctgaggacccaggcaccaaggtgctgctggtctcctggacctaccaggacgaggagctggggagcttcctcacatctctgctgaagaagggcctcccccaggcccccagctgaggccggcaactcacccagccgccacctctgccctctcccagctggacagaccctgggcctgcacttcaggactgtgggtgccctgggtgaacagaccctgcaggtcccatccctggggacagaggccttgtgtcacctgcctgcccaggcagctgtttgcagctgaagaaacaaactggtctccaggctgtcttgcctttattcctggttagggcaggtggtcctagacagcagtttccagtaaaagctgaacaaaaga

SEQ ID NO: 356456 - DNA, 3119 bp, Homo sapiens
accggaagttgcagcgaggtggttgcgcctgcgcagtgcatcaccgcaggcgggcctcgcgggtccgggagcgcggcggagacgatgcctgagatcagagtcacgcccttgggggccggccaggacgtgggccgaagctgcatcctggtctccattgcgggcaagaatgtcatgctggactgtggaatgcacatgggcttcaatgacgacgtgagtcccttgggcaggaggcccagaggctgggagagccggccatccacagctggaccctgggcctcagagccgggacagtggggtggtgggcagcagtggttgtgcttggatggctgcaccctgtggggagcagggatgggtgggcctggccgaggtgagcccctgcatggtggggtccccctgtgctggcgctgagccccagccccggggtcctgtaggctggactccgtgagaccctgggctcagcttccagctcacatctgtcagtgaggttgggggtaacctcggcccctccggatgctgtgagcagccaggggtcctggtgccacctgcgggatgggagtgcccagcctgagtctgcacatagaaccccccttcctgggggcccctccctggggcatgggtggccccagatgctgcctggagaccactgtgcaacctgaaacccccacatccttcctagcgacgcttccctgacttctcctacatcacccagaacggccgcctaacagacttcctggactgtgtgatcattaggtgggttcctgttgggggccttgagggtcccatgtctgtgcctgtggggcttgggccaccttgcttggtctcggcagcgtttggcaaggggcctgtgccatccttgatcctcagggggcttctaggccccaggatctgctccctgcctgccttactggtcacacacatggcctggtctctgtctgttcttccggccctgccctctgaaccctactttctgaacccggccctccaggcttcaccctctctgatgccttcactgtctcaggatctttaaaccccactgtcttgttggcgattccagagtcccgagtctgccctgaccccagcctttagggttcagcagctcatgacccgctggtctgggtggcctcgtctggacggccacagcactcctgctggccccctgcccttccctgccctgtcctcccagcagccaggcccgtgaagcctggagaagccccttctcctctccggaggcagtgtcctcagctgcccctgagcccctcgtggttgtggtttcttctcagacacggtggggtccccaatgccttcctggggcttgccaggcgctgcccttgccctcaggtctgtgccaccttcacctgcagctccactcagcctgtcctgactgcctgaaaagccagcggctcccctatgcgcggttccctcagcagctttgcattgtctcgcgagcatgtcgccgtcaccgacgtgttcaatttcccgtttgcttattgccttgctagactttgagactgaaagttccagggagacagttttgtgtttgctcattactgactcttcggtactcgggatgaggcctggcgcacagcaggcgaatgaaggggccagtgacccacaagcccagagcgggggtgaaggctggggcagggtgggcccaggctgacctgtgctgcgtccccctagccacttccacctggaccactgcggggcactcccctacttcagcgagatggtgggctacgacggccccatctacatgactcaccccacccaggccatctgccccatcttgctggaggactaccgcaagatcgccgtagacaagaagggcgaggccaacttcttcacctcccagatgatcaaagactgcatgaagaaggtggtggctgtccacctccaccagacggtccaggtagatgatgagctggagatcaaggcctactatgcaggccacgtgctgggggcagccatgttccagattaaagtgggctcagagtctgtggtctacacgggtgattataacatgaccccagaccgacacttaggagctgcctggattgacaagtgccgccccaacctgctcatcacagagtccacgtacgccacgaccatccgtgactccaagcgctgccgggagcgagacttcctgaagaaagtccacgagaccgtggagcgtggtgggaaggtgctgatacctgtgttcgcgctgggccgcgcccaggagctctgcatcctcctggagaccttctgggagcgcatgaacctgaaggtgcccatctacttctccacggggctgaccgagaaggccaaccactactacaagctgttcatcccctggaccaaccagaagatccgcaagacttttgtgcagaggaacatgtttgagttcaagcacatcaaggccttcgaccgggcttttgctgacaacccaggaccgatggttgtgtttgccacgccaggaatgctgcacgctgggcagtccctgcagatcttccggaaatgggccggaaacgaaaagaacatggtcatcatgcccggctactgcgtgcagggcaccgtcggccacaagatcctcagcgggcagcggaagctcgagatggaggggcggcaggtgctggaggtcaagatgcaggtggagtacatgtcattcagcgcacacgcggacgccaagggcatcatgcagctggtgggccaggcagagccggagagcgtgctgctggtgcatggcgaggccaagaagatggagttcctgaagcagaagatcgagcaggagctccgggtcaactgctacatgccggccaatggcgagacggtgacgctgcccacaagccccagcatccccgtaggcatctcgctggggctgctgaagcgggagatggcgcagggctgtcctgggccagaagctcggtcctggcggaccctgtcatgaggaacagacttccgggtggtgtctcagagaagcctcagagctggtcgttgagacagtggttccctgcgggggctgttgccgcgggcgagggtgggtagcccaggttggggccggtgtgccccgcgtcggggggggcccgggggcttttggagcagggggtgtgccgggggtcttgggccgccggggcccgcgg

SEQ ID NO: 356457 - DNA, 3737 bp, Homo sapiens
accggaagttgcagcgaggtggttgcgcctgcgcagtgcatcaccgcaggcgggcctcgcgggtccgggagcgcggcggagacgatgcctgagatcagagtcacgcccttgggggccggccaggacgtgggccgaagctgcatcctggtctccattgcgggcaagaatgtcatgctggactgtggaatgcacatgggcttcaatgacgacgtgagtcccttgggcaggaggcccagaggctgggagagccggccatccacagctggaccctgggcctcagagccgggacagtggggtggtgggcagcagtggttgtgcttggatggctgcaccctgtggggagcagggatgggtgggcctggccgaggtgagcccctgcatggtggggtccccctgtgctggcgctgagccccagccccggggtcctgtaggctggactccgtgagaccctgggctcagcttccagctcacatctgtcagtgaggttgggggtaacctcggcccctccggatgctgtgagcagccaggggtcctggtgccacctgcgggatgggagtgcccagcctgagtctgcacatagaaccccccttcctgggggcccctccctggggcatgggtggccccagatgctgcctggagaccactgtgcaacctgaaacccccacatccttcctagcgacgcttccctgacttctcctacatcacccagaacggccgcctaacagacttcctggactgtgtgatcattaggtgggttcctgttgggggccttgagggtcccatgtctgtgcctgtggggcttgggccaccttgcttggtctcggcagcgtttggcaaggggcctgtgccatccttgatcctcagggggcttctaggccccaggatctgctccctgcctgccttactggtcacacacatggcctggtctctgtctgttcttccggccctgccctctgaaccctactttctgaacccggccctccaggcttcaccctctctgatgccttcactgtctcaggatctttaaaccccactgtcttgttggcgattccagagtcccgagtctgccctgaccccagcctttagggttcagcagctcatgacccgctggtctgggtggcctcgtctggacggccacagcactcctgctggccccctgcccttccctgccctgtcctcccagcagccaggcccgtgaagcctggagaagccccttctcctctccggaggcagtgtcctcagctgcccctgagcccctcgtggttgtggtttcttctcagacacggtggggtccccaatgccttcctggggcttgccaggcgctgcccttgccctcaggtctgtgccaccttcacctgcagctccactcagcctgtcctgactgcctgaaaagccagcggctcccctatgcgcggttccctcagcagctttgcattgtctcgcgagcatgtcgccgtcaccgacgtgttcaatttcccgtttgcttattgccttgctagactttgagactgaaagttccagggagacagttttgtgtttgctcattactgactcttcggtactcgggatgaggcctggcgcacagcaggcgaatgaaggggccagtgacccacaagcccagagcgggggtgaaggctggggcagggtgggcccaggctgacctgtgctgcgtccccctagccacttccacctggaccactgcggggcactcccctacttcagcgagatggtgggctacgacggccccatctacatgactcaccccacccaggccatctgccccatcttgctggaggactaccgcaagatcgccgtagacaagaagggcgaggccaacttcttcacctcccagatgatcaaagactgcatgaagaaggtggtggctgtccacctccaccagacggtccagaggtcaggttcccagggccacagctggcacagtcactgcccacccccacaccaaccatgccctccgcccgttctacacagtttctggaaggctggggcctcagggtgagcccaccccacctcactcttgcgtccagcaccgtggggacaccaggaggcgtcagcgcgaggatgcgggtcccagaccagactgggcgccgacccgggagagcacgtgcagggtgggggtatgcactggcttacgaacccaccaggctctgtccgagcggcattgaaatggccagagtgggacaggctggtgccctcagagcgcttggagcggccagagactcgctggagctcccggggtgttgccgggcagggaggcaggggctggaggggagatgggccagctctggagggtgcctggttctgggtgtgggtcagggaagaagtgaaggttaaatcagcgagtgacaggtgaaattccatttctgacaaagattatgggtttgtctgtgtctcactcgaatctctgggtattgcttttatatttcttgaaattatattaggtacctatgtattttggaacatttaattttctgattgaacttgtcaaaatgaagtatgtttatcttttttgttgtgaaactttaatttttttttttttttgacagtgtctcactttgttacccaggctggagtgtgatcttggctcactgcagcctcggcctcccgggttgaggtgatctcccacctcggcctcccaagtagctgggactacaagcatgtgcccatacgcccagctaatttattttggtattttttgtagagatgggtatgtgttgctaaggctctcgaactcctgggctgggctccagggatcctcccacctcagcctctcaaagtgctcggattacaggcatccactgcgcctggccaaaattttgtttttaaattagcctggcgtggtgggtgcgtgcctatagtcccagctatttgggaggcggaggtggaggcgggaggacgcttgagcccaggagtttgagtgagccatgattgcgccactgcagcctgggtgacagccccaccctgtctctcaattttatttattaatttttttttgagacacagtctcgctctgtcgcccaggctggagtgcagtggcgcgatctcggcttactgcaacctccgcctcccgggttcaagcagttctcctgcctcagcctcccgagtagctgggattacaggcgcacaccaccacatccggctaattttgtatttttagtagagacgggctttttccgtgttggtcaggctggtcttgaattcccaacctcagatgatctgcccaccttggtctccccaagtgctgggattaaaggtgtgagccactgtgcccagcccagtatttttttgtttgtttttaccgagatggagtcccgccccattgcccaggctagagtgcagtggcgtgatctcagtacactgcaacctccacttcccaggttcaagcgattctcctgcctcagcctcctgagcagttgggattacaggcacgcacttccacacctggcttacttttgtatttttagtagagacggggtttcaccatgttggccaggctggtctccaattcctgaccccaagggatccaccttaggcctggccgccaacattctgaaccttgtcttttctctgtcatgtattcaaagtccacgctggaaactccaatttcaggtcccttcagttttttgtccgttgtctttcgttctttgtccacgttgcccgtcccttgtgaactggatgctgtgtgtgagcaccagggactgaaaagctccagtgcagtg

SEQ ID NO: 356458 - DNA, 3165 bp, Homo sapiens
accggaagttgcagcgaggtggttgcgcctgcgcagtgcatcaccgcaggcgggcctcgcgggtccgggagcgcggcggagacgatgcctgagatcagagtcacgcccttgggggccggccaggacgtgggccgaagctgcatcctggtctccattgcgggcaagaatgtcatgctggactgtggaatgcacatgggcttcaatgacgacgtgagtcccttgggcaggaggcccagaggctgggagagccggccatccacagctggaccctgggcctcagagccgggacagtggggtggtgggcagcagtggttgtgcttggatggctgcaccctgtggggagcagggatgggtgggcctggccgaggtgagcccctgcatggtggggtccccctgtgctggcgctgagccccagccccggggtcctgtaggctggactccgtgagaccctgggctcagcttccagctcacatctgtcagtgaggttgggggtaacctcggcccctccggatgctgtgagcagccaggggtcctggtgccacctgcgggatgggagtgcccagcctgagtctgcacatagaaccccccttcctgggggcccctccctggggcatgggtggccccagatgctgcctggagaccactgtgcaacctgaaacccccacatccttcctagcgacgcttccctgacttctcctacatcacccagaacggccgcctaacagacttcctggactgtgtgatcattaggtgggttcctgttgggggccttgagggtcccatgtctgtgcctgtggggcttgggccaccttgcttggtctcggcagcgtttggcaaggggcctgtgccatccttgatcctcagggggcttctaggccccaggatctgctccctgcctgccttactggtcacacacatggcctggtctctgtctgttcttccggccctgccctctgaaccctactttctgaacccggccctccaggcttcaccctctctgatgccttcactgtctcaggatctttaaaccccactgtcttgttggcgattccagagtcccgagtctgccctgaccccagcctttagggttcagcagctcatgacccgctggtctgggtggcctcgtctggacggccacagcactcctgctggccccctgcccttccctgccctgtcctcccagcagccaggcccgtgaagcctggagaagccccttctcctctccggaggcagtgtcctcagctgcccctgagcccctcgtggttgtggtttcttctcagacacggtggggtccccaatgccttcctggggcttgccaggcgctgcccttgccctcaggtctgtgccaccttcacctgcagctccactcagcctgtcctgactgcctgaaaagccagcggctcccctatgcgcggttccctcagcagctttgcattgtctcgcgagcatgtcgccgtcaccgacgtgttcaatttcccgtttgcttattgccttgctagactttgagactgaaagttccagggagacagttttgtgtttgctcattactgactcttcggtactcgggatgaggcctggcgcacagcaggcgaatgaaggggccagtgacccacaagcccagagcgggggtgaaggctggggcagggtgggcccaggctgacctgtgctgcgtccccctagccacttccacctggaccactgcggggcactcccctacttcagcgagatggtgggctacgacggccccatctacatgactcaccccacccaggccatctgccccatcttgctggaggactaccgcaagatcgccgtagacaagaagggcgaggccaacttcttcacctcccagatgatcaaagactgcatgaagaaggtggtggctgtccacctccaccagacggtccagaggtcaggttcccagggccacagctggcacagtcactgcccacccccacaccaaccatgccctccgcccgttctacacagtttctggaaggctggggcctcagggtgagcccaccccacctcactcttgcgtccagcaccgtggggacaccaggaggcgtcagcgcgaggatgcgggtcccagaccagactgggcgccgacccgggagagcacgtgcagggtgggggtatgcactggcttacgaacccaccaggctctgtccgagcggcattgaaatggccagagtgggacaggctggtgccctcagagcgcttggagcggccagagactcgctggagctcccggggtgttgccgggcagggaggcaggggctggaggggagatgggccagctctggagggtgcctggttctgggtgtgggtcagggaagaagtgaaggttaaatcagcgagtgacaggtgaaattccatttctgacaaagattatgggtttgtctgtgtctcactcgaatctctgggtattgcttttatatttcttgaaattatattaggtacctatgtattttggaacatttaattttctgattgaacttgtcaaaatgaagtatgtttatcttttttgttgtgaaactttaatttttttttttttttgacagtgtctcactttgttacccaggctggagtgtgatcttggctcactgcagcctcggcctcccgggttgaggtgatctcccacctcggcctcccaatagctgggattacaggcgcccaccaccatgcccagctaacttttgtatttttagtagagacagggtttcaccgtgtcggccaggatggtcttgaactcctgacttcagatgatctgcccaccttggtctccccaagtgctgatacctgtgttcgcgctgggccgcgcccaggagctctgcatcctcctggagaccttctggtaggtgccgccaggacggctctttaaggagcccctggcccggcctgaacacagtccagttggtgggcagccctgtccagcgtagcggtggcatcttggccctgcttgctgctgtcctggggggccgctcgtgtgctgtgtgaccccaggaagcctgtgacatcccgtcagcgccaccgtgtgcggctcttgtaggggttcctggttctccgctgagcccggctgctgcagggcttaatgggacaagtggtcgcgactggactcaacctggcccgtgcgtgggctgtgcagacacgggtgttgggggt

SEQ ID NO: 356459 - DNA, 1458 bp, Homo sapiens
tcccttttcctcttgtttgctttctccttcctttctctttgttgtttatgctccttcttgcttcctcctctctttctcgacttgtgttctttctccttctgtccttctctgctttcccttcttttcttctctctccctgtctgtctgttttctactttgtcctctccttcttttctctctctctttgttttttttctttttctttcttcgcttctgtcggtcgtgttctttgtgtttttttctttttttctttctcttccctggtttctcttcgtttccttgtctttgtttcttctttctcttcttttggtcgttttcttttattcttctttttggtttgcttttttctgcttcttttgccttcttttcgcctttccctccttaccgtctgttctgttcgccttccttttctgttctttctggcgttcgttcgcttctttctgctccttgctttcttgctttttttgttcgtcttgtttctctgtttcttcttttctttcgcttttctcctgttttgctctgcttgtctccccctctgtgtataaaaaattgtgttctagaagtaatacaaatcccgcgttagcgccgcaagacatttttctcaccgcgttcctgcacaatatccgccggcgtgtggtgtgataaccccccgattaacgcacccttagaaaattttatatatatttttacccctatagaagagcccttaaattctctcttaatgtataattgtttcccccacatattttcccccccccaccaaaataaaaggttctcctttccccaaaattctccccccttaccccttttttcccccactcttccaaccttttttaaaccccggcgccccactgtcctcggtcgcttatatataatataccacgcctccccatatatgggggccccccttgtttcacacaaaaaactgtggtgtgcgcgcgcgttaagatgtgtggtgccccccccggggagaattttttggccccccccccccttttttttttttttttttttttttttttttttttttttttttttgtctccaggctgtcttgcctttattcctggttagggcaggtggtcctagacagcagtttccagtaaaagctgaacaaaagactacttggtactctcttcttggtgtacatggctgtgtcctgcactgtgccccatcccgcctgggacagagacgggcatccagggtgctgggacccgggcagggaggctactgtggagaccaggcagcagtgctgtgggccccaagcagctgtgactgccctggcttgaccagcacagggttgggcctggtgtggcctaactttggcttgagtgtccagggtcatccgtggctcccgaactgtggcccctgcagggtgcaggaggcagcacctcgaggttcccgtacagcactgacttgaggaataagccgtgggctggggctacacgtgtctggtgctt

SEQ ID NO: 356460 - DNA, 2146 bp, Homo sapiens
accggaagttgcagcgaggtggttgcgcctgcgcagtgcatcaccgcaggcgggcctcgcgggtccgggagcgcggcggagacgatgcctgagatcagagtcacgcccttgggggccggccaggacgtgggccgaagctgcatcctggtctccattgcgggcaagaatgtcatgctggactgtggaatgcacatgggcttcaatgacgaccgacgcttccctgacttctcctacatcacccagaacggccgcctaacagacttcctggactgtgtgatcattagccacttccacctggaccactgcggggcactcccctacttcagcgagatggtgggctacgacggccccatctacatgactcaccccacccaggccatctgccccatcttgctggaggactaccgcaagatcgccgtagacaagaagggcgaggccaacttcttcacctcccagatgatcaaagactgcatgaagaaggtggtggctgtccacctccaccagacggtccaggtagatgatgagctggagatcaaggcctactatgcaggccacgtgctgggggcagccatgttccagattaaagtgggctcagagtctgtggtctacacgggtgattataacatgaccccagaccgacacttaggagctgcctggattgacaagtgccgccccaacctgctcatcacagagtccacgtacgccacgaccatccgtgactccaagcgctgccgggagcgagacttcctgaagaaagtccacgagaccgtggagcgtggtgggaaggtgctgatacctgtgttcgcgctgggccgcgcccaggagctctgcatcctcctggagaccttctgggagcgcatgaacctgaaggtgcccatctacttctccacggggctgaccgagaaggccaaccactactacaagctgttcatcccctggaccaaccagaagatccgcaagacttttgtgcagaggaacatgtttgagttcaagcacatcaaggccttcgaccgggcttttgctgacaacccaggaccgatggttgtgtttgccacgccaggaatgctgcacgctgggcagtccctgcagatcttccggaaatgggccggaaacgaaaagaacatggtcatcatgcccggctactgcgtgcagggcaccgtcggccacaagatcctcagcgggcagcggaagctcgagatggaggggcggcaggtgctggaggtcaagatgcaggtggagtacatgtcattcagcgcacacgcggacgccaagggcatcatgcagctggtgggccaggcagagccggagagcgtgctgctggtgcatggcgaggccaagaagatggagttcctgaagcagaagatcgagcaggagctccgggtcaactgctacatgccggccaatggcgagacggtgacgctgcccacaagccccagcatccccgtaggcatctcgctggggctgctgaagcgggagatggcgcaggggctgctccctgaggccaagaagcctcggctcctgcacggcaccctgatcatgaaggacagcaacttccggctggtgtcctcagagcaagccctcaaagagctgggtctggctgagcaccagctgcgcttcacctgccgcgtgcacctgcatgacacacgcaaggagcaggagacggcattgcgcgtctacagccacctcaagagcgtcctgaaggaccactgtgtgcagcacctcccggacggctctgtgactgtggagtccgtcctcctccaggccgccgccccttctgaggacccaggcaccaaggtgctgctggtctcctggacctaccaggacgaggagctggggagcttcctcacatctctgctgaagaagggcctcccccaggcccccagctgaggccggcaactcacccagccgccacctctgccctctcccagctggacagaccctgggcctgcacttcaggactgtgggtgccctgggtgaacagaccctgcaggtcccatccctggggacagaggccttgtgtcacctgcctgcccaggcagctgtttgcagctgaagaaacaaactggtctccaggctgtcttgcctttattcctggttagggcaggtggtcctagacagcagtttccagtaaaagctgaacaaaaga

SEQ ID NO: 356461 - DNA, 1525 bp, Homo sapiens
accggaagttgcagcgaggtggttgcgcctgcgcagtgcatcaccgcaggcgggcctcgcgggtccgggagcgcggcggagacgatgcctgagatcagagtcacgcccttgggggccggccaggacgtgggccgaagctgcatcctggtctccattgcgggcaagaatgtcatgctggactgtggaatgcacatgggcttcaatgacgaccgacgcttccctgacttctcctacatcacccagaacggccgcctaacagacttcctggactgtgtgatcattagccacttccacctggaccactgcggggcactcccctacttcagcgagatggtgggctacgacggccccatctacatgactcaccccacccaggccatctgccccatcttgctggaggactaccgcaagatcgccgtagacaagaagggcgaggccaacttcttcacctcccagatgatcaaagactgcatcctcctggagaccttctgggagcgcatgaacctgaaggtgcccatctacttctccacggggctgaccgagaaggccaaccactactacaagctgttcatcccctggaccaaccagaagatccgcaagacttttgtgcagaggaacatgtttgagttcaagcacatcaaggccttcgaccgggcttttgctgacaacccaggaccgatggttgtgtttgccacgccaggaatgctgcacgctgggcagtccctgcagatcttccggaaatgggccggaaacgaaaagaacatggtcatcatgcccggctactgcgtgcagggcaccgtcggccacaagatcctcagcgggcagcggaagctcgagatggaggggcggcaggtgctggaggtcaagatgcaggtggagtacatgtcattcagcgcacacgcggacgccaagggcatcatgcagctgaacttccggctggtgtcctcagagcaagccctcaaagagctgggtctggctgagcaccagctgcgcttcacctgccgcgtgcacctgcatgacacacgcaaggagcaggagacggcattgcgcgtctacagccacctcaagagcgtcctgaaggaccactgtgtgcagcacctcccggacggctctgtgactgtggagtccgtcctcctccaggccgccgccccttctgaggacccaggcaccaaggtgctgctggtctcctggacctaccaggacgaggagctggggagcttcctcacatctctgctgaagaagggcctcccccaggcccccagctgaggccggcaactcacccagccgccacctctgccctctcccagctggacagaccctgggcctgcacttcaggactgtgggtgccctgggtgaacagaccctgcaggtcccatccctggggacagaggccttgtgtcacctgcctgcccaggcagctgtttgcagctgaagaaacaaactggtctccaggctgtcttgcctttattcctggttagggcaggtggtcctagacagcagtttccagtaaaagctgaacaaaaga

SEQ ID NO: 356462 - DNA, 3623 bp, Homo sapiens
accggaagttgcagcgaggtggttgcgcctgcgcagtgcatcaccgcaggcgggcctcgcgggtccgggagcgcggcggagacgatgcctgagatcagagtcacgcccttgggggccggccaggacgtgggccgaagctgcatcctggtctccattgcgggcaagaatgtcatgctggactgtggaatgcacatgggcttcaatgacgacgtgagtcccttgggcaggaggcccagaggctgggagagccggccatccacagctggaccctgggcctcagagccgggacagtggggtggtgggcagcagtggttgtgcttggatggctgcaccctgtggggagcagggatgggtgggcctggccgaggtgagcccctgcatggtggggtccccctgtgctggcgctgagccccagccccggggtcctgtaggctggactccgtgagaccctgggctcagcttccagctcacatctgtcagtgaggttgggggtaacctcggcccctccggatgctgtgagcagccaggggtcctggtgccacctgcgggatgggagtgcccagcctgagtctgcacatagaaccccccttcctgggggcccctccctggggcatgggtggccccagatgctgcctggagaccactgtgcaacctgaaacccccacatccttcctagcgacgcttccctgacttctcctacatcacccagaacggccgcctaacagacttcctggactgtgtgatcattaggtgggttcctgttgggggccttgagggtcccatgtctgtgcctgtggggcttgggccaccttgcttggtctcggcagcgtttggcaaggggcctgtgccatccttgatcctcagggggcttctaggccccaggatctgctccctgcctgccttactggtcacacacatggcctggtctctgtctgttcttccggccctgccctctgaaccctactttctgaacccggccctccaggcttcaccctctctgatgccttcactgtctcaggatctttaaaccccactgtcttgttggcgattccagagtcccgagtctgccctgaccccagcctttagggttcagcagctcatgacccgctggtctgggtggcctcgtctggacggccacagcactcctgctggccccctgcccttccctgccctgtcctcccagcagccaggcccgtgaagcctggagaagccccttctcctctccggaggcagtgtcctcagctgcccctgagcccctcgtggttgtggtttcttctcagacacggtggggtccccaatgccttcctggggcttgccaggcgctgcccttgccctcaggtctgtgccaccttcacctgcagctccactcagcctgtcctgactgcctgaaaagccagcggctcccctatgcgcggttccctcagcagctttgcattgtctcgcgagcatgtcgccgtcaccgacgtgttcaatttcccgtttgcttattgccttgctagactttgagactgaaagttccagggagacagttttgtgtttgctcattactgactcttcggtactcgggatgaggcctggcgcacagcaggcgaatgaaggggccagtgacccacaagcccagagcgggggtgaaggctggggcagggtgggcccaggctgacctgtgctgcgtccccctagccacttccacctggaccactgcggggcactcccctacttcagcgagatggtgggctacgacggccccatctacatgactcaccccacccaggccatctgccccatcttgctggaggactaccgcaagatcgccgtagacaagaagggcgaggccaacttcttcacctcccagatgatcaaagactgcatgaagaaggtggtggctgtccacctccaccagacggtccaggtagatgatgagctggagatcaaggcctactatgcaggccacgtgctgggggcagccatgttccagattaaagtgggctcagagtctgtggtctacacggtcagtggaagggcttgaggcttgggaggggctgctggggtgggaggcaccctcctcatggcatccttgatcgttcaccagggtgattataacatgaccccagaccgacacttaggagctgcctggattgacaagtgccgccccaacctgctcatcacagagtccacgtacgccacgaccatccgtgactccaagcgctgccgggagcgagacttcctgaagaaagtccacgagaccgtggagcgtggtgggaaggtgctgatacctgtgttcgcgctgggccgcgcccaggagctctgcatcctcctggagaccttctgggagcgcatgaacctgaaggtgcccatctacttctccacggggctgaccgagaaggccaaccactactacaagctgttcatcccctggaccaaccagaagatccgcaagacttttgtgcagaggaacatgtttgagttcaagcacatcaaggccttcgaccgggcttttgctgacaacccaggaccgatggttgtgtttgccacgccaggaatgctgcacgctgggcagtccctgcagatcttccggaaatgggccggaaacgaaaagaacatggtcatcatgcccggctactgcgtgcagggcaccgtcggccacaagatcctcagcgggcagcggaagctcgagatggaggggcggcaggtgctggaggtcaagatgcaggtggagtacatgtcattcagcgcacacgcggacgccaagggcatcatgcagctggtgggccaggcagagccggagagcgtgctgctggtgcatggcgaggccaagaagatggagttcctgaagcagaagatcgagcaggagctccgggtcaactgctacatgccggccaatggcgagacggtgacgctgcccacaagccccagcatccccgtaggcatctcgctggggctgctgaagcgggagatggcgcaggggctgctccctgaggccaagaagcctcggctcctgcacggcaccctgatcatgaaggacagcaacttccggctggtgtcctcagagcaagccctcaaagagctgggtctggctgagcaccagctgcgcttcacctgccgcgtgcacctgcatgacacacgcaaggagcaggagacggcattgcgcgtctacagccacctcaagagcgtcctgaaggaccactgtgtgcagcacctcccggacggctctgtgactgtggagtccgtcctcctccaggccgccgccccttctgaggacccaggcaccaaggtgctgctggtctcctggacctaccaggacgaggagctggggagcttcctcacatctctgctgaagaagggcctcccccaggcccccagctgaggccggcaactcacccagccgccacctctgccctctcccagctggacagaccctgggcctgcacttcaggactgtgggtgccctgggtgaacagaccctgcaggtcccatccctggggacagaggccttgtgtcacctgcctgcccaggcagctgtttgcagctgaagaaacaaactggtctccaggctgtcttgcctttattcctggttagggcaggtggtcctagacagcagtttccagtaaaagctgaacaaaaga

SEQ ID NO: 356463 - DNA, 3507 bp, Homo sapiens
accggaagttgcagcgaggtggttgcgcctgcgcagtgcatcaccgcaggcgggcctcgcgggtccgggagcgcggcggagacgatgcctgagatcagagtcacgcccttgggggccggccaggacgtgggccgaagctgcatcctggtctccattgcgggcaagaatgtcatgctggactgtggaatgcacatgggcttcaatgacgacgtgagtcccttgggcaggaggcccagaggctgggagagccggccatccacagctggaccctgggcctcagagccgggacagtggggtggtgggcagcagtggttgtgcttggatggctgcaccctgtggggagcagggatgggtgggcctggccgaggtgagcccctgcatggtggggtccccctgtgctggcgctgagccccagccccggggtcctgtaggctggactccgtgagaccctgggctcagcttccagctcacatctgtcagtgaggttgggggtaacctcggcccctccggatgctgtgagcagccaggggtcctggtgccacctgcgggatgggagtgcccagcctgagtctgcacatagaaccccccttcctgggggcccctccctggggcatgggtggccccagatgctgcctggagaccactgtgcaacctgaaacccccacatccttcctagcgacgcttccctgacttctcctacatcacccagaacggccgcctaacagacttcctggactgtgtgatcattaggtgggttcctgttgggggccttgagggtcccatgtctgtgcctgtggggcttgggccaccttgcttggtctcggcagcgtttggcaaggggcctgtgccatccttgatcctcagggggcttctaggccccaggatctgctccctgcctgccttactggtcacacacatggcctggtctctgtctgttcttccggccctgccctctgaaccctactttctgaacccggccctccaggcttcaccctctctgatgccttcactgtctcaggatctttaaaccccactgtcttgttggcgattccagagtcccgagtctgccctgaccccagcctttagggttcagcagctcatgacccgctggtctgggtggcctcgtctggacggccacagcactcctgctggccccctgcccttccctgccctgtcctcccagcagccaggcccgtgaagcctggagaagccccttctcctctccggaggcagtgtcctcagctgcccctgagcccctcgtggttgtggtttcttctcagacacggtggggtccccaatgccttcctggggcttgccaggcgctgcccttgccctcaggtctgtgccaccttcacctgcagctccactcagcctgtcctgactgcctgaaaagccagcggctcccctatgcgcggttccctcagcagctttgcattgtctcgcgagcatgtcgccgtcaccgacgtgttcaatttcccgtttgcttattgccttgctagactttgagactgaaagttccagggagacagttttgtgtttgctcattactgactcttcggtactcgggatgaggcctggcgcacagcaggcgaatgaaggggccagtgacccacaagcccagagcgggggtgaaggctggggcagggtgggcccaggctgacctgtgctgcgtccccctagccacttccacctggaccactgcggggcactcccctacttcagcgagatggtgggctacgacggccccatctacatgactcaccccacccaggccatctgccccatcttgctggaggactaccgcaagatcgccgtagacaagaagggcgaggccaacttcttcacctcccagatgatcaaagactgcatgaagaaggtggtggctgtccacctccaccagacggtccaggtagatgatgagctggagatcaaggcctactatgcaggccacgtgctgggggcagccatgttccagattaaagtgggctcagagtctgtggtctacacgagctgcctggattgacaagtgccgccccaacctgctcatcacagagtccacgtacgccacgaccatccgtgactccaagcgctgccgggagcgagacttcctgaagaaagtccacgagaccgtggagcgtggtgggaaggtgctgatacctgtgttcgcgctgggccgcgcccaggagctctgcatcctcctggagaccttctgggagcgcatgaacctgaaggtgcccatctacttctccacggggctgaccgagaaggccaaccactactacaagctgttcatcccctggaccaaccagaagatccgcaagacttttgtgcagaggaacatgtttgagttcaagcacatcaaggccttcgaccgggcttttgctgacaacccaggaccgatggttgtgtttgccacgccaggaatgctgcacgctgggcagtccctgcagatcttccggaaatgggccggaaacgaaaagaacatggtcatcatgcccggctactgcgtgcagggcaccgtcggccacaagatcctcagcgggcagcggaagctcgagatggaggggcggcaggtgctggaggtcaagatgcaggtggagtacatgtcattcagcgcacacgcggacgccaagggcatcatgcagctggtgggccaggcagagccggagagcgtgctgctggtgcatggcgaggccaagaagatggagttcctgaagcagaagatcgagcaggagctccgggtcaactgctacatgccggccaatggcgagacggtgacgctgcccacaagccccagcatccccgtaggcatctcgctggggctgctgaagcgggagatggcgcaggggctgctccctgaggccaagaagcctcggctcctgcacggcaccctgatcatgaaggacagcaacttccggctggtgtcctcagagcaagccctcaaagagctgggtctggctgagcaccagctgcgcttcacctgccgcgtgcacctgcatgacacacgcaaggagcaggagacggcattgcgcgtctacagccacctcaagagcgtcctgaaggaccactgtgtgcagcacctcccggacggctctgtgactgtggagtccgtcctcctccaggccgccgccccttctgaggacccaggcaccaaggtgctgctggtctcctggacctaccaggacgaggagctggggagcttcctcacatctctgctgaagaagggcctcccccaggcccccagctgaggccggcaactcacccagccgccacctctgccctctcccagctggacagaccctgggcctgcacttcaggactgtgggtgccctgggtgaacagaccctgcaggtcccatccctggggacagaggccttgtgtcacctgcctgcccaggcagctgtttgcagctgaagaaacaaactggtctccaggctgtcttgcctttattcctggttagggcaggtggtcctagacagcagtttccagtaaaagctgaacaaaaga

SEQ ID NO: 356464 - DNA, 3503 bp, Homo sapiens
accggaagttgcagcgaggtggttgcgcctgcgcagtgcatcaccgcaggcgggcctcgcgggtccgggagcgcggcggagacgatgcctgagatcagagtcacgcccttgggggccggccaggacgtgggccgaagctgcatcctggtctccattgcgggcaagaatgtcatgctggactgtggaatgcacatgggcttcaatgacgacgtgagtcccttgggcaggaggcccagaggctgggagagccggccatccacagctggaccctgggcctcagagccgggacagtggggtggtgggcagcagtggttgtgcttggatggctgcaccctgtggggagcagggatgggtgggcctggccgaggtgagcccctgcatggtggggtccccctgtgctggcgctgagccccagccccggggtcctgtaggctggactccgtgagaccctgggctcagcttccagctcacatctgtcagtgaggttgggggtaacctcggcccctccggatgctgtgagcagccaggggtcctggtgccacctgcgggatgggagtgcccagcctgagtctgcacatagaaccccccttcctgggggcccctccctggggcatgggtggccccagatgctgcctggagaccactgtgcaacctgaaacccccacatccttcctagcgacgcttccctgacttctcctacatcacccagaacggccgcctaacagacttcctggactgtgtgatcattaggtgggttcctgttgggggccttgagggtcccatgtctgtgcctgtggggcttgggccaccttgcttggtctcggcagcgtttggcaaggggcctgtgccatccttgatcctcagggggcttctaggccccaggatctgctccctgcctgccttactggtcacacacatggcctggtctctgtctgttcttccggccctgccctctgaaccctactttctgaacccggccctccaggcttcaccctctctgatgccttcactgtctcaggatctttaaaccccactgtcttgttggcgattccagagtcccgagtctgccctgaccccagcctttagggttcagcagctcatgacccgctggtctgggtggcctcgtctggacggccacagcactcctgctggccccctgcccttccctgccctgtcctcccagcagccaggcccgtgaagcctggagaagccccttctcctctccggaggcagtgtcctcagctgcccctgagcccctcgtggttgtggtttcttctcagacacggtggggtccccaatgccttcctggggcttgccaggcgctgcccttgccctcaggtctgtgccaccttcacctgcagctccactcagcctgtcctgactgcctgaaaagccagcggctcccctatgcgcggttccctcagcagctttgcattgtctcgcgagcatgtcgccgtcaccgacgtgttcaatttcccgtttgcttattgccttgctagactttgagactgaaagttccagggagacagttttgtgtttgctcattactgactcttcggtactcgggatgaggcctggcgcacagcaggcgaatgaaggggccagtgacccacaagcccagagcgggggtgaaggctggggcagggtgggcccaggctgacctgtgctgcgtccccctagccacttccacctggaccactgcggggcactcccctacttcagcgagatggtgggctacgacggccccatctacatgactcaccccacccaggccatctgccccatcttgctggaggactaccgcaagatcgccgtagacaagaagggcgaggccaacttcttcacctcccagatgatcaaagactgcatgaagaaggtggtggctgtccacctccaccagacggtccaggtagatgatgagctggagatcaaggcctactatgcaggccacgtgctgggggcagccatgttccagattaaagtgggctcagagtctgtggtctacacgggtgattataacatgaccccagaccgacacttaggagctgcctggattgacaagtgccgccccaacctgctcatcacagagtccacgtacgccacgaccatccgtgactccaagcgctgccgggagcgagacttcctgaagaaagtccacgagaccgtggagcgtggtgggaaggtgctgatacctgtgttcgcgctgggccgcgcccaggagctctgcatcctcctggagaccttctgggagcgcatgaacctgaaggtgcccatctacttctccacggggctgaccgagaaggccaaccactactacaagctgttcatcccctggaccaaccagaagatccgcaagacttttgtgcagaggaacatgtttgagttcaagcacatcaaggccttcgaccgggcttttgctgacaacccaggaccgatggttgtgtttgccacgccaggaatgctgcacgctgggcagtccctgcagatcttccggaaatgggccggaaacgaaaagaacatggtcatcatgcccggctactgcgtgcagggcaccgtcggccacaagatcctcagcgggcagcggaagctcgagatggaggggcggcaggtgctggaggtcaagatgcaggtggagtacatgtcattcagcgcacacgcggacgccaagggcatcatgcagctggtgggccaggcagagccggagagcgtgctgctggtgcatggcgaggccaagaagatggagttcctgaagcagaagatcgagcaggagctccgggtcaactgctacatgccggccaatggcgagacggtgacgctgcccacaagccccagcatccccgtaggcatctcgctggggctgctgaagcgggagatggcgcaggggctgctccctgaggccaagaagcctcggctcctgcacggcaccctgatcatgaaggacagcaacttccggctggtgtcctcagagcaagccctcaaagagctgggtctggctgagcaccagctgcgcttcacctgccgcgtgcacctgcatgacacacgcaaggagcaggagacggcattgcgcgtctacagccacctcaagagcgtcctgaaggaccactgtgtgcagcacctcccggacggctctgtgactgtggagtccgtcctcctccaggccgccgccccttctgaggacccaggcaccaaggtgctgctggtctcctggacctaccaggacgaggagctggggagcttcctcacatctctgctgaagaagggcctcccccaggcccccagctgaggccggcaactcacccagccgccacctctgccctctcccagctggacagaccctgggcctgcacttcaggactgtgggtgccctgggtgaacagaccctgcaggtcccatccctggggacagaggccttgtgtcacctgcctgcccaggcagctgtttgcagctgaagaaacaaactggtggtcctagacagcagtttccagtaaaagctgaacaaaaga

SEQ ID NO: 356465 - DNA, 4509 bp, Homo sapiens
accggaagttgcagcgaggtggttgcgcctgcgcagtgcatcaccgcaggcgggcctcgcgggtccgggagcgcggcggagacgatgcctgagatcagagtcacgcccttgggggccggccaggacgtgggccgaagctgcatcctggtctccattgcgggcaagaatgtcatgctggactgtggaatgcacatgggcttcaatgacgacgtgagtcccttgggcaggaggcccagaggctgggagagccggccatccacagctggaccctgggcctcagagccgggacagtggggtggtgggcagcagtggttgtgcttggatggctgcaccctgtggggagcagggatgggtgggcctggccgaggtgagcccctgcatggtggggtccccctgtgctggcgctgagccccagccccggggtcctgtaggctggactccgtgagaccctgggctcagcttccagctcacatctgtcagtgaggttgggggtaacctcggcccctccggatgctgtgagcagccaggggtcctggtgccacctgcgggatgggagtgcccagcctgagtctgcacatagaaccccccttcctgggggcccctccctggggcatgggtggccccagatgctgcctggagaccactgtgcaacctgaaacccccacatccttcctagcgacgcttccctgacttctcctacatcacccagaacggccgcctaacagacttcctggactgtgtgatcattaggtgggttcctgttgggggccttgagggtcccatgtctgtgcctgtggggcttgggccaccttgcttggtctcggcagcgtttggcaaggggcctgtgccatccttgatcctcagggggcttctaggccccaggatctgctccctgcctgccttactggtcacacacatggcctggtctctgtctgttcttccggccctgccctctgaaccctactttctgaacccggccctccaggcttcaccctctctgatgccttcactgtctcaggatctttaaaccccactgtcttgttggcgattccagagtcccgagtctgccctgaccccagcctttagggttcagcagctcatgacccgctggtctgggtggcctcgtctggacggccacagcactcctgctggccccctgcccttccctgccctgtcctcccagcagccaggcccgtgaagcctggagaagccccttctcctctccggaggcagtgtcctcagctgcccctgagcccctcgtggttgtggtttcttctcagacacggtggggtccccaatgccttcctggggcttgccaggcgctgcccttgccctcaggtctgtgccaccttcacctgcagctccactcagcctgtcctgactgcctgaaaagccagcggctcccctatgcgcggttccctcagcagctttgcattgtctcgcgagcatgtcgccgtcaccgacgtgttcaatttcccgtttgcttattgccttgctagactttgagactgaaagttccagggagacagttttgtgtttgctcattactgactcttcggtactcgggatgaggcctggcgcacagcaggcgaatgaaggggccagtgacccacaagcccagagcgggggtgaaggctggggcagggtgggcccaggctgacctgtgctgcgtccccctagccacttccacctggaccactgcggggcactcccctacttcagcgagatggtgggctacgacggccccatctacatgactcaccccacccaggccatctgccccatcttgctggaggactaccgcaagatcgccgtagacaagaagggcgaggccaacttcttcacctcccagatgatcaaagactgcatgaagaaggtggtggctgtccacctccaccagacggtccaggtagatgatgagctggagatcaaggcctactatgcaggccacgtgctgggggcagccatgttccagattaaagtgggctcagagtctgtggtctacacgggtgattataacatgaccccagaccgacacttaggagctgcctggattgacaagtgccgccccaacctgctcatcacagagtccacgtacgccacgaccatccgtgactccaagcgctgccgggagcgagacttcctgaagaaagtccacgagaccgtggagcgtggtgggaaggtgctgatacctgtgttcgcgctgggccgcgcccaggagctctgcatcctcctggagaccttctgggagcgcatgaacctgaaggtgcccatctacttctccacggggctgaccgagaaggccaaccactactacaagctgttcatcccctggaccaaccagaagatccgcaagacttttgtgcagaggaacatgtttgagttcaagcacatcaaggccttcgaccgggcttttgctgacaacccaggaccgatggttgtgtttgccacgccaggaatgctgcacgctgggcagtccctgcagatcttccggaaatgggccggaaacgaaaagaacatggtcatcatgcccggctactgcgtgcagggcaccgtcggccacaagatcctcagcgggcagcggaagctcgagatggaggggcggcaggtgctggaggtcaagatgcaggtggagtacatgtcattcagcgcacacgcggacgccaagggcatcatgcagctggtgggccaggcagagccggagagcgtgctgctggtgcatggcgaggccaagaagatggagttcctgaagcagaagatcgagcaggagctccgggtcaactgctacatgccggccaatggcgagacggtgacgctgcccacaagccccagcatccccgtaggcatctcgctggggctgctgaagcgggagatggcgcaggggctgctccctgaggccaagaagcctcggctcctgcacggcaccctgatcatgaaggacagcaacttccggctggtgtcctcagagcaagccctcaaagagctgggtctggctgagcaccagctgcgcttcacctgccgcgtgcacctgcatgacacacgcaaggagcaggagacggcattgcgcgtctacagccacctcaagagcgtcctgaaggaccactgtgtgcagcacctcccggacggctctgtgactgtggagtccgtcctcctccaggccgccgccccttctgaggacccaggcaccaaggtgctgctggtctcctggacctaccaggacgaggagctggggagcttcctcacatctctgctgaagaagggcctcccccaggcccccagctgaggccggcaactcacccagccgccacctctgccctctcccagctggacagaccctgggcctgcacttcaggactgtgggtgccctgggtgaacagaccctgcaggtcccatccctggggacagaggccttgtgtcacctgcctgcccaggcagctgtttgcagctgaagaaacaaactggtctccaggctgtcttgcctttattcctggttagggcaggtggtcctagacagcagtttccagtaaaagctgaacaaaagaaaaaagaaaagatatagggcagagataaaaaggggggggggggcagaaataacattcctggcgggaggcgccactatgatagactcagcacagcccgtttttttgtgtaaaagggcggccccaccatagaagggtgggcttattataaaaagaagagagacgcgcgggtgaatacagaacacgacctcggtcgacggagaggaaaaacgtttatgtgtgtgtcatctttgagagagagagcaccccacctgctgtgtggggggggcgacacaatggtggcgagaccacaccatcagcatgaagaaattataagagctgagcgggtgaaaaaaaaaaaaaacatcggagatgtttgatgattgaggtgtaaaccaaacacaatgtgatataatgtggtgggatcgaggaagaaattggtgacaaaggcatgtacttaattatgatagaaaatatattccgcggcgcggcttcgtaataataaaacggctgataggagagtgacagaggaatcgagataatgcaaagaagtaatagagatgaaaagaggagtagcagcaataagcattgaattgtgaataagaaagactaagagagaactgaacaaaacagaaagaaaaaaagacagaaaaacgaagaaaagaaaaaaaaaaacagaaggagaaaaagaaaagcaagagggacaagaaaaaaaaagcgaagcagagcagagaaaaaaaaaaaaagacagagaaaagaaagataaacgacagaaagaaagcaacagacaaaaagaaaagtaaagaaaaaacagacggagagcaagacataacagacagaggaaagaacacgagcacctagaccaaggaaaacgcacacaccaacgcacggcagaaaccaagatacccaagagcacgcacagcacagcaacaagcacggagaaggaataacacaaaaggggaagaggagaagaaagaaagaagaaaaagag

SEQ ID NO: 356466 - DNA, 3480 bp, Homo sapiens
accggaagttgcagcgaggtggttgcgcctgcgcagtgcatcaccgcaggcgggcctcgcgggtccgggagcgcggcggagacgatgcctgagatcagagtcacgcccttgggggccggccaggacgtgggccgaagctgcatcctggtctccattgcgggcaagaatgtcatgctggactgtggaatgcacatgggcttcaatgacgacgtgagtcccttgggcaggaggcccagaggctgggagagccggccatccacagctggaccctgggcctcagagccgggacagtggggtggtgggcagcagtggttgtgcttggatggctgcaccctgtggggagcagggatgggtgggcctggccgaggtgagcccctgcatggtggggtccccctgtgctggcgctgagccccagccccggggtcctgtaggctggactccgtgagaccctgggctcagcttccagctcacatctgtcagtgaggttgggggtaacctcggcccctccggatgctgtgagcagccaggggtcctggtgccacctgcgggatgggagtgcccagcctgagtctgcacatagaaccccccttcctgggggcccctccctggggcatgggtggccccagatgctgcctggagaccactgtgcaacctgaaacccccacatccttcctagcgacgcttccctgacttctcctacatcacccagaacggccgcctaacagacttcctggactgtgtgatcattaggtgggttcctgttgggggccttgagggtcccatgtctgtgcctgtggggcttgggccaccttgcttggtctcggcagcgtttggcaaggggcctgtgccatccttgatcctcagggggcttctaggccccaggatctgctccctgcctgccttactggtcacacacatggcctggtctctgtctgttcttccggccctgccctctgaaccctactttctgaacccggccctccaggcttcaccctctctgatgccttcactgtctcaggatctttaaaccccactgtcttgttggcgattccagagtcccgagtctgccctgaccccagcctttagggttcagcagctcatgacccgctggtctgggtggcctcgtctggacggccacagcactcctgctggccccctgcccttccctgccctgtcctcccagcagccaggcccgtgaagcctggagaagccccttctcctctccggaggcagtgtcctcagctgcccctgagcccctcgtggttgtggtttcttctcagacacggtggggtccccaatgccttcctggggcttgccaggcgctgcccttgccctcaggtctgtgccaccttcacctgcagctccactcagcctgtcctgactgcctgaaaagccagcggctcccctatgcgcggttccctcagcagctttgcattgtctcgcgagcatgtcgccgtcaccgacgtgttcaatttcccgtttgcttattgccttgctagactttgagactgaaagttccagggagacagttttgtgtttgctcattactgactcttcggtactcgggatgaggcctggcgcacagcaggcgaatgaaggggccagtgacccacaagcccagagcgggggtgaaggctggggcagggtgggcccaggctgacctgtgctgcgtccccctagccacttccacctggaccactgcggggcactcccctacttcagcgagatggtgggctacgacggccccatctacatgactcaccccacccaggccatctgccccatcttgctggaggactaccgcaagatcgccgtagacaagaagggcgaggccaacttcttcacctcccagatgatcaaagactgcatgaagaaggtggtggctgtccacctccaccagacggtccaggtagatgatgagctggagatcaaggcctactatgcaggccacgtgctgggggcagccatgttccagattaaagtgggctcagagtctgtggtctacacgggtgattataacatgaccccagaccgacacttaggagctgcctggattgacaagtgccgccccaacctgctcatcacagagtccacgtacgccacgaccatccgtgactccaagcgctgccgggagcgagacttcctgaagaaagtccacgagaccgtggagcgtggtgggaaggtgctgatacctgtgttcgcgctgggccgcgcccaggagctctgcatcctcctggagaccttctgggagcgcatgaacctgaaggtgcccatctacttctccacggggctgaccgagaaggccaaccactactacaagctgttcatcccctggaccaaccagaagatccgcaagacttttgtgcagaggaacatgtttgagttcaagcacatcaaggccttcgaccgggcttttgctgacaacccaggaccgatggttgtgtttgccacgccaggaatgctgcacgctgggcagtccctgcagatcttccggaaatgggccggaaacgaaaagaacatggtcatcatgcccggctactgcgtgcagggcaccgtcggccacaagatcctcagcgggcagcggaagctcgagatggaggggcggcaggtgctggaggtcaagatgcaggtggagtacatgtcattcagcgcacacgcggacgccaagggcatcatgcagctggtgggccaggcagagccggagagcgtgctgctggtgcatggcgaggccaagaagatggagttcctgaagcagaagatcgagcaggagctccgggtcaactgctacatgccggccaatggcgagacggtgacgctgcccacaagccccagcatccccgtaggcatctcgctggggctgctgaagcgggagatggcgcaggaacttccggctggtgtcctcagagcaagccctcaaagagctgggtctggctgagcaccagctgcgcttcacctgccgcgtgcacctgcatgacacacgcaaggagcaggagacggcattgcgcgtctacagccacctcaagagcgtcctgaaggaccactgtgtgcagcacctcccggacggctctgtgactgtggagtccgtcctcctccaggccgccgccccttctgaggacccaggcaccaaggtgctgctggtctcctggacctaccaggacgaggagctggggagcttcctcacatctctgctgaagaagggcctcccccaggcccccagctgaggccggcaactcacccagccgccacctctgccctctcccagctggacagaccctgggcctgcacttcaggactgtgggtgccctgggtgaacagaccctgcaggtcccatccctggggacagaggccttgtgtcacctgcctgcccaggcagctgtttgcagctgaagaaacaaactggtctccaggctgtcttgcctttattcctggttagggcaggtggtcctagacagcagtttccagtaaaagctgaacaaaaga

SEQ ID NO: 356467 - DNA, 3473 bp, Homo sapiens
accggaagttgcagcgaggtggttgcgcctgcgcagtgcatcaccgcaggcgggcctcgcgggtccgggagcgcggcggagacgatgcctgagatcagagtcacgcccttgggggccggccaggacgtgggccgaagctgcatcctggtctccattgcgggcaagaatgtcatgctggactgtggaatgcacatgggcttcaatgacgacgtgagtcccttgggcaggaggcccagaggctgggagagccggccatccacagctggaccctgggcctcagagccgggacagtggggtggtgggcagcagtggttgtgcttggatggctgcaccctgtggggagcagggatgggtgggcctggccgaggtgagcccctgcatggtggggtccccctgtgctggcgctgagccccagccccggggtcctgtaggctggactccgtgagaccctgggctcagcttccagctcacatctgtcagtgaggttgggggtaacctcggcccctccggatgctgtgagcagccaggggtcctggtgccacctgcgggatgggagtgcccagcctgagtctgcacatagaaccccccttcctgggggcccctccctggggcatgggtggccccagatgctgcctggagaccactgtgcaacctgaaacccccacatccttcctagcgacgcttccctgacttctcctacatcacccagaacggccgcctaacagacttcctggactgtgtgatcattaggtgggttcctgttgggggccttgagggtcccatgtctgtgcctgtggggcttgggccaccttgcttggtctcggcagcgtttggcaaggggcctgtgccatccttgatcctcagggggcttctaggccccaggatctgctccctgcctgccttactggtcacacacatggcctggtctctgtctgttcttccggccctgccctctgaaccctactttctgaacccggccctccaggcttcaccctctctgatgccttcactgtctcaggatctttaaaccccactgtcttgttggcgattccagagtcccgagtctgccctgaccccagcctttagggttcagcagctcatgacccgctggtctgggtggcctcgtctggacggccacagcactcctgctggccccctgcccttccctgccctgtcctcccagcagccaggcccgtgaagcctggagaagccccttctcctctccggaggcagtgtcctcagctgcccctgagcccctcgtggttgtggtttcttctcagacacggtggggtccccaatgccttcctggggcttgccaggcgctgcccttgccctcaggtctgtgccaccttcacctgcagctccactcagcctgtcctgactgcctgaaaagccagcggctcccctatgcgcggttccctcagcagctttgcattgtctcgcgagcatgtcgccgtcaccgacgtgttcaatttcccgtttgcttattgccttgctagactttgagactgaaagttccagggagacagttttgtgtttgctcattactgactcttcggtactcgggatgaggcctggcgcacagcaggcgaatgaaggggccagtgacccacaagcccagagcgggggtgaaggctggggcagggtgggcccaggctgacctgtgctgcgtccccctagccacttccacctggaccactgcggggcactcccctacttcagcgagatggtgggctacgacggccccatctacatgactcaccccacccaggccatctgccccatcttgctggaggactaccgcaagatcgccgtagacaagaagggcgaggccaacttcttcacctcccagatgatcaaagactgcatgaagaaggtggtggctgtccacctccaccagacggtccaggtagatgatgagctggagatcaaggcctactatgcaggccacgtgctgggggcagccatgttccagattaaagtgggctcagagtctgtggtctacacgggtgattataacatgaccccagaccgacacttaggagctgcctggattgacaagtgccgccccaacctgctcatcacagagtccacgtacgccacgaccatccgtgactccaagcgctgccgggagcgagacttcctgaagaaagtccacgagaccgtggagcgtggtgggaaggtgctgatacctgtgttcgcgctgggccgcgcccaggagctctgcatcctcctggagaccttctgggagcgcatgaacctgaaggtgcccatctacttctccacggggctgaccgagaaggccaaccactactacaagctgttcatcccctggaccaaccagaagatccgcaagacttttgtgcagaggaacatgtttgagttcaagcacatcaaggccttcgaccgggcttttgctgacaacccaggaccgatggttgtgtttgccacgccaggaatgctgcacgctgggcagtccctgcagatcttccggaaatgggccggaaacgaaaagaacatggtcatcatgcccggctactgcgtgcagggcaccgtcggccacaagatcctcagcgggcagcggaagctcgagatggaggggcggcaggtgctggaggtcaagatgcaggtggagtacatgtcattcagcgcacacgcggacgccaagggcatcatgcagctggtgggccaggcagagccggagagcgtgctgctggtgcatggcgaggccaagaagatggagttcctgaagcagaagatcgagcaggagctccgggtcaactgctacatgccggccaatggcgagacggtgacgctgcccacaagccccagcatccccgtaggcatctcgctggggctgctgaagcgggagatggcgcaggggctgctccctgaggccaagaagcctcggctcctgcacggcaccctgatcatgaaggacagcaacttccggctggtgtcctcagagcaagccctcaaagagctgggtctggctgagcaccagctgcgcttcacctgccgcgtgcacctgcatgacacacgcaaggagcaggagacggcattgcgcgtctacagccacctcaagagcgtcctgaaggaccactgtgtgcagcacctcccggacggctctgtgactgtggagtccgtcctcctccaggccgccgccccttctgaggacccaggcaccaaggtgctgctggtctcctggacctaccaggacgaggagctggggagcttcctcacatctctgctgaagaagggcctcccccaggcccccagctgaggccggcaactcacccagccgccacctctgccctgtcccatccctggggacagaggccttgtgtcacctgcctgcccaggcagctgtttgcagctgaagaaacaaactggtctccaggctgtcttgcctttattcctggttagggcaggtggtcctagacagcagtttccagtaaaagctgaacaaaaga

SEQ ID NO: 356468 - DNA, 3373 bp, Homo sapiens
accggaagttgcagcgaggtggttgcgcctgcgcagtgcatcaccgcaggcgggcctcgcgggtccgggagcgcggcggagacgatgcctgagatcagagtcacgcccttgggggccggccaggacgtgggccgaagctgcatcctggtctccattgcgggcaagaatgtcatgctggactgtggaatgcacatgggcttcaatgacgacgtgagtcccttgggcaggaggcccagaggctgggagagccggccatccacagctggaccctgggcctcagagccgggacagtggggtggtgggcagcagtggttgtgcttggatggctgcaccctgtggggagcagggatgggtgggcctggccgaggtgagcccctgcatggtggggtccccctgtgctggcgctgagccccagccccggggtcctgtaggctggactccgtgagaccctgggctcagcttccagctcacatctgtcagtgaggttgggggtaacctcggcccctccggatgctgtgagcagccaggggtcctggtgccacctgcgggatgggagtgcccagcctgagtctgcacatagaaccccccttcctgggggcccctccctggggcatgggtggccccagatgctgcctggagaccactgtgcaacctgaaacccccacatccttcctagcgacgcttccctgacttctcctacatcacccagaacggccgcctaacagacttcctggactgtgtgatcattaggtgggttcctgttgggggccttgagggtcccatgtctgtgcctgtggggcttgggccaccttgcttggtctcggcagcgtttggcaaggggcctgtgccatccttgatcctcagggggcttctaggccccaggatctgctccctgcctgccttactggtcacacacatggcctggtctctgtctgttcttccggccctgccctctgaaccctactttctgaacccggccctccaggcttcaccctctctgatgccttcactgtctcaggatctttaaaccccactgtcttgttggcgattccagagtcccgagtctgccctgaccccagcctttagggttcagcagctcatgacccgctggtctgggtggcctcgtctggacggccacagcactcctgctggccccctgcccttccctgccctgtcctcccagcagccaggcccgtgaagcctggagaagccccttctcctctccggaggcagtgtcctcagctgcccctgagcccctcgtggttgtggtttcttctcagacacggtggggtccccaatgccttcctggggcttgccaggcgctgcccttgccctcaggtctgtgccaccttcacctgcagctccactcagcctgtcctgactgcctgaaaagccagcggctcccctatgcgcggttccctcagcagctttgcattgtctcgcgagcatgtcgccgtcaccgacgtgttcaatttcccgtttgcttattgccttgctagactttgagactgaaagttccagggagacagttttgtgtttgctcattactgactcttcggtactcgggatgaggcctggcgcacagcaggcgaatgaaggggccagtgacccacaagcccagagcgggggtgaaggctggggcagggtgggcccaggctgacctgtgctgcgtccccctagccacttccacctggaccactgcggggcactcccctacttcagcgagatggtgggctacgacggccccatctacatgactcaccccacccaggccatctgccccatcttgctggaggactaccgcaagatcgccgtagacaagaagggcgaggccaacttcttcacctcccagatgatcaaagactgcatgaagaaggtggtggctgtccacctccaccagacggtccaggtagatgatgagctggagatcaaggcctactatgcaggccacgtgctgggggcagccatgttccagattaaagtgggctcagagtctgtggtctacacgggtgattataacatgaccccagaccgacacttaggagctgcctggattgacaagtgccgccccaacctgctcatcacagagtccacgtacgccacgaccatccgtgactccaagcgctgccgggagcgagacttcctgaagaaagtccacgagaccgtggagcgtggtgggaaggtgctgatacctgtgttcgcgctgggccgcgcccaggagctctgcatcctcctggagaccttctgggagcgcatgaacctgaaggtgcccatctacttctccacggggctgaccgagaaggccaaccactactacaagctgttcatcccctggaccaaccagaagatccgcaagacttttgtgcagaggaacatgtttgagttcaagcacatcaaggccttcgaccgggcttttgctgacaacccaggaccgatggttgtgtttgccacgccaggaatgctgcacgctgggcagtccctgcagatcttccggaaatgggccggaaacgaaaagaacatggtcatcatgcccggctactgcgtgcagggcaccgtcggccacaagatcctcagcgggcagcggaagctcgagatggaggggcggcaggtgctggaggtcaagatgcaggtggagtacatgtcattcagcgcacacgcggacgccaagggcatcatgcagctggtgggccaggcagagccggagagcgtgctgctggtgcatggcgaggccaagaagatggagttcctgaagcagaagatcgagcaggagctccgggtcaactgctacatgccggccaatggcgagacggtgacgctgcccacaagccccagcatccccgtaggcatctcgctggggctgctgaagcgggagatggcgcaggggctgctccctgaggccaagaagcctcggctcctgcacggcaccctgatcatgaaggacagcaacttccggctggtgtcctcagagcaagccctcaaagagctgggtctggctgagcaccagctgcgcttcacctgccgcgtgcacctgcatgacacacgcaaggagacgaggagctggggagcttcctcacatctctgctgaagaagggcctcccccaggcccccagctgaggccggcaactcacccagccgccacctctgccctctcccagctggacagaccctgggcctgcacttcaggactgtgggtgccctgggtgaacagaccctgcaggtcccatccctggggacagaggccttgtgtcacctgcctgcccaggcagctgtttgcagctgaagaaacaaactggtctccaggctgtcttgcctttattcctggttagggcaggtggtcctagacagcagtttccagtaaaagctgaacaaaaga

SEQ ID NO: 356469 - DNA, 3329 bp, Homo sapiens
accggaagttgcagcgaggtggttgcgcctgcgcagtgcatcaccgcaggcgggcctcgcgggtccgggagcgcggcggagacgatgcctgagatcagagtcacgcccttgggggccggccaggacgtgggccgaagctgcatcctggtctccattgcgggcaagaatgtcatgctggactgtggaatgcacatgggcttcaatgacgacgtgagtcccttgggcaggaggcccagaggctgggagagccggccatccacagctggaccctgggcctcagagccgggacagtggggtggtgggcagcagtggttgtgcttggatggctgcaccctgtggggagcagggatgggtgggcctggccgaggtgagcccctgcatggtggggtccccctgtgctggcgctgagccccagccccggggtcctgtaggctggactccgtgagaccctgggctcagcttccagctcacatctgtcagtgaggttgggggtaacctcggcccctccggatgctgtgagcagccaggggtcctggtgccacctgcgggatgggagtgcccagcctgagtctgcacatagaaccccccttcctgggggcccctccctggggcatgggtggccccagatgctgcctggagaccactgtgcaacctgaaacccccacatccttcctagcgacgcttccctgacttctcctacatcacccagaacggccgcctaacagacttcctggactgtgtgatcattaggtgggttcctgttgggggccttgagggtcccatgtctgtgcctgtggggcttgggccaccttgcttggtctcggcagcgtttggcaaggggcctgtgccatccttgatcctcagggggcttctaggccccaggatctgctccctgcctgccttactggtcacacacatggcctggtctctgtctgttcttccggccctgccctctgaaccctactttctgaacccggccctccaggcttcaccctctctgatgccttcactgtctcaggatctttaaaccccactgtcttgttggcgattccagagtcccgagtctgccctgaccccagcctttagggttcagcagctcatgacccgctggtctgggtggcctcgtctggacggccacagcactcctgctggccccctgcccttccctgccctgtcctcccagcagccaggcccgtgaagcctggagaagccccttctcctctccggaggcagtgtcctcagctgcccctgagcccctcgtggttgtggtttcttctcagacacggtggggtccccaatgccttcctggggcttgccaggcgctgcccttgccctcaggtctgtgccaccttcacctgcagctccactcagcctgtcctgactgcctgaaaagccagcggctcccctatgcgcggttccctcagcagctttgcattgtctcgcgagcatgtcgccgtcaccgacgtgttcaatttcccgtttgcttattgccttgctagactttgagactgaaagttccagggagacagttttgtgtttgctcattactgactcttcggtactcgggatgaggcctggcgcacagcaggcgaatgaaggggccagtgacccacaagcccagagcgggggtgaaggctggggcagggtgggcccaggctgacctgtgctgcgtccccctagccacttccacctggaccactgcggggcactcccctacttcagcgagatggtgggctacgacggccccatctacatgactcaccccacccaggccatctgccccatcttgctggaggactaccgcaagatcgccgtagacaagaagggcgaggccaacttcttcacctcccagatgatcaaagactgcatgaagaaggtggtggctgtccacctccaccagacggtccaggtagatgatgagctggagatcaaggcctactatgcaggccacgtgctgggggcagccatgttccagattaaagtgggctcagagtctgtggtctacacgggtgattataacatgaccccagaccgacacttaggagctgcctggattgacaagtgccgccccaacctgctcatcacagagtccacgtacgccacgaccatccgtgactccaagcgctgccgggagcgagacttcctgaagaaagtccacgagaccgtggagcgtggtgggaaggtgctgatacctgtgttcgcgctgggccgcgcccaggagctctgcatcctcctggagaccttctgggagcgcatgaacctgaaggtgcccatctacttctccacggggctgaccgagaaggccaaccactactacaagctgttcatcccctggaccaaccagaagatccgcaagacttttgtgcagaggaacatgtttgagttcaagcacatcaaggccttcgaccgggcttttgctgacaacccaggaccgatggttgtgtttgccacgccaggaatgctgcacgctgggcagtccctgcagatcttccggaaatgggccggaaacgaaaagaacatgaagatggagttcctgaagcagaagatcgagcaggagctccgggtcaactgctacatgccggccaatggcgagacggtgacgctgcccacaagccccagcatccccgtaggcatctcgctggggctgctgaagcgggagatggcgcaggggctgctccctgaggccaagaagcctcggctcctgcacggcaccctgatcatgaaggacagcaacttccggctggtgtcctcagagcaagccctcaaagagctgggtctggctgagcaccagctgcgcttcacctgccgcgtgcacctgcatgacacacgcaaggagcaggagacggcattgcgcgtctacagccacctcaagagcgtcctgaaggaccactgtgtgcagcacctcccggacggctctgtgactgtggagtccgtcctcctccaggccgccgccccttctgaggacccaggcaccaaggtgctgctggtctcctggacctaccaggacgaggagctggggagcttcctcacatctctgctgaagaagggcctcccccaggcccccagctgaggccggcaactcacccagccgccacctctgccctctcccagctggacagaccctgggcctgcacttcaggactgtgggtgccctgggtgaacagaccctgcaggtcccatccctggggacagaggccttgtgtcacctgcctgcccaggcagctgtttgcagctgaagaaacaaactggtctccaggctgtcttgcctttattcctggttagggcaggtggtcctagacagcagtttccagtaaaagctgaacaaaaga

SEQ ID NO: 356470 - DNA, 3647 bp, Homo sapiens
accggaagttgcagcgaggtggttgcgcctgcgcagtgcatcaccgcaggcgggcctcgcgggtccgggagcgcggcggagacgatgcctgagatcagagtcacgcccttgggggccggccaggacgtgggccgaagctgcatcctggtctccattgcgggcaagaatgtcatgctggactgtggaatgcacatgggcttcaatgacgacgtgagtcccttgggcaggaggcccagaggctgggagagccggccatccacagctggaccctgggcctcagagccgggacagtggggtggtgggcagcagtggttgtgcttggatggctgcaccctgtggggagcagggatgggtgggcctggccgaggtgagcccctgcatggtggggtccccctgtgctggcgctgagccccagccccggggtcctgtaggctggactccgtgagaccctgggctcagcttccagctcacatctgtcagtgaggttgggggtaacctcggcccctccggatgctgtgagcagccaggggtcctggtgccacctgcgggatgggagtgcccagcctgagtctgcacatagaaccccccttcctgggggcccctccctggggcatgggtggccccagatgctgcctggagaccactgtgcaacctgaaacccccacatccttcctagcgacgcttccctgacttctcctacatcacccagaacggccgcctaacagacttcctggactgtgtgatcattaggtgggttcctgttgggggccttgagggtcccatgtctgtgcctgtggggcttgggccaccttgcttggtctcggcagcgtttggcaaggggcctgtgccatccttgatcctcagggggcttctaggccccaggatctgctccctgcctgccttactggtcacacacatggcctggtctctgtctgttcttccggccctgccctctgaaccctactttctgaacccggccctccaggcttcaccctctctgatgccttcactgtctcaggatctttaaaccccactgtcttgttggcgattccagagtcccgagtctgccctgaccccagcctttagggttcagcagctcatgacccgctggtctgggtggcctcgtctggacggccacagcactcctgctggccccctgcccttccctgccctgtcctcccagcagccaggcccgtgaagcctggagaagccccttctcctctccggaggcagtgtcctcagctgcccctgagcccctcgtggttgtggtttcttctcagacacggtggggtccccaatgccttcctggggcttgccaggcgctgcccttgccctcaggtctgtgccaccttcacctgcagctccactcagcctgtcctgactgcctgaaaagccagcggctcccctatgcgcggttccctcagcagctttgcattgtctcgcgagcatgtcgccgtcaccgacgtgttcaatttcccgtttgcttattgccttgctagactttgagactgaaagttccagggagacagttttgtgtttgctcattactgactcttcggtactcgggatgaggcctggcgcacagcaggcgaatgaaggggccagtgacccacaagcccagagcgggggtgaaggctggggcagggtgggcccaggctgacctgtgctgcgtccccctagccacttccacctggaccactgcggggcactcccctacttcagcgagatggtgggctacgacggccccatctacatgactcaccccacccaggccatctgccccatcttgctggaggactaccgcaagatcgccgtagacaagaagggcgaggccaacttcttcacctcccagatgatcaaagactgcatgaagaaggtggtggctgtccacctccaccagacggtccagattaaagtgggctcagagtctgtggtctacacgggtgattataacatgaccccagaccgacacttaggagctgcctggattgacaagtgccgccccaacctgctcatcacagagtccacgtacgccacgaccatccgtgactccaagcgctgccgggagcgagacttcctgaagaaagtccacgagaccgtggagcgtggtgggaaggtgctgatacctgtgttcgcgctgggccgcgcccaggagctctgcatcctcctggagaccttctgggagcgcatgaacctgaaggtgcccatctacttctccacggggctgaccgagaaggccaaccactactacaagctgttcatcccctggaccaaccagaagatccgcaagacttttgtgcagaggaacatgtttgagttcaagcacatcaaggccttcgaccgggcttttgctgacaacccaggaccgatggttgtgtttgccacgccaggaatgctgcacgctgggcagtccctgcagatcttccggaaatgggccggaaacgaaaagaacatggtcatcatgcccggctactgcgtgcagggcaccgtcggccacaagatcctcagcgggcagcggaagctcgagatggaggggcggcaggtggtgagtctcgaccccgcactgggctggcagggccgaggggcacctcctggtggtaaccactgtccacgccccgtggcctctgtagctggaggtcaagatgcaggtggagtacatgtcattcagcgcacacgcggacgccaagggcatcatgcagctggtgggccaggcagagccggagagcgtgctgctggtgcatggcgaggccaagaagatggagttcctgaagcagaagatcgagcaggagctccgtaggcagccgggcgggcggcgtggggcccacctcgggtcagcacgggcagcctgggctgaggctctctcttcccccggggtccaggggtcaactgctacatgccggccaatggcgagacggtgacgctgcccacaagccccagcatccccgtaggcatctcgctggggctgctgaagcgggagatggcgcaggggctgctccctgaggccaagaagcctcggctcctgcacggcaccctgatcatgaaggacagcaacttccggctggtgtcctcagagcaagccctcaaagagctgggtctggctgagcaccagctgcgcttcacctgccgcgtgcacctgcatgacacacgcaaggagcaggagacggcattgcgcgtctacagccacctcaagagcgtcctgaaggaccactgtgtgcagcacctcccggacggctctgtgactgtggagtccgtcctcctccaggccgccgccccttctgaggacccaggcaccaaggtgctgctggtctcctggacctaccaggacgaggagctggggagcttcctcacatctctgctgaagaagggcctcccccaggcccccagctgaggccggcaactcacccagccgccacctctgccctctcccagctggacagaccctgggcctgcacttcaggactgtgggtgccctgggtgaacagaccctgcaggtcccatccctggggacagaggccttgtgtcacctgcctgcccaggcagctgtttgcagctgaagaaacaaactggtctccaggctgtcttgcctttattcctggttagggcaggtggtcctagacagcagtttccagtaaaagctgaacaaaaga

SEQ ID NO: 356471 - DNA, 3737 bp, Homo sapiens
accggaagttgcagcgaggtggttgcgcctgcgcagtgcatcaccgcaggcgggcctcgcgggtccgggagcgcggcggagacgatgcctgagatcagagtcacgcccttgggggccggccaggacgtgggccgaagctgcatcctggtctccattgcgggcaagaatgtcatgctggactgtggaatgcacatgggcttcaatgacgacgtgagtcccttgggcaggaggcccagaggctgggagagccggccatccacagctggaccctgggcctcagagccgggacagtggggtggtgggcagcagtggttgtgcttggatggctgcaccctgtggggagcagggatgggtgggcctggccgaggtgagcccctgcatggtggggtccccctgtgctggcgctgagccccagccccggggtcctgtaggctggactccgtgagaccctgggctcagcttccagctcacatctgtcagtgaggttgggggtaacctcggcccctccggatgctgtgagcagccaggggtcctggtgccacctgcgggatgggagtgcccagcctgagtctgcacatagaaccccccttcctgggggcccctccctggggcatgggtggccccagatgctgcctggagaccactgtgcaacctgaaacccccacatccttcctagcgacgcttccctgacttctcctacatcacccagaacggccgcctaacagacttcctggactgtgtgatcattaggtgggttcctgttgggggccttgagggtcccatgtctgtgcctgtggggcttgggccaccttgcttggtctcggcagcgtttggcaaggggcctgtgccatccttgatcctcagggggcttctaggccccaggatctgctccctgcctgccttactggtcacacacatggcctggtctctgtctgttcttccggccctgccctctgaaccctactttctgaacccggccctccaggcttcaccctctctgatgccttcactgtctcaggatctttaaaccccactgtcttgttggcgattccagagtcccgagtctgccctgaccccagcctttagggttcagcagctcatgacccgctggtctgggtggcctcgtctggacggccacagcactcctgctggccccctgcccttccctgccctgtcctcccagcagccaggcccgtgaagcctggagaagccccttctcctctccggaggcagtgtcctcagctgcccctgagcccctcgtggttgtggtttcttctcagacacggtggggtccccaatgccttcctggggcttgccaggcgctgcccttgccctcaggtctgtgccaccttcacctgcagctccactcagcctgtcctgactgcctgaaaagccagcggctcccctatgcgcggttccctcagcagctttgcattgtctcgcgagcatgtcgccgtcaccgacgtgttcaatttcccgtttgcttattgccttgctagactttgagactgaaagttccagggagacagttttgtgtttgctcattactgactcttcggtactcgggatgaggcctggcgcacagcaggcgaatgaaggggccagtgacccacaagcccagagcgggggtgaaggctggggcagggtgggcccaggctgacctgtgctgcgtccccctagccacttccacctggaccactgcggggcactcccctacttcagcgagatggtgggctacgacggccccatctacatgactcaccccacccaggccatctgccccatcttgctggaggactaccgcaagatcgccgtagacaagaagggcgaggccaacttcttcacctcccagatgatcaaagactgcatgaagaaggtggtggctgtccacctccaccagacggtccagaggtcaggttcccagggccacagctggcacagtcactgcccacccccacaccaaccatgccctccgcccgttctacacagtttctggaaggctggggcctcagggtgagcccaccccacctcactcttgcgtccagcaccgtggggacaccaggaggcgtcagcgcgaggatgcgggtcccagaccagactgggcgccgacccgggagagcacgtgcagggtgggggtatgcactggcttacgaacccaccaggctctgtccgagcggcattgaaatggccagagtgggacaggctggtgccctcagagcgcttggagcggccagagactcgctggagctcccggggtgttgccgggcagggaggcaggggctggaggggagatgggccagctctggagggtgcctggttctgggtgtgggtcagggaagaagtgaaggttaaatcagcgagtgacaggtgaaattccatttctgacaaagattatgggtttgtctgtgtctcactcgaatctctgggtattgcttttatatttcttgaaattatattaggtacctatgtattttggaacatttaattttctgattgaacttgtcaaaatgaagtatgtttatcttttttgttgtgaaactttaatttttttttttttttgacagtgtctcactttgttacccaggctggagtgtgatcttggctcactgcagcctcggcctcccgggttgaggtgatctcccacctcggcctcccaagtagctgggactacaagcatgtgcccatacgcccagctaatttattttggtattttttgtagagatgggtatgtgttgctaaggctctcgaactcctgggctgggctccagggatcctcccacctcagcctctcaaagtgctcggattacaggcatccactgcgcctggccaaaattttgtttttaaattagcctggcgtggtgggtgcgtgcctatagtcccagctatttgggaggcggaggtggaggcgggaggacgcttgagcccaggagtttgagtgagccatgattgcgccactgcagcctgggtgacagccccaccctgtctctcaattttatttattaatttttttttgagacacaactctcgctcttgttgcccaggctggagtgcaatggcacaatctcagctcactgcaatctccgcctcccgggttcaagtaattctgccttagcctactgagtagctgggattacaggcgcccaccaccatgcccagctaacttttgtatttttagtagagacagggtttcaccgtgtcggccaggatggtcttgaactcctgacttcagatgatctgcccaccttggtctccccaagtgctgggattaaaggtgtgagccactgtgcccagcccagtatttttttgtttgtttttaccgagatggagtcccgccccattgcccaggctagagtgcagtggcgtgatctcagtacactgcaacctccacttcccaggttcaagcgattctcctgcctcagcctcctgagcagttgggattacaggcacgcacttccacacctggcttacttttgtatttttagtagagacggggtttcaccatgttggccaggctggtctccaattcctgaccccaagggatccaccttaggcctggccgccaacattctgaaccttgtcttttctctgtcatgtattcaaagtccacgctggaaactccaatttcaggtcccttcagttttttgtccgttgtctttcgttctttgtccacgttgcccgtcccttgtgaactggatgctgtgtgtgagcaccagggactgaaaagctccagtgcagtg

SEQ ID NO: 356472 - DNA, 11786 bp, Homo sapiens
gggggcgctaggcgcccttcgctccctccctctggaggagctgccgccgccaccgccgccactctgctgctgccgccgccgccgccgccgctcccgccgccattttgggttcgctttgcggaggggagacgatcccagtctcggttgcgggacccgcctcccctcagtttgccccctttagccttccacctttcccttctcctctctcgcatttccgccagtcagcttacccgctggccgcctcctgacaagcgggagggatccgccgtggacccagggaagcggaggagcctggcggccaccccctcttccccacttccctgcactctcatcgctctcggcctcggcctcggcctccgacacgagaaagatgctggtttcgagttttggagatccttgttttttatggaacacagttctgtaaaattttcataagattccttggcaataacatacgcttgtgatggaccctagaaatactgctatgttaggattgggttctgattccgaaggtttttcaagaaagagtccttctgccatcagtactggcacattggtcagtaagagagaagtagagctagaaaaaaacacaaaggaggaagaggaccttcgcaaacggaatcgagaaagaaacatcgaagctgggaaagatgatggtttgactgatgcacagcaacagttttcagtgaaagaaacaaacttttcagagggaaatttaaaattgaaaattggcctccaggctaagagaactaaaaaacctccaaagaacttggagaactatgtatgtcgacctgccataaaaacaactattaagcacccaaggaaagcacttaaaagtggaaagatgacggatgaaaagaatgaacactgtccttcaaaacgagacccttcaaagttgtacaagaaagcagatgatgttgcagccattgaatgccagtctgaagaagtcatccgtcttcattcacagggagaaaacaatcctttgtctaagaagctgtctccagtacactcagaaatggcagattatattaatgcaacgccatctactcttcttggtagccgggatcctgatttaaaggacagagcattacttaatggaggaactagtgtaacagaaaagttggcacagctgattgctacctgtcctccttccaagtcttccaagacaaaaccgaagaagttaggaactggcactacagcaggattggttagcaaggatttgatcaggaaagcaggtgttggctctgtagctggaataatacataaggacttaataaaaaagccaaccatcagcacagcagttggattggtaactaaagatcctgggaaaaagccagtgtttaatgcagcagtaggattggtcaataaggactctgtgaaaaaactgggaactggcactacagcggtattcattaataaaaacttaggcaaaaagccaggaactatcactacagtaggactgctaagcaaagattcaggaaagaagctaggaattggtattgttccaggtttagtgcataaagagtctggcaagaagttaggacttggcactgtggttggactggttaataaagatttgggaaagaaattgggttctactgttggcctagtggccaaggactgtgcaaagaagattgtagcaagttcagcaatgggattggttaataaggacattggaaagaaactaatgagttgtcctttggcaggtctgatcagtaaagatgccataaaccttaaagccgaagcactgctccccactcaggaaccgcttaaggcttcttgtagtacaaacatcaataatcaggaaagtcaggaactttctgaatccctgaaagatagtgccaccagcaaaacttttgaaaagaatgttgtacggcagaataaagaaagcatattggaaaagttctcagtacgaaaagaaatcattaatttggagaaagaaatgtttaatgaaggaacatgcattcagcaagacagtttctcatccagtgaaaagggatcttatgaaacctcaaagcatgaaaagcagcctcctgtatattgcacttctccggactttaaaatgggaggtgcttctgatgtatctaccgctaaatccccattcagtgcagtaggagaaagcaatctcccttccccatcacctactgtatctgttaatcctttaaccagaagtccccctgaaacttcttcacagttggctcctaatccattacttttaagttctactacagaactaatcgaagaaatttctgaatctgttggaaagaaccagtttacttctgaaagtacccacttgaacgttggtcataggtcagttggtcatagtataagtattgaatgtaaagggattgataaagaggtaaatgattcaaaaactacccatatagatattccaagaataagctcttcccttggaaaaaagccaagtttgacttctgaatccagcattcatactattactccttcagttgttaacttcactagtttatttagtaataagccttttttaaaactgggtgcagtatctgcatcagacaaacactgccaagttgctgaaagcctaagtactagtttgcagtccaaaccattaaaaaaaagaaaaggaagaaaacctcggtggactaaagtggtggcaagaagcacatgccggtctccaaaagggctagaattagaaagatcagagctttttaaaaacgtttcatgtagctcactatcaaatagtaattctgagccagccaagtttatgaaaaacattggacccccttcatttgtagatcatgacttccttaaacgccgattgccaaagttgagcaaatccacagctccatctcttgctctcttagctgatagtgaaaaaccatctcataagtcttttgctactcacaaactatcctccagtatgtgtgtctctagtgaccttttgtctgatatttataagcccaaaagaggaaggcctaaatctaaggagatgcctcaactggaagggccacctaaaaggactttaaaaatccctgcttctaaagtgttttctttacagtctaaggaagaacaagaacccccaattttacagccagaaattgaaatcccttccttcaaacaaggtctgtctgtgtctccttttccaaaaaagagaggcaggcctaagaggcaaatgaggtcaccagtcaagatgaagccacctgtactgtcagtggctccatttgttgccactgaaagtccaagcaagctagaatctgaaagtgacaaccatagaagtagcagtgatttctttgagagcgaggatcaacttcaggatccagatgacctagatgacagtcataggccaagtgtctgtagtatgagtgaccttgagatggaaccagataaaaaaattaccaagagaaacaatggacaattaatgaaaacaattatccgcaaaataaataaaatgaagactttaaagagaaagaaactgttgaatcagattctttcaagttctgtagaatcaagtaataaagggaaagtgcaatccaaactccataatacggtatcaagtcttgctgccacatttggctctaaattgggccaacagataaatgtcagcaagaaaggaaccatttatataggaaagagaagaggtcgcaaaccaaaaactgtcttaaatggtattctttctggtagtcctactagccttgctgttcttgagcaaacagctcaacaggcagctgggtcagcattaggacagattcttcccccattactgccttcatctgctagtagttctgagattcttccatcacctatttgctctcagtcttctgggactagtggaggtcagagccctgtaagtagtgatgcaggttttgttgaacccagttcagtgccatatttgcatttacactccagacagggcagtatgattcagactcttgcaatgaagaaggcctcaaaggggaggaggcggttatctcctcctactttgttgccaaattctccttcgcacttgagtgaactcacatctctaaaagaagctactccttccccaatcagtgagtctcatagtgatgagaccattcccagtgatagtggaattggaacagataataacagcacatcagacagggcagagaaattttgtgggcaaaaaaagaggaggcattcttttgagcatgtttctctgattccccctgaaacctctacagtgctaagcagtcttaaagaaaaacataaacacaaatgtaagcgcaggaatcatgattacctcagctatgacaagatgaaaaggcagaaacgaaaacggaaaaagaaatatccccagcttcgaaatagacaggatccagactttattgcagagctggaggaactaataagtcgcctaagtgaaattcggatcactcatcgaagtcatcattttatcccccgagatcttctgccaactatctttcgaatcaactttaatagtttctatacacatccttctttccccttagaccctttgcactacattcgaaaacctgacttaaaaaagaaaagagggagaccccctaagatgagggaggcaatggctgaaatgccttttatgcacagccttagttttcctctttctagtactggattctatccatcttatggtatgccttactctccttcaccccttacagctgctcccataggattaggttactatggaaggtatcctcccactctttatccacctcctccatctccttctttcaccacgccacttccacctccttcctatatgcatgctggtcatttacttctcaatcctgccaaataccataagaaaaagcataagctacttcgacaggaggcctttcttacaaccagcaggactcccctcctttccatgagtacctaccccagtgttcctcctgagatggcctatggttggatggttgagcacaaacacaggcaccgtcacaaacacagagaacaccgttcttctgaacaaccccaggtttctatggacactggctcttcccgatctgtcctggaatctttgaagcgctatagatttggaaaggatgctgttggagagcgatataagcataaggaaaagcaccgttgtcacatgtcctgccctcatctctctccttcaaaaagcttaataaacagagaggaacagtgggtccaccgagagccttcagaatctagtccattggccttgggattgcagacacctttacagattgactgttcagaaagttctccaagcttatcccttggaggattcactcccaactctgagccagccagcagtgatgaacatacaaaccttttcacaagtgcaataggcagctgcagagtttcaaaccctaactccagtggccggaagaaattaactgacagccctggactcttttctgcacaggacacttcactaaatcggcttcacagaaaggagtcactgccttctaacgaaagggcagtacagactttggcaggctcccagccaacctctgataaaccctcccagcggccatcagagagcacaaattgtagccctacccggaaaaggtcttcatctgagagtacttcttcaacagtaaacggagttccctctcgaagtccaagattagttgcttctggggatgactctgtggatagtctgctgcagcggatggtacaaaatgaggaccaagagcccatggagaaaagtattgatgctgtgattgcaactgcctctgcaccaccttcttccagtccaggccgtagccacagcaaggaccgaaccctgggaaaaccagacagccttttagtgcctgcagtcgcaagtgactcttgcaataatagcatctcactcctatctgaaaagttgacaagcagctgttccccccatcatatcaagagaagtgtagtggaagctatgcaacgccaagctcggaaaatgtgcaattacgacaaaatcttggccacaaagaaaaacctagaccatgtcaataaaatcttaaaagccaaaaaacttcaaaggcaggccaggacagggaataactttgtgaaacgtaggccaggtcgacctcggaaatgtccccttcaggctgtcgtatcaatgcaagcattccaggctgctcagtttgtcaacccagaattgaacagagacgaggaaggagcagcactgcacctcagtcctgacacagttacagatgtaattgaggctgttgttcagagtgtaaatctgaacccagaacataaaaaggggttgaagagaaaaggttggctattggaagaacagaccagaaaaaagcagaagccattaccagaggaagaagagcaagagaataataaaagctttaatgaagcaccagttgagattcccagtccttctgaaaccccagctaaaccttctgaacctgaaagtaccttgcagcctgtgctttctctcatcccaagggaaaagaagcccccacgtcccccaaagaagaagtatcagaaagcagggctgtattctgacgtttacaaaactacagacccaaagagtcgattgatccaattaaagaaagagaagctggagtatactccaggagagcatgaatatggattatttccagcgcccattcatgttgtgttttttgtttcaggaaagtatctaagacaaaagagaattgacttccagcttccttatgatatcctttggcagtggaaacacaatcagctatacaaaaagccagatgtcccactatataagaaaattcgttcaaatgtctacgttgatgtcaaacccctttctggttacgaagctaccacctgtaactgtaagaagccagatgatgacaccaggaagggctgtgttgatgactgcctcaatagaatgatctttgctgagtgttcccccaacacttgcccatgtggcgagcaatgctgtaaccagaggatacagaggcatgaatgggtgcaatgtctagaacgatttcgagctgaggaaaaaggttggggaatcagaaccaaagagcccctaaaagctgggcagttcatcattgaatacctaggggaggtcgtcagtgaacaggagttcaggaacaggatgattgagcagtatcataatcacagtgaccactactgcctgaacctggatagtgggatggtgattgacagttaccgcatgggaaatgaggcccgattcatcaaccatagctgtgacccaaattgtgaaatgcagaaatggtctgttaatggagtataccggattggactctatgctcttaaagacatgccagctgggactgaactcacttatgattataactttcattccttcaatgtggaaaaacagcaactttgtaagtgtggctttgagaaatgtcgaggaatcatcggaggcaagagtcagcgtgtgaatggactcaccagcagcaaaaacagccagcccatggccacacacaaaaaatctggacggtcaaaagagaagagaaagtctaagcacaagctgaagaaaaggagaggccatctctctgaggaacccagtgaaaatatcaacaccccaactagattgaccccccaattacagatgaagccaatgtccaatcgtgaaaggaactttgtgttaaagcatcatgtattcttggtccgaaactgggagaagattcgtcaaaaacaggaggaagtaaagcacaccagtgataatattcactcagcatcattatatacccgttggaatgggatctgccgagatgatgggaatatcaagtctgatgtcttcatgacccagttctctgccctgcagacagctcgatctgttcgaacaagacggttggcagctgcagaggaaaatattgaagtggctcgggcagcccgcctagcccagatcttcaaagaaatttgtgatggtatcatctcttataaagattcttcccggcaagcactggcagctccacttttgaaccttcccccaaagaaaaagaatgctgattattatgagaagatctctgatcccctagatcttatcaccatagagaagcagatcctcactggttactataagacagtggaagcttttgatgctgacatgctcaaagtctttcggaatgctgagaagtactatgggcgtaaatccccagttgggagagatgtttgtcgtctacgaaaggcctattacaatgcccggcatgaggcatcagcccagattgatgagattgtgggagagacagcaagtgaggcagacagcagtgagacctcagtctctgaaaaggagaatgggcatgagaaggacgacgatgttattcgctgtatctgtggcctctacaacgatgaaggtctcatgatccagtgtgacaagtgcatggtatggcagcactgtgattgtatgggagtgaactcagatgtggagcactacctttgtgagcagtgtgacccaaggcctgtggacagggaggttcccatgatccctcggccccactatgcccaacctggctgtgtctacttcatctgtttgctccgagatgacttgctgcttcgtcagggtgactgtgtgtatctgatgagggatagtcggcgcacccctgatggccacccggtccgtcagtcctatcgactgttatctcacattaaccgagataaacttgacatctttcgcattgagaagctttggaagaatgaaaaagaggaacggtttgcctttggtcaccattatttccgtccccacgaaacacaccactctccatcccgtcggttctatcataatgaactatttcgggtgccactctatgagatcattcccttggaggctgtagtggggacctgctgtgtgttggacctttatacgtattgtaaagggagacccaaaggagtaaaggagcaagatgtgtacatctgtgattatcggcttgacaagtcagcacacctgttttacaagatccaccggaaccgctatcctgtctgcaccaaaccctatgcttttgatcacttccccaagaagctcactcccaaaaaagatttctcgcctcattacgtcccagacaactacaagaggaatggaggacgatcatcctggaagtctgagcgctcaaagccacccctaaaagacttgggccaggaggatgatgctctacccttgattgaagaggttctagccagtcaagagcaagcagccaatgagatacccagcctggaggagccagaacgggaaggggccactgctaacgtcagtgagggtgaaaaaaaaacagaggaaagtagtcaagaaccccagtcaacctgtacccctgaggaacgacggcataaccaacgggaacgactcaaccagatcttgctcaatctccttgaaaaaatccctggaaaaaatgccattgatgtgacctacttgctggaggaaggatcaggcaggaaactgcgaaggcgtactttgtttatcccagaaaacagctttcgaaagtgaccctcaaagaatgagaacctcaagcatctgggatccagtggagctaatcagtcctgcctcctgctctctgggtatagacaggggtgggaagggtccatctgggcaaggggaatggggccatgttgttgacattaggtacttaataagccttggagctagtggagagggagaggaaagggttctgtccaagacagttcaggttaattaattttcttctccattgcttcaccttaagggttaataatgtagagaggagggaggaccacattgatgaccagaacctactggtactttatagcatttgccccaccccacagcttaggtttttctgtcatcctcagatcccacaggcattgcgaagaagctgcttcctatacccaggtataactcaaaatccaaagggatagggccaggatccctattcctaccccatctattctctgttggctccaagagctaccccagagaccttaaacagaaacagtagctgaggcttcttcctagatacctgactagggaagtttgtctctcctttcttgcccaaccaggtcaaagtaaaatgtgagttgacagctcaaagcacttgtaactgctgccccctccctacctctactccccaaaatggaatcatgggatagggaaggcccccatggggtcagaagggcacggtagttcttgcaattatttttgttttacccttcataacctgtcaaacatatttttttctaatgagaaagccaggcccccgccagcacacatgctgtttttaatgcgctgtagttcttgtgtgtctgctgtgctgtgcaaatggagattcagttcaaaataaaatcatttaaaaacctacataaaaagaactctaaacccacccctgcaacaaaagtcactacataaactgttcagcagtattcacctatcagagtatttgttgtgagtatagattatcaattgaaaacactactcttgttttcttaattgtacagttttcaatgtccctttcttaaagagacagtatatttctcttcacccctagcccatcttccctcaccctcctgaatgacatcaggaggtatatccagggtgtctccttccttcctactctcttgaccagaagttaacagactatactgtctctttaaaaataaaatttaaaaagctttgttgtcttttcagacatacatatgcatatatgttttagatgttcttataagagaaaagatggtttttaaatgtgccaagttgtgtgtgtgtgtgtatatatatgtgtgtatgtgtgtgtatatatatatgtgtgtgtgtgtgtatatatatacacacacacacacacacctgctgtgtgattggtaagcaatacaatagtaaacatgtccccattacttttttctaatattggaccaatgctgtcctaattgtacatttccccttatggtgacgatgctctgactcgtttaggtagacacattgaccaccttccattccattaaatattttttcctttttcccctttctgtgtcattcttgaggaaaaaacaaaagagagaggggatgccaatgatccccttgagcagagaaaaagcaaaataaatattttattaaagaaaaaagagaattaagaaaatagtttggagtattttcttactgtagagaagcactgtacattactaagagacctgggtataagatactcacatgtggagctggaaaaatcgcatgtccaagcccgtttgagtggtttcttttgtttttcattgcagggagtgggtgggagggaggtgggactaggggcactttgggggtctccttttagtcaaaagcgagaaaatgacaagaaagagattaaaattcaatgtttcctttatagtgttaaacactaaaattttaaaaaagatgaaaaagaaaaaaaaactttgtaaaatgcgagaacagaagcaaaagacactacgctctgtcattttatctttcttttgttgaaagactaaaaaaaaactgaaatgttttttagacaatcaaatgttaggtaagtgcaaaaacttgttttttcttactggtgtagaaattaatgcctttttttatttttcagttattttataataacgaaataaaaagaaccccccagctgccaggcgggttttggtgtttgaaatgcggggcaaagcactacatcactgcaaatagatacagagttagtctgcatgtctgtaggctgtgtgattgcggaaaatataaatgctgctaatatatttcctttttacaaaagcatatctaaatagatgattgttttgatgttaatctttgtaaattatgtattaccaattttaacattggatgtaattgcatacaaagcttgcatctcaatccttgaaagtctagtattaaatggaaaaaacttttcctaactgtggaaaaaaaaaaa

SEQ ID NO: 356473 - DNA, 11736 bp, Homo sapiens
gggggcgctaggcgcccttcgctccctccctctggaggagctgccgccgccaccgccgccactctgctgctgccgccgccgccgccgccgctcccgccgccattttgggttcgctttgcggaggggagacgatcccagtctcggttgcgggacccgcctcccctcagtttgccccctttagccttccacctttcccttctcctctctcgcatttccgccagtcagcttacccgctggccgcctcctgacaagcgggagggatccgccgtggacccagggaagcggaggagcctggcggccaccccctcttccccacttccctgcactctcatcgctctcggcctcggcctcggcctccgacacgagaaagatgctggtttcgagttttggagatccttgttttttatggaacacagttctgtaaaattttcataagattccttggcaataacatacgcttgtgatggaccctagaaatactgctatgttaggattgggttctgattccgaaggtttttcaagaaagagtccttctgccatcagtactggcacattggtcagtaagagagaagtagagctagaaaaaaacacaaaggaggaagaggaccttcgcaaacggaatcgagaaagaaacatcgaagctgggaaagatgatggtttgactgatgcacagcaacagttttcagtgaaagaaacaaacttttcagagggaaatttaaaattgaaaattggcctccaggctaagagaactaaaaaacctccaaagaacttggagaactatgtatgtcgacctgccataaaaacaactattaagcacccaaggaaagcacttaaaagtggaaagatgacggatgaaaagaatgaacactgtccttcaaaacgagacccttcaaagttgtacaagaaagcagatgatgttgcagccattgaatgccagtctgaagaagtcatccgtcttcattcacagggagaaaacaatcctttgtctaagaagctgtctccagtacactcagaaatggcagattatattaatgcaacgccatctactcttcttggtagccgggatcctgatttaaaggacagagcattacttaatggaggaactagtgtaacagaaaagttggcacagctgattgctacctgtcctccttccaagtcttccaagacaaaaccgaagaagttaggaactggcactacagcaggattggttagcaaggatttgatcaggaaagcaggtgttggctctgtagctggaataatacataaggacttaataaaaaagccaaccatcagcacagcagttggattggtaactaaagatcctgggaaaaagccagtgtttaatgcagcagtaggattggtcaataaggactctgtgaaaaaactgggaactggcactacagcggtattcattaataaaaacttaggcaaaaagccaggaactatcactacagtaggactgctaagcaaagattcaggaaagaagctaggaattggtattgttccaggtttagtgcataaagagtctggcaagaagttaggacttggcactgtggttggactggttaataaagatttgggaaagaaattgggttctactgttggcctagtggccaaggactgtgcaaagaagattgtagcaagttcagcaatgggattggttaataaggacattggaaagaaactaatgagttgtcctttggcaggtctgatcagtaaagatgccataaaccttaaagccgaagcactgctccccactcaggaaccgcttaaggcttcttgtagtacaaacatcaataatcaggaaagtcaggaactttctgaatccctgaaagatagtgccaccagcaaaacttttgaaaagaatgttgtacggcagaataaagaaagcatattggaaaagttctcagtacgaaaagaaatcattaatttggagaaagaaatgtttaatgaaggaacatgcattcagcaagacagtttctcatccagtgaaaagggatcttatgaaacctcaaagcatgaaaagcagcctcctgtatattgcacttctccggactttaaaatgggaggtgcttctgatgtatctaccgctaaatccccattcagtgcagtaggagaaagcaatctcccttccccatcacctactgtatctgttaatcctttaaccagaagtccccctgaaacttcttcacagttggctcctaatccattacttttaagttctactacagaactaatcgaagaaatttctgaatctgttggaaagaaccagtttacttctgaaagtacccacttgaacgttggtcataggtcagttggtcatagtataagtattgaatgtaaagggattgataaagaggtaaatgattcaaaaactacccatatagatattccaagaataagctcttcccttggaaaaaagccaagtttgacttctgaatccagcattcatactattactccttcagttgttaacttcactagtttatttagtaataagccttttttaaaactgggtgcagtatctgcatcagacaaacactgccaagttgctgaaagcctaagtactagtttgcagtccaaaccattaaaaaaaagaaaaggaagaaaacctcggtggactaaagtggtggcaagaagcacatgccggtctccaaaagggctagaattagaaagatcagagctttttaaaaacgtttcatgtagctcactatcaaatagtaattctgagccagccaagtttatgaaaaacattggacccccttcatttgtagatcatgacttccttaaacgccgattgccaaagttgagcaaatccacagctccatctcttgctctcttagctgatagtgaaaaaccatctcataagtcttttgctactcacaaactatcctccagtatgtgtgtctctagtgaccttttgtctgatatttataagcccaaaagaggaaggcctaaatctaaggagatgcctcaactggaagggccacctaaaaggactttaaaaatccctgcttctaaagtgttttctttacagtctaaggaagaacaagaacccccaattttacagccagaaattgaaatcccttccttcaaacaaggtctgtctgtgtctccttttccaaaaaagagaggcaggcctaagaggcaaatgaggtcaccagtcaagatgaagccacctgtactgtcagtggctccatttgttgccactgaaagtccaagcaagctagaatctgaaagtgacaaccatagaagtagcagtgatttctttgagagcgaggatcaacttcaggatccagatgacctagatgacagtcataggccaagtgtctgtagtatgagtgaccttgagatggaaccagataaaaaaattaccaagagaaacaatggacaattaatgaaaacaattatccgcaaaataaataaaatgaagactttaaagagaaagaaactgttgaatcagattctttcaagttctgtagaatcaagtaataaagggaaagtgcaatccaaactccataatacggtatcaagtcttgctgccacatttggctctaaattgggccaacagataaatgtcagcaagaaaggaaccatttatataggaaagagaagaggtcgcaaaccaaaaactgtcttaaatggtattctttctggtagtcctactagccttgctgttcttgagcaaacagctcaacaggcagctgggtcagcattaggacagattcttcccccattactgccttcatctgctagtagttctgagattcttccatcacctatttgctctcagtcttctgggactagtggaggtcagagccctgtaagtagtgatgcaggttttgttgaacccagttcagtgccatatttgcatttacactccagacagggcagtatgattcagactcttgcaatgaagaaggcctcaaaggggaggaggcggttatctcctcctactttgttgccaaattctccttcgcacttgagtgaactcacatctctaaaagaagctactccttccccaatcagtgagtctcatagtgatgagaccattcccagtgatagtggaattggaacagataataacagcacatcagacagggcagagaaattttgtgggcaaaaaaagaggaggcattcttttgagcatgtttctctgattccccctgaaacctctacagtgctaagcagtcttaaagaaaaacataaacacaaatgtaagcgcaggaatcatgattacctcagctatgacaagatgaaaaggcagaaacgaaaacggaaaaagaaatatccccagcttcgaaatagacaggatccagactttattgcagagctggaggaactaataagtcgcctaagtgaaattcggatcactcatcgaagtcatcattttatcccccgagatcttctgccaactatctttcgaatcaactttaatagtttctatacacatccttctttccccttagaccctttgcactacattcgaaaacctgacttaaaaaagaaaagagggagaccccctaagatgagggaggcaatggctgaaatgccttttatgcacagccttagttttcctctttctagtactggattctatccatcttatggtatgccttactctccttcaccccttacagctgctcccataggattaggttactatggaaggtatcctcccactctttatccacctcctccatctccttctttcaccacgccacttccacctccttcctatatgcatgctggtcatttacttctcaatcctgccaaataccataagaaaaagcataagctacttcgacaggaggcctttcttacaaccagcaggactcccctcctttccatgagtacctaccccagtgttcctcctgagatggcctatggttggatggttgagcacaaacacaggcaccgtcacaaacacagagaacaccgttcttctgaacaaccccaggtttctatggacactggctcttcccgatctgtcctggaatctttgaagcgctatagatttggaaaggatgctgttggagagcgatataagcataaggaaaagcaccgttgtcacatgtcctgccctcatctctctccttcaaaaagcttaataaacagagaggaacagtgggtccaccgagagccttcagaatctagtccattggccttgggattgcagacacctttacagattgactgttcagaaagttctccaagcttatcccttggaggattcactcccaactctgagccagccagcagtgatgaacatacaaaccttttcacaagtgcaataggcagctgcagagtttcaaaccctaactccagtggccggaagaaattaactgacagccctggactcttttctgcacaggacacttcactaaatcggcttcacagaaaggagtcactgccttctaacgaaagggcagtacagactttggcaggctcccagccaacctctgataaaccctcccagcggccatcagagagcacaaattgtagccctacccggaaaaggtcttcatctgagagtacttcttcaacagtaaacggagttccctctcgaagtccaagattagttgcttctggggatgactctgtggatagtctgctgcagcggatggtacaaaatgaggaccaagagcccatggagaaaagtattgatgctgtgattgcaactgcctctgcaccaccttcttccagtccaggccgtagccacagcaaggaccgaaccctgggaaaaccagacagccttttagtgcctgcagtcgcaagtgactcttgcaataatagcatctcactcctatctgaaaagttgacaagcagctgttccccccatcatatcaagagaagtgtagtggaagctatgcaacgccaagctcggaaaatgtgcaattacgacaaaatcttggccacaaagaaaaacctagaccatgtcaataaaatcttaaaagccaaaaaacttcaaaggcaggccaggacagggaataactttgtgaaacgtaggccaggtcgacctcggaaatgtccccttcaggctgtcgtatcaatgcaagcattccaggctgctcagtttgtcaacccagaattgaacagagacgaggaaggagcagcactgcacctcagtcctgacacagttacagatgtaattgaggctgttgttcagagtgtaaatctgaacccagaacataaaaaggggttgaagagaaaaggttggctattggaagaacagaccagaaaaaagcagaagccattaccagaggaagaagagcaagagaataataaaagctttaatgaagcaccagttgagattcccagtccttctgaaaccccagctaaaccttctgaacctgaaagtaccttgcagcctgtgctttctctcatcccaagggaaaagaagcccccacgtcccccaaagaagaagtatcagaaagcagggctgtattctgacgtttacaaaactacagacccaaagagtcgattgatccaattaaagaaagagaagctggagtatactccaggagagcatgaatatggattatttccagcgcccattcatgttgtgttttttgtttcaggaaagtatctaagacaaaagagaattgacttccagcttccttatgatatcctttggcagtggaaacacaatcagctatacaaaaagccagatgtcccactatataagaaaattcgttcaaatgtctacgttgatgtcaaacccctttctggttacgaagctaccacctgtaactgtaagaagccagatgatgacaccaggaagggctgtgttgatgactgcctcaatagaatgatctttgctgagtgttcccccaacacttgcccatgtggcgagcaatgctgtaaccagaggatacagaggcatgaatgggtgcaatgtctagaacgatttcgagctgaggaaaaaggttggggaatcagaaccaaagagcccctaaaagctgggcagttcatcattgaatacctaggggaggtcgtcagtgaacaggagttcaggaacaggatgattgagcagtatcataatcacagtgaccactactgcctgaacctggatagtgggatggtgattgacagttaccgcatgggaaatgaggcccgattcatcaaccatagctgtgacccaaattgtgaaatgcagaaatggtctgttaatggagtataccggattggactctatgctcttaaagacatgccagctgggactgaactcacttatgattataactttcattccttcaatgtggaaaaacagcaactttgtaagtgtggctttgagaaatgtcgaggaatcatcggaggcaagagtcagcgtgtgaatggactcaccagcagcaaaaacagccagcccatggccacacacaaaaaatctggacggtcaaaagagaagagaaagtctaagcacaagctgaagaaaaggagaggccatctctctgaggaacccagtgaaaatatcaacaccccaactagattgaccccccaattacagatgaagccaatgtccaatcgtgaaaggaactttgtgttaaagcatcatgtattcttggtccgaaactgggagaagattcgtcaaaaacaggaggaagtaaagcacaccagtgataatattcactcagcatcattatatacccgttggaatgggatctgccgagatgatgggaatatcaagtctgatgtcttcatgacccagttctctgccctgcagacagctcgatctgttcgaacaagacggttggcagctgcagaggaaaatattgaagtggctcgggcagcccgcctagcccagatcttcaaagaaatttgtgatggtatcatctcttataaagattcttcccggcaagcactggcagctccacttttgaaccttcccccaaagaaaaagaatgctgattattatgagaagatctctgatcccctagatcttatcaccatagagaagcagatcctcactggttactataagacagtggaagcttttgatgctgacatgctcaaagtctttcggaatgctgagaagtactatgggcgtaaatccccagttgggagagatgtttgtcgtctacgaaaggcctattacaatgcccggcatgaggcatcagcccagattgatgagattgtgggagagacagcaagtgaggcagacagcagtgagacctcagtctctgaaaaggagaatgggcatgagaaggacgacgatgttattcgctgtatctgtggcctctacaacgatgaaggtctcatgatccagtgtgacaagtgcatggtatggcagcactgtgattgtatgggagtgaactcagatgtggagcactacctttgtgagcagtgtgacccaaggcctgtggacagggaggttcccatgatccctcggccccactatgcccaacctggctgtgtctacttcatctgtttgctccgagatgacttgctgcttcgtcagggtgactgtgtgtatctgatgagggatagtcggcgcacccctgatggccacccggtccgtcagtcctatcgactgttatctcacattaaccgagataaacttgacatctttcgcattgagaagctttggaagaatgaaaaaccactctccatcccgtcggttctatcataatgaactatttcgggtgccactctatgagatcattcccttggaggctgtagtggggacctgctgtgtgttggacctttatacgtattgtaaagggagacccaaaggagtaaaggagcaagatgtgtacatctgtgattatcggcttgacaagtcagcacacctgttttacaagatccaccggaaccgctatcctgtctgcaccaaaccctatgcttttgatcacttccccaagaagctcactcccaaaaaagatttctcgcctcattacgtcccagacaactacaagaggaatggaggacgatcatcctggaagtctgagcgctcaaagccacccctaaaagacttgggccaggaggatgatgctctacccttgattgaagaggttctagccagtcaagagcaagcagccaatgagatacccagcctggaggagccagaacgggaaggggccactgctaacgtcagtgagggtgaaaaaaaaacagaggaaagtagtcaagaaccccagtcaacctgtacccctgaggaacgacggcataaccaacgggaacgactcaaccagatcttgctcaatctccttgaaaaaatccctggaaaaaatgccattgatgtgacctacttgctggaggaaggatcaggcaggaaactgcgaaggcgtactttgtttatcccagaaaacagctttcgaaagtgaccctcaaagaatgagaacctcaagcatctgggatccagtggagctaatcagtcctgcctcctgctctctgggtatagacaggggtgggaagggtccatctgggcaaggggaatggggccatgttgttgacattaggtacttaataagccttggagctagtggagagggagaggaaagggttctgtccaagacagttcaggttaattaattttcttctccattgcttcaccttaagggttaataatgtagagaggagggaggaccacattgatgaccagaacctactggtactttatagcatttgccccaccccacagcttaggtttttctgtcatcctcagatcccacaggcattgcgaagaagctgcttcctatacccaggtataactcaaaatccaaagggatagggccaggatccctattcctaccccatctattctctgttggctccaagagctaccccagagaccttaaacagaaacagtagctgaggcttcttcctagatacctgactagggaagtttgtctctcctttcttgcccaaccaggtcaaagtaaaatgtgagttgacagctcaaagcacttgtaactgctgccccctccctacctctactccccaaaatggaatcatgggatagggaaggcccccatggggtcagaagggcacggtagttcttgcaattatttttgttttacccttcataacctgtcaaacatatttttttctaatgagaaagccaggcccccgccagcacacatgctgtttttaatgcgctgtagttcttgtgtgtctgctgtgctgtgcaaatggagattcagttcaaaataaaatcatttaaaaacctacataaaaagaactctaaacccacccctgcaacaaaagtcactacataaactgttcagcagtattcacctatcagagtatttgttgtgagtatagattatcaattgaaaacactactcttgttttcttaattgtacagttttcaatgtccctttcttaaagagacagtatatttctcttcacccctagcccatcttccctcaccctcctgaatgacatcaggaggtatatccagggtgtctccttccttcctactctcttgaccagaagttaacagactatactgtctctttaaaaataaaatttaaaaagctttgttgtcttttcagacatacatatgcatatatgttttagatgttcttataagagaaaagatggtttttaaatgtgccaagttgtgtgtgtgtgtgtatatatatgtgtgtatgtgtgtgtatatatatatgtgtgtgtgtgtgtatatatatacacacacacacacacacctgctgtgtgattggtaagcaatacaatagtaaacatgtccccattacttttttctaatattggaccaatgctgtcctaattgtacatttccccttatggtgacgatgctctgactcgtttaggtagacacattgaccaccttccattccattaaatattttttcctttttcccctttctgtgtcattcttgaggaaaaaacaaaagagagaggggatgccaatgatccccttgagcagagaaaaagcaaaataaatattttattaaagaaaaaagagaattaagaaaatagtttggagtattttcttactgtagagaagcactgtacattactaagagacctgggtataagatactcacatgtggagctggaaaaatcgcatgtccaagcccgtttgagtggtttcttttgtttttcattgcagggagtgggtgggagggaggtgggactaggggcactttgggggtctccttttagtcaaaagcgagaaaatgacaagaaagagattaaaattcaatgtttcctttatagtgttaaacactaaaattttaaaaaagatgaaaaagaaaaaaaaactttgtaaaatgcgagaacagaagcaaaagacactacgctctgtcattttatctttcttttgttgaaagactaaaaaaaaactgaaatgttttttagacaatcaaatgttaggtaagtgcaaaaacttgttttttcttactggtgtagaaattaatgcctttttttatttttcagttattttataataacgaaataaaaagaaccccccagctgccaggcgggttttggtgtttgaaatgcggggcaaagcactacatcactgcaaatagatacagagttagtctgcatgtctgtaggctgtgtgattgcggaaaatataaatgctgctaatatatttcctttttacaaaagcatatctaaatagatgattgttttgatgttaatctttgtaaattatgtattaccaattttaacattggatgtaattgcatacaaagcttgcatctcaatccttgaaagtctagtattaaatggaaaaaacttttcctaactgtggaaaaaaaaaaa

SEQ ID NO: 356474 - DNA, 11447 bp, Homo sapiens
gaggcttgggcttgcgccgttgaagagaaagatgctggtttcgagttttggagatccttgttttttatggaacacagttctgtaaaattttcataagattccttggcaataacatacgcttgtgatggaccctagaaatactgctatgttaggattgggttctgattccgaaggtttttcaagaaagagtccttctgccatcagtactggcacattggtcagtaagagagaagtagagctagaaaaaaacacaaaggaggaagaggaccttcgcaaacggaatcgagaaagaaacatcgaagctgggaaagatgatggtttgactgatgcacagcaacagttttcagtgaaagaaacaaacttttcagagggaaatttaaaattgaaaattggcctccaggctaagagaactaaaaaacctccaaagaacttggagaactatgtatgtcgacctgccataaaaacaactattaagcacccaaggaaagcacttaaaagtggaaagatgacggatgaaaagaatgaacactgtccttcaaaacgagacccttcaaagttgtacaagaaagcagatgatgttgcagccattgaatgccagtctgaagaagtcatccgtcttcattcacagggagaaaacaatcctttgtctaagaagctgtctccagtacactcagaaatggcagattatattaatgcaacgccatctactcttcttggtagccgggatcctgatttaaaggacagagcattacttaatggaggaactagtgtaacagaaaagttggcacagctgattgctacctgtcctccttccaagtcttccaagacaaaaccgaagaagttaggaactggcactacagcaggattggttagcaaggatttgatcaggaaagcaggtgttggctctgtagctggaataatacataaggacttaataaaaaagccaaccatcagcacagcagttggattggtaactaaagatcctgggaaaaagccagtgtttaatgcagcagtaggattggtcaataaggactctgtgaaaaaactgggaactggcactacagcggtattcattaataaaaacttaggcaaaaagccaggaactatcactacagtaggactgctaagcaaagattcaggaaagaagctaggaattggtattgttccaggtttagtgcataaagagtctggcaagaagttaggacttggcactgtggttggactggttaataaagatttgggaaagaaattgggttctactgttggcctagtggccaaggactgtgcaaagaagattgtagcaagttcagcaatgggattggttaataaggacattggaaagaaactaatgagttgtcctttggcaggtctgatcagtaaagatgccataaaccttaaagccgaagcactgctccccactcaggaaccgcttaaggcttcttgtagtacaaacatcaataatcaggaaagtcaggaactttctgaatccctgaaagatagtgccaccagcaaaacttttgaaaagaatgttgtacggcagaataaagaaagcatattggaaaagttctcagtacgaaaagaaatcattaatttggagaaagaaatgtttaatgaaggaacatgcattcagcaagacagtttctcatccagtgaaaagggatcttatgaaacctcaaagcatgaaaagcagcctcctgtatattgcacttctccggactttaaaatgggaggtgcttctgatgtatctaccgctaaatccccattcagtgcagtaggagaaagcaatctcccttccccatcacctactgtatctgttaatcctttaaccagaagtccccctgaaacttcttcacagttggctcctaatccattacttttaagttctactacagaactaatcgaagaaatttctgaatctgttggaaagaaccagtttacttctgaaagtacccacttgaacgttggtcataggtcagttggtcatagtataagtattgaatgtaaagggattgataaagaggtaaatgattcaaaaactacccatatagatattccaagaataagctcttcccttggaaaaaagccaagtttgacttctgaatccagcattcatactattactccttcagttgttaacttcactagtttatttagtaataagccttttttaaaactgggtgcagtatctgcatcagacaaacactgccaagttgctgaaagcctaagtactagtttgcagtccaaaccattaaaaaaaagaaaaggaagaaaacctcggtggactaaagtggtggcaagaagcacatgccggtctccaaaagggctagaattagaaagatcagagctttttaaaaacgtttcatgtagctcactatcaaatagtaattctgagccagccaagtttatgaaaaacattggacccccttcatttgtagatcatgacttccttaaacgccgattgccaaagttgagcaaatccacagctccatctcttgctctcttagctgatagtgaaaaaccatctcataagtcttttgctactcacaaactatcctccagtatgtgtgtctctagtgaccttttgtctgatatttataagcccaaaagaggaaggcctaaatctaaggagatgcctcaactggaagggccacctaaaaggactttaaaaatccctgcttctaaagtgttttctttacagtctaaggaagaacaagaacccccaattttacagccagaaattgaaatcccttccttcaaacaaggtctgtctgtgtctccttttccaaaaaagagaggcaggcctaagaggcaaatgaggtcaccagtcaagatgaagccacctgtactgtcagtggctccatttgttgccactgaaagtccaagcaagctagaatctgaaagtgacaaccatagaagtagcagtgatttctttgagagcgaggatcaacttcaggatccagatgacctagatgacagtcataggccaagtgtctgtagtatgagtgaccttgagatggaaccagataaaaaaattaccaagagaaacaatggacaattaatgaaaacaattatccgcaaaataaataaaatgaagactttaaagagaaagaaactgttgaatcagattctttcaagttctgtagaatcaagtaataaagggaaagtgcaatccaaactccataatacggtatcaagtcttgctgccacatttggctctaaattgggccaacagataaatgtcagcaagaaaggaaccatttatataggaaagagaagaggtcgcaaaccaaaaactgtcttaaatggtattctttctggtagtcctactagccttgctgttcttgagcaaacagctcaacaggcagctgggtcagcattaggacagattcttcccccattactgccttcatctgctagtagttctgagattcttccatcacctatttgctctcagtcttctgggactagtggaggtcagagccctgtaagtagtgatgcaggttttgttgaacccagttcagtgccatatttgcatttacactccagacagggcagtatgattcagactcttgcaatgaagaaggcctcaaaggggaggaggcggttatctcctcctactttgttgccaaattctccttcgcacttgagtgaactcacatctctaaaagaagctactccttccccaatcagtgagtctcatagtgatgagaccattcccagtgatagtggaattggaacagataataacagcacatcagacagggcagagaaattttgtgggcaaaaaaagaggaggcattcttttgagcatgtttctctgattccccctgaaacctctacagtgctaagcagtcttaaagaaaaacataaacacaaatgtaagcgcaggaatcatgattacctcagctatgacaagatgaaaaggcagaaacgaaaacggaaaaagaaatatccccagcttcgaaatagacaggatccagactttattgcagagctggaggaactaataagtcgcctaagtgaaattcggatcactcatcgaagtcatcattttatcccccgagatcttctgccaactatctttcgaatcaactttaatagtttctatacacatccttctttccccttagaccctttgcactacattcgaaaacctgacttaaaaaagaaaagagggagaccccctaagatgagggaggcaatggctgaaatgccttttatgcacagccttagttttcctctttctagtactggattctatccatcttatggtatgccttactctccttcaccccttacagctgctcccataggattaggttactatggaaggtatcctcccactctttatccacctcctccatctccttctttcaccacgccacttccacctccttcctatatgcatgctggtcatttacttctcaatcctgccaaataccataagaaaaagcataagctacttcgacaggaggcctttcttacaaccagcaggactcccctcctttccatgagtacctaccccagtgttcctcctgagatggcctatggttggatggttgagcacaaacacaggcaccgtcacaaacacagagaacaccgttcttctgaacaaccccaggtttctatggacactggctcttcccgatctgtcctggaatctttgaagcgctatagatttggaaaggatgctgttggagagcgatataagcataaggaaaagcaccgttgtcacatgtcctgccctcatctctctccttcaaaaagcttaataaacagagaggaacagtgggtccaccgagagccttcagaatctagtccattggccttgggattgcagacacctttacagattgactgttcagaaagttctccaagcttatcccttggaggattcactcccaactctgagccagccagcagtgatgaacatacaaaccttttcacaagtgcaataggcagctgcagagtttcaaaccctaactccagtggccggaagaaattaactgacagccctggactcttttctgcacaggacacttcactaaatcggcttcacagaaaggagtcactgccttctaacgaaagggcagtacagactttggcaggctcccagccaacctctgataaaccctcccagcggccatcagagagcacaaattgtagccctacccggaaaaggtcttcatctgagagtacttcttcaacagtaaacggagttccctctcgaagtccaagattagttgcttctggggatgactctgtggatagtctgctgcagcggatggtacaaaatgaggaccaagagcccatggagaaaagtattgatgctgtgattgcaactgcctctgcaccaccttcttccagtccaggccgtagccacagcaaggaccgaaccctgggaaaaccagacagccttttagtgcctgcagtcgcaagtgactcttgcaataatagcatctcactcctatctgaaaagttgacaagcagctgttccccccatcatatcaagagaagtgtagtggaagctatgcaacgccaagctcggaaaatgtgcaattacgacaaaatcttggccacaaagaaaaacctagaccatgtcaataaaatcttaaaagccaaaaaacttcaaaggcaggccaggacagggaataactttgtgaaacgtaggccaggtcgacctcggaaatgtccccttcaggctgtcgtatcaatgcaagcattccaggctgctcagtttgtcaacccagaattgaacagagacgaggaaggagcagcactgcacctcagtcctgacacagttacagatgtaattgaggctgttgttcagagtgtaaatctgaacccagaacataaaaaggggttgaagagaaaaggttggctattggaagaacagaccagaaaaaagcagaagccattaccagaggaagaagagcaagagaataataaaagctttaatgaagcaccagttgagattcccagtccttctgaaaccccagctaaaccttctgaacctgaaagtaccttgcagcctgtgctttctctcatcccaagggaaaagaagcccccacgtcccccaaagaagaagtatcagaaagcagggctgtattctgacgtttacaaaactacagacccaaagagtcgattgatccaattaaagaaagagaagctggagtatactccaggagagcatgaatatggattatttccagcgcccattcatgttgtgttttttgtttcaggaaagtatctaagacaaaagagaattgacttccagcttccttatgatatcctttggcagtggaaacacaatcagctatacaaaaagccagatgtcccactatataagaaaattcgttcaaatgtctacgttgatgtcaaacccctttctggttacgaagctaccacctgtaactgtaagaagccagatgatgacaccaggaagggctgtgttgatgactgcctcaatagaatgatctttgctgagtgttcccccaacacttgcccatgtggcgagcaatgctgtaaccagaggatacagaggcatgaatgggtgcaatgtctagaacgatttcgagctgaggaaaaaggttggggaatcagaaccaaagagcccctaaaagctgggcagttcatcattgaatacctaggggaggtcgtcagtgaacaggagttcaggaacaggatgattgagcagtatcataatcacagtgaccactactgcctgaacctggatagtgggatggtgattgacagttaccgcatgggaaatgaggcccgattcatcaaccatagctgtgacccaaattgtgaaatgcagaaatggtctgttaatggagtataccggattggactctatgctcttaaagacatgccagctgggactgaactcacttatgattataactttcattccttcaatgtggaaaaacagcaactttgtaagtgtggctttgagaaatgtcgaggaatcatcggaggcaagagtcagcgtgtgaatggactcaccagcagcaaaaacagccagcccatggccacacacaaaaaatctggacggtcaaaagagaagagaaagtctaagcacaagctgaagaaaaggagaggccatctctctgaggaacccagtgaaaatatcaacaccccaactagattgaccccccaattacagatgaagccaatgtccaatcgtgaaaggaactttgtgttaaagcatcatgtattcttggtccgaaactgggagaagattcgtcaaaaacaggaggaagtaaagcacaccagtgataatattcactcagcatcattatatacccgttggaatgggatctgccgagatgatgggaatatcaagtctgatgtcttcatgacccagttctctgccctgcagacagctcgatctgttcgaacaagacggttggcagctgcagaggaaaatattgaagtggctcgggcagcccgcctagcccagatcttcaaagaaatttgtgatggtatcatctcttataaagattcttcccggcaagcactggcagctccacttttgaaccttcccccaaagaaaaagaatgctgattattatgagaagatctctgatcccctagatcttatcaccatagagaagcagatcctcactggttactataagacagtggaagcttttgatgctgacatgctcaaagtctttcggaatgctgagaagtactatgggcgtaaatccccagttgggagagatgtttgtcgtctacgaaaggcctattacaatgcccggcatgaggcatcagcccagattgatgagattgtgggagagacagcaagtgaggcagacagcagtgagacctcagtctctgaaaaggagaatgggcatgagaaggacgacgatgttattcgctgtatctgtggcctctacaacgatgaaggtctcatgatccagtgtgacaagtgcatggtatggcagcactgtgattgtatgggagtgaactcagatgtggagcactacctttgtgagcagtgtgacccaaggcctgtggacagggaggttcccatgatccctcggccccactatgcccaacctggctgtgtctacttcatctgtttgctccgagatgacttgctgcttcgtcagggtgactgtgtgtatctgatgagggatagtcggcgcacccctgatggccacccggtccgtcagtcctatcgactgttatctcacattaaccgagataaacttgacatctttcgcattgagaagctttggaagaatgaaaaagaggaacggtttgcctttggtcaccattatttccgtccccacgaaacacaccactctccatcccgtcggttctatcataatgaactatttcgggtgccactctatgagatcattcccttggaggctgtagtggggacctgctgtgtgttggacctttatacgtattgtaaagggagacccaaaggagtaaaggagcaagatgtgtacatctgtgattatcggcttgacaagtcagcacacctgttttacaagatccaccggaaccgctatcctgtctgcaccaaaccctatgcttttgatcacttccccaagaagctcactcccaaaaaagatttctcgcctcattacgtcccagacaactacaagaggaatggaggacgatcatcctggaagtctgagcgctcaaagccacccctaaaagacttgggccaggaggatgatgctctacccttgattgaagaggttctagccagtcaagagcaagcagccaatgagatacccagcctggaggagccagaacgggaaggggccactgctaacgtcagtgagggtgaaaaaaaaacagaggaaagtagtcaagaaccccagtcaacctgtacccctgaggaacgacggcataaccaacgggaacgactcaaccagatcttgctcaatctccttgaaaaaatccctggaaaaaatgccattgatgtgacctacttgctggaggaaggatcaggcaggaaactgcgaaggcgtactttgtttatcccagaaaacagctttcgaaagtgaccctcaaagaatgagaacctcaagcatctgggatccagtggagctaatcagtcctgcctcctgctctctgggtatagacaggggtgggaagggtccatctgggcaaggggaatggggccatgttgttgacattaggtacttaataagccttggagctagtggagagggagaggaaagggttctgtccaagacagttcaggttaattaattttcttctccattgcttcaccttaagggttaataatgtagagaggagggaggaccacattgatgaccagaacctactggtactttatagcatttgccccaccccacagcttaggtttttctgtcatcctcagatcccacaggcattgcgaagaagctgcttcctatacccaggtataactcaaaatccaaagggatagggccaggatccctattcctaccccatctattctctgttggctccaagagctaccccagagaccttaaacagaaacagtagctgaggcttcttcctagatacctgactagggaagtttgtctctcctttcttgcccaaccaggtcaaagtaaaatgtgagttgacagctcaaagcacttgtaactgctgccccctccctacctctactccccaaaatggaatcatgggatagggaaggcccccatggggtcagaagggcacggtagttcttgcaattatttttgttttacccttcataacctgtcaaacatatttttttctaatgagaaagccaggcccccgccagcacacatgctgtttttaatgcgctgtagttcttgtgtgtctgctgtgctgtgcaaatggagattcagttcaaaataaaatcatttaaaaacctacataaaaagaactctaaacccacccctgcaacaaaagtcactacataaactgttcagcagtattcacctatcagagtatttgttgtgagtatagattatcaattgaaaacactactcttgttttcttaattgtacagttttcaatgtccctttcttaaagagacagtatatttctcttcacccctagcccatcttccctcaccctcctgaatgacatcaggaggtatatccagggtgtctccttccttcctactctcttgaccagaagttaacagactatactgtctctttaaaaataaaatttaaaaagctttgttgtcttttcagacatacatatgcatatatgttttagatgttcttataagagaaaagatggtttttaaatgtgccaagttgtgtgtgtgtgtgtatatatatgtgtgtatgtgtgtgtatatatatatgtgtgtgtgtgtgtatatatatacacacacacacacacacctgctgtgtgattggtaagcaatacaatagtaaacatgtccccattacttttttctaatattggaccaatgctgtcctaattgtacatttccccttatggtgacgatgctctgactcgtttaggtagacacattgaccaccttccattccattaaatattttttcctttttcccctttctgtgtcattcttgaggaaaaaacaaaagagagaggggatgccaatgatccccttgagcagagaaaaagcaaaataaatattttattaaagaaaaaagagaattaagaaaatagtttggagtattttcttactgtagagaagcactgtacattactaagagacctgggtataagatactcacatgtggagctggaaaaatcgcatgtccaagcccgtttgagtggtttcttttgtttttcattgcagggagtgggtgggagggaggtgggactaggggcactttgggggtctccttttagtcaaaagcgagaaaatgacaagaaagagattaaaattcaatgtttcctttatagtgttaaacactaaaattttaaaaaagatgaaaaagaaaaaaaaactttgtaaaatgcgagaacagaagcaaaagacactacgctctgtcattttatctttcttttgttgaaagactaaaaaaaaactgaaatgttttttagacaatcaaatgttaggtaagtgcaaaaacttgttttttcttactggtgtagaaattaatgcctttttttatttttcagttattttataataacgaaataaaaagaaccccccagctgccaggcgggttttggtgtttgaaatgcggggcaaagcactacatcactgcaaatagatacagagttagtctgcatgtctgtaggctgtgtgattgcggaaaatataaatgctgctaatatatttcctttttacaaaagcatatctaaatagatgattgttttgatgttaatctttgtaaattatgtattaccaattttaacattggatgtaattgcatacaaagcttgcatctcaatccttgaaagtctagtattaaatggaaaaaacttttcctaactgtggaaaaaaaaaaa

SEQ ID NO: 356475 - DNA, 10002 bp, Homo sapiens
gggggcgctaggcgcccttcgctccctccctctggaggagctgccgccgccaccgccgccactctgctgctgccgccgccgccgccgccgctcccgccgccattttgggttcgctttgcggaggggagacgatcccagtctcggttgcgggacccgcctcccctcagtttgccccctttagccttccacctttcccttctcctctctcgcatttccgccagtcagcttacccgctggccgcctcctgacaagcgggagggatccgccgtggacccagggaagcggaggagcctggcggccaccccctcttccccacttccctgcactctcatcgctctcggcctcggcctcggcctccgacacgagaaagatgctggtttcgagttttggagatccttgttttttatggaacacagttctgtaaaattttcataagattccttggcaataacatacgcttgtgatggaccctagaaatactgctatgttaggattgggttctgattccgaaggtttttcaagaaagagtccttctgccatcagtactggcacattggtcagtaagagagaagtagagctagaaaaaaacacaaaggaggaagaggaccttcgcaaacggaatcgagaaagaaacatcgaagctgggaaagatgatggtttgactgatgcacagcaacagttttcagtgaaagaaacaaacttttcagagggaaatttaaaattgaaaattggcctccaggctaagagaactaaaaaacctccaaagaacttggagaactatgtatgtcgacctgccataaaaacaactattaagcacccaaggaaagcacttaaaagtggaaagatgacggatgaaaagaatgaacactgtccttcaaaacgagacccttcaaagttgtacaagaaagcagatgatgttgcagccattgaatgccagtctgaagaagtcatccgtcttcattcacagggagaaaacaatcctttgtctaagaagctgtctccagtacactcagaaatggcagattatattaatgcaacgccatctactcttcttggtagccgggatcctgatttaaaggacagagcattacttaatggaggaactagtgtaacagaaaagttggcacagctgattgctacctgtcctccttccaagtcttccaagacaaaaccgaagaagttaggaactggcactacagcaggattggttagcaaggatttgatcaggaaagcaggtgttggctctgtagctggaataatacataaggacttaataaaaaagccaaccatcagcacagcagttggattggtaactaaagatcctgggaaaaagccagtgtttaatgcagcagtaggattggtcaataaggactctgtgaaaaaactgggaactggcactacagcggtattcattaataaaaacttaggcaaaaagccaggaactatcactacagtaggactgctaagcaaagattcaggaaagaagctaggaattggtattgttccaggtttagtgcataaagagtctggcaagaagttaggacttggcactgtggttggactggttaataaagatttgggaaagaaattgggttctactgttggcctagtggccaaggactgtgcaaagaagattgtagcaagttcagcaatgggattggttaataaggacattggaaagaaactaatgagttgtcctttggcaggtctgatcagtaaagatgccataaaccttaaagccgaagcactgctccccactcaggaaccgcttaaggcttcttgtagtacaaacatcaataatcaggaaagtcaggaactttctgaatccctgaaagatagtgccaccagcaaaacttttgaaaagaatgttgtacggcagaataaagaaagcatattggaaaagttctcagtacgaaaagaaatcattaatttggagaaagaaatgtttaatgaaggaacatgcattcagcaagacagtttctcatccagtgaaaagggatcttatgaaacctcaaagcatgaaaagcagcctcctgtatattgcacttctccggactttaaaatgggaggtgcttctgatgtatctaccgctaaatccccattcagtgcagtaggagaaagcaatctcccttccccatcacctactgtatctgttaatcctttaaccagaagtccccctgaaacttcttcacagttggctcctaatccattacttttaagttctactacagaactaatcgaagaaatttctgaatctgttggaaagaaccagtttacttctgaaagtacccacttgaacgttggtcataggtcagttggtcatagtataagtattgaatgtaaagggattgataaagaggtaaatgattcaaaaactacccatatagatattccaagaataagctcttcccttggaaaaaagccaagtttgacttctgaatccagcattcatactattactccttcagttgttaacttcactagtttatttagtaataagccttttttaaaactgggtgcagtatctgcatcagacaaacactgccaagttgctgaaagcctaagtactagtttgcagtccaaaccattaaaaaaaagaaaaggaagaaaacctcggtggactaaagtggtggcaagaagcacatgccggtctccaaaagggctagaattagaaagatcagagctttttaaaaacgtttcatgtagctcactatcaaatagtaattctgagccagccaagtttatgaaaaacattggacccccttcatttgtagatcatgacttccttaaacgccgattgccaaagttgagcaaatccacagctccatctcttgctctcttagctgatagtgaaaaaccatctcataagtcttttgctactcacaaactatcctccagtatgtgtgtctctagtgaccttttgtctgatatttataagcccaaaagaggaaggcctaaatctaaggagatgcctcaactggaagggccacctaaaaggactttaaaaatccctgcttctaaagtgttttctttacagtctaaggaagaacaagaacccccaattttacagccagaaattgaaatcccttccttcaaacaaggtctgtctgtgtctccttttccaaaaaagagaggcaggcctaagaggcaaatgaggtcaccagtcaagatgaagccacctgtactgtcagtggctccatttgttgccactgaaagtccaagcaagctagaatctgaaagtgacaaccatagaagtagcagtgatttctttgagagcgaggatcaacttcaggatccagatgacctagatgacagtcataggccaagtgtctgtagtatgagtgaccttgagatggaaccagataaaaaaattaccaagagaaacaatggacaattaatgaaaacaattatccgcaaaataaataaaatgaagactttaaagagaaagaaactgttgaatcagattctttcaagttctgtagaatcaagtaataaagggaaagtgcaatccaaactccataatacggtatcaagtcttgctgccacatttggctctaaattgggccaacagataaatgtcagcaagaaaggaaccatttatataggaaagagaagaggtcgcaaaccaaaaactgtcttaaatggtattctttctggtagtcctactagccttgctgttcttgagcaaacagctcaacaggcagctgggtcagcattaggacagattcttcccccattactgccttcatctgctagtagttctgagattcttccatcacctatttgctctcagtcttctgggactagtggaggtcagagccctgtaagtagtgatgcaggttttgttgaacccagttcagtgccatatttgcatttacactccagacagggcagtatgattcagactcttgcaatgaagaaggcctcaaaggggaggaggcggttatctcctcctactttgttgccaaattctccttcgcacttgagtgaactcacatctctaaaagaagctactccttccccaatcagtgagtctcatagtgatgagaccattcccagtgatagtggaattggaacagataataacagcacatcagacagggcagagaaattttgtgggcaaaaaaagaggaggcattcttttgagcatgtttctctgattccccctgaaacctctacagtgctaagcagtcttaaagaaaaacataaacacaaatgtaagcgcaggaatcatgattacctcagctatgacaagatgaaaaggcagaaacgaaaacggaaaaagaaatatccccagcttcgaaatagacaggatccagactttattgcagagctggaggaactaataagtcgcctaagtgaaattcggatcactcatcgaagtcatcattttatcccccgagatcttctgccaactatctttcgaatcaactttaatagtttctatacacatccttctttccccttagaccctttgcactacattcgaaaacctgacttaaaaaagaaaagagggagaccccctaagatgagggaggcaatggctgaaatgccttttatgcacagccttagttttcctctttctagtactggattctatccatcttatggtatgccttactctccttcaccccttacagctgctcccataggattaggttactatggaaggtatcctcccactctttatccacctcctccatctccttctttcaccacgccacttccacctccttcctatatgcatgctggtcatttacttctcaatcctgccaaataccataagaaaaagcataagctacttcgacaggaggcctttcttacaaccagcaggactcccctcctttccatgagtacctaccccagtgttcctcctgagatggcctatggttggatggttgagcacaaacacaggcaccgtcacaaacacagagaacaccgttcttctgaacaaccccaggtttctatggacactggctcttcccgatctgtcctggaatctttgaagcgctatagatttggaaaggatgctgttggagagcgatataagcataaggaaaagcaccgttgtcacatgtcctgccctcatctctctccttcaaaaagcttaataaacagagaggaacagtgggtccaccgagagccttcagaatctagtccattggccttgggattgcagacacctttacagattgactgttcagaaagttctccaagcttatcccttggaggattcactcccaactctgagccagccagcagtgatgaacatacaaaccttttcacaagtgcaataggcagctgcagagtttcaaaccctaactccagtggccggaagaaattaactgacagccctggactcttttctgcacaggacacttcactaaatcggcttcacagaaaggagtcactgccttctaacgaaagggcagtacagactttggcaggctcccagccaacctctgataaaccctcccagcggccatcagagagcacaaattgtagccctacccggaaaaggtcttcatctgagagtacttcttcaacagtaaacggagttccctctcgaagtccaagattagttgcttctggggatgactctgtggatagtctgctgcagcggatggtacaaaatgaggaccaagagcccatggagaaaagtattgatgctgtgattgcaactgcctctgcaccaccttcttccagtccaggccgtagccacagcaaggaccgaaccctgggaaaaccagacagccttttagtgcctgcagtcgcaagtgactcttgcaataatagcatctcactcctatctgaaaagttgacaagcagctgttccccccatcatatcaagagaagtgtagtggaagctatgcaacgccaagctcggaaaatgtgcaattacgacaaaatcttggccacaaagaaaaacctagaccatgtcaataaaatcttaaaagccaaaaaacttcaaaggcaggccaggacagggaataactttgtgaaacgtaggccaggtcgacctcggaaatgtccccttcaggctgtcgtatcaatgcaagcattccaggctgctcagtttgtcaacccagaattgaacagagacgaggaaggagcagcactgcacctcagtcctgacacagttacagatgtaattgaggctgttgttcagagtgtaaatctgaacccagaacataaaaaggggttgaagagaaaaggttggctattggaagaacagaccagaaaaaagcagaagccattaccagaggaagaagagcaagagaataataaaagctttaatgaagcaccagttgagattcccagtccttctgaaaccccagctaaaccttctgaacctgaaagtaccttgcagcctgtgctttctctcatcccaagggaaaagaagcccccacgtcccccaaagaagaagtatcagaaagcagggctgtattctgacgtttacaaaactacagacccaaagagtcgattgatccaattaaagaaagagaagctggagtatactccaggagagcatgaatatggattatttccagcgcccattcatgttgtgttttttgtttcaggaaagtatctaagacaaaagagaattgacttccagcttccttatgatatcctttggcagtggaaacacaatcagctatacaaaaagccagatgtcccactatataagaaaattcgttcaaatgtctacgttgatgtcaaacccctttctggttacgaagctaccacctgtaactgtaagaagccagatgatgacaccaggaagggctgtgttgatgactgcctcaatagaatgatctttgctgagtgttcccccaacacttgcccatgtggcgagcaatgctgtaaccagaggatacagaggcatgaatgggtgcaatgtctagaacgatttcgagctgaggaaaaaggttggggaatcagaaccaaagagcccctaaaagctgggcagttcatcattgaatacctaggggaggtcgtcagtgaacaggagttcaggaacaggatgattgagcagtatcataatcacagtgaccactactgcctgaacctggatagtgggatggtgattgacagttaccgcatgggaaatgaggcccgattcatcaaccatagctgtgacccaaattgtgaaatgcagaaatggtctgttaatggagtataccggattggactctatgctcttaaagacatgccagctgggactgaactcacttatgattataactttcattccttcaatgtggaaaaacagcaactttgtaagtgtggctttgagaaatgtcgaggaatcatcggaggcaagagtcagcgtgtgaatggactcaccagcagcaaaaacagccagcccatggccacacacaaaaaatctggacggtcaaaagagaagagaaagtctaagcacaagctgaagaaaaggagaggccatctctctgaggaacccagtgaaaatatcaacaccccaactagattgaccccccaattacagatgaagccaatgtccaatcgtgaaaggaactttgtgttaaagcatcatgtattcttggtccgaaactgggagaagattcgtcaaaaacaggaggaagtaaagcacaccagtgataatattcactcagcatcattatatacccgttggaatgggatctgccgagatgatgggaatatcaagtctgatgtcttcatgacccagttctctgccctgcagacagctcgatctgttcgaacaagacggttggcagctgcagaggaaaatattgaagtggctcgggcagcccgcctagcccagatcttcaaagaaatttgtgatggtatcatctcttataaagattcttcccggcaagcactggcagctccacttttgaaccttcccccaaagaaaaagaatgctgattattatgagaagatctctgatcccctagatcttatcaccatagagaagcagatcctcactggttactataagacagtggaagcttttgatgctgacatgctcaaagtctttcggaatgctgagaagtactatgggcgtaaatccccagttgggagagatgtttgtcgtctacgaaaggcctattacaatgcccggcatgaggcatcagcccagattgatgagattgtgggagagacagcaagtgaggcagacagcagtgagacctcagtctctgaaaaggagaatgggcatgagaaggacgacgatgttattcgctgtatctgtggcctctacaacgatgaaggtctcatgatccagtgtgacaagtgcatggtatggcagcactgtgattgtatgggagtgaactcagatgtggagcactacctttgtgagcagtgtgacccaaggcctgtggacagggaggttcccatgatccctcggccccactatgcccaacctggctgtgtctacttcatctgtttgctccgagatgacttgctgcttcgtcagggtgactgtgtgtatctgatgagggatagtcggcgcacccctgatggccacccggtccgtcagtcctatcgactgttatctcacattaaccgagataaacttgacatctttcgcattgagaagctttggaagaatgaaaaagaggaacggtttgcctttggtcaccattatttccgtccccacgaaacacaccactctccatcccgtcggttctatcataatgaactatttcgggtgccactctatgagatcattcccttggaggctgtagtggggacctgctgtgtgttggacctttatacgtattgtaaagggagacccaaaggagtaaaggagcaagatgtgtacatctgtgattatcggcttgacaagtcagcacacctgttttacaagatccaccggaaccgctatcctgtctgcaccaaaccctatgcttttgatcacttccccaagaagctcactcccaaaaaagatttctcgcctcattacgtcccagacaactacaagaggaatggaggacgatcatcctggaagtctgagcgctcaaagccacccctaaaagacttgggccaggaggatgatgctctacccttgattgaagaggttctagccagtcaagagcaagcagccaatgagatacccagcctggaggagccagaacgggaaggggccactgctaacgtcagtgagggtgaaaaaaaaacagaggaaagtagtcaagaaccccagtcaacctgtacccctgaggaacgacggcataaccaacgggaacgactcaaccagatcttgctcaatctccttgaaaaaatccctggaaaaaatgccattgatgtgacctacttgctggaggaaggatcaggcaggaaactgcgaaggcgtactttgtttatcccagaaaacagctttcgaaagtgaccctcaaagaatgagaacctcaagcatctgggatccagtggagctaatcagtcctgcctcctgctctctgggtatagacaggggtgggaagggtccatctgggcaaggggaatggggccatgttgttgacattaggtacttaataagccttggagctagtggagagggagaggaaagggttctgtccaagacagttcaggttaattaattttcttctccattgcttcaccttaagggttaataatgtagagaggagggaggaccacattgatgaccagaacctactggtactttatagcatttgccccaccccacagcttaggtttttctgtcatcctcagatcccacaggcattgcgaagaagctgcttcctatacccaggtataactcaaaatccaaagggatagggccaggatccctattcctaccccatctattctctgttggctccaagagctaccccagagaccttaaacagaaacagtagctgaggcttcttcctagatacctgactagggaagtagggactcatttttggccaccaggcgaggtaaagtgattgcagtccaggctgttatgtggccccctgatcccggacagggaagggaggcctgtgtaagggggtctgg

SEQ ID NO: 356476 - DNA, 4427 bp, Homo sapiens
gtgggctgtgtatttgcctaatcataattactgttgggatggacaaggagggaatgggtaaaaataattaagaaaaaggagaggccatctctctgaggaacccagtgaaaatatcaacaccccaactagattgaccccccaattacagatgaagccaatgtccaatcgtgaaaggaactttgtgttaaagcatcatgtattcttggtccgaaactgggagaagattcgtcaaaaacaggaggaagtaaagcacaccagtgataatattcactcagcatcattatatacccgttggaatgggatctgccgagatgatgggaatatcaagtctgatgtcttcatgacccagttctctgccctgcagacagctcgatctgttcgaacaagacggttggcagctgcagaggaaaatattgaagtggctcgggcagcccgcctagcccagatcttcaaagaaatttgtgatggtatcatctcttataaagattcttcccggcaagcactggcagctccacttttgaaccttcccccaaagaaaaagaatgctgattattatgagaagatctctgatcccctagatcttatcaccatagagaagcagatcctcactggttactataagacagtggaagcttttgatgctgacatgctcaaagtctttcggaatgctgagaagtactatgggcgtaaatccccagttgggagagatgtttgtcgtctacgaaaggcctattacaatgcccggcatgaggcatcagcccagattgatgagattgtgggagagacagcaagtgaggcagacagcagtgagacctcagtctctgaaaaggagaatgggcatgagaaggacgacgatgttattcgctgtatctgtggcctctacaacgatgaaggtctcatgatccagtgtgacaagtgcatggtatggcagcactgtgattgtatgggagtgaactcagatgtggagcactacctttgtgagcagtgtgacccaaggcctgtggacagggaggttcccatgatccctcggccccactatgcccaacctggctgtgtctacttcatctgtttgctccgagatgacttgctgcttcgtcagggtgactgtgtgtatctgatgagggatagtcggcgcacccctgatggccacccggtccgtcagtcctatcgactgttatctcacattaaccgagataaacttgacatctttcgcattgagaagctttggaagaatgaaaaagaggaacggtttgcctttggtcaccattatttccgtccccacgaaacacaccactctccatcccgtcggttctatcataatgaactatttcgggtgccactctatgagatcattcccttggaggctgtagtggggacctgctgtgtgttggacctttatacgtattgtaaagggagacccaaaggagtaaaggagcaagatgtgtacatctgtgattatcggcttgacaagtcagcacacctgttttacaagatccaccggaaccgctatcctgtctgcaccaaaccctatgcttttgatcacttccccaagaagctcactcccaaaaaagatttctcgcctcattacgtcccagacaactacaagaggaatggaggacgatcatcctggaagtctgagcgctcaaagccacccctaaaagacttgggccaggaggatgatgctctacccttgattgaagaggttctagccagtcaagagcaagcagccaatgagatacccagcctggaggagccagaacgggaaggggccactgctaacgtcagtgagggtgaaaaaaaaacagaggaaagtagtcaagaaccccagtcaacctgtacccctgaggaacgacggcataaccaacgggaacgactcaaccagatcttgctcaatctccttgaaaaaatccctggaaaaaatgccattgatgtgacctacttgctggaggaaggatcaggcaggaaactgcgaaggcgtactttgtttatcccagaaaacagctttcgaaagtgaccctcaaagaatgagaacctcaagcatctgggatccagtggagctaatcagtcctgcctcctgctctctgggtatagacaggggtgggaagggtccatctgggcaaggggaatggggccatgttgttgacattaggtacttaataagccttggagctagtggagagggagaggaaagggttctgtccaagacagttcaggttaattaattttcttctccattgcttcaccttaagggttaataatgtagagaggagggaggaccacattgatgaccagaacctactggtactttatagcatttgccccaccccacagcttaggtttttctgtcatcctcagatcccacaggcattgcgaagaagctgcttcctatacccaggtataactcaaaatccaaagggatagggccaggatccctattcctaccccatctattctctgttggctccaagagctaccccagagaccttaaacagaaacagtagctgaggcttcttcctagatacctgactagggaagtttgtctctcctttcttgcccaaccaggtcaaagtaaaatgtgagttgacagctcaaagcacttgtaactgctgccccctccctacctctactccccaaaatggaatcatgggatagggaaggcccccatggggtcagaagggcacggtagttcttgcaattatttttgttttacccttcataacctgtcaaacatatttttttctaatgagaaagccaggcccccgccagcacacatgctgtttttaatgcgctgtagttcttgtgtgtctgctgtgctgtgcaaatggagattcagttcaaaataaaatcatttaaaaacctacataaaaagaactctaaacccacccctgcaacaaaagtcactacataaactgttcagcagtattcacctatcagagtatttgttgtgagtatagattatcaattgaaaacactactcttgttttcttaattgtacagttttcaatgtccctttcttaaagagacagtatatttctcttcacccctagcccatcttccctcaccctcctgaatgacatcaggaggtatatccagggtgtctccttccttcctactctcttgaccagaagttaacagactatactgtctctttaaaaataaaatttaaaaagctttgttgtcttttcagacatacatatgcatatatgttttagatgttcttataagagaaaagatggtttttaaatgtgccaagttgtgtgtgtgtgtgtatatatatgtgtgtatgtgtgtgtatatatatatgtgtgtgtgtgtgtatatatatacacacacacacacacacctgctgtgtgattggtaagcaatacaatagtaaacatgtccccattacttttttctaatattggaccaatgctgtcctaattgtacatttccccttatggtgacgatgctctgactcgtttaggtagacacattgaccaccttccattccattaaatattttttcctttttcccctttctgtgtcattcttgaggaaaaaacaaaagagagaggggatgccaatgatccccttgagcagagaaaaagcaaaataaatattttattaaagaaaaaagagaattaagaaaatagtttggagtattttcttactgtagagaagcactgtacattactaagagacctgggtataagatactcacatgtggagctggaaaaatcgcatgtccaagcccgtttgagtggtttcttttgtttttcattgcagggagtgggtgggagggaggtgggactaggggcactttgggggtctccttttagtcaaaagcgagaaaatgacaagaaagagattaaaattcaatgtttcctttatagtgttaaacactaaaattttaaaaaagatgaaaaagaaaaaaaaactttgtaaaatgcgagaacagaagcaaaagacactacgctctgtcattttatctttcttttgttgaaagactaaaaaaaaactgaaatgttttttagacaatcaaatgttaggtaagtgcaaaaacttgttttttcttactggtgtagaaattaatgcctttttttatttttcagttattttataataacgaaataaaaagaaccccccagctgccaggcgggttttggtgtttgaaatgcggggcaaagcactacatcactgcaaatagatacagagttagtctgcatgtctgtaggctgtgtgattgcggaaaatataaatgctgctaatatatttcctttttacaaaagcatatctaaatagatgattgttttgatgttaatctttgtaaattatgtattaccaattttaacattggatgtaattgcatacaaagcttgcatctcaatccttgaaagtctagtattaaatggaaaaaacttttcctaactgtggaaaaaaaaaaa

SEQ ID NO: 356477 - DNA, 2463 bp, Homo sapiens
ctgaccaacatggtgaaaccccatctctactaaaaagcaaaaattagctgggcgtggtggtgcacacctgtaatcgcagctactcaggaggctgaggcaggagaattgcttgaatctctgggtatagacaggggtgggaagggtccatctgggcaaggggaatggggccatgttgttgacattaggtacttaataagccttggagctagtggagagggagaggaaagggttctgtccaagacagttcaggttaattaattttcttctccattgcttcaccttaagggttaataatgtagagaggagggaggaccacattgatgaccagaacctactggtactttatagcatttgccccaccccacagcttaggtttttctgtcatcctcagatcccacaggcattgcgaagaagctgcttcctatacccaggtataactcaaaatccaaagggatagggccaggatccctattcctaccccatctattctctgttggctccaagagctaccccagagaccttaaacagaaacagtagctgaggcttcttcctagatacctgactagggaagtttgtctctcctttcttgcccaaccaggtcaaagtaaaatgtgagttgacagctcaaagcacttgtaactgctgccccctccctacctctactccccaaaatggaatcatgggatagggaaggcccccatggggtcagaagggcacggtagttcttgcaattatttttgttttacccttcataacctgtcaaacatatttttttctaatgagaaagccaggcccccgccagcacacatgctgtttttaatgcgctgtagttcttgtgtgtctgctgtgctgtgcaaatggagattcagttcaaaataaaatcatttaaaaacctacataaaaagaactctaaacccacccctgcaacaaaagtcactacataaactgttcagcagtattcacctatcagagtatttgttgtgagtatagattatcaattgaaaacactactcttgttttcttaattgtacagttttcaatgtccctttcttaaagagacagtatatttctcttcacccctagcccatcttccctcaccctcctgaatgacatcaggaggtatatccagggtgtctccttccttcctactctcttgaccagaagttaacagactatactgtctctttaaaaataaaatttaaaaagctttgttgtcttttcagacatacatatgcatatatgttttagatgttcttataagagaaaagatggtttttaaatgtgccaagttgtgtgtgtgtgtgtatatatatgtgtgtatgtgtgtgtatatatatatgtgtgtgtgtgtgtatatatatacacacacacacacacacctgctgtgtgattggtaagcaatacaatagtaaacatgtccccattacttttttctaatattggaccaatgctgtcctaattgtacatttccccttatggtgacgatgctctgactcgtttaggtagacacattgaccaccttccattccattaaatattttttcctttttcccctttctgtgtcattcttgaggaaaaaacaaaagagagaggggatgccaatgatccccttgagcagagaaaaagcaaaataaatattttattaaagaaaaaagagaattaagaaaatagtttggagtattttcttactgtagagaagcactgtacattactaagagacctgggtataagatactcacatgtggagctggaaaaatcgcatgtccaagcccgtttgagtggtttcttttgtttttcattgcagggagtgggtgggagggaggtgggactaggggcactttgggggtctccttttagtcaaaagcgagaaaatgacaagaaagagattaaaattcaatgtttcctttatagtgttaaacactaaaattttaaaaaagatgaaaaagaaaaaaaaactttgtaaaatgcgagaacagaagcaaaagacactacgctctgtcattttatctttcttttgttgaaagactaaaaaaaaactgaaatgttttttagacaatcaaatgttaggtaagtgcaaaaacttgttttttcttactggtgtagaaattaatgcctttttttatttttcagttattttataataacgaaataaaaagaaccccccagctgccaggcgggttttggtgtttgaaatgcggggcaaagcactacatcactgcaaatagatacagagttagtctgcatgtctgtaggctgtgtgattgcggaaaatataaatgctgctaatatatttcctttttacaaaagcatatctaaatagatgattgttttgatgttaatctttgtaaattatgtattaccaattttaacattggatgtaattgcatacaaagcttgcatctcaatccttgaaagtctagtattaaatggaaaaaacttttcctaactgtggaaaaaaaaaaa

SEQ ID NO: 356478 - DNA, 1145 bp, Homo sapiens
gggggcgctaggcgcccttcgctccctccctctggaggagctgccgccgccaccgccgccactctgctgctgccgccgccgccgccgccgctcccgccgccattttgggttcgctttgcggaggggagacgatcccagtctcggttgcgggacccgcctcccctcagtttgccccctttagccttccacctttcccttctcctctctcgcatttccgccagtcagcttacccgctggccgcctcctgacaagcgggagggatccgccgtggacccagggaagcggaggagcctggcggccaccccctcttccccacttccctgcactctcatcgctctcggcctcggcctcggcctccgacacggtgagtagaacgatttgggccggcattcgggcctaagcactctctcagcgattgaatcctgggctttctgggagccactgtcatctcccggacctggatctctgagagagcagtggtgaagatgggggaggggagagcagggagggggatcctgagcctaccgggaagtccctccaggcggggtgaaggggtgtccctgacaggcagactcccggagggggctgggaagtaagcgagtggaggcggagtcggctgtgcccctgacaggttagtttgtgtttgtaggcatgatcggagcctcccccatagtccagtttgtgtgtgtttaattaagggataagagtggtcgaggacacgatcttgagaggggattttacctgtgtgacaaggtctgtggtgtccctgccgcgttgaacggtatgtgggaacgacaggatgatctcagtgttgtaagtttaataaatgtcactggttagtttgtacatggaaagagatgtttttggtctagcagacagatggtctgttggtgtgtagcggctgtgttggtgtgtgtatgtgaggatggcaagtgtttccgtaagagtttgcctttatttgtgtaagtgtaatggagttccccttataagttagcttatttcttgaataaatgttgggaggttccttgcaggttgatatgtgtgtgtattttagggattgggagcccctagttacttgttgggaaagagcggcaatggtagtgttctgtacagcatgtgtctgtgaggtcagggaggggagaaac

SEQ ID NO: 356479 - DNA, 1461 bp, Homo sapiens
gaggcttgggcttgcgccgttgaagagaaagatgctggtttcgagttttggagatccttgttttttatggaacacagttctgtaaaattttcataagattccttggcaataacatacgcttgtgatggaccctagaaatactgctatgttaggattgggttctgattccgaaggtttttcaagaaagagtccttctgccatcagtactggcacattggtcagtaagagagaagtagagctagaaaaaaacacaaaggaggaagaggaccttcgcaaacggaatcgagaaagaaacatcgaagctgggaaagatgatggtttgactgatgcacagcaacagttttcagtgaaagaaacaaacttttcagagggaaatttaaaattgaaaattggcctccaggctaagagaactaaaaaacctccaaagaacttggagaactatgtatgtcgacctgccataaaaacaactattaagcacccaaggaaagcacttaaaagtggaaagatgacggatgaaaagaatgaacactgtccttcaaaacgagacccttcaaagttgtacaagaaagcagatgatgttgcagccattgaatgccagtctgaagaagtcatccgtcttcattcacagggagaaaacaatcctttgtctaagaagctgtctccagtacactcagaaatggcagattatattaatgcaacgccatctactcttcttggtagccgggatcctgatttaaaggacagagcattacttaatggaggaactagtgtaacagaaaagttggcacagctgattgctacctgtcctccttccaagtcttccaagacaaaaccgaagaagttaggaactggcactacagcaggattggttagcaaggatttgatcaggaaagcaggtgttggctctgtagctggaataatacataaggacttaataaaaaagccaaccatcagcacagcagttggattggtaactaaagatcctgggaaaaagccagtgtttaatgcagcagtaggattggtcaataaggactctgtgaaaaaactgggaactggcactacagcggtattcattaataaaaacttaggcaaaaagccaggaactatcactacagtaggactgctaagcaaagattcaggaaagaagctaggaattggtattgttccaggtttagtgcataaagagtctggcaagaagttaggacttggcactgtggttggactggttaataaagatttgggaaagaaattgggttctactgttggcctagtggccaaggactgtgcaaagaagattgtagcaagttcagcaatgggattggttaataaggacattggaaagaaactaatgagttgtcctttggcaggtctgatcagtaaagatgccataacttaagcgagatgtccatagaacgtaggtctgtgtgactcatatcggagggatttgatccgaaattgccg

SEQ ID NO: 356480 - DNA, 557 bp, Homo sapiens
ttcacccagttatcccttagttcctcttttactttaccctgacctattgctaattttttattctgggctcccaggacactctcaataagtcatagcctccatgttccccaaactgtatgtttttctacaggtatggcagcactgtgattgtatgggagtgaactcagatgtggagcactacctttgtgagcagtgtgacccaaggcctgtggacagggtaagctgaacctctgataaaactctgatctataagtaggagaggtagcacatggtatctcacctgtcctgctcctgctttgcagaatttcctttaataggttgttcagcctctctgggccttggtttcttaaactttacattaagggtcataattctgttcttccctatttcaggagtatgaccaaagggaaaataaaatacttagaaatctgtggaaggaatggcactatataaaactaaggtttttggccgggcacggtcgctcatgcctgtaatcctagcacactgggaggctaaggcggatggattgcctgagctcaggagttcgagaccagcct

SEQ ID NO: 356481 - DNA, 625 bp, Homo sapiens
aagacttggatttttctctcacttttaatttgagggattctattcttccagttaggagatgcttgcctcccttgtatggtggaatctttctactaaacctcacattcttttgcagattcttcccggcaagcactggcagctccacttttgaaccttcccccaaagaaaaagtaggttcacatttgtgggaatcatctgagtttttaaaaagtgctaagtgtgccagattgacaccctggctttgtgttccaggaatgctgattattatgagaagatctctgatcccctagatcttatcaccatagagaagcagatcctcactggttactataagacagtggaagcttttgatgctgacatgctcaaagtctttcggaatgctgaggtatttttcactgacttcaaacagatttcacaagtttgttctgaaaagaattagtctagaagtttaagatttttaccctcctctatcagccatatttctggttggaaaagccagtcatttttgagtatccttggggtatgtgttacagtatactaaatattatagaaggctatctatgaagacattgataggactagaatggaaggttaaatcattcccccccaaaaaaataatttttgt

SEQ ID NO: 356482 - DNA, 409 bp, Homo sapiens
agttcttttataggcttgcttttagttgtatcttggtagtgaaactggaaggtgagatgatctcctctaaagaaccacctttttcacgtagggttggaggatgggctaaattgcttataggtcagaaaaggaatcattgagttcgtgtgctctccttagagctcaaatctggaataaggagtaggagattggtattttgatgagcctccttggttctgttttcagccattgatgtgacctacttgctggaggaaggatcaggcaggaaactgcgaaggcgtactttgtttatcccagaaaacagctttcgaaagtgaccctcaaagaatgagaacctcaagcatctgggatccagtggagctaatcagtcctgcctcctgctctctgggtatagacaggggtgggaagg

SEQ ID NO: 356483 - DNA, 408 bp, Homo sapiens
ctcccaactctgagccagccagcagtgatgaacatacaaaccttttcacaagtgcaataggcagctgcagagtttcaaaccctaactccagtggccggaagaaattaactgacagccctggactcttttctgcacaggacacttcactaaatcggcttcacagaaaggagtcactgccttctaacgaaagggcagtacagactttggcaggtaagagggttattttgttacctgttatttgttaaagaaataggttattttccacaggtgcctgataaatgtagatgaacttttaatatatatatctttttttgttttttaataagtgtattttgaaatctcagtattccttttccttaagatttaagaagtagggaatgtctatattatttttttgttttgagaaga

SEQ ID NO: 356484 - DNA, 11518 bp, Homo sapiens
gggggcgctaggcgcccttcgctccctccctctggaggagctgccgccgccaccgccgccactctgctgctgccgccgccgccgccgccgctcccgccgccattttgggttcgctttgcggaggggagacgatcccagtctcggttgcgggacccgcctcccctcagtttgccccctttagccttccacctttcccttctcctctctcgcatttccgccagtcagcttacccgctggccgcctcctgacaagcgggagggatccgccgtggacccagggaagcggaggagcctggcggccaccccctcttccccacttccctgcactctcatcgctctcggcctcggcctcggcctccgacacgagaaagatgctggtttcgagttttggagatccttgttttttatggaacacagttctgtaaaattttcataagattccttggcaataacatacgcttgtgatggaccctagaaatactgctatgttaggattgggttctgattccgaaggtttttcaagaaagagtccttctgccatcagtactggcacattggtcagtaagagagaagtagagctagaaaaaaacacaaaggaggaagaggaccttcgcaaacggaatcgagaaagaaacatcgaagctgggaaagatgatggtttgactgatgcacagcaacagttttcagtgaaagaaacaaacttttcagagggaaatttaaaattgaaaattggcctccaggctaagagaactaaaaaacctccaaagaacttggagaactatgtatgtcgacctgccataaaaacaactattaagcacccaaggaaagcacttaaaagtggaaagatgacggatgaaaagaatgaacactgtccttcaaaacgagacccttcaaagttgtacaagaaagcagatgatgttgcagccattgaatgccagtctgaagaagtcatccgtcttcattcacagggagaaaacaatcctttgtctaagaagctgtctccagtacactcagaaatggcagattatattaatgcaacgccatctactcttcttggtagccgggatcctgatttaaaggacagagcattacttaatggaggaactagtgtaacagaaaagttggcacagctgattgctacctgtcctccttccaagtcttccaagacaaaaccgaagaagttaggaactggcactacagcaggattggttagcaaggatttgatcaggaaagcaggtgttggctctgtagctggaataatacataaggacttaataaaaaagccaaccatcagcacagcagttggattggtaactaaagatcctgggaaaaagccagtgtttaatgcagcagtaggattggtcaataaggactctgtgaaaaaactgggaactggcactacagcggtattcattaataaaaacttaggcaaaaagccaggaactatcactacagtaggactgctaagcaaagattcaggaaagaagctaggaattggtattgttccaggtttagtgcataaagagtctggcaagaagttaggacttggcactgtggttggactggttaataaagatttgggaaagaaattgggttctactgttggcctagtggccaaggactgtgcaaagaagattgtagcaagttcagcaatgggattggttaataaggacattggaaagaaactaatgagttgtcctttggcaggtctgatcagtaaagatgccataaaccttaaagccgaagcactgctccccactcaggaaccgcttaaggcttcttgtagtacaaacatcaataatcaggaaagtcaggaactttctgaatccctgaaagatagtgccaccagcaaaacttttgaaaagaatgttgtacggcagaataaagaaagcatattggaaaagttctcagtacgaaaagaaatcattaatttggagaaagaaatgtttaatgaaggaacatgcattcagcaagacagtttctcatccagtgaaaagggatcttatgaaacctcaaagcatgaaaagcagcctcctgtatattgcacttctccggactttaaaatgggaggtgcttctgatgtatctaccgctaaatccccattcagtgcagtaggagaaagcaatctcccttccccatcacctactgtatctgttaatcctttaaccagaagtccccctgaaacttcttcacagttggctcctaatccattacttttaagttctactacagaactaatcgaagaaatttctgaatctgttggaaagaaccagtttacttctgaaagtacccacttgaacgttggtcataggtcagttggtcatagtataagtattgaatgtaaagggattgataaagaggtaaatgattcaaaaactacccatatagatattccaagaataagctcttcccttggaaaaaagccaagtttgacttctgaatccagcattcatactattactccttcagttgttaacttcactagtttatttagtaataagccttttttaaaactgggtgcagtatctgcatcagacaaacactgccaagttgctgaaagcctaagtactagtttgcagtccaaaccattaaaaaaaagaaaaggaagaaaacctcggtggactaaagtggtggcaagaagcacatgccggtctccaaaagggctagaattagaaagatcagagctttttaaaaacgtttcatgtagctcactatcaaatagtaattctgagccagccaagtttatgaaaaacattggacccccttcatttgtagatcatgacttccttaaacgccgattgccaaagttgagcaaatccacagctccatctcttgctctcttagctgatagtgaaaaaccatctcataagtcttttgctactcacaaactatcctccagtatgtgtgtctctagtgaccttttgtctgatatttataagcccaaaagaggaaggcctaaatctaaggagatgcctcaactggaagggccacctaaaaggactttaaaaatccctgcttctaaagtgttttctttacagtctaaggaagaacaagaacccccaattttacagccagaaattgaaatcccttccttcaaacaaggtctgtctgtgtctccttttccaaaaaagagaggcaggcctaagaggcaaatgaggtcaccagtcaagatgaagccacctgtactgtcagtggctccatttgttgccactgaaagtccaagcaagctagaatctgaaagtgacaaccatagaagtagcagtgatttctttgagagcgaggatcaacttcaggatccagatgacctagatgacagtcataggccaagtgtctgtagtatgagtgaccttgagatggaaccagataaaaaaattaccaagagaaacaatggacaattaatgaaaacaattatccgcaaaataaataaaatgaagactttaaagagaaagaaactgttgaatcagattctttcaagttctgtagaatcaagtaataaagggaaagtgcaatccaaactccataatacggtatcaagtcttgctgccacatttggctctaaattgggccaacagataaatgtcagcaagaaaggaaccatttatataggaaagagaagaggtcgcaaaccaaaaactgtcttaaatggtattctttctggtagtcctactagccttgctgttcttgagcaaacagctcaacaggcagctgggtcagcattaggacagattcttcccccattactgccttcatctgctagtagttctgagattcttccatcacctatttgctctcagtcttctgggactagtggaggtcagagccctgtaagtagtgatgcaggttttgttgaacccagttcagtgccatatttgcatttacactccagacagggcagtatgattcagactcttgcaatgaagaaggcctcaaaggggaggaggcggttatctcctcctactttgttgccaaattctccttcgcacttgagtgaactcacatctctaaaagaagctactccttccccaatcagtgagtctcatagtgatgagaccattcccagtgatagtggaattggaacagataataacagcacatcagacagggcagagaaattttgtgggcaaaaaaagaggaggcattcttttgagcatgtttctctgattccccctgaaacctctacagtgctaagcagtcttaaagaaaaacataaacacaaatgtaagcgcaggaatcatgattacctcagctatgacaagatgaaaaggcagaaacgaaaacggaaaaagaaatatccccagcttcgaaatagacaggatccagactttattgcagagctggaggaactaataagtcgcctaagtgaaattcggatcactcatcgaagtcatcattttatcccccgagatcttctgccaactatctttcgaatcaactttaatagtttctatacacatccttctttccccttagaccctttgcactacattcgaaaacctgacttaaaaaagaaaagagggagaccccctaagatgagggaggcaatggctgaaatgccttttatgcacagccttagttttcctctttctagtactggattctatccatcttatggtatgccttactctccttcaccccttacagctgctcccataggattaggttactatggaaggtatcctcccactctttatccacctcctccatctccttctttcaccacgccacttccacctccttcctatatgcatgctggtcatttacttctcaatcctgccaaataccataagaaaaagcataagctacttcgacaggaggcctttcttacaaccagcaggactcccctcctttccatgagtacctaccccagtgttcctcctgagatggcctatggttggatggttgagcacaaacacaggcaccgtcacaaacacagagaacaccgttcttctgaacaaccccaggtttctatggacactggctcttcccgatctgtcctggaatctttgaagcgctatagatttggaaaggatgctgttggagagcgatataagcataaggaaaagcaccgttgtcacatgtcctgccctcatctctctccttcaaaaagcttaataaacagagaggaacagtgggtccaccgagagccttcagaatctagtccattggccttgggattgcagacacctttacagattgactgttcagaaagttctccaagcttatcccttggaggattcactcccaactctgagccagccagcagtgatgaacatacaaaccttttcacaagtgcaataggcagctgcagagtttcaaaccctaactccagtggccggaagaaattaactgacagccctggactcttttctgcacaggacacttcactaaatcggcttcacagaaaggagtcactgccttctaacgaaagggcagtacagactttggcaggctcccagccaacctctgataaaccctcccagcggccatcagagagcacaaattgtagccctacccggaaaaggtcttcatctgagagtacttcttcaacagtaaacggagttccctctcgaagtccaagattagttgcttctggggatgactctgtggatagtctgctgcagcggatggtacaaaatgaggaccaagagcccatggagaaaagtattgatgctgtgattgcaactgcctctgcaccaccttcttccagtccaggccgtagccacagcaaggaccgaaccctgggaaaaccagacagccttttagtgcctgcagtcgcaagtgactcttgcaataatagcatctcactcctatctgaaaagttgacaagcagctgttccccccatcatatcaagagaagtgtagtggaagctatgcaacgccaagctcggaaaatgtgcaattacgacaaaatcttggccacaaagaaaaacctagaccatgtcaataaaatcttaaaagccaaaaaacttcaaaggcaggccaggacagggaataactttgtgaaacgtaggccaggtcgacctcggaaatgtccccttcaggctgtcgtatcaatgcaagcattccaggctgctcagtttgtcaacccagaattgaacagagacgaggaaggagcagcactgcacctcagtcctgacacagttacagatgtaattgaggctgttgttcagagtgtaaatctgaacccagaacataaaaaggggttgaagagaaaaggttggctattggaagaacagaccagaaaaaagcagaagccattaccagaggaagaagagcaagagaataataaaagctttaatgaagcaccagttgagattcccagtccttctgaaaccccagctaaaccttctgaacctgaaagtaccttgcagcctgtgctttctctcatcccaagggaaaagaagcccccacgtcccccaaagaagaagtatcagaaagcagggctgtattctgacgtttacaaaactacagacccaaagagtcgattgatccaattaaagaaagagaagctggagtatactccaggagagcatgaatatggattatttccagcgcccattcatgttgtgttttttgtttcaggaaagtatctaagacaaaagagaattgacttccagcttccttatgatatcctttggcagtggaaacacaatcagctatacaaaaagccagatgtcccactatataagaaaattcgttcaaatgtctacgttgatgtcaaacccctttctggttacgaagctaccacctgtaactgtaagaagccagatgatgacaccaggaagggctgtgttgatgactgcctcaatagaatgatctttgctgagtgttcccccaacacttgcccatgtggcgagcaatgctgtaaccagaggatacagaggcatgaatgggtgcaatgtctagaacgatttcgagctgaggaaaaaggttggggaatcagaaccaaagagcccctaaaagctgggcagttcatcattgaatacctaggggaggtcgtcagtgaacaggagttcaggaacaggatgattgagcagtatcataatcacagtgaccactactgcctgaacctggatagtgggatggtgattgacagttaccgcatgggaaatgaggcccgattcatcaaccatagctgtgacccaaattgtgaaatgcagaaatggtctgttaatggagtataccggattggactctatgctcttaaagacatgccagctgggactgaactcacttatgattataactttcattccttcaatgtggaaaaacagcaactttgtaagtgtggctttgagaaatgtcgaggaatcatcggaggcaagagtcagcgtgtgaatggactcaccagcagcaaaaacagccagcccatggccacacacaaaaaatctggacggtcaaaagagaagagaaagtctaagcacaagctgaagaaaaggagaggccatctctctgaggaacccagtgaaaatatcaacaccccaactagattgaccccccaattacagatgaagccaatgtccaatcgtgaaaggaactttgtgttaaagcatcatgtattcttggtccgaaactgggagaagattcgtcaaaaacaggaggaagtaaagcacaccagtgataatattcactcagcatcattatatacccgttggaatgggatctgccgagatgatgggaatatcaagtctgatgtcttcatgacccagttctctgccctgcagacagctcgatctgttcgaacaagacggttggcagctgcagaggaaaatattgaagtggctcgggcagcccgcctagcccagatcttcaaagaaatttgtgatggtatcatctcttataaagattcttcccggcaagcactggcagctccacttttgaaccttcccccaaagaaaaagaatgctgattattatgagaagatctctgatcccctagatcttatcaccatagagaagcagatcctcactggttactataagacagtggaagcttttgatgctgacatgctcaaagtctttcggaatgctgagaagtactatgggcgtaaatccccagttgggagagatgtttgtcgtctacgaaaggcctattacaatgcccggcatgaggcatcagcccagattgatgagattgtgggagagacagcaagtgaggcagacagcagtgagacctcagtctctgaaaaggagaatgggcatgagaaggacgacgatgttattcgctgtatctgtggcctctacaacgatgaaggtctcatgatccagtgtgacaagtgcatggtatggcagcactgtgattgtatgggagtgaactcagatgtggagcactacctttgtgagcagtgtgacccaaggcctgtggacagggaggttcccatgatccctcggccccactatgcccaacctggctgtgtctacttcatctgtttgctccgagatgacttgctgcttcgtcagggtgactgtgtgtatctgatgagggatagtcggcgcacccctgatggccacccggtccgtcagtcctatcgactgttatctcacattaaccgagataaacttgacatctttcgcattgagaagctttggaagaatgaaaaagaggaacggtttgcctttggtcaccattatttccgtccccacgaaacacaccactctccatcccgtcggttctatcataatgaactatttcgggtgccactctatgagatcattcccttggaggctgtagtggggacctgctgtgtgttggacctttatacgtattgtaaagggagacccaaaggagtaaaggagcaagatgtgtacatctgtgattatcggcttgacaagtcagcacacctgttttacaagatccaccggaaccgctatcctgtctgcaccaaaccctatgcttttgatcacttccccaagaagctcactcccaaaaaagatttctcgcctcattacgtcccagacaactacaagaggaatggaggacgatcatcctggaagtctgagcgctcaaagccacccctaaaagacttgggccaggaggatgatgctctacccttgattgaagaggttctagccagtcaagagcaagcagccaatgagatacccagcctggaggagccagaacgggaaggggccactgctaacgtcagtgagggtgaaaaaaaaacagaggaaagtagtcaagaaccccagtcaacctgtacccctgaggaacgacggcataaccaacgggaacgactcaaccagatcttgctcaatctccttgaaaaaatccctggaaaaaatgccattgatgtgacctacttgctggaggaaggatcaggcaggaaactgcgaaggcgtactttgtttatcccagaaaacagctttcgaaagtgaccctcaaagaatgagaacctcaagcatctgggatccagtggagctaatcagtcctgcctcctgctctctgggtatagacaggggtgggaagggtccatctgggcaaggggaatggggccatgttgttgacattaggtacttaataagccttggagctagtggagagggagaggaaagggttctgtccaagacagttcaggttaattaattttcttctccattgcttcaccttaagggttaataatgtagagaggagggaggaccacattgatgaccagaacctactggtactttatagcatttgccccaccccacagcttaggtttttctgtcatcctcagatcccacaggcattgcgaagaagctgcttcctatacccaggtataactcaaaatccaaagggatagggccaggatccctattcctaccccatctattctctgttggctccaagagctaccccagagaccttaaacagaaacagtagctgaggcttcttcctagatacctgactagggaagtttgtctctcctttcttgcccaaccaggtcaaagtaaaatgtgagttgacagctcaaagcacttgtaactgctgccccctccctacctctactccccaaaatggaatcatgggatagggaaggcccccatggggtcagaagggcacggtagttcttgcaattatttttgttttacccttcataacctgtcaaacatatttttttctaatgagaaagccaggcccccgccagcacacatgctgtttttaatgcgctgtagttcttgtgtgtctgctgtgctgtgcaaatggagattcagttcaaaataaaatcatttaaaaacctacataaaaagaactctaaacccacccctgcaacaaaagtcactacataaactgttcagcagtattcacctatcagagtatttgttgtgagtatagattatcaattgaaaacactactcttgttttcttaattgtacagttttcaatgtccctttcttaaagagacagtatatttctcttcacccctagcccatcttccctcaccctcctgaatgacatcaggaggtatatccagggtgtctccttccttcctactctcttgaccagaagttaacagactatactgtctctttaaaaataaaatttaaaaagctttgttgtcttttcagacatacatatgcatatatgttttagatgttcttataagagaaaagatggtttttaaatgtgccaagttgtgtgtgtgtgtgtatatatatgtgtgtatgtgtgtgtatatatatatgtgtgtgtgtgtgtatatatatacacacacacacacacacctgctgtgtgattggtaagcaatacaatagtaaacatgtccccattacttttttctaatattggaccaatgctgtcctaattgtacatttccccttatggtgacgatgctctgactcgtttaggtagacacattgaccaccttccattccattaaatattttttcctttttcccctttctgtgtcattcttgaggaaaaaacaaaagagagaggggatgccaatgatccccttgagcagagaaaaagcaaaataaatattttattaaagaaaaaagagaattaagaaaatagtttggagtattttcttactgtagagaagcactgtacattactaagagacctgggtataagatactcacatgtggagctggaaaaatcgcatgtccaagcccgtttgagtggtttcttttgtttttcattgcagggagtgggtgggagggaggtgggactaggggcactttgggggtctccttttagtcaaaagcgagaaaatgacaagaaagagattaaaattcaatgtttcctttatagtgttaaacactaaaattttaaaaaagatgaaaaagaaaaaaaaactttgtaaaatgcgagaacagaagcaaaagacactacgctctgtcattttatctttcttttgttgaaagactaaaaaaaaactgaaatgttttttagacaatcaaatgttaggtaagtgcaaaaacttgttttttcttactggtgtagaaattaatgcctttttttatttttcagttattgtagttatacgttagtaaacagaatacgcacccatgattacggacggcactggctgtctg

SEQ ID NO: 356485 - DNA, 9044 bp, Homo sapiens
gggggcgctaggcgcccttcgctccctccctctggaggagctgccgccgccaccgccgccactctgctgctgccgccgccgccgccgccgctcccgccgccattttgggttcgctttgcggaggggagacgatcccagtctcggttgcgggacccgcctcccctcagtttgccccctttagccttccacctttcccttctcctctctcgcatttccgccagtcagcttacccgctggccgcctcctgacaagcgggagggatccgccgtggacccagggaagcggaggagcctggcggccaccccctcttccccacttccctgcactctcatcgctctcggcctcggcctcggcctccgacacgagaaagatgctggtttcgagttttggagatccttgttttttatggaacacagttctgtaaaattttcataagattccttggcaataacatacgcttgtgatggaccctagaaatactgctatgttaggattgggttctgattccgaaggtttttcaagaaagagtccttctgccatcagtactggcacattggtcagtaagagagaagtagagctagaaaaaaacacaaaggaggaagaggaccttcgcaaacggaatcgagaaagaaacatcgaagctgggaaagatgatggtttgactgatgcacagcaacagttttcagtgaaagaaacaaacttttcagagggaaatttaaaattgaaaattggcctccaggctaagagaactaaaaaacctccaaagaacttggagaactatgtatgtcgacctgccataaaaacaactattaagcacccaaggaaagcacttaaaagtggaaagatgacggatgaaaagaatgaacactgtccttcaaaacgagacccttcaaagttgtacaagaaagcagatgatgttgcagccattgaatgccagtctgaagaagtcatccgtcttcattcacagggagaaaacaatcctttgtctaagaagctgtctccagtacactcagaaatggcagattatattaatgcaacgccatctactcttcttggtagccgggatcctgatttaaaggacagagcattacttaatggaggaactagtgtaacagaaaagttggcacagctgattgctacctgtcctccttccaagtcttccaagacaaaaccgaagaagttaggaactggcactacagcaggattggttagcaaggatttgatcaggaaagcaggtgttggctctgtagctggaataatacataaggacttaataaaaaagccaaccatcagcacagcagttggattggtaactaaagatcctgggaaaaagccagtgtttaatgcagcagtaggattggtcaataaggactctgtgaaaaaactgggaactggcactacagcggtattcattaataaaaacttaggcaaaaagccaggaactatcactacagtaggactgctaagcaaagattcaggaaagaagctaggaattggtattgttccaggtttagtgcataaagagtctggcaagaagttaggacttggcactgtggttggactggttaataaagatttgggaaagaaattgggttctactgttggcctagtggccaaggactgtgcaaagaagattgtagcaagttcagcaatgggattggttaataaggacattggaaagaaactaatgagttgtcctttggcaggtctgatcagtaaagatgccataaaccttaaagccgaagcactgctccccactcaggaaccgcttaaggcttcttgtagtacaaacatcaataatcaggaaagtcaggaactttctgaatccctgaaagatagtgccaccagcaaaacttttgaaaagaatgttgtacggcagaataaagaaagcatattggaaaagttctcagtacgaaaagaaatcattaatttggagaaagaaatgtttaatgaaggaacatgcattcagcaagacagtttctcatccagtgaaaagggatcttatgaaacctcaaagcatgaaaagcagcctcctgtatattgcacttctccggactttaaaatgggaggtgcttctgatgtatctaccgctaaatccccattcagtgcagtaggagaaagcaatctcccttccccatcacctactgtatctgttaatcctttaaccagaagtccccctgaaacttcttcacagttggctcctaatccattacttttaagttctactacagaactaatcgaagaaatttctgaatctgttggaaagaaccagtttacttctgaaagtacccacttgaacgttggtcataggtcagttggtcatagtataagtattgaatgtaaagggattgataaagaggtaaatgattcaaaaactacccatatagatattccaagaataagctcttcccttggaaaaaagccaagtttgacttctgaatccagcattcatactattactccttcagttgttaacttcactagtttatttagtaataagccttttttaaaactgggtgcagtatctgcatcagacaaacactgccaagttgctgaaagcctaagtactagtttgcagtccaaaccattaaaaaaaagaaaaggaagaaaacctcggtggactaaagtggtggcaagaagcacatgccggtctccaaaagggctagaattagaaagatcagagctttttaaaaacgtttcatgtagctcactatcaaatagtaattctgagccagccaagtttatgaaaaacattggacccccttcatttgtagatcatgacttccttaaacgccgattgccaaagttgagcaaatccacagctccatctcttgctctcttagctgatagtgaaaaaccatctcataagtcttttgctactcacaaactatcctccagtatgtgtgtctctagtgaccttttgtctgatatttataagcccaaaagaggaaggcctaaatctaaggagatgcctcaactggaagggccacctaaaaggactttaaaaatccctgcttctaaagtgttttctttacagtctaaggaagaacaagaacccccaattttacagccagaaattgaaatcccttccttcaaacaaggtctgtctgtgtctccttttccaaaaaagagaggcaggcctaagaggcaaatgaggtcaccagtcaagatgaagccacctgtactgtcagtggctccatttgttgccactgaaagtccaagcaagctagaatctgaaagtgacaaccatagaagtagcagtgatttctttgagagcgaggatcaacttcaggatccagatgacctagatgacagtcataggccaagtgtctgtagtatgagtgaccttgagatggaaccagataaaaaaattaccaagagaaacaatggacaattaatgaaaacaattatccgcaaaataaataaaatgaagactttaaagagaaagaaactgttgaatcagattctttcaagttctgtagaatcaagtaataaagggaaagtgcaatccaaactccataatacggtatcaagtcttgctgccacatttggctctaaattgggccaacagataaatgtcagcaagaaaggaaccatttatataggaaagagaagaggtcgcaaaccaaaaactgtcttaaatggtattctttctggtagtcctactagccttgctgttcttgagcaaacagctcaacaggcagctgggtcagcattaggacagattcttcccccattactgccttcatctgctagtagttctgagattcttccatcacctatttgctctcagtcttctgggactagtggaggtcagagccctgtaagtagtgatgcaggttttgttgaacccagttcagtgccatatttgcatttacactccagacagggcagtatgattcagactcttgcaatgaagaaggcctcaaaggggaggaggcggttatctcctcctactttgttgccaaattctccttcgcacttgagtgaactcacatctctaaaagaagctactccttccccaatcagtgagtctcatagtgatgagaccattcccagtgatagtggaattggaacagataataacagcacatcagacagggcagagaaattttgtgggcaaaaaaagaggaggcattcttttgagcatgtttctctgattccccctgaaacctctacagtgctaagcagtcttaaagaaaaacataaacacaaatgtaagcgcaggaatcatgattacctcagctatgacaagatgaaaaggcagaaacgaaaacggaaaaagaaatatccccagcttcgaaatagacaggatccagactttattgcagagctggaggaactaataagtcgcctaagtgaaattcggatcactcatcgaagtcatcattttatcccccgagatcttctgccaactatctttcgaatcaactttaatagtttctatacacatccttctttccccttagaccctttgcactacattcgaaaacctgacttaaaaaagaaaagagggagaccccctaagatgagggaggcaatggctgaaatgccttttatgcacagccttagttttcctctttctagtactggattctatccatcttatggtatgccttactctccttcaccccttacagctgctcccataggattaggttactatggaaggtatcctcccactctttatccacctcctccatctccttctttcaccacgccacttccacctccttcctatatgcatgctggtcatttacttctcaatcctgccaaataccataagaaaaagcataagctacttcgacaggaggcctttcttacaaccagcaggactcccctcctttccatgagtacctaccccagtgttcctcctgagatggcctatggttggatggttgagcacaaacacaggcaccgtcacaaacacagagaacaccgttcttctgaacaaccccaggtttctatggacactggctcttcccgatctgtcctggaatctttgaagcgctatagatttggaaaggatgctgttggagagcgatataagcataaggaaaagcaccgttgtcacatgtcctgccctcatctctctccttcaaaaagcttaataaacagagaggaacagtgggtccaccgagagccttcagaatctagtccattggccttgggattgcagacacctttacagattgactgttcagaaagttctccaagcttatcccttggaggattcactcccaactctgagccagccagcagtgatgaacatacaaaccttttcacaagtgcaataggcagctgcagagtttcaaaccctaactccagtggccggaagaaattaactgacagccctggactcttttctgcacaggacacttcactaaatcggcttcacagaaaggagtcactgccttctaacgaaagggcagtacagactttggcaggctcccagccaacctctgataaaccctcccagcggccatcagagagcacaaattgtagccctacccggaaaaggtcttcatctgagagtacttcttcaacagtaaacggagttccctctcgaagtccaagattagttgcttctggggatgactctgtggatagtctgctgcagcggatggtacaaaatgaggaccaagagcccatggagaaaagtattgatgctgtgattgcaactgcctctgcaccaccttcttccagtccaggccgtagccacagcaaggaccgaaccctgggaaaaccagacagccttttagtgcctgcagtcgcaagtgactcttgcaataatagcatctcactcctatctgaaaagttgacaagcagctgttccccccatcatatcaagagaagtgtagtggaagctatgcaacgccaagctcggaaaatgtgcaattacgacaaaatcttggccacaaagaaaaacctagaccatgtcaataaaatcttaaaagccaaaaaacttcaaaggcaggccaggacagggaataactttgtgaaacgtaggccaggtcgacctcggaaatgtccccttcaggctgtcgtatcaatgcaagcattccaggctgctcagtttgtcaacccagaattgaacagagacgaggaaggagcagcactgcacctcagtcctgacacagttacagatgtaattgaggctgttgttcagagtgtaaatctgaacccagaacataaaaaggggttgaagagaaaaggttggctattggaagaacagaccagaaaaaagcagaagccattaccagaggaagaagagcaagagaataataaaagctttaatgaagcaccagttgagattcccagtccttctgaaaccccagctaaaccttctgaacctgaaagtaccttgcagcctgtgctttctctcatcccaagggaaaagaagcccccacgtcccccaaagaagaagtatcagaaagcagggctgtattctgacgtttacaaaactacagacccaaagagtcgattgatccaattaaagaaagagaagctggagtatactccaggagagcatgaatatggattatttccagcgcccattcatgttgtgttttttgtttcaggaaagtatctaagacaaaagagaattgacttccagcttccttatgatatcctttggcagtggaaacacaatcagctatacaaaaagccagatgtcccactatataagaaaattcgttcaaatgtctacgttgatgtcaaacccctttctggttacgaagctaccacctgtaactgtaagaagccagatgatgacaccaggaagggctgtgttgatgactgcctcaatagaatgatctttgctgagtgttcccccaacacttgcccatgtggcgagcaatgctgtaaccagaggatacagaggcatgaatgggtgcaatgtctagaacgatttcgagctgaggaaaaaggttggggaatcagaaccaaagagcccctaaaagctgggcagttcatcattgaatacctaggggaggtcgtcagtgaacaggagttcaggaacaggatgattgagcagtatcataatcacagtgaccactactgcctgaacctggatagtgggatggtgattgacagttaccgcatgggaaatgaggcccgattcatcaaccatagctgtgacccaaattgtgaaatgcagaaatggtctgttaatggagtataccggattggactctatgctcttaaagacatgccagctgggactgaactcacttatgattataactttcattccttcaatgtggaaaaacagcaactttgtaagtgtggctttgagaaatgtcgaggaatcatcggaggcaagagtcagcgtgtgaatggactcaccagcagcaaaaacagccagcccatggccacacacaaaaaatctggacggtcaaaagagaagagaaagtctaagcacaagctgaagaaaaggagaggccatctctctgaggaacccagtgaaaatatcaacaccccaactagattgaccccccaattacagatgaagccaatgtccaatcgtgaaaggaactttgtgttaaagcatcatgtattcttggtccgaaactgggagaagattcgtcaaaaacaggaggaagtaaagcacaccagtgataatattcactcagcatcattatatacccgttggaatgggatctgccgagatgatgggaatatcaagtctgatgtcttcatgacccagttctctgccctgcagacagctcgatctgttcgaacaagacggttggcagctgcagaggaaaatattgaagtggctcgggcagcccgcctagcccagatcttcaaagaaatttgtgatggtatcatctcttataaagattcttcccggcaagcactggcagctccacttttgaaccttcccccaaagaaaaagaatgctgattattatgagaagatctctgatcccctagatcttatcaccatagagaagcagatcctcactggttactataagacagtggaagcttttgatgctgacatgctcaaagtctttcggaatgctgagaagtactatgggcgtaaatccccagttgggagagatgtttgtcgtctacgaaaggcctattacaatgcccggcatgaggcatcagcccagattgatgagattgtgggagagacagcaagtgaggcagacagcagtgagacctcagtctctgaaaaggagaatgggcatgagaaggacgacgatgttattcgctgtatctgtggcctctacaacgatgaaggtctcatgatccagtgtgacaagtgcatggtatggcagcactgtgattgtatgggagtgaactcagatgtggagcactacctttgtgagcagtgtgacccaaggcctgtggacagggaggttcccatgatccctcggccccactatgcccaacctggctgtgtctacttcatctgtttgctccgagatgacttgctgcttcgtcagggtgactgtgtgtatctgatgagggatagtcggcgcacccctgatggccacccggtccgtcagtcctatcgactgttatctcacattaaccgagataaacttgacatctttcgcattgagaagctttggaagaatgaaaaagaggaacggtttgcctttggtcaccattatttccgtccccacgaaacacaccactctccatcccgtcggttctatcataatgaactatttcgggtgccactctatgagatcattcccttggaggctgtagtggggacctgctgtgtgttggacctttatacgtattgtaaaggtaagtgatctgggctagttaaaaaatgacctcggccaagtgcagtggctcacgctgataatcccagcggtgtgggaggccgaggcaggcagattgcttaagcccaggagtgtgagaccagcctggccaacgtggcaaaactctgcctctgtagctgggcatggcagtgtaggcctgtagtcccaactactgggaggattgctgagcctgggaggcagaggttgcagtgagccaagatcgcaccactgcactccaacctgtgcaacagaatga

SEQ ID NO: 356486 - DNA, 7528 bp, Homo sapiens
gggggcgctaggcgcccttcgctccctccctctggaggagctgccgccgccaccgccgccactctgctgctgccgccgccgccgccgccgctcccgccgccattttgggttcgctttgcggaggggagacgatcccagtctcggttgcgggacccgcctcccctcagtttgccccctttagccttccacctttcccttctcctctctcgcatttccgccagtcagcttacccgctggccgcctcctgacaagcgggagggatccgccgtggacccagggaagcggaggagcctggcggccaccccctcttccccacttccctgcactctcatcgctctcggcctcggcctcggcctccgacacgagaaagatgctggtttcgagttttggagatccttgttttttatggaacacagttctgtaaaattttcataagattccttggcaataacatacgcttgtgatggaccctagaaatactgctatgttaggattgggttctgattccgaaggtttttcaagaaagagtccttctgccatcagtactggcacattggtcagtaagagagaagtagagctagaaaaaaacacaaaggaggaagaggaccttcgcaaacggaatcgagaaagaaacatcgaagctgggaaagatgatggtttgactgatgcacagcaacagttttcagtgaaagaaacaaacttttcagagggaaatttaaaattgaaaattggcctccaggctaagagaactaaaaaacctccaaagaacttggagaactatgtatgtcgacctgccataaaaacaactattaagcacccaaggaaagcacttaaaagtggaaagatgacggatgaaaagaatgaacactgtccttcaaaacgagacccttcaaagttgtacaagaaagcagatgatgttgcagccattgaatgccagtctgaagaagtcatccgtcttcattcacagggagaaaacaatcctttgtctaagaagctgtctccagtacactcagaaatggcagattatattaatgcaacgccatctactcttcttggtagccgggatcctgatttaaaggacagagcattacttaatggaggaactagtgtaacagaaaagttggcacagctgattgctacctgtcctccttccaagtcttccaagacaaaaccgaagaagttaggaactggcactacagcaggattggttagcaaggatttgatcaggaaagcaggtgttggctctgtagctggaataatacataaggacttaataaaaaagccaaccatcagcacagcagttggattggtaactaaagatcctgggaaaaagccagtgtttaatgcagcagtaggattggtcaataaggactctgtgaaaaaactgggaactggcactacagcggtattcattaataaaaacttaggcaaaaagccaggaactatcactacagtaggactgctaagcaaagattcaggaaagaagctaggaattggtattgttccaggtttagtgcataaagagtctggcaagaagttaggacttggcactgtggttggactggttaataaagatttgggaaagaaattgggttctactgttggcctagtggccaaggactgtgcaaagaagattgtagcaagttcagcaatgggattggttaataaggacattggaaagaaactaatgagttgtcctttggcaggtctgatcagtaaagatgccataaaccttaaagccgaagcactgctccccactcaggaaccgcttaaggcttcttgtagtacaaacatcaataatcaggaaagtcaggaactttctgaatccctgaaagatagtgccaccagcaaaacttttgaaaagaatgttgtacggcagaataaagaaagcatattggaaaagttctcagtacgaaaagaaatcattaatttggagaaagaaatgtttaatgaaggaacatgcattcagcaagacagtttctcatccagtgaaaagggatcttatgaaacctcaaagcatgaaaagcagcctcctgtatattgcacttctccggactttaaaatgggaggtgcttctgatgtatctaccgctaaatccccattcagtgcagtaggagaaagcaatctcccttccccatcacctactgtatctgttaatcctttaaccagaagtccccctgaaacttcttcacagttggctcctaatccattacttttaagttctactacagaactaatcgaagaaatttctgaatctgttggaaagaaccagtttacttctgaaagtacccacttgaacgttggtcataggtcagttggtcatagtataagtattgaatgtaaagggattgataaagaggtaaatgattcaaaaactacccatatagatattccaagaataagctcttcccttggaaaaaagccaagtttgacttctgaatccagcattcatactattactccttcagttgttaacttcactagtttatttagtaataagccttttttaaaactgggtgcagtatctgcatcagacaaacactgccaagttgctgaaagcctaagtactagtttgcagtccaaaccattaaaaaaaagaaaaggaagaaaacctcggtggactaaagtggtggcaagaagcacatgccggtctccaaaagggctagaattagaaagatcagagctttttaaaaacgtttcatgtagctcactatcaaatagtaattctgagccagccaagtttatgaaaaacattggacccccttcatttgtagatcatgacttccttaaacgccgattgccaaagttgagcaaatccacagctccatctcttgctctcttagctgatagtgaaaaaccatctcataagtcttttgctactcacaaactatcctccagtatgtgtgtctctagtgaccttttgtctgatatttataagcccaaaagaggaaggcctaaatctaaggagatgcctcaactggaagggccacctaaaaggactttaaaaatccctgcttctaaagtgttttctttacagtctaaggaagaacaagaacccccaattttacagccagaaattgaaatcccttccttcaaacaaggtctgtctgtgtctccttttccaaaaaagagaggcaggcctaagaggcaaatgaggtcaccagtcaagatgaagccacctgtactgtcagtggctccatttgttgccactgaaagtccaagcaagctagaatctgaaagtgacaaccatagaagtagcagtgatttctttgagagcgaggatcaacttcaggatccagatgacctagatgacagtcataggccaagtgtctgtagtatgagtgaccttgagatggaaccagataaaaaaattaccaagagaaacaatggacaattaatgaaaacaattatccgcaaaataaataaaatgaagactttaaagagaaagaaactgttgaatcagattctttcaagttctgtagaatcaagtaataaagggaaagtgcaatccaaactccataatacggtatcaagtcttgctgccacatttggctctaaattgggccaacagataaatgtcagcaagaaaggaaccatttatataggaaagagaagaggtcgcaaaccaaaaactgtcttaaatggtattctttctggtagtcctactagccttgctgttcttgagcaaacagctcaacaggcagctgggtcagcattaggacagattcttcccccattactgccttcatctgctagtagttctgagattcttccatcacctatttgctctcagtcttctgggactagtggaggtcagagccctgtaagtagtgatgcaggttttgttgaacccagttcagtgccatatttgcatttacactccagacagggcagtatgattcagactcttgcaatgaagaaggcctcaaaggggaggaggcggttatctcctcctactttgttgccaaattctccttcgcacttgagtgaactcacatctctaaaagaagctactccttccccaatcagtgagtctcatagtgatgagaccattcccagtgatagtggaattggaacagataataacagcacatcagacagggcagagaaattttgtgggcaaaaaaagaggaggcattcttttgagcatgtttctctgattccccctgaaacctctacagtgctaagcagtcttaaagaaaaacataaacacaaatgtaagcgcaggaatcatgattacctcagctatgacaagatgaaaaggcagaaacgaaaacggaaaaagaaatatccccagcttcgaaatagacaggatccagactttattgcagagctggaggaactaataagtcgcctaagtgaaattcggatcactcatcgaagtcatcattttatcccccgagatcttctgccaactatctttcgaatcaactttaatagtttctatacacatccttctttccccttagaccctttgcactacattcgaaaacctgacttaaaaaagaaaagagggagaccccctaagatgagggaggcaatggctgaaatgccttttatgcacagccttagttttcctctttctagtactggattctatccatcttatggtatgccttactctccttcaccccttacagctgctcccataggattaggttactatggaaggtatcctcccactctttatccacctcctccatctccttctttcaccacgccacttccacctccttcctatatgcatgctggtcatttacttctcaatcctgccaaataccataagaaaaagcataagctacttcgacaggaggcctttcttacaaccagcaggactcccctcctttccatgagtacctaccccagtgttcctcctgagatggcctatggttggatggttgagcacaaacacaggcaccgtcacaaacacagagaacaccgttcttctgaacaaccccaggtttctatggacactggctcttcccgatctgtcctggaatctttgaagcgctatagatttggaaaggatgctgttggagagcgatataagcataaggaaaagcaccgttgtcacatgtcctgccctcatctctctccttcaaaaagcttaataaacagagaggaacagtgggtccaccgagagccttcagaatctagtccattggccttgggattgcagacacctttacagattgactgttcagaaagttctccaagcttatcccttggaggattcactcccaactctgagccagccagcagtgatgaacatacaaaccttttcacaagtgcaataggcagctgcagagtttcaaaccctaactccagtggccggaagaaattaactgacagccctggactcttttctgcacaggacacttcactaaatcggcttcacagaaaggagtcactgccttctaacgaaagggcagtacagactttggcaggctcccagccaacctctgataaaccctcccagcggccatcagagagcacaaattgtagccctacccggaaaaggtcttcatctgagagtacttcttcaacagtaaacggagttccctctcgaagtccaagattagttgcttctggggatgactctgtggatagtctgctgcagcggatggtacaaaatgaggaccaagagcccatggagaaaagtattgatgctgtgattgcaactgcctctgcaccaccttcttccagtccaggccgtagccacagcaaggaccgaaccctgggaaaaccagacagccttttagtgcctgcagtcgcaagtgactcttgcaataatagcatctcactcctatctgaaaagttgacaagcagctgttccccccatcatatcaagagaagtgtagtggaagctatgcaacgccaagctcggaaaatgtgcaattacgacaaaatcttggccacaaagaaaaacctagaccatgtcaataaaatcttaaaagccaaaaaacttcaaaggcaggccaggacagggaataactttgtgaaacgtaggccaggtcgacctcggaaatgtccccttcaggctgtcgtatcaatgcaagcattccaggctgctcagtttgtcaacccagaattgaacagagacgaggaaggagcagcactgcacctcagtcctgacacagttacagatgtaattgaggctgttgttcagagtgtaaatctgaacccagaacataaaaaggggttgaagagaaaaggttggctattggaagaacagaccagaaaaaagcagaagccattaccagaggaagaagagcaagagaataataaaagctttaatgaagcaccagttgagattcccagtccttctgaaaccccagctaaaccttctgaacctgaaagtaccttgcagcctgtgctttctctcatcccaagggaaaagaagcccccacgtcccccaaagaagaagtatcagaaagcagggctgtattctgacgtttacaaaactacagacccaaagagtcgattgatccaattaaagaaagagaagctggagtatactccaggagagcatgaatatggattatttccagcgcccattcatgttgtgttttttgtttcaggaaagtatctaagacaaaagagaattgacttccagcttccttatgatatcctttggcagtggaaacacaatcagctatacaaaaagccagatgtcccactatataagaaaattcgttcaaatgtctacgttgatgtcaaacccctttctggttacgaagctaccacctgtaactgtaagaagccagatgatgacaccaggaagggctgtgttgatgactgcctcaatagaatgatctttgctgagtgttcccccaacacttgcccatgtggcgagcaatgctgtaaccagaggatacagaggcatgaatgggtgcaatgtctagaacgatttcgagctgaggaaaaaggttggggaatcagaaccaaagagcccctaaaagctgggcagttcatcattgaatacctaggggaggtcgtcagtgaacaggagttcaggaacaggatgattgagcagtatcataatcacagtgaccactactgcctgaacctggatagtgggatggtgattgacagttaccgcatgggaaatgaggcccgattcatcaaccatagctgtgacccaaattgtgaaatgcagaaatggtaaggaagcaaaagaaggtgaagacaagaatccagcagaataagcattgagtgcagcaagggattgatctttccagtgtcagtcagcttacacaaagcagctcaggctgttccccattaccccagatcccacgggcagagtaagctgcttcgttttcaccctaacttctcactcccagacagatatttttgtttttatttgtgttctgtttttttgttttgcttttttggtttttttgtttggcatgcaagtagtttcaggatctatgtcctagaaaaatataataatgatgatgatgatagccagggtggtggtacacacctgtagtcccagctatttgagaggttgaggtgagaggatcac

SEQ ID NO: 356487 - DNA, 11394 bp, Homo sapiens
gaggcttgggcttgcgccgttgaagagaaagatgctggtttcgagttttggagatccttgttttttatggaacacagttctgtaaaattttcataagattccttggcaataacatacgcttgtgatggaccctagaaatactgctatgttaggattgggttctgattccgaaggtttttcaagaaagagtccttctgccatcagtactggcacattggtcagtaagagagaagtagagctagaaaaaaacacaaaggaggaagaggaccttcgcaaacggaatcgagaaagaaacatcgaagctgggaaagatgatggtttgactgatgcacagcaacagttttcagtgaaagaaacaaacttttcagagggaaatttaaaattgaaaattggcctccaggctaagagaactaaaaaacctccaaagaacttggagaactatgtatgtcgacctgccataaaaacaactattaagcacccaaggaaagcacttaaaagtggaaagatgacggatgaaaagaatgaacactgtccttcaaaacgagacccttcaaagttgtacaagaaagcagatgatgttgcagccattgaatgccagtctgaagaagtcatccgtcttcattcacagggagaaaacaatcctttgtctaagaagctgtctccagtacactcagaaatggcagattatattaatgcaacgccatctactcttcttggtagccgggatcctgatttaaaggacagagcattacttaatggaggaactagtgtaacagaaaagttggcacagctgattgctacctgtcctccttccaagtcttccaagacaaaaccgaagaagttaggaactggcactacagcaggattggttagcaaggatttgatcaggaaagcaggtgttggctctgtagctggaataatacataaggacttaataaaaaagccaaccatcagcacagcagttggattggtaactaaagatcctgggaaaaagccagtgtttaatgcagcagtaggattggtcaataaggactctgtgaaaaaactgggaactggcactacagcggtattcattaataaaaacttaggcaaaaagccaggaactatcactacagtaggactgctaagcaaagattcaggaaagaagctaggaattggtattgttccaggtttagtgcataaagagtctggcaagaagttaggacttggcactgtggttggactggttaataaagatttgggaaagaaattgggttctactgttggcctagtggccaaggactgtgcaaagaagattgtagcaagttcagcaatgggattggttaataaggacattggaaagaaactaatgagttgtcctttggcaggtctgatcagtaaagatgccataaaccttaaagccgaagcactgctccccactcaggaaccgcttaaggcttcttgtagtacaaacatcaataatcaggaaagtcaggaactttctgaatccctgaaagatagtgccaccagcaaaacttttgaaaagaatgttgtacggcagaataaagaaagcatattggaaaagttctcagtacgaaaagaaatcattaatttggagaaagaaatgtttaatgaaggaacatgcattcagcaagacagtttctcatccagtgaaaagggatcttatgaaacctcaaagcatgaaaagcagcctcctgtatattgcacttctccggactttaaaatgggaggtgcttctgatgtatctaccgctaaatccccattcagtgcagtaggagaaagcaatctcccttccccatcacctactgtatctgttaatcctttaaccagaagtccccctgaaacttcttcacagttggctcctaatccattacttttaagttctactacagaactaatcgaagaaatttctgaatctgttggaaagaaccagtttacttctgaaagtacccacttgaacgttggtcataggtcagttggtcatagtataagtattgaatgtaaagggattgataaagaggtaaatgattcaaaaactacccatatagatattccaagaataagctcttcccttggaaaaaagccaagtttgacttctgaatccagcattcatattaaaactgggtgcagtatctgcatcagacaaacactgccaagttgctgaaagcctaagtactagtttgcagtccaaaccattaaaaaaaagaaaaggaagaaaacctcggtggactaaagtggtggcaagaagcacatgccggtctccaaaagggctagaattagaaagatcagagctttttaaaaacgtttcatgtagctcactatcaaatagtaattctgagccagccaagtttatgaaaaacattggacccccttcatttgtagatcatgacttccttaaacgccgattgccaaagttgagcaaatccacagctccatctcttgctctcttagctgatagtgaaaaaccatctcataagtcttttgctactcacaaactatcctccagtatgtgtgtctctagtgaccttttgtctgatatttataagcccaaaagaggaaggcctaaatctaaggagatgcctcaactggaagggccacctaaaaggactttaaaaatccctgcttctaaagtgttttctttacagtctaaggaagaacaagaacccccaattttacagccagaaattgaaatcccttccttcaaacaaggtctgtctgtgtctccttttccaaaaaagagaggcaggcctaagaggcaaatgaggtcaccagtcaagatgaagccacctgtactgtcagtggctccatttgttgccactgaaagtccaagcaagctagaatctgaaagtgacaaccatagaagtagcagtgatttctttgagagcgaggatcaacttcaggatccagatgacctagatgacagtcataggccaagtgtctgtagtatgagtgaccttgagatggaaccagataaaaaaattaccaagagaaacaatggacaattaatgaaaacaattatccgcaaaataaataaaatgaagactttaaagagaaagaaactgttgaatcagattctttcaagttctgtagaatcaagtaataaagggaaagtgcaatccaaactccataatacggtatcaagtcttgctgccacatttggctctaaattgggccaacagataaatgtcagcaagaaaggaaccatttatataggaaagagaagaggtcgcaaaccaaaaactgtcttaaatggtattctttctggtagtcctactagccttgctgttcttgagcaaacagctcaacaggcagctgggtcagcattaggacagattcttcccccattactgccttcatctgctagtagttctgagattcttccatcacctatttgctctcagtcttctgggactagtggaggtcagagccctgtaagtagtgatgcaggttttgttgaacccagttcagtgccatatttgcatttacactccagacagggcagtatgattcagactcttgcaatgaagaaggcctcaaaggggaggaggcggttatctcctcctactttgttgccaaattctccttcgcacttgagtgaactcacatctctaaaagaagctactccttccccaatcagtgagtctcatagtgatgagaccattcccagtgatagtggaattggaacagataataacagcacatcagacagggcagagaaattttgtgggcaaaaaaagaggaggcattcttttgagcatgtttctctgattccccctgaaacctctacagtgctaagcagtcttaaagaaaaacataaacacaaatgtaagcgcaggaatcatgattacctcagctatgacaagatgaaaaggcagaaacgaaaacggaaaaagaaatatccccagcttcgaaatagacaggatccagactttattgcagagctggaggaactaataagtcgcctaagtgaaattcggatcactcatcgaagtcatcattttatcccccgagatcttctgccaactatctttcgaatcaactttaatagtttctatacacatccttctttccccttagaccctttgcactacattcgaaaacctgacttaaaaaagaaaagagggagaccccctaagatgagggaggcaatggctgaaatgccttttatgcacagccttagttttcctctttctagtactggattctatccatcttatggtatgccttactctccttcaccccttacagctgctcccataggattaggttactatggaaggtatcctcccactctttatccacctcctccatctccttctttcaccacgccacttccacctccttcctatatgcatgctggtcatttacttctcaatcctgccaaataccataagaaaaagcataagctacttcgacaggaggcctttcttacaaccagcaggactcccctcctttccatgagtacctaccccagtgttcctcctgagatggcctatggttggatggttgagcacaaacacaggcaccgtcacaaacacagagaacaccgttcttctgaacaaccccaggtttctatggacactggctcttcccgatctgtcctggaatctttgaagcgctatagatttggaaaggatgctgttggagagcgatataagcataaggaaaagcaccgttgtcacatgtcctgccctcatctctctccttcaaaaagcttaataaacagagaggaacagtgggtccaccgagagccttcagaatctagtccattggccttgggattgcagacacctttacagattgactgttcagaaagttctccaagcttatcccttggaggattcactcccaactctgagccagccagcagtgatgaacatacaaaccttttcacaagtgcaataggcagctgcagagtttcaaaccctaactccagtggccggaagaaattaactgacagccctggactcttttctgcacaggacacttcactaaatcggcttcacagaaaggagtcactgccttctaacgaaagggcagtacagactttggcaggctcccagccaacctctgataaaccctcccagcggccatcagagagcacaaattgtagccctacccggaaaaggtcttcatctgagagtacttcttcaacagtaaacggagttccctctcgaagtccaagattagttgcttctggggatgactctgtggatagtctgctgcagcggatggtacaaaatgaggaccaagagcccatggagaaaagtattgatgctgtgattgcaactgcctctgcaccaccttcttccagtccaggccgtagccacagcaaggaccgaaccctgggaaaaccagacagccttttagtgcctgcagtcgcaagtgactcttgcaataatagcatctcactcctatctgaaaagttgacaagcagctgttccccccatcatatcaagagaagtgtagtggaagctatgcaacgccaagctcggaaaatgtgcaattacgacaaaatcttggccacaaagaaaaacctagaccatgtcaataaaatcttaaaagccaaaaaacttcaaaggcaggccaggacagggaataactttgtgaaacgtaggccaggtcgacctcggaaatgtccccttcaggctgtcgtatcaatgcaagcattccaggctgctcagtttgtcaacccagaattgaacagagacgaggaaggagcagcactgcacctcagtcctgacacagttacagatgtaattgaggctgttgttcagagtgtaaatctgaacccagaacataaaaaggggttgaagagaaaaggttggctattggaagaacagaccagaaaaaagcagaagccattaccagaggaagaagagcaagagaataataaaagctttaatgaagcaccagttgagattcccagtccttctgaaaccccagctaaaccttctgaacctgaaagtaccttgcagcctgtgctttctctcatcccaagggaaaagaagcccccacgtcccccaaagaagaagtatcagaaagcagggctgtattctgacgtttacaaaactacagacccaaagagtcgattgatccaattaaagaaagagaagctggagtatactccaggagagcatgaatatggattatttccagcgcccattcatgttgtgttttttgtttcaggaaagtatctaagacaaaagagaattgacttccagcttccttatgatatcctttggcagtggaaacacaatcagctatacaaaaagccagatgtcccactatataagaaaattcgttcaaatgtctacgttgatgtcaaacccctttctggttacgaagctaccacctgtaactgtaagaagccagatgatgacaccaggaagggctgtgttgatgactgcctcaatagaatgatctttgctgagtgttcccccaacacttgcccatgtggcgagcaatgctgtaaccagaggatacagaggcatgaatgggtgcaatgtctagaacgatttcgagctgaggaaaaaggttggggaatcagaaccaaagagcccctaaaagctgggcagttcatcattgaatacctaggggaggtcgtcagtgaacaggagttcaggaacaggatgattgagcagtatcataatcacagtgaccactactgcctgaacctggatagtgggatggtgattgacagttaccgcatgggaaatgaggcccgattcatcaaccatagctgtgacccaaattgtgaaatgcagaaatggtctgttaatggagtataccggattggactctatgctcttaaagacatgccagctgggactgaactcacttatgattataactttcattccttcaatgtggaaaaacagcaactttgtaagtgtggctttgagaaatgtcgaggaatcatcggaggcaagagtcagcgtgtgaatggactcaccagcagcaaaaacagccagcccatggccacacacaaaaaatctggacggtcaaaagagaagagaaagtctaagcacaagctgaagaaaaggagaggccatctctctgaggaacccagtgaaaatatcaacaccccaactagattgaccccccaattacagatgaagccaatgtccaatcgtgaaaggaactttgtgttaaagcatcatgtattcttggtccgaaactgggagaagattcgtcaaaaacaggaggaagtaaagcacaccagtgataatattcactcagcatcattatatacccgttggaatgggatctgccgagatgatgggaatatcaagtctgatgtcttcatgacccagttctctgccctgcagacagctcgatctgttcgaacaagacggttggcagctgcagaggaaaatattgaagtggctcgggcagcccgcctagcccagatcttcaaagaaatttgtgatggtatcatctcttataaagattcttcccggcaagcactggcagctccacttttgaaccttcccccaaagaaaaagaatgctgattattatgagaagatctctgatcccctagatcttatcaccatagagaagcagatcctcactggttactataagacagtggaagcttttgatgctgacatgctcaaagtctttcggaatgctgagaagtactatgggcgtaaatccccagttgggagagatgtttgtcgtctacgaaaggcctattacaatgcccggcatgaggcatcagcccagattgatgagattgtgggagagacagcaagtgaggcagacagcagtgagacctcagtctctgaaaaggagaatgggcatgagaaggacgacgatgttattcgctgtatctgtggcctctacaacgatgaaggtctcatgatccagtgtgacaagtgcatggtatggcagcactgtgattgtatgggagtgaactcagatgtggagcactacctttgtgagcagtgtgacccaaggcctgtggacagggaggttcccatgatccctcggccccactatgcccaacctggctgtgtctacttcatctgtttgctccgagatgacttgctgcttcgtcagggtgactgtgtgtatctgatgagggatagtcggcgcacccctgatggccacccggtccgtcagtcctatcgactgttatctcacattaaccgagataaacttgacatctttcgcattgagaagctttggaagaatgaaaaagaggaacggtttgcctttggtcaccattatttccgtccccacgaaacacaccactctccatcccgtcggttctatcataatgaactatttcgggtgccactctatgagatcattcccttggaggctgtagtggggacctgctgtgtgttggacctttatacgtattgtaaagggagacccaaaggagtaaaggagcaagatgtgtacatctgtgattatcggcttgacaagtcagcacacctgttttacaagatccaccggaaccgctatcctgtctgcaccaaaccctatgcttttgatcacttccccaagaagctcactcccaaaaaagatttctcgcctcattacgtcccagacaactacaagaggaatggaggacgatcatcctggaagtctgagcgctcaaagccacccctaaaagacttgggccaggaggatgatgctctacccttgattgaagaggttctagccagtcaagagcaagcagccaatgagatacccagcctggaggagccagaacgggaaggggccactgctaacgtcagtgagggtgaaaaaaaaacagaggaaagtagtcaagaaccccagtcaacctgtacccctgaggaacgacggcataaccaacgggaacgactcaaccagatcttgctcaatctccttgaaaaaatccctggaaaaaatgccattgatgtgacctacttgctggaggaaggatcaggcaggaaactgcgaaggcgtactttgtttatcccagaaaacagctttcgaaagtgaccctcaaagaatgagaacctcaagcatctgggatccagtggagctaatcagtcctgcctcctgctctctgggtatagacaggggtgggaagggtccatctgggcaaggggaatggggccatgttgttgacattaggtacttaataagccttggagctagtggagagggagaggaaagggttctgtccaagacagttcaggttaattaattttcttctccattgcttcaccttaagggttaataatgtagagaggagggaggaccacattgatgaccagaacctactggtactttatagcatttgccccaccccacagcttaggtttttctgtcatcctcagatcccacaggcattgcgaagaagctgcttcctatacccaggtataactcaaaatccaaagggatagggccaggatccctattcctaccccatctattctctgttggctccaagagctaccccagagaccttaaacagaaacagtagctgaggcttcttcctagatacctgactagggaagtttgtctctcctttcttgcccaaccaggtcaaagtaaaatgtgagttgacagctcaaagcacttgtaactgctgccccctccctacctctactccccaaaatggaatcatgggatagggaaggcccccatggggtcagaagggcacggtagttcttgcaattatttttgttttacccttcataacctgtcaaacatatttttttctaatgagaaagccaggcccccgccagcacacatgctgtttttaatgcgctgtagttcttgtgtgtctgctgtgctgtgcaaatggagattcagttcaaaataaaatcatttaaaaacctacataaaaagaactctaaacccacccctgcaacaaaagtcactacataaactgttcagcagtattcacctatcagagtatttgttgtgagtatagattatcaattgaaaacactactcttgttttcttaattgtacagttttcaatgtccctttcttaaagagacagtatatttctcttcacccctagcccatcttccctcaccctcctgaatgacatcaggaggtatatccagggtgtctccttccttcctactctcttgaccagaagttaacagactatactgtctctttaaaaataaaatttaaaaagctttgttgtcttttcagacatacatatgcatatatgttttagatgttcttataagagaaaagatggtttttaaatgtgccaagttgtgtgtgtgtgtgtatatatatgtgtgtatgtgtgtgtatatatatatgtgtgtgtgtgtgtatatatatacacacacacacacacacctgctgtgtgattggtaagcaatacaatagtaaacatgtccccattacttttttctaatattggaccaatgctgtcctaattgtacatttccccttatggtgacgatgctctgactcgtttaggtagacacattgaccaccttccattccattaaatattttttcctttttcccctttctgtgtcattcttgaggaaaaaacaaaagagagaggggatgccaatgatccccttgagcagagaaaaagcaaaataaatattttattaaagaaaaaagagaattaagaaaatagtttggagtattttcttactgtagagaagcactgtacattactaagagacctgggtataagatactcacatgtggagctggaaaaatcgcatgtccaagcccgtttgagtggtttcttttgtttttcattgcagggagtgggtgggagggaggtgggactaggggcactttgggggtctccttttagtcaaaagcgagaaaatgacaagaaagagattaaaattcaatgtttcctttatagtgttaaacactaaaattttaaaaaagatgaaaaagaaaaaaaaactttgtaaaatgcgagaacagaagcaaaagacactacgctctgtcattttatctttcttttgttgaaagactaaaaaaaaactgaaatgttttttagacaatcaaatgttaggtaagtgcaaaaacttgttttttcttactggtgtagaaattaatgcctttttttatttttcagttattttataataacgaaataaaaagaaccccccagctgccaggcgggttttggtgtttgaaatgcggggcaaagcactacatcactgcaaatagatacagagttagtctgcatgtctgtaggctgtgtgattgcggaaaatataaatgctgctaatatatttcctttttacaaaagcatatctaaatagatgattgttttgatgttaatctttgtaaattatgtattaccaattttaacattggatgtaattgcatacaaagcttgcatctcaatccttgaaagtctagtattaaatggaaaaaacttttcctaactgtggaaaaaaaaaaa

SEQ ID NO: 356488 - DNA, 1061 bp, Homo sapiens
gggggcgctaggcgcccttcgctccctccctctggaggagctgccgccgccaccgccgccactctgctgctgccgccgccgccgccgccgctcccgccgccattttgggttcgctttgcggaggggagacgatcccagtctcggttgcgggacccgcctcccctcagtttgccccctttagccttccacctttcccttctcctctctcgcatttccgccagtcagcttacccgctggccgcctcctgacaagcgggagggatccgccgtggacccagggaagcggaggagcctggcggccaccccctcttccccacttccctgcactctcatcgctctcggcctcggcctcggcctccgacacggtgagtagaacgatttgggccggcattcgggcctaagcactctctcagcgattgaatcctgggctttctgggagccactgtcatctcccggacctggatctctgagagagcagtggtgaagatgggggaggggagagcagggagggggatcctgagcctaccgggaagtccctccaggcggggtgaaggggtgtccctgacaggcagactcccggagggggctgggaagtaagcgagtggaggcggagtcggctgtgcccctgacaggttagtttgtgtttgtaggcatgatcggagcctcccccatagtccagtttgtgtgtgtttaattaagggataagagtggtcgaggacacgatcttgagaggggattttacctgtgtgacaaggtctgtggtgtccctgccgcgttgaacggtatgtgggaacgacaggatgatctcagtgttgtaagtttaataaatgtcactggttagtttgtacatggaaagagatgtttttggtctagcagacagatggtctgttggtgtgtagcggctgtgttggtgtgtgtatgtgaggatggcaagtgtttccgtaagagtttgcctttatttgtgtaagtgtaatggagttccccttataagttagcttatttcttgaatccgtgttcaagggtacagctgtttcttatttttgtgcgtacggccagtgaagc

SEQ ID NO: 356489 - DNA, 1001 bp, Homo sapiens
gggggcgctaggcgcccttcgctccctccctctggaggagctgccgccgccaccgccgccactctgctgctgccgccgccgccgccgccgctcccgccgccattttgggttcgctttgcggaggggagacgatcccagtctcggttgcgggacccgcctcccctcagtttgccccctttagccttccacctttcccttctcctctctcgcatttccgccagtcagcttacccgctggccgcctcctgacaagcgggagggatccgccgtggacccagggaagcggaggagcctggcggccaccccctcttccccacttccctgcactctcatcgctctcggccatccgaccaccgaacacagggaagcaaatgcagctgcgcatgcgacacgatcgtgttgtcgaaactagaccagggtctatgccatgttctggcaactcatcaggctcacagtaatcttcctgccgtcaacctcccagaagtgctggaattaccagttccacagatgcagcatgggcattctcccaacatggacagatgcatggcccagaagaggaggagcgtgtggctgagcctcacgctaactttaacacccctcaagctctacggcttcgaggaactactggcccaacctacctaaactgaacaacactcacgatagccgaacggacactcatccgacaccagctgacacgactgaccgaaccccttcagcccacaccacgccagaccgcgcagcgctcgcgcccggtccccccccccagctgctaacgcgccgtcccactcaagcaccgcctgcccttcctcgccacccagcacccccaacgcgaccgcagactccccccacgccacgactgccacgccagcacttgcttccaggcatcctctgaacaccacaacctcccacaacctctctgtgccccaccccctggccacaacccccacacgtctccccacttcgcgcggacgcggccaaagttacaccaccccacggcctccc

SEQ ID NO: 356490 - DNA, 2264 bp, Homo sapiens
agagcccgggaagcgctcgggcgaagaggaggagccaagggtaccgagcgggtggagtcgggagccggagagcggtggaggcggatttcctgggcccggccctctggcgctaccatggcgtttggcaagagtcaccgggatccctacgcgacctccgtgggccacctcatagaaaaggctacatttgctggagttcagactgaagattggggccagttcatgcacatctgtgacataattaacactacccaggatgggccaaaagatgcagtgaaagctttgaagaaaaggatttccaaaaactacaatcataaagaaatccaacttaccttgtcacttattgacatgtgtgtgcagaactgtggtccaagtttccagtctctgattgtgaagaaggaatttgttaaagagaatttagttaagctactgaatcccagatacaacttgccattagacattcagaatagaatcttgaatttcattaagacttggtcacagggcttcccaggaggtgtggatgtaagcgaagtcaaagaagtatacctcgacctggttaagaaaggcgttcagtttcctccctcagaagcagaggctgaaacagcaagacaagagactgctcaaatctcatcaaatcctccaacatctgtccctactgcaccagctctttcttctgtaattgctccaaagaactcgactgttacattggtcccagaacagattggaaaactgcacagtgaattggatatggtgaaaatgaatgtgcgagtgatgtccgccatattgatggagaatactcctgggtctgaaaaccatgaagacatagagcttctgcagaaactctataaaacaggtcgggagatgcaggagaggatcatggacctgcttgtggtggtggagaacgaagatgtaactgttgagctaattcaggtgaatgaggatttgaataatgctatccttggatatgagaggtttactagaaaccaacaaaggattttggagcaaaataagaaccagaaggaagccaccaatactaccagtgagccttctgccccatctcaagatctcctcgacctaagtcccagtccccggatgcctagggccactctgggagaactcaacaccatgaataatcaactttcaggcttaaatttcagccttccaagttctgatgtaacaaacaacttaaaacccagtcttcatccacagatgaacttgctagccttggagaatacagagatacccccgtttgcccaaaggaccagccaaaacctcacctcaagccacgcatatgataattttctggaacattcaaattcagtgtttctacagccagttagtctacaaaccattgcagcagcaccatcaaaccagagtctgccacctttgcccagcaatcatccagcgatgacaaaaagtgatctccagccacctaattactacgaggtaatggagtttgatcccttagctcctgctgtcactacagaagctatttatgaagaaattgatgctcaccagcacaaaggagctcaaaatgatggtgactgagaagaaagtggatgatcagctcactaccacatcaaaggtgccaactctctaaaacgtagactctgtgcagctttgaagcctggaagacaatacctaccaacatgtcaaagccatggtggcacatttctgctataatgaagattaaatagaataacagttccaggataacactgattcctgacaacagcgtgagatttcaacagaacttgtttggaacaaatactcacttaaaacttcagcagaagaaaaattacttagtccttaggccaaccaatttaactgcagtgtcatgtttcacaggccttcctacatttagaaatcgtcacacagctgtgataagagtagattattttactatgaaataattctgaatagatgaaagcataaaatgtgagaaactgaatgtattattcaggaagaatactgagtgccttcatttaactaaagttgaatgtaaaagtcaatttgcacttctttataatcctctggtttagaattataaattgttaaaaccttgataattgtcatttaattatatttcaggtgtcctgaacaggtcactagactctacattgggcagcctttaaatatgattctttgtaatgctaaatagcctttttttctctttttactgcaacttaatatttctatttagaacacagaaaatgaaaatatttagaataagttgtacatttgatgacaaataaatcactattaaa

SEQ ID NO: 356491 - DNA, 1548 bp, Homo sapiens
gacacaccgccgccacacagacgaccccaccaccgcataaattatacttctttatcagcagtagtttgtttccagaagaacttttgatgtcagtaaatcttcacaatcccacctgtacattttaacattcatggacttgtaatggtgatgctttggctaacagcctagtagatgtattttatttcaattttatgatactacagtttcaaagtaattattcagaactctgaatataaaatagccctaaaccttaaaggacaaatcaaatttgaaataagaatttaaatctttggacaagctgttagggcttagtgactcctcttctactttgagcttttaaaatactgactattcataatgaaggaaaatagcaaccaactcttttagacacaataaacatggttagaagttctggcctatgacttgaaacaaataaccctgagcatacatttttgaaaaacattgtcagattcattgctgtaagtatgaagagttaataatctggaagggaattatggaattaagctgaacccatgcctgcatatttaaaaaacaaagcggcttattttaatagtatcaaactcttcagtatggtattgaatagtcagtcatatattctagctaggcatatgagtttcttatgataaaagctgaacttgttctctcaagtttaagtgaaaaaaattagttgagaaaaaataattatttaaaatataagccttcatattattgtacaatatttctcctttgagaagataggatatatgattttcccaaaaatcacaactttgaaggaagacttagttgctgacttcaattatatcctggaactggcaacttgtgcccttcctttgcttcaaaaaaagtgtaagaaagagtgataagatcaactttaatcattcttggatcttcagcaaattcaggatcaatgtagaaaaacactggcatatctacttcctcttggggattaagcctttgttcttcaaaacagaagcactggaaattatagaaagattttaataacatttctattctcgtattacataacagaaactatacagttcttttatcttagcattccagtacacttcgtgattttaataagcatactattaaatacacagttctgtgataaattaagagcatcttttcatctcaatgagttctgctttaaggatgaagaacaaattctaatcttaaaagcagatatccatttggtttggttctcaatctctgcatagcaggtatagatagtgaagaaaaatagcttgatgtttagaagaaattcgttttcagaaatcacaagatctactaaaacactaagtttcatactaaaccgtttcatgtatctttatcatattctgtaaagtttacactttgatgtacctgtattttattgaaatactgtccagcttcaaatggaacaatattgtatgtagaaattccaattactggtttgtcagtaggattcttagctctgtaaaacgccagtgcagtctctcctggcaccacctgttttaaagaatatatatattatcaatactttga

SEQ ID NO: 356492 - DNA, 476 bp, Homo sapiens
tcaggaatcagtgagtatttgtctccacacaagttctgtgtgtcatgctatgcctaggccttcctacatttagaaatcgtcacacagctgtgataagagtagattattttactatgaaataattctgaatagatgaaagcataaaatgtgagaaactgaatgtattattcaggaagaatactgagtgccttcatttaactaaagttgaatgtaaaagtcaatttgcacttctttataatcctctggtttagaattataaattgttaaaaccttgataattgtcatttaattatatttcaggtgtcctgaacaggtcactagactctacattgggcagcctttaaatatgattctttgtaatgctaaatagcctttttttctctttttactgcaacttaatatttctatttagaacacagaaaatgaaaatatttagaataagttgtacatttgatgacaaataaatcactattaaa

SEQ ID NO: 356493 - DNA, 913 bp, Homo sapiens
gtagagctcagtatgtactgtaattttttacttttgtgctaggcagaacaagatgtaaaatcctttgcattctggatcagcttgggattttagaaaatccaatacaataatatttgttacccttacaacaacttcttctcatggcagggaaattctttctctctctacctaccataaatgatgctttttaatttctcttagagctaggaaatctcatgattttagggtgacagaaatatctaaattaatctcttttatttggtgggtttttcttttttttttctttttcttttttctttttttttgtttttactgtagaaaatccagcataactgactgacaaaatgttttaaagccaaacaagtccattttgtgttttagatttcagccttccaagttctgatgtaacaaacaacttaaaacccagtcttcatccacagatgaacttgctagccttggagaatacagagatacccccgtttgcccaaaggaccagccaaaacctcacctcaagccacgcatatgataattttctggaacattcaaattcagtgtttctacagccagttagtctacaaaccattgcagcagcaccatcaaaccagagtctgccacctttgcccagcaatcatccagcgatgacaaaaagtgatctccagccacctaattactacgaggtaatggagtttgatcccttagctcctgctgtcactacagagtatattttccagctacagacatatgtaagacgcatataaagaattgaatgggcctggcatggtggcttatgcctctaatcccaacattttgagaggctgaagtggaaggatcacttgaacctgggaggtcgaagctgcaatgggccatgattgcacccctgcactccagcctgggtgacagtgaccctgtctca

SEQ ID NO: 356494 - DNA, 802 bp, Homo sapiens
tgtttatataactgtgttcgtttttgttgttccgtcccgtcgtccttgtagactctcatcctcgtgtgttttggaccctccaggggtgacatcgggtcttgtgttcagctctcctggactgttattccttgtccgcgtgttcgtgttagacattgtccacgatctgtatcatgcctatgtctcactttggtctcttatttcagcgtgaacactatagttccaagtttgttccgaaattagcaggctggtcaccggtccggaaattcccgggacattttcgcggtacaaatactcacttaaaacttcagcagaagaaaaattacttagtccttaggccaaccaatttaactgcagtgtcatgtttcacaggccttcctacatttagaaatcgtcacacagctgtgataagagtagattattttactatgaaataattctgaatagatgaaagcataaaatgtgagaaactgaatgtattattcaggaagaatactgagtgccttcatttaactaaagttgaatgtaaaagtcaatttgcacttctttataatcctctggtttagaattataaattgttaaaaccttgataattgtcatttaattatatttcaggtgtcctgaacaggtcactagactctacattgggcagcctttaaatatgattctttgtaatgctaaatagcctttttttctctttttactgcaacttaatatttctatttagaacacagaaaatgaaaatatttagaattacgcgacttgtgcatatcctcgcgtcgttgctgttgtgtgtgctctgggc

SEQ ID NO: 356495 - DNA, 571 bp, Homo sapiens
gtagagctcagtatgtactgtaattttttacttttgtgctaggcagaacaagatgtaaaatcctttgcattctggatcagcttgggattttagaaaatccaatacaataatatttgttacccttacaacaacttcttctcatggcagggaaattctttctctctctacctaccataaatgatgctttttaatttctcttagagctaggaaatctcatgattttagggtgacagaaatatctaaattaatctcttttatttggtgggtttttcttttttttttctttttcttttttctttttttttgtttttactgtagaaaatccagcataactgactgacaaaatgttttaaagccaaacaagtccattttgtgttttagatttcagccttccaagttctgatgtaacaaacaacttaaaacccagtcttcatccacagatgaacttgctagccttggagaatacagagatacccccgtttgcccaaaggaccagccaaaacctcacctcaagccacgcatatgataatgtaagtaacaaaactcttttctagcagtgcatctagtcagc

SEQ ID NO: 356496 - DNA, 4910 bp, Homo sapiens
agagcccgggaagcgctcgggcgaagaggaggagccaagggtaccgagcgggtggagtcgggagccggagagcggtggaggcggatttcctgggcccggccctctggcgctaccatggcgtttggcaagagtcaccgggatccctacgcgacctccgtgggccacctcatagaaaaggctacatttgctggagttcagactgaagattggggccagttcatgcacatctgtgacataattaacactacccaggatgggccaaaagatgcagtgaaagctttgaagaaaaggatttccaaaaactacaatcataaagaaatccaacttaccttgtcacttattgacatgtgtgtgcagaactgtggtccaagtttccagtctctgattgtgaagaaggaatttgttaaagagaatttagttaagctactgaatcccagatacaacttgccattagacattcagaatagaatcttgaatttcattaagacttggtcacagggcttcccaggaggtgtggatgtaagcgaagtcaaagaagtatacctcgacctggttaagaaaggcgttcagtttcctccctcagaagcagaggctgaaacagcaagacaagagactgctcaaatctcatcaaatcctccaacatctgtccctactgcaccagctctttcttctgtaattgctccaaagaactcgactgttacattggtcccagaacagattggaaaactgcacagtgaattggatatggtgaaaatgaatgtgcgagtgatgtccgccatattgatggagaatactcctgggtctgaaaaccatgaagacatagagcttctgcagaaactctataaaacaggtcgggagatgcaggagaggatcatggacctgcttgtggtggtggagaacgaagatgtaactgttgagctaattcaggtgaatgaggatttgaataatgctatccttggatatgagaggtttactagaaaccaacaaaggattttggagcaaaataagaaccagaaggaagccaccaatactaccagtgagccttctgccccatctcaagatctcctcgacctaagtcccagtccccggatgcctagggccactctgggagaactcaacaccatgaataatcaactttcaggcttaagtaaataaacactcaggtcttttcagaccagcagaagagcttgatgttaaacagttctccttaattacgtgattaaataccacctaagaaggactgaagtcaggttgaatgtcagagcgctatgttaggagatgtgattacttcccggcaaatggttgagtcaaacccagtatagcaatgggatgtgtctgggcgaggaggtccttgaaactcatcctactcacttagaatctcatggaattcacctggcctgctttgtagaagttgttcagcccaatggccaatacttaaagtctactgtgaacctacacactattatcattgggtttttctgctatacctcagcatcaggtaagggagtatctctgatgcaagcggagaaattcagggattacaaggtatgaactgagtggttgtgaaatgtagaaggaaaaacacaggctttaaagtcagagaagtccaagttgaaatgccagttctgccacctctcagccacctaacttttgagagtctcactttataaaatgggaacaatgattgccttaaagggtggttgtcaaggttaacaaactaatgtttataaaatgcattgtagcaaagcttacaatgcattttataaacatttataaaagagttacctatcttacctgttatcttctgctgtccttattcccagcaagggtttggcaaattacaaaataaggatgatgaaaaatgctgaaatccagttttgtcaaattaaaagcagtttgtttttctcatatgtcatctgctgtttccggagtaaaaatattcagtatcactgaatttgtggttttcttagaactctactcagttctaaaatgttggctacttgtttatgtaggccagtgggatgtgtagagtcagttacattggagagttttcctgagtttttaattgagaattttcagagggggagggaattattccctttggggtatctcacttaagattatggcctggaggccaggcatagtggctcacacctataatcccagcactttgggaggccgagtcaggtggatcacctgaggtcaggagttcgagaccagcctggccaacatggcaaagccctgtctctactaaaaatacaaaaattagccgggagtggtggtgggcgcctataatcccagctactcaggaggctgaggcagaagaatcacttgaactcaggaggtggaggttgtggtgagccgagatcgtgccactgcactccagtctgggtgacaaagtgagactccatctcaaaaaaaaagaaaaaatgaagtgcaacattagaatttaaataaactagaatacacacttcagggcagagacttatttttactcatatgtagcctgaactccaaaaccagctcaatttttaattacagtgctggcagttaaaaaccaaaatagcactttgaaattgatacataacccttttgctgtgatggctttgtttcagagctatttatgaagaaattgatgctcaccagcacaaaggagctcaaaatgatggtgactgagaagaaagtggatgatcagctcactaccacatcaaaggtgccaactctctaaaacgtagactctgtgcagctttgaagcctggaagacaatacctaccaacatgtcaaagccatggtggcacatttctgctataatgaagattaaatagaataacagttccaggataacactgattcctgacaacagcgtgagatttcaacagaacttgtttggaacaaatactcacttaaaacttcagcagaagaaaaattacttagtccttaggccaaccaatttaactgcagtgtcatgtttcacaggccttcctacatttagaaatcgtcacacagctgtgataagagtagattattttactatgaaataattctgaatagatgaaagcataaaatgtgagaaactgaatgtattattcaggaagaatactgagtgccttcatttaactaaagttgaatgtaaaagtcaatttgcacttctttataatcctctggtttagaattataaattgttaaaaccttgataattgtcatttaattatatttcaggtgtcctgaacaggtcactagactctacattgggcagcctttaaatatgattctttgtaatgctaaatagcctttttttctctttttactgcaacttaatatttctatttagaacacagaaaatgaaaatatttagaataagttgtacatttgatgacaaataaatcactattaaaataatttaatactttttttttttaacaaaggtttgtttccagaagaacttttgatgtcagtaaatcttcacaatcccacctgtacattttaacattcatggacttgtaatggtgatgctttggctaacagcctagtagatgtattttatttcaattttatgatactacagtttcaaagtaattattcagaactctgaatataaaatagccctaaaccttaaaggacaaatcaaatttgaaataagaatttaaatctttggacaagctgttagggcttagtgactcctcttctactttgagcttttaaaatactgactattcataatgaaggaaaatagcaaccaactcttttagacacaataaacatggttagaagttctggcctatgacttgaaacaaataaccctgagcatacatttttgaaaaacattgtcagattcattgctgtaagtatgaagagttaataatctggaagggaattatggaattaagctgaacccatgcctgcatatttaaaaaacaaagcggcttattttaatagtatcaaactcttcagtatggtattgaatagtcagtcatatattctagctaggcatatgagtttcttatgataaaagctgaacttgttctctcaagtttaagtgaaaaaaattagttgagaaaaaataattatttaaaatataagccttcatattattgtacaatatttctcctttgagaagataggatatatgattttcccaaaaatcacaactttgaaggaagacttagttgctgacttcaattatatcctggaactggcaacttgtgcccttcctttgcttcaaaaaaagtgtaagaaagagtgataagatcaactttaatcattcttggatcttcagcaaattcaggatcaatgtagaaaaacactggcatatctacttcctcttggggattaagcctttgttcttcaaaacagaagcactggaaattatagaaagattttaataacatttctattctcgtattacataacagaaactatacagttcttttatcttagcattccagtacacttcgtgattttaataagcatactattaaatacacagttctgtgataaattaagagcatcttttcatctcaatgagttctgctttaaggatgaagaacaaattctaatcttaaaagcagatatccatttggtttggttctcaatctctgcatagcaggtatagatagtgaagaaaaatagcttgatgtttagaagaaattcgttttcagaaatcacaagatctactaaaacactaagtttcatactaaaccgtttcatgtatctttatcatattctgtaaagtttacactttgatgtacctgtattttattgaaatactgtccagcttcaaatggaacaatattgtatgtagaaattccaattactggtttgtcagtaggattcttagctctgtaaaacgccagtgcagtctctcctggcaccacctgttttaaagaatatatatattatcaatactttga

SEQ ID NO: 356497 - DNA, 3615 bp, Homo sapiens
agagcccgggaagcgctcgggcgaagaggaggagccaagggtaccgagcgggtggagtcgggagccggagagcggtggaggcggatttcctgggcccggccctctggcgctaccatggcgtttggcaagagtcaccgggatccctacgcgacctccgtgggccacctcatagcttattgacatgtgtgtgcagaactgtggtccaagtttccagtctctgattgtgaagaaggaatttgttaaagagaatttagttaagctactgaatcccagatacaacttgccattagacattcagaatagaatcttgaatttcattaagacttggtcacagggcttcccaggaggtgtggatgtaagcgaagtcaaagaagtatacctcgacctggttaagaaaggcgttcagtttcctccctcagaagcagaggctgaaacagcaagacaagagactgctcaaatctcatcaaatcctccaacatctgtccctactgcaccagctctttcttctgtaattgctccaaagaactcgactgttacattggtcccagaacagattggaaaactgcacagtgaattggatatggtgaaaatgaatgtgcgagtgatgtccgccatattgatggagaatactcctgggtctgaaaaccatgaagacatagagcttctgcagaaactctataaaacaggtcgggagatgcaggagaggatcatggacctgcttgtggtggtggagaacgaagatgtaactgttgagctaattcaggtgaatgaggatttgaataatgctatccttggatatgagaggtttactagaaaccaacaaaggattttggagcaaaataagaaccagaaggaagccaccaatactaccagtgagccttctgccccatctcaagatctcctcgacctaagtcccagtccccggatgcctagggccactctgggagaactcaacaccatgaataatcaactttcaggcttaaatttcagccttccaagttctgatgtaacaaacaacttaaaacccagtcttcatccacagatgaacttgctagccttggagaatacagagatacccccgtttgcccaaaggaccagccaaaacctcacctcaagccacgcatatgataattttctggaacattcaaattcagtgtttctacagccagttagtctacaaaccattgcagcagcaccatcaaaccagagtctgccacctttgcccagcaatcatccagcgatgacaaaaagtgatctccagccacctaattactacgaggtaatggagtttgatcccttagctcctgctgtcactacagaagctatttatgaagaaattgatgctcaccagcacaaaggagctcaaaatgatggtgactgagaagaaagtggatgatcagctcactaccacatcaaaggtgccaactctctaaaacgtagactctgtgcagctttgaagcctggaagacaatacctaccaacatgtcaaagccatggtggcacatttctgctataatgaagattaaatagaataacagttccaggataacactgattcctgacaacagcgtgagatttcaacagaacttgtttggaacaaatactcacttaaaacttcagcagaagaaaaattacttagtccttaggccaaccaatttaactgcagtgtcatgtttcacaggccttcctacatttagaaatcgtcacacagctgtgataagagtagattattttactatgaaataattctgaatagatgaaagcataaaatgtgagaaactgaatgtattattcaggaagaatactgagtgccttcatttaactaaagttgaatgtaaaagtcaatttgcacttctttataatcctctggtttagaattataaattgttaaaaccttgataattgtcatttaattatatttcaggtgtcctgaacaggtcactagactctacattgggcagcctttaaatatgattctttgtaatgctaaatagcctttttttctctttttactgcaacttaatatttctatttagaacacagaaaatgaaaatatttagaataagttgtacatttgatgacaaataaatcactattaaaataatttaatactttttttttttaacaaaggtttgtttccagaagaacttttgatgtcagtaaatcttcacaatcccacctgtacattttaacattcatggacttgtaatggtgatgctttggctaacagcctagtagatgtattttatttcaattttatgatactacagtttcaaagtaattattcagaactctgaatataaaatagccctaaaccttaaaggacaaatcaaatttgaaataagaatttaaatctttggacaagctgttagggcttagtgactcctcttctactttgagcttttaaaatactgactattcataatgaaggaaaatagcaaccaactcttttagacacaataaacatggttagaagttctggcctatgacttgaaacaaataaccctgagcatacatttttgaaaaacattgtcagattcattgctgtaagtatgaagagttaataatctggaagggaattatggaattaagctgaacccatgcctgcatatttaaaaaacaaagcggcttattttaatagtatcaaactcttcagtatggtattgaatagtcagtcatatattctagctaggcatatgagtttcttatgataaaagctgaacttgttctctcaagtttaagtgaaaaaaattagttgagaaaaaataattatttaaaatataagccttcatattattgtacaatatttctcctttgagaagataggatatatgattttcccaaaaatcacaactttgaaggaagacttagttgctgacttcaattatatcctggaactggcaacttgtgcccttcctttgcttcaaaaaaagtgtaagaaagagtgataagatcaactttaatcattcttggatcttcagcaaattcaggatcaatgtagaaaaacactggcatatctacttcctcttggggattaagcctttgttcttcaaaacagaagcactggaaattatagaaagattttaataacatttctattctcgtattacataacagaaactatacagttcttttatcttagcattccagtacacttcgtgattttaataagcatactattaaatacacagttctgtgataaattaagagcatcttttcatctcaatgagttctgctttaaggatgaagaacaaattctaatcttaaaagcagatatccatttggtttggttctcaatctctgcatagcaggtatagatagtgaagaaaaatagcttgatgtttagaagaaattcgttttcagaaatcacaagatctactaaaacactaagtttcatactaaaccgtttcatgtatctttatcatattctgtaaagtttacactttgatgtacctgtattttattgaaatactgtccagcttcaaatggaacaatattgtatgtagaaattccaattactggtttgtcagtaggattcttagctctgtaaaacgccagtgcagtctctcctggcaccacctgttttaaagaatatatatattatcaatactttga

SEQ ID NO: 356498 - DNA, 3655 bp, Homo sapiens
aaaaatgtaccttcctttcgatgccgcctggggagtggaaccaaacagaaaaggctacatttgctggagttcagactgaagattggggccagttcatgcacatctgtgacataattaacactacccaggatgggccaaaagatgcagtgaaagctttgaagaaaaggatttccaaaaactacaatcataaagaaatccaacttaccttgtcacttattgacatgtgtgtgcagaactgtggtccaagtttccagtctctgattgtgaagaaggaatttgttaaagagaatttagttaagctactgaatcccagatacaacttgccattagacattcagaatagaatcttgaatttcattaagacttggtcacagggcttcccaggaggtgtggatgtaagcgaagtcaaagaagtatacctcgacctggttaagaaaggcgttcagtttcctccctcagaagcagaggctgaaacagcaagacaagagactgctcaaatctcatcaaatcctccaacatctgtccctactgcaccagctctttcttctgtaattgctccaaagaactcgactgttacattggtcccagaacagattggaaaactgcacagtgaattggatatggtgaaaatgaatgtgcgagtgatgtccgccatattgatggagaatactcctgggtctgaaaaccatgaagacatagagcttctgcagaaactctataaaacaggtcgggagatgcaggagaggatcatggacctgcttgtggtggtggagaacgaagatgtaactgttgagctaattcaggtgaatgaggatttgaataatgctatccttggatatgagaggtttactagaaaccaacaaaggattttggagcaaaataagaaccagaaggaagccaccaatactaccagtgagccttctgccccatctcaagatctcctcgacctaagtcccagtccccggatgcctagggccactctgggagaactcaacaccatgaataatcaactttcaggcttaaatttcagccttccaagttctgatgtaacaaacaacttaaaacccagtcttcatccacagatgaacttgctagccttggagaatacagagatacccccgtttgcccaaaggaccagccaaaacctcacctcaagccacgcatatgataattttctggaacattcaaattcagtgtttctacagccagttagtctacaaaccattgcagcagcaccatcaaaccagagtctgccacctttgcccagcaatcatccagcgatgacaaaaagtgatctccagccacctaattactacgaggtaatggagtttgatcccttagctcctgctgtcactacagaagctatttatgaagaaattgatgctcaccagcacaaaggagctcaaaatgatggtgactgagaagaaagtggatgatcagctcactaccacatcaaaggtgccaactctctaaaacgtagactctgtgcagctttgaagcctggaagacaatacctaccaacatgtcaaagccatggtggcacatttctgctataatgaagattaaatagaataacagttccaggataacactgattcctgacaacagcgtgagatttcaacagaacttgtttggaacaaatactcacttaaaacttcagcagaagaaaaattacttagtccttaggccaaccaatttaactgcagtgtcatgtttcacaggccttcctacatttagaaatcgtcacacagctgtgataagagtagattattttactatgaaataattctgaatagatgaaagcataaaatgtgagaaactgaatgtattattcaggaagaatactgagtgccttcatttaactaaagttgaatgtaaaagtcaatttgcacttctttataatcctctggtttagaattataaattgttaaaaccttgataattgtcatttaattatatttcaggtgtcctgaacaggtcactagactctacattgggcagcctttaaatatgattctttgtaatgctaaatagcctttttttctctttttactgcaacttaatatttctatttagaacacagaaaatgaaaatatttagaataagttgtacatttgatgacaaataaatcactattaaaataatttaatactttttttttttaacaaaggtttgtttccagaagaacttttgatgtcagtaaatcttcacaatcccacctgtacattttaacattcatggacttgtaatggtgatgctttggctaacagcctagtagatgtattttatttcaattttatgatactacagtttcaaagtaattattcagaactctgaatataaaatagccctaaaccttaaaggacaaatcaaatttgaaataagaatttaaatctttggacaagctgttagggcttagtgactcctcttctactttgagcttttaaaatactgactattcataatgaaggaaaatagcaaccaactcttttagacacaataaacatggttagaagttctggcctatgacttgaaacaaataaccctgagcatacatttttgaaaaacattgtcagattcattgctgtaagtatgaagagttaataatctggaagggaattatggaattaagctgaacccatgcctgcatatttaaaaaacaaagcggcttattttaatagtatcaaactcttcagtatggtattgaatagtcagtcatatattctagctaggcatatgagtttcttatgataaaagctgaacttgttctctcaagtttaagtgaaaaaaattagttgagaaaaaataattatttaaaatataagccttcatattattgtacaatatttctcctttgagaagataggatatatgattttcccaaaaatcacaactttgaaggaagacttagttgctgacttcaattatatcctggaactggcaacttgtgcccttcctttgcttcaaaaaaagtgtaagaaagagtgataagatcaactttaatcattcttggatcttcagcaaattcaggatcaatgtagaaaaacactggcatatctacttcctcttggggattaagcctttgttcttcaaaacagaagcactggaaattatagaaagattttaataacatttctattctcgtattacataacagaaactatacagttcttttatcttagcattccagtacacttcgtgattttaataagcatactattaaatacacagttctgtgataaattaagagcatcttttcatctcaatgagttctgctttaaggatgaagaacaaattctaatcttaaaagcagatatccatttggtttggttctcaatctctgcatagcaggtatagatagtgaagaaaaatagcttgatgtttagaagaaattcgttttcagaaatcacaagatctactaaaacactaagtttcatactaaaccgtttcatgtatctttatcatattctgtaaagtttacactttgatgtacctgtattttattgaaatactgtccagcttcaaatggaacaatattgtatgtagaaattccaattactggtttgtcagtaggattcttagctctgtaaaacgccagtgcagtctctcctggcaccacctgttttaaagaatatatatattatcaatactttga

SEQ ID NO: 356499 - DNA, 3728 bp, Homo sapiens
agagcccgggaagcgctcgggcgaagaggaggagccaagggtaccgagcgggtggagtcgggagccggagagcggtggaggcggatttcctgggcccggccctctggcgctaccatggcgtttggcaagagtcaccgggatccctacgcgacctccgtgggccacctcatagaaaaggctacatttgctggagttcagactgaagattggggccagttcatgcacatctgtgacataattaacactacccaggatgggccaaaagatgcagtgaaagctttgaagcttattgacatgtgtgtgcagaactgtggtccaagtttccagtctctgattgtgaagaaggaatttgttaaagagaatttagttaagctactgaatcccagatacaacttgccattagacattcagaatagaatcttgaatttcattaagacttggtcacagggcttcccaggaggtgtggatgtaagcgaagtcaaagaagtatacctcgacctggttaagaaaggcgttcagtttcctccctcagaagcagaggctgaaacagcaagacaagagactgctcaaatctcatcaaatcctccaacatctgtccctactgcaccagctctttcttctgtaattgctccaaagaactcgactgttacattggtcccagaacagattggaaaactgcacagtgaattggatatggtgaaaatgaatgtgcgagtgatgtccgccatattgatggagaatactcctgggtctgaaaaccatgaagacatagagcttctgcagaaactctataaaacaggtcgggagatgcaggagaggatcatggacctgcttgtggtggtggagaacgaagatgtaactgttgagctaattcaggtgaatgaggatttgaataatgctatccttggatatgagaggtttactagaaaccaacaaaggattttggagcaaaataagaaccagaaggaagccaccaatactaccagtgagccttctgccccatctcaagatctcctcgacctaagtcccagtccccggatgcctagggccactctgggagaactcaacaccatgaataatcaactttcaggcttaaatttcagccttccaagttctgatgtaacaaacaacttaaaacccagtcttcatccacagatgaacttgctagccttggagaatacagagatacccccgtttgcccaaaggaccagccaaaacctcacctcaagccacgcatatgataattttctggaacattcaaattcagtgtttctacagccagttagtctacaaaccattgcagcagcaccatcaaaccagagtctgccacctttgcccagcaatcatccagcgatgacaaaaagtgatctccagccacctaattactacgaggtaatggagtttgatcccttagctcctgctgtcactacagaagctatttatgaagaaattgatgctcaccagcacaaaggagctcaaaatgatggtgactgagaagaaagtggatgatcagctcactaccacatcaaaggtgccaactctctaaaacgtagactctgtgcagctttgaagcctggaagacaatacctaccaacatgtcaaagccatggtggcacatttctgctataatgaagattaaatagaataacagttccaggataacactgattcctgacaacagcgtgagatttcaacagaacttgtttggaacaaatactcacttaaaacttcagcagaagaaaaattacttagtccttaggccaaccaatttaactgcagtgtcatgtttcacaggccttcctacatttagaaatcgtcacacagctgtgataagagtagattattttactatgaaataattctgaatagatgaaagcataaaatgtgagaaactgaatgtattattcaggaagaatactgagtgccttcatttaactaaagttgaatgtaaaagtcaatttgcacttctttataatcctctggtttagaattataaattgttaaaaccttgataattgtcatttaattatatttcaggtgtcctgaacaggtcactagactctacattgggcagcctttaaatatgattctttgtaatgctaaatagcctttttttctctttttactgcaacttaatatttctatttagaacacagaaaatgaaaatatttagaataagttgtacatttgatgacaaataaatcactattaaaataatttaatactttttttttttaacaaaggtttgtttccagaagaacttttgatgtcagtaaatcttcacaatcccacctgtacattttaacattcatggacttgtaatggtgatgctttggctaacagcctagtagatgtattttatttcaattttatgatactacagtttcaaagtaattattcagaactctgaatataaaatagccctaaaccttaaaggacaaatcaaatttgaaataagaatttaaatctttggacaagctgttagggcttagtgactcctcttctactttgagcttttaaaatactgactattcataatgaaggaaaatagcaaccaactcttttagacacaataaacatggttagaagttctggcctatgacttgaaacaaataaccctgagcatacatttttgaaaaacattgtcagattcattgctgtaagtatgaagagttaataatctggaagggaattatggaattaagctgaacccatgcctgcatatttaaaaaacaaagcggcttattttaatagtatcaaactcttcagtatggtattgaatagtcagtcatatattctagctaggcatatgagtttcttatgataaaagctgaacttgttctctcaagtttaagtgaaaaaaattagttgagaaaaaataattatttaaaatataagccttcatattattgtacaatatttctcctttgagaagataggatatatgattttcccaaaaatcacaactttgaaggaagacttagttgctgacttcaattatatcctggaactggcaacttgtgcccttcctttgcttcaaaaaaagtgtaagaaagagtgataagatcaactttaatcattcttggatcttcagcaaattcaggatcaatgtagaaaaacactggcatatctacttcctcttggggattaagcctttgttcttcaaaacagaagcactggaaattatagaaagattttaataacatttctattctcgtattacataacagaaactatacagttcttttatcttagcattccagtacacttcgtgattttaataagcatactattaaatacacagttctgtgataaattaagagcatcttttcatctcaatgagttctgctttaaggatgaagaacaaattctaatcttaaaagcagatatccatttggtttggttctcaatctctgcatagcaggtatagatagtgaagaaaaatagcttgatgtttagaagaaattcgttttcagaaatcacaagatctactaaaacactaagtttcatactaaaccgtttcatgtatctttatcatattctgtaaagtttacactttgatgtacctgtattttattgaaatactgtccagcttcaaatggaacaatattgtatgtagaaattccaattactggtttgtcagtaggattcttagctctgtaaaacgccagtgcagtctctcctggcaccacctgttttaaagaatatatatattatcaatactttga

SEQ ID NO: 356500 - DNA, 3629 bp, Homo sapiens
agagcccgggaagcgctcgggcgaagaggaggagccaagggtaccgagcgggtggagtcgggagccggagagcggtggaggcggatttcctgggcccggccctctggcgctaccatggcgtttggcaagagtcaccgggatccctacgcgacctccgtgggccacctcatagaaaaggctacatttgctggagttcagactgaagattggggccagttcatgcacatctgtgacataattaacactacccaggatgggccaaaagatgcagtgaaagctttgaagaaaaggatttccaaaaactacaatcataaagaaatccaacttaccttgtcaacttggtcacagggcttcccaggaggtgtggatgtaagcgaagtcaaagaagtatacctcgacctggttaagaaaggcgttcagtttcctccctcagaagcagaggctgaaacagcaagacaagagactgctcaaatctcatcaaatcctccaacatctgtccctactgcaccagctctttcttctgtaattgctccaaagaactcgactgttacattggtcccagaacagattggaaaactgcacagtgaattggatatggtgaaaatgaatgtgcgagtgatgtccgccatattgatggagaatactcctgggtctgaaaaccatgaagacatagagcttctgcagaaactctataaaacaggtcgggagatgcaggagaggatcatggacctgcttgtggtggtggagaacgaagatgtaactgttgagctaattcaggtgaatgaggatttgaataatgctatccttggatatgagaggtttactagaaaccaacaaaggattttggagcaaaataagaaccagaaggaagccaccaatactaccagtgagccttctgccccatctcaagatctcctcgacctaagtcccagtccccggatgcctagggccactctgggagaactcaacaccatgaataatcaactttcaggcttaaatttcagccttccaagttctgatgtaacaaacaacttaaaacccagtcttcatccacagatgaacttgctagccttggagaatacagagatacccccgtttgcccaaaggaccagccaaaacctcacctcaagccacgcatatgataattttctggaacattcaaattcagtgtttctacagccagttagtctacaaaccattgcagcagcaccatcaaaccagagtctgccacctttgcccagcaatcatccagcgatgacaaaaagtgatctccagccacctaattactacgaggtaatggagtttgatcccttagctcctgctgtcactacagaagctatttatgaagaaattgatgctcaccagcacaaaggagctcaaaatgatggtgactgagaagaaagtggatgatcagctcactaccacatcaaaggtgccaactctctaaaacgtagactctgtgcagctttgaagcctggaagacaatacctaccaacatgtcaaagccatggtggcacatttctgctataatgaagattaaatagaataacagttccaggataacactgattcctgacaacagcgtgagatttcaacagaacttgtttggaacaaatactcacttaaaacttcagcagaagaaaaattacttagtccttaggccaaccaatttaactgcagtgtcatgtttcacaggccttcctacatttagaaatcgtcacacagctgtgataagagtagattattttactatgaaataattctgaatagatgaaagcataaaatgtgagaaactgaatgtattattcaggaagaatactgagtgccttcatttaactaaagttgaatgtaaaagtcaatttgcacttctttataatcctctggtttagaattataaattgttaaaaccttgataattgtcatttaattatatttcaggtgtcctgaacaggtcactagactctacattgggcagcctttaaatatgattctttgtaatgctaaatagcctttttttctctttttactgcaacttaatatttctatttagaacacagaaaatgaaaatatttagaataagttgtacatttgatgacaaataaatcactattaaaataatttaatactttttttttttaacaaaggtttgtttccagaagaacttttgatgtcagtaaatcttcacaatcccacctgtacattttaacattcatggacttgtaatggtgatgctttggctaacagcctagtagatgtattttatttcaattttatgatactacagtttcaaagtaattattcagaactctgaatataaaatagccctaaaccttaaaggacaaatcaaatttgaaataagaatttaaatctttggacaagctgttagggcttagtgactcctcttctactttgagcttttaaaatactgactattcataatgaaggaaaatagcaaccaactcttttagacacaataaacatggttagaagttctggcctatgacttgaaacaaataaccctgagcatacatttttgaaaaacattgtcagattcattgctgtaagtatgaagagttaataatctggaagggaattatggaattaagctgaacccatgcctgcatatttaaaaaacaaagcggcttattttaatagtatcaaactcttcagtatggtattgaatagtcagtcatatattctagctaggcatatgagtttcttatgataaaagctgaacttgttctctcaagtttaagtgaaaaaaattagttgagaaaaaataattatttaaaatataagccttcatattattgtacaatatttctcctttgagaagataggatatatgattttcccaaaaatcacaactttgaaggaagacttagttgctgacttcaattatatcctggaactggcaacttgtgcccttcctttgcttcaaaaaaagtgtaagaaagagtgataagatcaactttaatcattcttggatcttcagcaaattcaggatcaatgtagaaaaacactggcatatctacttcctcttggggattaagcctttgttcttcaaaacagaagcactggaaattatagaaagattttaataacatttctattctcgtattacataacagaaactatacagttcttttatcttagcattccagtacacttcgtgattttaataagcatactattaaatacacagttctgtgataaattaagagcatcttttcatctcaatgagttctgctttaaggatgaagaacaaattctaatcttaaaagcagatatccatttggtttggttctcaatctctgcatagcaggtatagatagtgaagaaaaatagcttgatgtttagaagaaattcgttttcagaaatcacaagatctactaaaacactaagtttcatactaaaccgtttcatgtatctttatcatattctgtaaagtttacactttgatgtacctgtattttattgaaatactgtccagcttcaaatggaacaatattgtatgtagaaattccaattactggtttgtcagtaggattcttagctctgtaaaacgccagtgcagtctctcctggcaccacctgttttaaagaatatatatattatcaatactttga

SEQ ID NO: 356501 - DNA, 3674 bp, Homo sapiens
agagcccgggaagcgctcgggcgaagaggaggagccaagggtaccgagcgggtggagtcgggagccggagagcggtggaggcggatttcctgggcccggccctctggcgctaccatggcgtttggcaagagtcaccgggatccctacgcgacctccgtgggccacctcatagaaaaggctacatttgctggagttcagactgaagattggggccagttcatgcacatctgtgacataattaacactacccaggatgggccaaaagatgcagtgaaagctttgaagaaaaggatttccaaaaactacaatcataaagaaatccaacttaccttgtcacttattgacatgtgtgtgcagaactgtggtccaagtttccagtctctgattgtgaagaaggaatttgttaaagagaatttagttaagctactgaatcccagatacaacttgccattagacattcagaatagaatcttgaatttcattaagacttggtcacagggcttcccaggaggtgtggatgtaagcgaagtcaaagaagtatacctcgacctggttaagaaaggcgttcagtttcctccctcagaagcagaggctgaaacagcaagacaagagattggaaaactgcacagtgaattggatatggtgaaaatgaatgtgcgagtgatgtccgccatattgatggagaatactcctgggtctgaaaaccatgaagacatagagcttctgcagaaactctataaaacaggtcgggagatgcaggagaggatcatggacctgcttgtggtggtggagaacgaagatgtaactgttgagctaattcaggtgaatgaggatttgaataatgctatccttggatatgagaggtttactagaaaccaacaaaggattttggagcaaaataagaaccagaaggaagccaccaatactaccagtgagccttctgccccatctcaagatctcctcgacctaagtcccagtccccggatgcctagggccactctgggagaactcaacaccatgaataatcaactttcaggcttaaatttcagccttccaagttctgatgtaacaaacaacttaaaacccagtcttcatccacagatgaacttgctagccttggagaatacagagatacccccgtttgcccaaaggaccagccaaaacctcacctcaagccacgcatatgataattttctggaacattcaaattcagtgtttctacagccagttagtctacaaaccattgcagcagcaccatcaaaccagagtctgccacctttgcccagcaatcatccagcgatgacaaaaagtgatctccagccacctaattactacgaggtaatggagtttgatcccttagctcctgctgtcactacagaagctatttatgaagaaattgatgctcaccagcacaaaggagctcaaaatgatggtgactgagaagaaagtggatgatcagctcactaccacatcaaaggtgccaactctctaaaacgtagactctgtgcagctttgaagcctggaagacaatacctaccaacatgtcaaagccatggtggcacatttctgctataatgaagattaaatagaataacagttccaggataacactgattcctgacaacagcgtgagatttcaacagaacttgtttggaacaaatactcacttaaaacttcagcagaagaaaaattacttagtccttaggccaaccaatttaactgcagtgtcatgtttcacaggccttcctacatttagaaatcgtcacacagctgtgataagagtagattattttactatgaaataattctgaatagatgaaagcataaaatgtgagaaactgaatgtattattcaggaagaatactgagtgccttcatttaactaaagttgaatgtaaaagtcaatttgcacttctttataatcctctggtttagaattataaattgttaaaaccttgataattgtcatttaattatatttcaggtgtcctgaacaggtcactagactctacattgggcagcctttaaatatgattctttgtaatgctaaatagcctttttttctctttttactgcaacttaatatttctatttagaacacagaaaatgaaaatatttagaataagttgtacatttgatgacaaataaatcactattaaaataatttaatactttttttttttaacaaaggtttgtttccagaagaacttttgatgtcagtaaatcttcacaatcccacctgtacattttaacattcatggacttgtaatggtgatgctttggctaacagcctagtagatgtattttatttcaattttatgatactacagtttcaaagtaattattcagaactctgaatataaaatagccctaaaccttaaaggacaaatcaaatttgaaataagaatttaaatctttggacaagctgttagggcttagtgactcctcttctactttgagcttttaaaatactgactattcataatgaaggaaaatagcaaccaactcttttagacacaataaacatggttagaagttctggcctatgacttgaaacaaataaccctgagcatacatttttgaaaaacattgtcagattcattgctgtaagtatgaagagttaataatctggaagggaattatggaattaagctgaacccatgcctgcatatttaaaaaacaaagcggcttattttaatagtatcaaactcttcagtatggtattgaatagtcagtcatatattctagctaggcatatgagtttcttatgataaaagctgaacttgttctctcaagtttaagtgaaaaaaattagttgagaaaaaataattatttaaaatataagccttcatattattgtacaatatttctcctttgagaagataggatatatgattttcccaaaaatcacaactttgaaggaagacttagttgctgacttcaattatatcctggaactggcaacttgtgcccttcctttgcttcaaaaaaagtgtaagaaagagtgataagatcaactttaatcattcttggatcttcagcaaattcaggatcaatgtagaaaaacactggcatatctacttcctcttggggattaagcctttgttcttcaaaacagaagcactggaaattatagaaagattttaataacatttctattctcgtattacataacagaaactatacagttcttttatcttagcattccagtacacttcgtgattttaataagcatactattaaatacacagttctgtgataaattaagagcatcttttcatctcaatgagttctgctttaaggatgaagaacaaattctaatcttaaaagcagatatccatttggtttggttctcaatctctgcatagcaggtatagatagtgaagaaaaatagcttgatgtttagaagaaattcgttttcagaaatcacaagatctactaaaacactaagtttcatactaaaccgtttcatgtatctttatcatattctgtaaagtttacactttgatgtacctgtattttattgaaatactgtccagcttcaaatggaacaatattgtatgtagaaattccaattactggtttgtcagtaggattcttagctctgtaaaacgccagtgcagtctctcctggcaccacctgttttaaagaatatatatattatcaatactttga

SEQ ID NO: 356502 - DNA, 4470 bp, Homo sapiens
agagcccgggaagcgctcgggcgaagaggaggagccaagggtaccgagcgggtggagtcgggagccggagagcggtggaggcggatttcctgggcccggccctctggcgctaccatggcgtttggcaagagtcaccgggatccctacgcgacctccgtgggccacctcatagaaaaggctacatttgctggagttcagactgaagattggggccagttcatgcacatctgtgacataattaacactacccaggatgggccaaaagatgcagtgaaagctttgaagaaaaggatttccaaaaactacaatcataaagaaatccaacttaccttgtcacttattgacatgtgtgtgcagaactgtggtccaagtttccagtctctgattgtgaagaaggaatttgttaaagagaatttagttaagctactgaatcccagatacaacttgccattagacattcagaatagaatcttgaatttcattaagacttggtcacagggcttcccaggaggtgtggatgtaagcgaagtcaaagaagtatacctcgacctggttaagaaaggcgttcagtttcctccctcagaagcagaggctgaaacagcaagacaagagatctcaagatctcctcgacctaagtcccagtccccggatgcctagggccactctgggagaactcaacaccatgaataatcaactttcaggcttaagtaaataaacactcaggtcttttcagaccagcagaagagcttgatgttaaacagttctccttaattacgtgattaaataccacctaagaaggactgaagtcaggttgaatgtcagagcgctatgttaggagatgtgattacttcccggcaaatggttgagtcaaacccagtatagcaatgggatgtgtctgggcgaggaggtccttgaaactcatcctactcacttagaatctcatggaattcacctggcctgctttgtagaagttgttcagcccaatggccaatacttaaagtctactgtgaacctacacactattatcattgggtttttctgctatacctcagcatcaggtaagggagtatctctgatgcaagcggagaaattcagggattacaaggtatgaactgagtggttgtgaaatgtagaaggaaaaacacaggctttaaagtcagagaagtccaagttgaaatgccagttctgccacctctcagccacctaacttttgagagtctcactttataaaatgggaacaatgattgccttaaagggtggttgtcaaggttaacaaactaatgtttataaaatgcattgtagcaaagcttacaatgcattttataaacatttataaaagagttacctatcttacctgttatcttctgctgtccttattcccagcaagggtttggcaaattacaaaataaggatgatgaaaaatgctgaaatccagttttgtcaaattaaaagcagtttgtttttctcatatgtcatctgctgtttccggagtaaaaatattcagtatcactgaatttgtggttttcttagaactctactcagttctaaaatgttggctacttgtttatgtaggccagtgggatgtgtagagtcagttacattggagagttttcctgagtttttaattgagaattttcagagggggagggaattattccctttggggtatctcacttaagattatggcctggaggccaggcatagtggctcacacctataatcccagcactttgggaggccgagtcaggtggatcacctgaggtcaggagttcgagaccagcctggccaacatggcaaagccctgtctctactaaaaatacaaaaattagccgggagtggtggtgggcgcctataatcccagctactcaggaggctgaggcagaagaatcacttgaactcaggaggtggaggttgtggtgagccgagatcgtgccactgcactccagtctgggtgacaaagtgagactccatctcaaaaaaaaagaaaaaatgaagtgcaacattagaatttaaataaactagaatacacacttcagggcagagacttatttttactcatatgtagcctgaactccaaaaccagctcaatttttaattacagtgctggcagttaaaaaccaaaatagcactttgaaattgatacataacccttttgctgtgatggctttgtttcagagctatttatgaagaaattgatgctcaccagcacaaaggagctcaaaatgatggtgactgagaagaaagtggatgatcagctcactaccacatcaaaggtgccaactctctaaaacgtagactctgtgcagctttgaagcctggaagacaatacctaccaacatgtcaaagccatggtggcacatttctgctataatgaagattaaatagaataacagttccaggataacactgattcctgacaacagcgtgagatttcaacagaacttgtttggaacaaatactcacttaaaacttcagcagaagaaaaattacttagtccttaggccaaccaatttaactgcagtgtcatgtttcacaggccttcctacatttagaaatcgtcacacagctgtgataagagtagattattttactatgaaataattctgaatagatgaaagcataaaatgtgagaaactgaatgtattattcaggaagaatactgagtgccttcatttaactaaagttgaatgtaaaagtcaatttgcacttctttataatcctctggtttagaattataaattgttaaaaccttgataattgtcatttaattatatttcaggtgtcctgaacaggtcactagactctacattgggcagcctttaaatatgattctttgtaatgctaaatagcctttttttctctttttactgcaacttaatatttctatttagaacacagaaaatgaaaatatttagaataagttgtacatttgatgacaaataaatcactattaaaataatttaatactttttttttttaacaaaggtttgtttccagaagaacttttgatgtcagtaaatcttcacaatcccacctgtacattttaacattcatggacttgtaatggtgatgctttggctaacagcctagtagatgtattttatttcaattttatgatactacagtttcaaagtaattattcagaactctgaatataaaatagccctaaaccttaaaggacaaatcaaatttgaaataagaatttaaatctttggacaagctgttagggcttagtgactcctcttctactttgagcttttaaaatactgactattcataatgaaggaaaatagcaaccaactcttttagacacaataaacatggttagaagttctggcctatgacttgaaacaaataaccctgagcatacatttttgaaaaacattgtcagattcattgctgtaagtatgaagagttaataatctggaagggaattatggaattaagctgaacccatgcctgcatatttaaaaaacaaagcggcttattttaatagtatcaaactcttcagtatggtattgaatagtcagtcatatattctagctaggcatatgagtttcttatgataaaagctgaacttgttctctcaagtttaagtgaaaaaaattagttgagaaaaaataattatttaaaatataagccttcatattattgtacaatatttctcctttgagaagataggatatatgattttcccaaaaatcacaactttgaaggaagacttagttgctgacttcaattatatcctggaactggcaacttgtgcccttcctttgcttcaaaaaaagtgtaagaaagagtgataagatcaactttaatcattcttggatcttcagcaaattcaggatcaatgtagaaaaacactggcatatctacttcctcttggggattaagcctttgttcttcaaaacagaagcactggaaattatagaaagattttaataacatttctattctcgtattacataacagaaactatacagttcttttatcttagcattccagtacacttcgtgattttaataagcatactattaaatacacagttctgtgataaattaagagcatcttttcatctcaatgagttctgctttaaggatgaagaacaaattctaatcttaaaagcagatatccatttggtttggttctcaatctctgcatagcaggtatagatagtgaagaaaaatagcttgatgtttagaagaaattcgttttcagaaatcacaagatctactaaaacactaagtttcatactaaaccgtttcatgtatctttatcatattctgtaaagtttacactttgatgtacctgtattttattgaaatactgtccagcttcaaatggaacaatattgtatgtagaaattccaattactggtttgtcagtaggattcttagctctgtaaaacgccagtgcagtctctcctggcaccacctgttttaaagaatatatatattatcaatactttga

SEQ ID NO: 356503 - DNA, 3013 bp, Homo sapiens
gtagagctcagtatgtactgtaattttttacttttgtgctaggcagaacaagatgtaaaatcctttgcattctggatcagcttgggattttagaaaatccaatacaataatatttgttacccttacaacaacttcttctcatggcagggaaattctttctctctctacctaccataaatgatgctttttaatttctcttagagctaggaaatctcatgattttagggtgacagaaatatctaaattaatctcttttatttggtgggtttttcttttttttttctttttcttttttctttttttttgtttttactgtagaaaatccagcataactgactgacaaaatgttttaaagccaaacaagtccattttgtgttttagatttcagccttccaagttctgatgtaacaaacaacttaaaacccagtcttcatccacagatgaacttgctagccttggagaatacagagatacccccgtttgcccaaaggaccagccaaaacctcacctcaagccacgcatatgataattttctggaacattcaaattcagtgtttctacagccagttagtctacaaaccattgcagcagcaccatcaaaccagagtctgccacctttgcccagcaatcatccagcgatgacaaaaagtgatctccagccacctaattactacgaggtaatggagtttgatcccttagctcctgctgtcactacagaagctatttatgaagaaattgatgctcaccagcacaaaggagctcaaaatgatggtgactgagaagaaagtggatgatcagctcactaccacatcaaaggtgccaactctctaaaacgtagactctgtgcagctttgaagcctggaagacaatacctaccaacatgtcaaagccatggtggcacatttctgctataatgaagattaaatagaataacagttccaggataacactgattcctgacaacagcgtgagatttcaacagaacttgtttggaacaaatactcacttaaaacttcagcagaagaaaaattacttagtccttaggccaaccaatttaactgcagtgtcatgtttcacaggccttcctacatttagaaatcgtcacacagctgtgataagagtagattattttactatgaaataattctgaatagatgaaagcataaaatgtgagaaactgaatgtattattcaggaagaatactgagtgccttcatttaactaaagttgaatgtaaaagtcaatttgcacttctttataatcctctggtttagaattataaattgttaaaaccttgataattgtcatttaattatatttcaggtgtcctgaacaggtcactagactctacattgggcagcctttaaatatgattctttgtaatgctaaatagcctttttttctctttttactgcaacttaatatttctatttagaacacagaaaatgaaaatatttagaataagttgtacatttgatgacaaataaatcactattaaaataatttaatactttttttttttaacaaaggtttgtttccagaagaacttttgatgtcagtaaatcttcacaatcccacctgtacattttaacattcatggacttgtaatggtgatgctttggctaacagcctagtagatgtattttatttcaattttatgatactacagtttcaaagtaattattcagaactctgaatataaaatagccctaaaccttaaaggacaaatcaaatttgaaataagaatttaaatctttggacaagctgttagggcttagtgactcctcttctactttgagcttttaaaatactgactattcataatgaaggaaaatagcaaccaactcttttagacacaataaacatggttagaagttctggcctatgacttgaaacaaataaccctgagcatacatttttgaaaaacattgtcagattcattgctgtaagtatgaagagttaataatctggaagggaattatggaattaagctgaacccatgcctgcatatttaaaaaacaaagcggcttattttaatagtatcaaactcttcagtatggtattgaatagtcagtcatatattctagctaggcatatgagtttcttatgataaaagctgaacttgttctctcaagtttaagtgaaaaaaattagttgagaaaaaataattatttaaaatataagccttcatattattgtacaatatttctcctttgagaagataggatatatgattttcccaaaaatcacaactttgaaggaagacttagttgctgacttcaattatatcctggaactggcaacttgtgcccttcctttgcttcaaaaaaagtgtaagaaagagtgataagatcaactttaatcattcttggatcttcagcaaattcaggatcaatgtagaaaaacactggcatatctacttcctcttggggattaagcctttgttcttcaaaacagaagcactggaaattatagaaagattttaataacatttctattctcgtattacataacagaaactatacagttcttttatcttagcattccagtacacttcgtgattttaataagcatactattaaatacacagttctgtgataaattaagagcatcttttcatctcaatgagttctgctttaaggatgaagaacaaattctaatcttaaaagcagatatccatttggtttggttctcaatctctgcatagcaggtatagatagtgaagaaaaatagcttgatgtttagaagaaattcgttttcagaaatcacaagatctactaaaacactaagtttcatactaaaccgtttcatgtatctttatcatattctgtaaagtttacactttgatgtacctgtattttattgaaatactgtccagcttcaaatggaacaatattgtatgtagaaattccaattactggtttgtcagtaggattcttagctctgtaaaacgccagtgcagtctctcctggcaccacctgttttaaagaatatatatattatcaatactttga

SEQ ID NO: 356504 - DNA, 2835 bp, Homo sapiens
agagcccgggaagcgctcgggcgaagaggaggagccaagggtaccgagcgggtggagtcgggagccggagagcggtggaggcggatttcctgggcccggccctctggcgctaccatggcgtttggcaagagtcaccgggatccctacgcgacctccgtgggccacctcatagaaaaggctacatttgctggagttcagactgaagattggggccagttcatgcacatctgtgacataattaacactacccaggatgggccaaaagatgcagtgaaagctttgaagaaaaggatttccaaaaactacaatcataaagaaatccaacttaccttgtcacttattgacatgtgtgtgcagaactgtggtccaagtttccagtctctgattgtgaagaaggaatttgttaaagagaatttagttaagctactgaatcccagatacaacttgccattagacattcagaatagaatcttgaatttcattaagacttggtcacagggcttcccaggaggtgtggatgtaagcgaagtcaaagaagtatacctcgacctggttaagaaaggcgttcagtttcctccctcagaagcagaggctgaaacagcaagacaagagactgctcaaatctcatcaaatcctccaacatctgtccctactgcaccagctctttcttctgtaattgctccaaagaactcgactgttacattggtcccagaacagattggaaaactgcacagtgaattggatatggtgaaaatgaatgtgcgagtgatgtccgccatattgatggagaatactcctgggtctgaaaaccatgaagacatagagcttctgcagaaactctataaaacaggtcgggagatgcaggagaggatcatggacctgcttgtggtggtggagaacgaagatgtaactgttgagctaattcaggtgaatgaggatttgaataatgctatccttggatatgagaggtttactagaaaccaacaaaggattttggagcaaaataagaaccagaaggaagccaccaatactaccagtgagccttctgccccatctcaagatctcctcgacctaagtcccagtccccggatgcctagggccactctgggagaactcaacaccatgaataatcaactttcaggcttaagtaaataaacactcaggtcttttcagaccagcagaagagcttgatgttaaacagttctccttaattacgtgattaaataccacctaagaaggactgaagtcaggttgaatgtcagagcgctatgttaggagatgtgattacttcccggcaaatggttgagtcaaacccagtatagcaatgggatgtgtctgggcgaggaggtccttgaaactcatcctactcacttagaatctcatggaattcacctggcctgctttgtagaagttgttcagcccaatggccaatacttaaagtctactgtgaacctacacactattatcattgggtttttctgctatacctcagcatcaggtaagggagtatctctgatgcaagcggagaaattcagggattacaaggtatgaactgagtggttgtgaaatgtagaaggaaaaacacaggctttaaagtcagagaagtccaagttgaaatgccagttctgccacctctcagccacctaacttttgagagtctcactttataaaatgggaacaatgattgccttaaagggtggttgtcaaggttaacaaactaatgtttataaaatgcattgtagcaaagcttacaatgcattttataaacatttataaaagagttacctatcttacctgttatcttctgctgtccttattcccagcaagggtttggcaaattacaaaataaggatgatgaaaaatgctgaaatccagttttgtcaaattaaaagcagtttgtttttctcatatgtcatctgctgtttccggagtaaaaatattcagtatcactgaatttgtggttttcttagaactctactcagttctaaaatgttggctacttgtttatgtaggccagtgggatgtgtagagtcagttacattggagagttttcctgagtttttaattgagaattttcagagggggagggaattattccctttggggtatctcacttaagattatggcctggaggccaggcatagtggctcacacctataatcccagcactttgggaggccgagtcaggtggatcacctgaggtcaggagttcgagaccagcctggccaacatggcaaagccctgtctctactaaaaatacaaaaattagccgggagtggtggtgggcgcctataatcccagctactcaggaggctgaggcagaagaatcacttgaactcaggaggtggaggttgtggtgagccgagatcgtgccactgcactccagtctgggtgacaaagtgagactccatctcaaaaaaaaagaaaaaatgaagtgcaacattagaatttaaataaactagaatacacacttcagggcagagacttatttttactcatatgtagcctgaactccaaaaccagctcaatttttaattacagtgctggcagttaaaaaccaaaatagcactttgaaattgatacataacccttttgctgtgatggctttgtttcagagctatttatgaagaaattgatgctcaccagcacaaaggagctcaaaatgatggtgactgaggtaaagacttcaacttatacaacttaattccatattccatataatttcagtataattatcactttacatatttagtatttaaattttctaagggccatctgagtctgacactttgaaatatgagttcccctgaatcattcaaattgtgctgaaccatt

SEQ ID NO: 356505 - DNA, 573 bp, Homo sapiens
gagcccgggaagcgctcgggcgaagaggaggagccaagggtaccgagcgggtggagtcgggagccggagagcggtggaggcggatttcctgggcccggccctctggcgctaccatggcgtttggcaagagtcaccgggatccctacgcgacctccgtgggccacctcataggtaaggaggcgcggggagagacgcccaggcaggcaggggaccgtgggatcctttcctgcttgatccattctcggcctgcagaggacggagttagtccaacttgaaaaaattattcccctccccccgcaactttcccaaggcacccgcattccacccggccccctttcgtcgtttccttcttggccaactcactgtagaacctcagtcctcaaaaatgtaccttcctttcgatgccgcctggggagtggaaccaaacaggtgaaccgcgggagtcaggcatggagtgtttgggcctccacgaggagacaccagaaacttctcggtaggggaagttattcctaaaggcacattctccagggcacggtattgttatgcccgttttacagatcagaagaggaggct

SEQ ID NO: 356506 - DNA, 2231 bp, Homo sapiens
agagcccgggaagcgctcgggcgaagaggaggagccaagggtaccgagcgggtggagtcgggagccggagagcggtggaggcggatttcctgggcccggccctctggcgctaccatggcgtttggcaagagtcaccgggatccctacgcgacctccgtgggccacctcatagaaaaggctacatttgctggagttcagactgaagattggggccagttcatgcacatctgtgacataattaacactacccaggatgggccaaaagatgcagtgaaagctttgaagaaaaggatttccaaaaactacaatcataaagaaatccaacttaccttgtcacttattgacatgtgtgtgcagaactgtggtccaagtttccagtctctgattgtgaagaaggaatttgttaaagagaatttagttaagctactgaatcccagatacaacttgccattagacattcagaatagaatcttgaatttcattaagacttggtcacagggcttcccaggaggtgtggatgtaagcgaagtcaaagaagtatacctcgacctggttaagaaaggcgttcagtttcctccctcagaagcagaggctgaaacagcaagacaagagactgctcaaatctcatcaaatcctccaacatctgtccctactgcaccagctctttcttctgtaattgctccaaagaactcgactgttacattggtcccagaacagattggaaaactgcacagtgaattggatatggtgaaaatgaatgtgcgagtgatgtccgccatattgatggagaatactcctgggtctgaaaaccatgaagacatagagcttctgcagaaactctataaaacaggtcgggagatgcaggagaggatcatggacctgcttgtggtggtggagaacgaagatgtaactgttgagctaattcaggtgaatgaggatttgaataatgctatccttggatatgagaggtttactagaaaccaacaaaggattttggagcaaaataagaaccagaaggaagccaccaatactaccagtgagccttctgccccatctcaagatctcctcgacctaagtcccagtccccggatgcctagggccactctgggagaactcaacaccatgaataatcaactttcaggcttaaatttcagccttccaagttctgatgtaacaaacaacttaaaacccagtcttcatccacagatgaacttgctagccttggagaatacagagatacccccgtttgcccaaaggaccagccaaaacctcacctcaagccacgcatatgataatccagttagtctacaaaccattgcagcagcaccatcaaaccagagtctgccacctttgcccagcaatcatccagcgatgacaaaaagtgatctccagccacctaattactacgaggtaatggagtttgatcccttagctcctgctgtcactacagaagctatttatgaagaaattgatgctcaccagcacaaaggagctcaaaatgatggtgactgagaagaaagtggatgatcagctcactaccacatcaaaggtgccaactctctaaaacgtagactctgtgcagctttgaagcctggaagacaatacctaccaacatgtcaaagccatggtggcacatttctgctataatgaagattaaatagaataacagttccaggataacactgattcctgacaacagcgtgagatttcaacagaacttgtttggaacaaatactcacttaaaacttcagcagaagaaaaattacttagtccttaggccaaccaatttaactgcagtgtcatgtttcacaggccttcctacatttagaaatcgtcacacagctgtgataagagtagattattttactatgaaataattctgaatagatgaaagcataaaatgtgagaaactgaatgtattattcaggaagaatactgagtgccttcatttaactaaagttgaatgtaaaagtcaatttgcacttctttataatcctctggtttagaattataaattgttaaaaccttgataattgtcatttaattatatttcaggtgtcctgaacaggtcactagactctacattgggcagcctttaaatatgattctttgtaatgctaaatagcctttttttctctttttactgcaacttaatatttctatttagaacacagaaaatgaaaatatttagaataagttgtacatttgatgacaaataaatcactattaaa

SEQ ID NO: 356507 - DNA, 3779 bp, Homo sapiens
agagcccgggaagcgctcgggcgaagaggaggagccaagggtaccgagcgggtggagtcgggagccggagagcggtggaggcggatttcctgggcccggccctctggcgctaccatggcgtttggcaagagtcaccgggatccctacgcgacctccgtgggccacctcatagaaaaggctacatttgctggagttcagactgaagattggggccagttcatgcacatctgtgacataattaacactacccaggatgggccaaaagatgcagtgaaagctttgaagaaaaggatttccaaaaactacaatcataaagaaatccaacttaccttgtcacttattgacatgtgtgtgcagaactgtggtccaagtttccagtctctgattgtgaagaaggaatttgttaaagagaatttagttaagctactgaatcccagatacaacttgccattagacattcagaatagaatcttgaatttcattaagacttggtcacagggcttcccaggaggtgtggatgtaagcgaagtcaaagaagtatacctcgacctggttaagaaaggcgttcagtttcctccctcagaagcagaggctgaaacagcaagacaagagactgctcaaatctcatcaaatcctccaacatctgtccctactgcaccagctctttcttctgtaattgctccaaagaactcgactgttacattggtcccagaacagattggaaaactgcacagtgaattggatatggtgaaaatgaatgtgcgagtgatgtccgccatattgatggagaatactcctgggtctgaaaaccatgaagacatagagcttctgcagaaactctataaaacaggtcgggagatgcaggagaggatcatggacctgcttgtggtggtggagaacgaagatgtaactgttgagctaattcaggtgaatgaggatttgaataatgctatccttggatatgagaggtttactagaaaccaacaaaggattttggagcaaaataagaaccagaaggaagccaccaatactaccagtgagccttctgccccatctcaagatctcctcgacctaagtcccagtccccggatgcctagggccactctgggagaactcaacaccatgaataatcaactttcaggcttaaatttcagccttccaagttctgatgtaacaaacaacttaaaacccagtcttcatccacagatgaacttgctagccttggagaatacagagatacccccgtttgcccaaaggaccagccaaaacctcacctcaagccacgcatatgataattttctggaacattcaaattcagtgtttctacagccagttagtctacaaaccattgcagcagcaccatcaaaccagagtctgccacctttgcccagcaatcatccagcgatgacaaaaagtgatctccagccacctaattactacgaggtaatggagtttgatcccttagctcctgctgtcactacagaagctatttatgaagaaattgatgctcaccagcacaaaggagctcaaaatgatggtgactgagaagaaagtggatgatcagctcactaccacatcaaaggtgccaactctctaaaacgtagactctgtgcagctttgaagcctggaagacaatacctaccaacatgtcaaagccatggtggcacatttctgctataatgaagattaaatagaataacagttccaggataacactgattcctgacaacagcgtgagatttcaacagaacttgtttggaacaaatactcacttaaaacttcagcagaagaaaaattacttagtccttaggccaaccaatttaactgcagtgtcatgtttcacaggccttcctacatttagaaatcgtcacacagctgtgataagagtagattattttactatgaaataattctgaatagatgaaagcataaaatgtgagaaactgaatgtattattcaggaagaatactgagtgccttcatttaactaaagttgaatgtaaaagtcaatttgcacttctttataatcctctggtttagaattataaattgttaaaaccttgataattgtcatttaattatatttcaggtgtcctgaacaggtcactagactctacattgggcagcctttaaatatgattctttgtaatgctaaatagcctttttttctctttttactgcaacttaatatttctatttagaacacagaaaatgaaaatatttagaataagttgtacatttgatgacaaataaatcactattaaaataatttaatactttttttttttaacaaaggtttgtttccagaagaacttttgatgtcagtaaatcttcacaatcccacctgtacattttaacattcatggacttgtaatggtgatgctttggctaacagcctagtagatgtattttatttcaattttatgatactacagtttcaaagtaattattcagaactctgaatataaaatagccctaaaccttaaaggacaaatcaaatttgaaataagaatttaaatctttggacaagctgttagggcttagtgactcctcttctactttgagcttttaaaatactgactattcataatgaaggaaaatagcaaccaactcttttagacacaataaacatggttagaagttctggcctatgacttgaaacaaataaccctgagcatacatttttgaaaaacattgtcagattcattgctgtaagtatgaagagttaataatctggaagggaattatggaattaagctgaacccatgcctgcatatttaaaaaacaaagcggcttattttaatagtatcaaactcttcagtatggtattgaatagtcagtcatatattctagctaggcatatgagtttcttatgataaaagctgaacttgttctctcaagtttaagtgaaaaaaattagttgagaaaaaataattatttaaaatataagccttcatattattgtacaatatttctcctttgagaagataggatatatgattttcccaaaaatcacaactttgaaggaagacttagttgctgacttcaattatatcctggaactggcaacttgtgcccttcctttgcttcaaaaaaagtgtaagaaagagtgataagatcaactttaatcattcttggatcttcagcaaattcaggatcaatgtagaaaaacactggcatatctacttcctcttggggattaagcctttgttcttcaaaacagaagcactggaaattatagaaagattttaataacatttctattctcgtattacataacagaaactatacagttcttttatcttagcattccagtacacttcgtgattttaataagcatactattaaatacacagttctgtgataaattaagagcatcttttcatctcaatgagttctgctttaaggatgaagaacaaattctaatcttaaaagcagatatccatttggtttggttctcaatctctgcatagcaggtatagatagtgaagaaaaatagcttgatgtttagaagaaattcgttttcagaaatcacaagatctactaaaacactaagtttcatactaaaccgtttcatgtatctttatcatattctgtaaagtttacactttgatgtacctgtattttattgaaatactgtccagcttcaaatggaacaatattgtatgtagaaattccaattactggtttgtcagtaggattcttagctctgtaaaacgccagtgcagtctctcctggcaccacctgttttaaagaatatatatattatcaatactttga

SEQ ID NO: 356508 - DNA, 3352 bp, Homo sapiens
tcgtgaggatcttccaacttcgacggacgcttcagaatagaatcttgaatttcattaagacttggtcacagggcttcccaggaggtgtggatgtaagcgaagtcaaagaagtatacctcgacctggttaagaaaggcgttcagtttcctccctcagaagcagaggctgaaacagcaagacaagagactgctcaaatctcatcaaatcctccaacatctgtccctactgcaccagctctttcttctgtaattgctccaaagaactcgactgttacattggtcccagaacagattggaaaactgcacagtgaattggatatggtgaaaatgaatgtgcgagtgatgtccgccatattgatggagaatactcctgggtctgaaaaccatgaagacatagagcttctgcagaaactctataaaacaggtcgggagatgcaggagaggatcatggacctgcttgtggtggtggagaacgaagatgtaactgttgagctaattcaggtgaatgaggatttgaataatgctatccttggatatgagaggtttactagaaaccaacaaaggattttggagcaaaataagaaccagaaggaagccaccaatactaccagtgagccttctgccccatctcaagatctcctcgacctaagtcccagtccccggatgcctagggccactctgggagaactcaacaccatgaataatcaactttcaggcttaaatttcagccttccaagttctgatgtaacaaacaacttaaaacccagtcttcatccacagatgaacttgctagccttggagaatacagagatacccccgtttgcccaaaggaccagccaaaacctcacctcaagccacgcatatgataattttctggaacattcaaattcagtgtttctacagccagttagtctacaaaccattgcagcagcaccatcaaaccagagtctgccacctttgcccagcaatcatccagcgatgacaaaaagtgatctccagccacctaattactacgaggtaatggagtttgatcccttagctcctgctgtcactacagaagctatttatgaagaaattgatgctcaccagcacaaaggagctcaaaatgatggtgactgagaagaaagtggatgatcagctcactaccacatcaaaggtgccaactctctaaaacgtagactctgtgcagctttgaagcctggaagacaatacctaccaacatgtcaaagccatggtggcacatttctgctataatgaagattaaatagaataacagttccaggataacactgattcctgacaacagcgtgagatttcaacagaacttgtttggaacaaatactcacttaaaacttcagcagaagaaaaattacttagtccttaggccaaccaatttaactgcagtgtcatgtttcacaggccttcctacatttagaaatcgtcacacagctgtgataagagtagattattttactatgaaataattctgaatagatgaaagcataaaatgtgagaaactgaatgtattattcaggaagaatactgagtgccttcatttaactaaagttgaatgtaaaagtcaatttgcacttctttataatcctctggtttagaattataaattgttaaaaccttgataattgtcatttaattatatttcaggtgtcctgaacaggtcactagactctacattgggcagcctttaaatatgattctttgtaatgctaaatagcctttttttctctttttactgcaacttaatatttctatttagaacacagaaaatgaaaatatttagaataagttgtacatttgatgacaaataaatcactattaaaataatttaatactttttttttttaacaaaggtttgtttccagaagaacttttgatgtcagtaaatcttcacaatcccacctgtacattttaacattcatggacttgtaatggtgatgctttggctaacagcctagtagatgtattttatttcaattttatgatactacagtttcaaagtaattattcagaactctgaatataaaatagccctaaaccttaaaggacaaatcaaatttgaaataagaatttaaatctttggacaagctgttagggcttagtgactcctcttctactttgagcttttaaaatactgactattcataatgaaggaaaatagcaaccaactcttttagacacaataaacatggttagaagttctggcctatgacttgaaacaaataaccctgagcatacatttttgaaaaacattgtcagattcattgctgtaagtatgaagagttaataatctggaagggaattatggaattaagctgaacccatgcctgcatatttaaaaaacaaagcggcttattttaatagtatcaaactcttcagtatggtattgaatagtcagtcatatattctagctaggcatatgagtttcttatgataaaagctgaacttgttctctcaagtttaagtgaaaaaaattagttgagaaaaaataattatttaaaatataagccttcatattattgtacaatatttctcctttgagaagataggatatatgattttcccaaaaatcacaactttgaaggaagacttagttgctgacttcaattatatcctggaactggcaacttgtgcccttcctttgcttcaaaaaaagtgtaagaaagagtgataagatcaactttaatcattcttggatcttcagcaaattcaggatcaatgtagaaaaacactggcatatctacttcctcttggggattaagcctttgttcttcaaaacagaagcactggaaattatagaaagattttaataacatttctattctcgtattacataacagaaactatacagttcttttatcttagcattccagtacacttcgtgattttaataagcatactattaaatacacagttctgtgataaattaagagcatcttttcatctcaatgagttctgctttaaggatgaagaacaaattctaatcttaaaagcagatatccatttggtttggttctcaatctctgcatagcaggtatagatagtgaagaaaaatagcttgatgtttagaagaaattcgttttcagaaatcacaagatctactaaaacactaagtttcatactaaaccgtttcatgtatctttatcatattctgtaaagtttacactttgatgtacctgtattttattgaaatactgtccagcttcaaatggaacaatattgtatgtagaaattccaattactggtttgtcagtaggattcttagctctgtaaaacgccagtgcagtctctcctggcaccacctgttttaaagaatatatatattatcaatactttga

SEQ ID NO: 356509 - DNA, 4659 bp, Homo sapiens
agagcccgggaagcgctcgggcgaagaggaggagccaagggtaccgagcgggtggagtcgggagccggagagcggtggaggcggatttcctgggcccggccctctggcgctaccatggcgtttggcaagagtcaccgggatccctacgcgacctccgtgggccacctcatagaaaaggctacatttgctggagttcagactgaagattggggccagttcatgcacatctgtgacataattaacactacccaggatgggccaaaagatgcagtgaaagctttgaagaaaaggatttccaaaaactacaatcataaagaaatccaacttaccttgtcacttattgacatgtgtgtgcagaactgtggtccaagtttccagtctctgattgtgaagaaggaatttgttaaagagaatttagttaagctactgaatcccagatacaacttgccattagacattcagaatagaatcttgaatttcattaagacttggtcacagggcttcccaggaggtgtggatgtaagcgaagtcaaagaagtatacctcgacctggttaagaaaggcgttcagtttcctccctcagaagcagaggctgaaacagcaagacaagagactgctcaaatctcatcaaatcctccaacatctgtccctactgcaccagctctttcttctgtaattgctccaaagaactcgactgttacattggtcccagaacaggtttactagaaaccaacaaaggattttggagcaaaataagaaccagaaggaagccaccaatactaccagtgagccttctgccccatctcaagatctcctcgacctaagtcccagtccccggatgcctagggccactctgggagaactcaacaccatgaataatcaactttcaggcttaagtaaataaacactcaggtcttttcagaccagcagaagagcttgatgttaaacagttctccttaattacgtgattaaataccacctaagaaggactgaagtcaggttgaatgtcagagcgctatgttaggagatgtgattacttcccggcaaatggttgagtcaaacccagtatagcaatgggatgtgtctgggcgaggaggtccttgaaactcatcctactcacttagaatctcatggaattcacctggcctgctttgtagaagttgttcagcccaatggccaatacttaaagtctactgtgaacctacacactattatcattgggtttttctgctatacctcagcatcaggtaagggagtatctctgatgcaagcggagaaattcagggattacaaggtatgaactgagtggttgtgaaatgtagaaggaaaaacacaggctttaaagtcagagaagtccaagttgaaatgccagttctgccacctctcagccacctaacttttgagagtctcactttataaaatgggaacaatgattgccttaaagggtggttgtcaaggttaacaaactaatgtttataaaatgcattgtagcaaagcttacaatgcattttataaacatttataaaagagttacctatcttacctgttatcttctgctgtccttattcccagcaagggtttggcaaattacaaaataaggatgatgaaaaatgctgaaatccagttttgtcaaattaaaagcagtttgtttttctcatatgtcatctgctgtttccggagtaaaaatattcagtatcactgaatttgtggttttcttagaactctactcagttctaaaatgttggctacttgtttatgtaggccagtgggatgtgtagagtcagttacattggagagttttcctgagtttttaattgagaattttcagagggggagggaattattccctttggggtatctcacttaagattatggcctggaggccaggcatagtggctcacacctataatcccagcactttgggaggccgagtcaggtggatcacctgaggtcaggagttcgagaccagcctggccaacatggcaaagccctgtctctactaaaaatacaaaaattagccgggagtggtggtgggcgcctataatcccagctactcaggaggctgaggcagaagaatcacttgaactcaggaggtggaggttgtggtgagccgagatcgtgccactgcactccagtctgggtgacaaagtgagactccatctcaaaaaaaaagaaaaaatgaagtgcaacattagaatttaaataaactagaatacacacttcagggcagagacttatttttactcatatgtagcctgaactccaaaaccagctcaatttttaattacagtgctggcagttaaaaaccaaaatagcactttgaaattgatacataacccttttgctgtgatggctttgtttcagagctatttatgaagaaattgatgctcaccagcacaaaggagctcaaaatgatggtgactgagaagaaagtggatgatcagctcactaccacatcaaaggtgccaactctctaaaacgtagactctgtgcagctttgaagcctggaagacaatacctaccaacatgtcaaagccatggtggcacatttctgctataatgaagattaaatagaataacagttccaggataacactgattcctgacaacagcgtgagatttcaacagaacttgtttggaacaaatactcacttaaaacttcagcagaagaaaaattacttagtccttaggccaaccaatttaactgcagtgtcatgtttcacaggccttcctacatttagaaatcgtcacacagctgtgataagagtagattattttactatgaaataattctgaatagatgaaagcataaaatgtgagaaactgaatgtattattcaggaagaatactgagtgccttcatttaactaaagttgaatgtaaaagtcaatttgcacttctttataatcctctggtttagaattataaattgttaaaaccttgataattgtcatttaattatatttcaggtgtcctgaacaggtcactagactctacattgggcagcctttaaatatgattctttgtaatgctaaatagcctttttttctctttttactgcaacttaatatttctatttagaacacagaaaatgaaaatatttagaataagttgtacatttgatgacaaataaatcactattaaaataatttaatactttttttttttaacaaaggtttgtttccagaagaacttttgatgtcagtaaatcttcacaatcccacctgtacattttaacattcatggacttgtaatggtgatgctttggctaacagcctagtagatgtattttatttcaattttatgatactacagtttcaaagtaattattcagaactctgaatataaaatagccctaaaccttaaaggacaaatcaaatttgaaataagaatttaaatctttggacaagctgttagggcttagtgactcctcttctactttgagcttttaaaatactgactattcataatgaaggaaaatagcaaccaactcttttagacacaataaacatggttagaagttctggcctatgacttgaaacaaataaccctgagcatacatttttgaaaaacattgtcagattcattgctgtaagtatgaagagttaataatctggaagggaattatggaattaagctgaacccatgcctgcatatttaaaaaacaaagcggcttattttaatagtatcaaactcttcagtatggtattgaatagtcagtcatatattctagctaggcatatgagtttcttatgataaaagctgaacttgttctctcaagtttaagtgaaaaaaattagttgagaaaaaataattatttaaaatataagccttcatattattgtacaatatttctcctttgagaagataggatatatgattttcccaaaaatcacaactttgaaggaagacttagttgctgacttcaattatatcctggaactggcaacttgtgcccttcctttgcttcaaaaaaagtgtaagaaagagtgataagatcaactttaatcattcttggatcttcagcaaattcaggatcaatgtagaaaaacactggcatatctacttcctcttggggattaagcctttgttcttcaaaacagaagcactggaaattatagaaagattttaataacatttctattctcgtattacataacagaaactatacagttcttttatcttagcattccagtacacttcgtgattttaataagcatactattaaatacacagttctgtgataaattaagagcatcttttcatctcaatgagttctgctttaaggatgaagaacaaattctaatcttaaaagcagatatccatttggtttggttctcaatctctgcatagcaggtatagatagtgaagaaaaatagcttgatgtttagaagaaattcgttttcagaaatcacaagatctactaaaacactaagtttcatactaaaccgtttcatgtatctttatcatattctgtaaagtttacactttgatgtacctgtattttattgaaatactgtccagcttcaaatggaacaatattgtatgtagaaattccaattactggtttgtcagtaggattcttagctctgtaaaacgccagtgcagtctctcctggcaccacctgttttaaagaatatatatattatcaatactttga

SEQ ID NO: 356510 - DNA, 2538 bp, Homo sapiens
tgactcgagttcggtaccccagttacaacagctccagtacaacagctatgataattttctggaacattcaaattcagtgtttctacagccagttagtctacaaaccattgcagcagcaccatcaaaccagagtctgccacctttgcccagcaatcatccagcgatgacaaaaagtgatctccagccacctaattactacgaggtaatggagtttgatcccttagctcctgctgtcactacagaagctatttatgaagaaattgatgctcaccagcacaaaggagctcaaaatgatggtgactgagaagaaagtggatgatcagctcactaccacatcaaaggtgccaactctctaaaacgtagactctgtgcagctttgaagcctggaagacaatacctaccaacatgtcaaagccatggtggcacatttctgctataatgaagattaaatagaataacagttccaggataacactgattcctgacaacagcgtgagatttcaacagaacttgtttggaacaaatactcacttaaaacttcagcagaagaaaaattacttagtccttaggccaaccaatttaactgcagtgtcatgtttcacaggccttcctacatttagaaatcgtcacacagctgtgataagagtagattattttactatgaaataattctgaatagatgaaagcataaaatgtgagaaactgaatgtattattcaggaagaatactgagtgccttcatttaactaaagttgaatgtaaaagtcaatttgcacttctttataatcctctggtttagaattataaattgttaaaaccttgataattgtcatttaattatatttcaggtgtcctgaacaggtcactagactctacattgggcagcctttaaatatgattctttgtaatgctaaatagcctttttttctctttttactgcaacttaatatttctatttagaacacagaaaatgaaaatatttagaataagttgtacatttgatgacaaataaatcactattaaaataatttaatactttttttttttaacaaaggtttgtttccagaagaacttttgatgtcagtaaatcttcacaatcccacctgtacattttaacattcatggacttgtaatggtgatgctttggctaacagcctagtagatgtattttatttcaattttatgatactacagtttcaaagtaattattcagaactctgaatataaaatagccctaaaccttaaaggacaaatcaaatttgaaataagaatttaaatctttggacaagctgttagggcttagtgactcctcttctactttgagcttttaaaatactgactattcataatgaaggaaaatagcaaccaactcttttagacacaataaacatggttagaagttctggcctatgacttgaaacaaataaccctgagcatacatttttgaaaaacattgtcagattcattgctgtaagtatgaagagttaataatctggaagggaattatggaattaagctgaacccatgcctgcatatttaaaaaacaaagcggcttattttaatagtatcaaactcttcagtatggtattgaatagtcagtcatatattctagctaggcatatgagtttcttatgataaaagctgaacttgttctctcaagtttaagtgaaaaaaattagttgagaaaaaataattatttaaaatataagccttcatattattgtacaatatttctcctttgagaagataggatatatgattttcccaaaaatcacaactttgaaggaagacttagttgctgacttcaattatatcctggaactggcaacttgtgcccttcctttgcttcaaaaaaagtgtaagaaagagtgataagatcaactttaatcattcttggatcttcagcaaattcaggatcaatgtagaaaaacactggcatatctacttcctcttggggattaagcctttgttcttcaaaacagaagcactggaaattatagaaagattttaataacatttctattctcgtattacataacagaaactatacagttcttttatcttagcattccagtacacttcgtgattttaataagcatactattaaatacacagttctgtgataaattaagagcatcttttcatctcaatgagttctgctttaaggatgaagaacaaattctaatcttaaaagcagatatccatttggtttggttctcaatctctgcatagcaggtatagatagtgaagaaaaatagcttgatgtttagaagaaattcgttttcagaaatcacaagatctactaaaacactaagtttcatactaaaccgtttcatgtatctttatcatattctgtaaagtttacactttgatgtacctgtattttattgaaatactgtccagcttcaaatggaacaatattgtatgtagaaattccaattactggtttgtcagtaggattcttagctctgtaaaacgccagtgcagtctctcctggcaccacctgttttaaagaatatatatattatcaatactttga

SEQ ID NO: 356511 - DNA, 1679 bp, Homo sapiens
agagcccgggaagcgctcgggcgaagaggaggagccaagggtaccgagcgggtggagtcgggagccggagagcggtggaggcggatttcctgggcccggccctctggcgctaccatggcgtttggcaagagtcaccgggatccctacgcgacctccgtgggccacctcatagaaaaggctacatttgctggagttcagactgaagattggggccagttcatgcacatctgtgacataattaacactacccaggatgggccaaaagatgcagtgaaagctttgaagaaaaggatttccaaaaactacaatcataaagaaatccaacttaccttgtcacttattgacatgtgtgtgcagaactgtggtccaagtttccagtctctgattgtgaagaaggaatttgttaaagagaatttagttaagctactgaatcccagatacaacttgccattagacattcagaatagaatcttgaatttcattaagacttggtcacagggcttcccaggaggtgtggatgtaagcgaagtcaaagaagtatacctcgacctggttaagaaaggcgttcagtttcctccctcagaagcagaggctgaaacagcaagacaagagactgctcaaatctcatcaaatcctccaacatctgtccctactgcaccagctctttcttctgtaattgctccaaagaactcgactgttacattggtcccagaacagattggaaaactgcacagtgaattggatatggtgaaaatgaatgtgcgagtgatgtccgccatattgatggagaatactcctgggtctgaaaaccatgaagacatagagcttctgcagaaactctataaaacaggtcgggagatgcaggagaggatcatggacctgcttgtggtggtggagaacgaagatgtaactgttgagctaattcaggtgaatgaggatttgaataatgctatccttggatatgagaggtttactagaaaccaacaaaggattttggagcaaaataagaaccagaaggaagccaccaatactaccagtgagccttctgccccatctcaagatctcctcgacctaagtcccagtccccggatgcctagggccactctgggagaactcaacaccatgaataatcaactttcaggcttaaatttcagccttccaagttctgatgtaacaaacaacttaaaacccagtcttcatccacagatgaacttgctagccttggagaatacagagatacccccgtttgcccaaaggaccagccaaaacctcacctcaagccacgcatatgataattttctggaacattcaaattcagtgtttctacagccagttagtctacaaaccattgcagcagcaccatcaaaccagagtctgccacctttgcccagcaatcatccagcgatgacaaaaagtgatctccagccacctaattactacgaggtaatggagtttgatcccttagctcctgctgtcactacagagtatattttccagctacagacatatgtaagacgcatataaagaattgaatgggcctggcatggtggcttatgcctctaatcccaacattttgagaggctgaagtggaaggatcacttgaacctgggaggtcgaagctgcaatgggccatgattgcacccctgcactccagcctgggtgacagtgaccctgtctca

SEQ ID NO: 356512 - DNA, 954 bp, Homo sapiens
ccgtgttggccaggctggtcttgaactcctgacctcaggtgatccacccgccttggcctcccaaagtgctgggattacaggtgtgagcctctgcgcccggccaaaaatacagacttttaaatagatttttaaatagtgtcaagattttaaggtcaagatagcatgctttcccgctctaacttttcagatcattatatattaccctttttccccctacaggcatttggatggcaatactgagccagggcttacattaggaggctatttctgcccacagtgtcgggcaaagtactgtgagctacctgttgaatgtaaaatctgtggtcttactttggtgtctgctccccacttggcacggtcttaccatcatttgtttcctttggatgcttttcaagaaattcccctagaagaatataatggagaaaggtatttcagtttggactaatttatatctgttataagtggtaagctaatgtttgaatagattgttactaccttaaaaaataatctgattaacttggacaagagtacttctaatatggaagatgagataaagaatgccatagttatgattgaaatgactcgttgctaaatagatctgaatctccagaaaccaaataatttcactaaacccacctatgtataaataggggtgatgattgtactactaaatcagttttccagaaggaaaagaaaaaaagccctgattggtagtatttgctgatttccatggtttgaatactcccaccatggccaatttttagctacaattaacaaccagctttcttgaatacatatttaacaatatatccttttgatccagtacaatccagtcctagcacactactgaaaataagaggctcattcagcactttgggaggctgaggtgggaggatcacttgaggccaggagttgaagactagctggggcaacatagtgagacactgtctctta

SEQ ID NO: 356513 - DNA, 916 bp, Homo sapiens
  misc_feature (788)..(788): n is a, c, g, or t
  misc_feature (794)..(794): n is a, c, g, or t
  misc_feature (800)..(800): n is a, c, g, or t
  misc_feature (804)..(804): n is a, c, g, or t
  misc_feature (807)..(807): n is a, c, g, or t
ccacgcgtccgcggacgcgtgggtcgacccacgcgtccgcgtctagcggcgccggctggagtgcagtggcacaaccttggctcgctccagtgtctacctcccaggttcaagtgattctcctgcctcagcctcccgagtagctgggattacagattattgaataataaaatacagttttgaaaaaaatggatgaagaacctgaaagaactaagcgatgggaaggaggctatgaaagaacatgggagattcttaaagaagatgaatctggatcacttaaagctacaatagaagacattctattcaaggcaaagagaaaaagagtatttgagcaccatggacaagttcgacttggaatgatgcgccacctttatgtggtagtagatggatcaagaacaatggaagaccaagatttaaagcctaatagactgacgtgtactttaaagttgttggaatactttgtagaggaatattttgatcaaaatcctattagtcagattggaataattgtaactaagagtaaaagagctgaaaaattgactgaactttcaggaaacccaagaaaacatataacgtctttgaagaaagctgtggatatgacctgccatggagagccatctctttataattccctaagcatggctatgcagactctaaagttagtattatacattatgtataattgaattagaagttttttaaatgagttaagctgaagtgatgtgttaatatggggcccataaacccagctataacaaaattgttaagtacaagaattatgtagtgtatangagtangggggngganaanttattcttagagattgggaggttaaatattttaaggggaattgaaaggggaaattttcgggtttgggaaaaaaaaagcggggagaatcaatggggcaaaagatagatag

SEQ ID NO: 356514 - DNA, 483 bp, Homo sapiens
ccggacctgaccgcgagaacagacagttcgacttggaatgatgcgccacctttatgtggtagtagatggatcaagaacaatggaagaccaagatttaaagcctaatagactgacgtgtactttaaaggaaacccaagaaaacatataacgtctttgaagaaagctgtggatatgacctgccatggagagccatctctttataattccctaagcatggctatgcagactctaaaacacatgcctggacatacaagtcgagaagtactaatcatctttagcagccttacaacttgcgatccatctaatatttatgatctaatcaagaccctaaaggcagctaaaattagagtatctgttattggattgtctgcagaagttcgcgtttgcactgtacttgctcgtgaaactggtgcacgtaccatggcaacaacttcgtccactatgatctgtgtcaccaaggggtatgggtgttcggcgtgtgca

SEQ ID NO: 356515 - DNA, 583 bp, Homo sapiens
tttctacaaaacaaaacaagtacttgaaattggccctttctttttttccgatagatgcgccacctttatgtggtagtagatggatcaagaacaatggaagaccaagatttaaagcctaatagactgacgtgtactttaaaggtaaaatttaagtttatactaaatcatttaaatttgtaccaaaatcacttaaacttttactaaaaaagtggggaagaacactggattctaaaggatatttttaaagaatgcaatattttttattttttgccttgtatttttagttaatgctaatgatagctaagtagaagtactgccaggttatttagggaaattttaaaccaacatagctaattatttgtgtttttaatttctatcctcccaccccacatcaggatcttggtttatcagttatcccttttctttcttgaatcttcattctcctttgccttacttaactctgtctcctcagattacaaatatgttcgtattcctaatttatcaaaacctattctcaattctgctcgttctcccatctctcttcattggatcttttcctcattgaaatttcttctgacacatc

SEQ ID NO: 356516 - DNA, 662 bp, Homo sapiens
caggcaattagaaaaagagtatttgagcaccatggacaagttcgacttggaatagctggaaagcggcggagaggagtgtcgggcggagtttccggctgagagtccttctagcggcgccggctggagtgcagtggcacaaccttggctcgctccagtgtctacctcccaggttcaagtgattctcctgcctcagcctcccgagtagctgggattacagattattgaataataaaatacagttttgaaaaaaatggatgaagaacctgaaagaactaagcgatgggaaggaggctatgaaagaacatgggagattcttaaagaagatgaatctggatcacttaaagctacaatagaagacattctattcaaggcaaagagaaaaaggtatgtaaccttcctatgtatcttaaaaaggtaaaatatattcattttaagcctttctatctataaatactcctcagtacttcattttagctgtgtttcagggtaactgacctattgccttctgactatggggaaagaactagccacctacccttgccccagcaggaaatggtctttagagactgtctacaatacctataattgtgtgtattgtattccataagttaattatttactccactaaaaatgcacgttatgacattcttactcagaattag

SEQ ID NO: 356517 - DNA, 329 bp, Homo sapiens
gatgatacaacttttacagaattacatagaacgtacagttcgttatgtctatgaaggtgtttttttttcccttttcatcttgttaggcacgtaccatgttattttagatgaaagccattacaaagagttgctcacacatcatgttagtcctcctcctgctagctcaagttctgaatgctcacttattcgtatgggtaagtgtttttatgtttttaaaaaatacatatctaggctctccattttcatttgcacaagttattttaatatttaagaatttttaaagaaaaaatatgcttgttgaagcaattttggaaagtacagagaagtgg

SEQ ID NO: 356518 - DNA, 358 bp, Homo sapiens
aactattttaatgagtaaattctaagaaaaaacattgttaaacttttttttcagattttgttatggatgtcagggggaattgaaagaccaacatgtaagttctttggctttctaaatattaagtaatgtacaagaaatattgaaatcaatggtactataagttttcaacaggttgttaaagaccaggctcatatcagtttatttcttgtaaagataatgacaataggtgaaggtaaaataggaacaaaatagtttaaatagtagttttgttattctgcattctaatttttgctataaagtattttgtaattcatctttttaaaactttttattaaaaattttttaatttttttcctct

SEQ ID NO: 356519 - DNA, 195 bp, Homo sapiens
tgagttatactgttttcaaagtcattatacatactgcataatgactttgaaaacagtataactcaaaataatagaaaacaaaattaattgaatgaattatactgttttcaaagtcattatgcagtatgtataaacttataagaattaaattgatgtgataattttatgtttttataattaaatatagaatcttta

SEQ ID NO: 356520 - DNA, 1828 bp, Homo sapiens
caggcaattagaaaaagagtatttgagcaccatggacaagttcgacttggaatagctggaaagcggcggagaggagtgtcgggcggagtttccggctgagagtccttctagcggcgccggtgagtccgcgtgtggaagtctgtgaggcgcagaggtggggcaggccgtctggctagctaggcggctgggagcgttttcgtggcggggaacggaggttgaattgccctgcctgggctcatagggaaggaggatgtgaaggagcttgtgaaggcagaggaagattattgaataataaaatacagttttgaaaaaaatggatgaagaacctgaaagaactaagcgatgggaaggaggctatgaaagaacatgggagattcttaaagaagatgaatctggatcacttaaagctacaatagaagacattctattcaaggcaaagagaaaaagagtatttgagcaccatggacaagttcgacttggaatgatgcgccacctttatgtggtagtagatggatcaagaacaatggaagaccaagatttaaagcctaatagactgacgtgtactttaaagttgttggaatactttgtagaggaatattttgatcaaaatcctattagtcagattggaataattgtaactaagagtaaaagagctgaaaaattgactgaactttcaggaaacccaagaaaacatataacgtctttgaagaaagctgtggatatgacctgccatggagagccatctctttataattccctaagcatggctatgcagactctaaaacacatgcctggacatacaagtcgagaagtactaatcatctttagcagccttacaacttgcgatccatctaatatttatgatctaatcaagaccctaaaggcagctaaaattagagtatctgttattggattgtctgcagaagttcgcgtttgcactgtacttgctcgtgaaactggtggcacgtaccatgttattttagatgaaagccattacaaagagttgctcacacatcatgttagtcctcctcctgctagctcaagttctgaatgctcacttattcgtatgggatttcctcagcacaccattgcttctttatctgaccaggatgcaaaaccctctttcagcatggcgcatttggatggcaatactgagccagggcttacattaggaggctatttctgcccacagtgtcgggcaaagtactgtgagctacctgttgaatgtaaaatctgtggtcttactttggtgtctgctccccacttggcacggtcttaccatcatttgtttcctttggatgcttttcaagaaattcccctagaagaatataatggagaaagattttgttatggatgtcagggggaattgaaagaccaacatgtttatgtttgtgctgtgtgccaaaatgttttctgtgtggactgtgatgtttttgttcatgattctctacactgttgccctggctgtattcataagattccagctccttcaggtgtttgattccagcatgtagtatacattgtatgtgttaaaaagaaatttgcaactgtgaataaaaggacttctttagaagaagcttcatttaaaacatgaaaggataatctgacttaagaaactttttgctaagaaaaggtaatattttattaaattttaaatttgtgttgtcacagaaatacctgaaattcagtagtacttcattcaattaattttgttttctattattttgagttatactgttttcaaagtcattatgcagtatgtataaacttataagaattaaattgatgtgataattttatgtttttataattaaatatagaatcttta

SEQ ID NO: 356521 - DNA, 1926 bp, Homo sapiens
caggcaattagaaaaagagtatttgagcaccatggacaagttcgacttggaatagctggaaagcggcggagaggagtgtcgggcggagtttccggctgagagtccttctagcggcgccggtgagtccgcgtgtggaagtctgtgaggcgcagaggtggggcaggccgtctggctagctaggcggctgggagcgttttcgtggcggggaacggaggttgaattgccctgcctgggctcatagggaaggaggatgtgaaggagcttgtgaaggcagaggaaggctggagtgcagtggcacaaccttggctcgctccagtgtctacctcccaggttcaagtgattctcctgcctcagcctcccgagtagctgggattacagattattgaataataaaatacagttttgaaaaaaatggatgaagaacctgaaagaactaagcgatgggaaggaggctatgaaagaacatgggagattcttaaagaagatgaatctggatcacttaaagctacaatagaagacattctattcaaggcaaagagaaaaagagtatttgagcaccatggacaagttcgacttggaatgatgcgccacctttatgtggtagtagatggatcaagaacaatggaagaccaagatttaaagcctaatagactgacgtgtactttaaagttgttggaatactttgtagaggaatattttgatcaaaatcctattagtcagattggaataattgtaactaagagtaaaagagctgaaaaattgactgaactttcaggaaacccaagaaaacatataacgtctttgaagaaagctgtggatatgacctgccatggagagccatctctttataattccctaagcatggctatgcagactctaaaacacatgcctggacatacaagtcgagaagtactaatcatctttagcagccttacaacttgcgatccatctaatatttatgatctaatcaagaccctaaaggcagctaaaattagagtatctgttattggattgtctgcagaagttcgcgtttgcactgtacttgctcgtgaaactggtggcacgtaccatgttattttagatgaaagccattacaaagagttgctcacacatcatgttagtcctcctcctgctagctcaagttctgaatgctcacttattcgtatgggatttcctcagcacaccattgcttctttatctgaccaggatgcaaaaccctctttcagcatggcgcatttggatggcaatactgagccagggcttacattaggaggctatttctgcccacagtgtcgggcaaagtactgtgagctacctgttgaatgtaaaatctgtggtcttactttggtgtctgctccccacttggcacggtcttaccatcatttgtttcctttggatgcttttcaagaaattcccctagaagaatataatggagaaagattttgttatggatgtcagggggaattgaaagaccaacatgtttatgtttgtgctgtgtgccaaaatgttttctgtgtggactgtgatgtttttgttcatgattctctacactgttgccctggctgtattcataagattccagctccttcaggtgtttgattccagcatgtagtatacattgtatgtgttaaaaagaaatttgcaactgtgaataaaaggacttctttagaagaagcttcatttaaaacatgaaaggataatctgacttaagaaactttttgctaagaaaaggtaatattttattaaattttaaatttgtgttgtcacagaaatacctgaaattcagtagtacttcattcaattaattttgttttctattattttgagttatactgttttcaaagtcattatgcagtatgtataaacttataagaattaaattgatgtgataattttatgtttttataattaaatatagaatcttta

SEQ ID NO: 356522 - DNA, 1791 bp, Homo sapiens
caggcaattagaaaaagagtatttgagcaccatggacaagttcgacttggaatagctggaaagcggcggagaggagtgtcgggcggagtttccggctgagagtccttctagcggcgccggtgagtccgcgtgtggaagtctgtgaggcgcagaggtggggcaggccgtctggctagctaggcggctgggagcgttttcgtggcggggaacggaggttgaattgccctgcctgggctcatagggaaggaggatgtgaaggagcttgtgaaggcagaggaagattattgaataataaaatacagttttgaaaaaaatggatgaagaacctgaaagaactaagcgatgggaaggaggctatgaaagaacatgggagattcttaaagaagatgaatctggatcacttaaagctacaatagaagacattctattcaaggcaaagagaaaaagatgcgccacctttatgtggtagtagatggatcaagaacaatggaagaccaagatttaaagcctaatagactgacgtgtactttaaagttgttggaatactttgtagaggaatattttgatcaaaatcctattagtcagattggaataattgtaactaagagtaaaagagctgaaaaattgactgaactttcaggaaacccaagaaaacatataacgtctttgaagaaagctgtggatatgacctgccatggagagccatctctttataattccctaagcatggctatgcagactctaaaacacatgcctggacatacaagtcgagaagtactaatcatctttagcagccttacaacttgcgatccatctaatatttatgatctaatcaagaccctaaaggcagctaaaattagagtatctgttattggattgtctgcagaagttcgcgtttgcactgtacttgctcgtgaaactggtggcacgtaccatgttattttagatgaaagccattacaaagagttgctcacacatcatgttagtcctcctcctgctagctcaagttctgaatgctcacttattcgtatgggatttcctcagcacaccattgcttctttatctgaccaggatgcaaaaccctctttcagcatggcgcatttggatggcaatactgagccagggcttacattaggaggctatttctgcccacagtgtcgggcaaagtactgtgagctacctgttgaatgtaaaatctgtggtcttactttggtgtctgctccccacttggcacggtcttaccatcatttgtttcctttggatgcttttcaagaaattcccctagaagaatataatggagaaagattttgttatggatgtcagggggaattgaaagaccaacatgtttatgtttgtgctgtgtgccaaaatgttttctgtgtggactgtgatgtttttgttcatgattctctacactgttgccctggctgtattcataagattccagctccttcaggtgtttgattccagcatgtagtatacattgtatgtgttaaaaagaaatttgcaactgtgaataaaaggacttctttagaagaagcttcatttaaaacatgaaaggataatctgacttaagaaactttttgctaagaaaaggtaatattttattaaattttaaatttgtgttgtcacagaaatacctgaaattcagtagtacttcattcaattaattttgttttctattattttgagttatactgttttcaaagtcattatgcagtatgtataaacttataagaattaaattgatgtgataattttatgtttttataattaaatatagaatcttta

SEQ ID NO: 356523 - DNA, 1774 bp, Homo sapiens
caggcaattagaaaaagagtatttgagcaccatggacaagttcgacttggaatagctggaaagcggcggagaggagtgtcgggcggagtttccggctgagagtccttctagcggcgccggtgagtccgcgtgtggaagtctgtgaggcgcagaggtggggcaggccgtctggctagctaggcggctgggagcgttttcgtggcggggaacggaggttgaattgccctgcctgggctcatagggaaggaggatgtgaaggagcttgtgaaggcagaggaagattattgaataataaaatacagttttgaaaaaaatggatgaagaacctgaaagaactaagcgatgggaaggaggctatgaaagaacatgggagattcttaaagaagatgaatctggatcacttaaagctacaatagaagacattctattcaaggcaaagagaaaaagagtatttgagcaccatggacaagttcgacttggaatgatgcgccacctttatgtggtagtagatggatcaagaacaatggaagaccaagatttaaagcctaatagactgacgtgtactttaaagttgttggaatactttgtagaggaatattttgatcaaaatcctattagtcagattggaataattgtaactaagagtaaaagagctgaaaaattgactgaactttcaggaaacccaagaaaacatataacgtctttgaagaaagctgtggatatgacctgccatggagagccatctctttataattccctaagcatggctatgcagactctaaaacacatgcctggacatacaagtcgagaagtactaatcatctttagcagccttacaacttgcgatccatctaatatttatgatctaatcaagaccctaaaggcagctcttgctcgtgaaactggtggcacgtaccatgttattttagatgaaagccattacaaagagttgctcacacatcatgttagtcctcctcctgctagctcaagttctgaatgctcacttattcgtatgggatttcctcagcacaccattgcttctttatctgaccaggatgcaaaaccctctttcagcatggcgcatttggatggcaatactgagccagggcttacattaggaggctatttctgcccacagtgtcgggcaaagtactgtgagctacctgttgaatgtaaaatctgtggtcttactttggtgtctgctccccacttggcacggtcttaccatcatttgtttcctttggatgcttttcaagaaattcccctagaagaatataatggagaaagattttgttatggatgtcagggggaattgaaagaccaacatgtttatgtttgtgctgtgtgccaaaatgttttctgtgtggactgtgatgtttttgttcatgattctctacactgttgccctggctgtattcataagattccagctccttcaggtgtttgattccagcatgtagtatacattgtatgtgttaaaaagaaatttgcaactgtgaataaaaggacttctttagaagaagcttcatttaaaacatgaaaggataatctgacttaagaaactttttgctaagaaaaggtaatattttattaaattttaaatttgtgttgtcacagaaatacctgaaattcagtagtacttcattcaattaattttgttttctattattttgagttatactgttttcaaagtcattatgcagtatgtataaacttataagaattaaattgatgtgataattttatgtttttataattaaatatagaatcttta

SEQ ID NO: 356524 - DNA, 1597 bp, Homo sapiens
tatatatagggttcagtactatccttgatttcaggtatccactgggggtcttggaatgtatcctctgcagataagaggggactactatagtctttgagaaagaagtgtgtgttactgttttgaagccacatctctgcactttaaagctgatccatatgatattgccacattttagtttaaagtttatccatatattgttgtattttttattgtatactctagactttgtatgaaacaaacctactagaatgtaagcttaatgatgtcgggaacattgtcagtcttgtttatcactctacccccagaacttgagagtacttggtaaatattaaatgaatcaattaacaattttttgaagtgcatagctcattttagaaaaatttgcattaaagtgtttaaaatatactcacaacctttctttgcattgttgaaacaaatgagatattctatagtctaaatgtgtaatcctatgtttactgttctttctgggtaaattttttggtagtataatttgttgtacctaattggagtgtattttatctttcttttaagacacatgcctggacatacaagtcgagaagtactaatcatctttagcagccttacaacttgcgatccatctaatatttatgatctaatcaagaccctaaaggcagctaaaattagagtatctgttattggattgtctgcagaagttcgcgtttgcactgtacttgctcgtgaaactggtggcacgtaccatgttattttagatgaaagccattacaaagagttgctcacacatcatgttagtcctcctcctgctagctcaagttctgaatgctcacttattcgtatgggatttcctcagcacaccattgcttctttatctgaccaggatgcaaaaccctctttcagcatggcgcatttggatggcaatactgagccagggcttacattaggaggctatttctgcccacagtgtcgggcaaagtactgtgagctacctgttgaatgtaaaatctgtggtcttactttggtgtctgctccccacttggcacggtcttaccatcatttgtttcctttggatgcttttcaagaaattcccctagaagaatataatggagaaagattttgttatggatgtcagggggaattgaaagaccaacatgtttatgtttgtgctgtgtgccaaaatgttttctgtgtggactgtgatgtttttgttcatgattctctacactgttgccctggctgtattcataagattccagctccttcaggtgtttgattccagcatgtagtatacattgtatgtgttaaaaagaaatttgcaactgtgaataaaaggacttctttagaagaagcttcatttaaaacatgaaaggataatctgacttaagaaactttttgctaagaaaaggtaatattttattaaattttaaatttgtgttgtcacagaaatacctgaaattcagtagtacttcattcaattaattttgttttctattattttgagttatactgttttcaaagtcattatgcagtatgtataaacttataagaattaaattgatgtgataattttatgtttttataattaaatatagaatcttta

SEQ ID NO: 356525 - DNA, 1815 bp, Homo sapiens
tatatatagggttcagtactatccttgatttcaggtatccactgggggtcttggaatgtatcctctgcagataagaggggactactatagtctttgagaaagaagtgtgtgttactgttttgaagccacatctctgcactttaaagctgatccatatgatattgccacattttagtttaaagtttatccatatattgttgtattttttattgtatactctagactttgtatgaaacaaacctactagaatgtaagcttaatgatgtcgggaacattgtcagtcttgtttatcactctacccccagaacttgagagtacttggtaaatattaaatgaatcaattaacaattttttgaagtgcatagctcattttagaaaaatttgcattaaagtgtttaaaatatactcacaacctttctttgcattgttgaaacaaatgagatattctatagtctaaatgtgtaatcctatgtttactgttctttctgggtaaattttttggtagtataatttgttgtacctaattggagtgtattttatctttcttttaagacacatgcctggacatacaagtcgagaagtactaatcatctttagcagccttacaacttgcgatccatctaatatttatgatctaatcaaggtagaccaaaaaatcaaaaccaaagttataactgtaaagagaattctgtagcaaattgatttatatatatatgtatttttgtatgtgtgattcatctttgtggtagatgtattgaatttattactagttttcagagcattctttatttttcaaatacattaaatcttaaatgtttttcttctttcctaaaactatctatctacttggattttatgaagaccctaaaggcagctaaaattagagtatctgttattggattgtctgcagaagttcgcgtttgcactgtacttgctcgtgaaactggtggcacgtaccatgttattttagatgaaagccattacaaagagttgctcacacatcatgttagtcctcctcctgctagctcaagttctgaatgctcacttattcgtatgggatttcctcagcacaccattgcttctttatctgaccaggatgcaaaaccctctttcagcatggcgcatttggatggcaatactgagccagggcttacattaggaggctatttctgcccacagtgtcgggcaaagtactgtgagctacctgttgaatgtaaaatctgtggtcttactttggtgtctgctccccacttggcacggtcttaccatcatttgtttcctttggatgcttttcaagaaattcccctagaagaatataatggagaaagattttgttatggatgtcagggggaattgaaagaccaacatgtttatgtttgtgctgtgtgccaaaatgttttctgtgtggactgtgatgtttttgttcatgattctctacactgttgccctggctgtattcataagattccagctccttcaggtgtttgattccagcatgtagtatacattgtatgtgttaaaaagaaatttgcaactgtgaataaaaggacttctttagaagaagcttcatttaaaacatgaaaggataatctgacttaagaaactttttgctaagaaaaggtaatattttattaaattttaaatttgtgttgtcacagaaatacctgaaattcagtagtacttcattcaattaattttgttttctattattttgagttatactgttttcaaagtcattatgcagtatgtataaacttataagaattaaattgatgtgataattttatgtttttataattaaatatagaatcttta

SEQ ID NO: 356526 - DNA, 1034 bp, Homo sapiens
  misc_feature (13)..(13): n is a, c, g, or t
gctctagaggatnctcaactacacagctatgaaacccaagaaaacatataacgtctttgaagaaagctgtggatatgacctgccatggagagccatctctttataattccctaagcatggctatgcagactctaaaacacatgcctggacatacaagtcgagaagtactaatcatctttagcagccttacaacttgcgatccatctaatatttatgatctaatcaagaccctaaaggcagctaaaattagagtatctgttattggattgtctgcagaagttcgcgtttgcactgtacttgctcgtgaaactggtggcacgtaccatgttattttagatgaaagccattacaaagagttgctcacacatcatgttagtcctcctcctgctagctcaagttctgaatgctcacttattcgtatgggatttcctcagcacaccattgcttctttatctgaccaggatgcaaaaccctctttcagcatggctcatttgtttcctttggatgcttttcaagaaattcccctagaagaatataatggagaaagattttgttatggatgtcagggggaattgaaagaccaacatgtttatgtttgtgctgtgtgccaaaatgttttctgtgtggactgtgatgtttttgttcatgattctctacactgttgccctggctgtattcataagattccagctccttcaggtgtttgattccagcatgtagtatacattgtatgtgttaaaaagaaatttgcaactgtgaataaaaggacttctttagaagaagcttcatttaaaacatgaaaggataatctgacttaagaaactttttgctaagaaaaggtaatattttattaaattttaaatttgtgttgtcacagaaatacctgaaattcagtagtacttcattcaattaattttgttttctattattttgagttatactgttttcaaagtcattatgcagtatgtataaacttataagaattaaattgatgtgataattttatgtttttataattaaatatagaatcttta

SEQ ID NO: 356527 - DNA, 882 bp, Homo sapiens
gcggaatgacttccggggcgcccctaaagcggcggagaggagtgtcgggcggagtttccggctgagagtccttctagcggcgccgattattgaataataaaatacagttttgaaaaaaatggatgaagaacctgaaagaactaagcgatgggaaggaggctatgaaagaacatgggagattcttaaagaagatgaatctggatcacttaaagctacaatagaagacattctattcaaggcaaagagaaaaagagtatttgagcaccatggacaagttcgacttggaatgatgcgccacctttatgtggtagtagatggatcaagaacaatggaagaccaagatttaaagcctaatagactgacgtgtactttaaagttgttggaatactttgtagaggaatattttgatcaaaatcctattagtcagattggaataattgtaactaagagtaaaagagctgaaaaattgactgaactttcaggaaacccaagaaaacatataacgtctttgaagaaagctgtggatatgacctgccatggagagccatctctttataattccctaagcatggctatgcagactctaaagttagtattatacattatgtataattgaattagaagttttttaaatgagttaagctgaagtgatgtgttaatatggggcccataaacccagctataacaaaattgttaagtacaagaattatgtagtgttatttatgatgtttagtgtggtgttggttagtaatctttattttacattttagtaagatattgttaaaggttttataaaaatataatttaaaactgtcggcagtatcaatagtacaaaaaatatgttgatgaaaaaatattttattaaaatgagatttaatatag

SEQ ID NO: 356528 - DNA, 1691 bp, Homo sapiens
caggcaattagaaaaagagtatttgagcaccatggacaagttcgacttggaatagctggaaagcggcggagaggagtgtcgggcggagtttccggctgagagtccttctagcggcgccggtgagtccgcgtgtggaagtctgtgaggcgcagaggtggggcaggccgtctggctagctaggcggctgggagcgttttcgtggcggggaacggaggttgaattgccctgcctgggctcatagggaaggaggatgtgaaggagcttgtgaaggcagaggaagattattgaataataaaatacagttttgaaaaaaatggatgaagaacctgaaagaactaagcgatgggaaggaggctatgaaagaacatgggagattcttaaagaagatgaatctggatcacttaaagctacaatagaagacattctattcaaggcaaagagaaaaagagtatttgagcaccatggacaagttcgacttggaatgatgcgccacctttatgtggtagtagatggatcaagaacaatggaagaccaagatttaaagcctaatagactgacgtgtactttaaagttgttggaatactttgtagaggaatattttgatcaaaatcctattagtcagattggaataattgtaactaagagtaaaagagctgaaaaattgactgaactttcaggaaacccaagaaaacatataacgtctttgaagaaagctgtggatatgacctgccatggagagccatctctttataattccctaagcatggctatgcagactctaaaacacatgcctggacatacaagtcgagaagtactaatcatctttagcagccttacaacttgcgatccatctaatatttatgatctaatcaaggtagaccaaaaaatcaaaaccaaagttataactgtaaagagaattctgtagcaaattgatttatatatatatgtatttttgtatgtgtgattcatctttgtggtagatgtattgaatttattactagttttcagagcattctttatttttcaaatacattaaatcttaaatgtttttcttctttcctaaaactatctatctacttggattttatgaagaccctaaaggcagctaaaattagagtatctgttattggattgtctgcagaagttcgcgtttgcactgtacttgctcgtgaaactggtggtatatatataatttatttaatatttgcttataattactgtgtaggaaataatttattaattaaattaggatgttttaatctgttctgagctactaaacttaaagtagtctaaaatatgggcagtcatcttaaatatatcattgattccataagaaatcatctccaaatgcaaagagttttcagtacttatgtcagtatttagaggaggtattataactcttggaaagctggaaattttactgtatgtaattctttataaagattttataacttgtctttaattaaattgtaattacaggccaggcatgatagctcatgcctgtaatctcaacattttggtaggccaaggcaggagaatcacttgaggccagaagtttgagatcagtctggttaacatagtgagacctgtctctatttatatgttaaaataataataatagtaataataatcaattgtaattatagttattcctagagaagttgatttagatatattacttaaataaggtt

SEQ ID NO: 356529 - DNA, 2319 bp, Homo sapiens
aagtgctgggattacaggcgtgagtcactacacccggcctcatttgagtttttaagaataggtcattgtctgtgttgtttgaaatttatttattcattctttctttttttttttattcaaagccaaatacttctgagatttagtgatttttgaatctgtgtatgaagctgccctggaaattctatcccaaggagcaagtactcatatatgtaatgctgaaagaacaaatgtagttttttcctttctgcttgtcttatctgtgtcatttgacatatttttttaaaggtttacttgaaagggaaatatgtttgcaattgtgaggtcattccctaagaataattaaatcgatgttaaatttttatgcttctctttttaattgaatcaatcaggtggtcttgctaagcattcaaaagtagcgctggtttgaagctcatatgtctttcctaaaccttagaatgaaataattgagagcgaactgtaatagaatagactttaaagactcaaaaacaaaaccattccctcatttctaagggatagttttggggaaaaaattaattgccttagatttgagaatatagagtacattggaagtaataaagtaggtagtgggaaaaaattggtagagatataaaagagcaaagcacaccttgaatgtcatctagctgtgctgtaattaacttttggaaactagtttatcacttttcttcttttcactacaggtttatgtttgtgctgtgtgccaaaatgttttctgtgtggactgtgatgtttttgttcatgattctctacactgttgccctggctgtattcataagattccagctccttcaggtgtttgattccagcatgtagtatacattgtatgtgttaaaaagaaatttgcaactgtgaataaaaggacttctttagaagaagcttcatttaaaacatgaaaggataatctgacttaagaaactttttgctaagaaaaggtaatattttattaaattttaaatttgtgttgtcacagaaatacctgaaattcagtagtacttcattcaattaattttgttttctattattttgagttatactgttttcaaagtcattatgcagtatgtataaacttataagaattaaattgatgtgataattttatgtttttataattaaatatagaatctttatgatttatgttaattcattaatttagtgtaagaagaaagttaagtctgaatgtaaattcagtgtaagatgaaaatttatcaatacttatgaaattaggctgggcgctgtggctcacgcctgtaatcccaacactttgggaggctgaggtgggcagatcacttgaggtcaggagttcgagaccagcctggccagcatggtgaaaccccgtcactactaaaaatacaaagaataattagccgggcatggtggttcacgcctggagtcccagctacttgggaggctgaggcaggagaatcgcttgaacccaggaggcggaggttgcagggagccgagattgtgccactgcactccaccctagagtgagactccctctcaaaaaaaaaaaaagttatgaaattaatacatatgaaatgatgtactgctacatccaccagagaggtctttttaggtttaaccaaacatctggaatatgtttatcaagttagtacatctgaaattatttgtggctatgaccaacagaagtcactttacattaaacattcaaactcacaagactgccatggccatacttggtacccgcttactcagaaggatattaaacagaaacaacagcctgccagcacagcatcaagcagtcctcattagcagtggaagtccttgtagcagtccactagtacaatttgggtgcaaggagataagatcctccacaggcatcaaggaaccaatatctcttaacaattccataaacacagcttccaggtatccacaagggatgtgtcaatttcaagagtcactacactcaggaaagcctaaagcttgaagactccatttatttatagtgcatcccaatccagatacgtaacaattaacgagttatttttactataagcaaagttgcctaaaatcatagttgatactaaccatggttaacagagctctaaagtttgacagaaagtgagattcaaatcctttcactctcatatgctaaaccttttgccttactctgggtcatcagagaaatttaggtgagaatgtatgatgaagtctgtgttttagattcaatgcagatatatcattgtgggcagaactctttctggttatatccagttaagagtaaatcaggctttcagccgggcgcggtggctcacgcct

SEQ ID NO: 356530 - DNA, 1736 bp, Homo sapiens
cccccccccggggggcacggtttcccccaataattgctcccttggaatgctttcccaaaaattccccccccagaagaatataatggagaaagatttggtaatgaatgtccggggggaattgaaaagacccaaccatgtttatgtttgtgctgtgtgccaaaatgttttctgtgtggactgtgatgtttttgttcatgattctctacactgttgccctggctgtattcataagattccagctccttcaggtgtttgattccagcatgtagtatacattgtatgtgttaaaaagaaatttgcaactgtgaataaaaggacttctttagaagaagcttcatttaaaacatgaaaggataatctgacttaagaaactttttgctaagaaaaggtaatattttattaaattttaaatttgtgttgtcacagaaatacctgaaattcagtagtacttcattcaattaattttgttttctattattttgagttatactgttttcaaagtcattatgcagtatgtataaacttataagaattaaattgatgtgataattttatgtttttataattaaatatagaatctttatgatttatgttaattcattaatttagtgtaagaagaaagttaagtctgaatgtaaattcagtgtaagatgaaaatttatcaatacttatgaaattaggctgggcgctgtggctcacgcctgtaatcccaacactttgggaggctgaggtgggcagatcacttgaggtcaggagttcgagaccagcctggccagcatggtgaaaccccgtcactactaaaaatacaaagaataattagccgggcatggtggttcacgcctggagtcccagctacttgggaggctgaggcaggagaatcgcttgaacccaggaggcggaggttgcagggagccgagattgtgccactgcactccaccctagagtgagactccctctcaaaaaaaaaaaaagttatgaaattaatacatatgaaatgatgtactgctacatccaccagagaggtctttttaggtttaaccaaacatctggaatatgtttatcaagttagtacatctgaaattatttgtggctatgaccaacagaagtcactttacattaaacattcaaactcacaagactgccatggccatacttggtacccgcttactcagaaggatattaaacagaaacaacagcctgccagcacagcatcaagcagtcctcattagcagtggaagtccttgtagcagtccactagtacaatttgggtgcaaggagataagatcctccacaggcatcaaggaaccaatatctcttaacaattccataaacacagcttccaggtatccacaagggatgtgtcaatttcaagagtcactacactcaggaaagcctaaagcttgaagactccatttatttatagtgcatcccaatccagatacgtaacaattaacgagttatttttactataagcaaagttgcctaaaatcatagttgatactaaccatggttaacagagctctaaagtttgacagaaagtgagattcaaatcctttcactctcatatgctaaaccttttgccttactctgggtcatcagagaaatttaggtgagaatgtatgatgaagtctgtgttttagattcaatgcagatatatcattgtgggcagaactctttctggttatatccagttaagagtaaatcaggctttcagccgggcgcggtggctcacgcct

SEQ ID NO: 356531 - DNA, 1180 bp, Homo sapiens
caggcaattagaaaaagagtatttgagcaccatggacaagttcgacttggaatagctggaaagcggcggagaggagtgtcgggcggagtttccggctgagagtccttctagcggcgccggctggagtgcagtggcacaaccttggctcgctccagtgtctacctcccaggttcaagtgattctcctgcctcagcctcccgagtagctgggattacagattattgaataataaaatacagttttgaaaaaaatggatgaagaacctgaaagaactaagcgatgggaaggaggctatgaaagaacatgggagattcttaaagaagatgaatctggatcacttaaagctacaatagaagacattctattcaaggcaaagagaaaaagagtatttgagcaccatggacaagttcgacttggaatgatgcgccacctttatgtggtagtagatggatcaagaacaatggaagaccaagatttaaagcctaatagactgacgtgtactttaaagttgttggaatactttgtagaggaatattttgatcaaaatcctattagtcagattggaataattgtaactaagagtaaaagagctgaaaaattgactgaactttcaggaaacccaagaaaacatataacgtctttgaagaaagctgtggatatgacctgccatggagagccatctctttataattccctaagcatggctatgcagactctaaagttagtattatacattatgtataattgaattagaagttttttaaatgagttaagctgaagtgatgtgttaatatggggcccataaacccagctataacaaaattgttaagtacaagaattatgtagtgttatttatgatgtttagtgtggtgttggttagtaatctttattttacattttagtaagatattgttaaaggttttataaaaatataatttaaaactgtcggcagtatcaatagtacaaaaaatatgttgatgaaaaaatattttattaaaatgagatttaatatagtataataattgtaagttggttgtacctttattaacatttattaatttattttgaaagtaatggccaaaaccacagttccttttgcaccaatgtcatatatctgtaaattaatagatatggcaagttcagctatatggaatagagctaagaccccaaaggaaatact

SEQ ID NO: 356532 - DNA, 465 bp, Homo sapiens
tctacagtttgtcatgtgacacatctataaagcatttttgttcttttacaaatcgtaaaaagacgcttatttttattggtaccaagtttgtgtataagttcatattatttcttggaaatgagaaatggagttctatgaagatttttaagacaattattgagtaaaatacaaagaataagatgacctggcattccatttttttttacttcatatatgtgtctaattttcaaatttaattggatgaattttgtaacaaacatctttagataacttacattctaatggtttttacagattattgaataataaaatacagttttgaaaaaaatggatgaagaacctgaaagaactaagcgatgggaaggaggctatgaaagaacatggtaaggagagctttattgccctgtcttttcttttagacaatgtctttttttttctttacaactttattaaagtatattttac

SEQ ID NO: 356533 - DNA, 2981 bp, Homo sapiens
caggcaattagaaaaagagtatttgagcaccatggacaagttcgacttggaatagctggaaagcggcggagaggagtgtcgggcggagtttccggctgagagtccttctagcggcgccggtgagtccgcgtgtggaagtctgtgaggcgcagaggtggggcaggccgtctggctagctaggcggctgggagcgttttcgtggcggggaacggaggttgaattgccctgcctgggctcatagggaaggaggatgtgaaggagcttgtgaaggcagaggaagattattgaataataaaatacagttttgaaaaaaatggatgaagaacctgaaagaactaagcgatgggaaggaggctatgaaagaacatgggagattcttaaagaagatgaatctggatcacttaaagctacaatagaagacattctattcaaggcaaagagaaaaagagtatttgagcaccatggacaagttcgacttggaatgatgcgccacctttatgtggtagtagatggatcaagaacaatggaagaccaagatttaaagcctaatagactgacgtgtactttaaagttgttggaatactttgtagaggaatattttgatcaaaatcctattagtcagattggaataattgtaactaagagtaaaagagctgaaaaattgactgaactttcaggaaacccaagaaaacatataacgtctttgaagaaagctgtggatatgacctgccatggagagccatctctttataattccctaagcatggctatgcagactctaaaacacatgcctggacatacaagtcgagaagtactaatcatctttagcagccttacaacttgcgatccatctaatatttatgatctaatcaagaccctaaaggcagctaaaattagagtatctgttattggattgtctgcagaagttcgcgtttgcactgtacttgctcgtgaaactggtggcacgtaccatgttattttagatgaaagccattacaaagagttgctcacacatcatgttagtcctcctcctgctagctcaagttctgaatgctcacttattcgtatgggatttcctcagcacaccattgcttctttatctgaccaggatgcaaaaccctctttcagcatggcgcatttggatggcaatactgagccagggcttacattaggaggctatttctgcccacagtgtcgggcaaagtactgtgagctacctgttgaatgtaaaatctgtggtcttactttggtgtctgctccccacttggcacggtcttaccatcatttgtttcctttggatgcttttcaagaaattcccctagaagaatataatggagaaagattttgttatggatgtcagggggaattgaaagaccaacatgtttatgtttgtgctgtgtgccaaaatgttttctgtgtggactgtgatgtttttgttcatgattctctacactgttgccctggctgtattcataagattccagctccttcaggtgtttgattccagcatgtagtatacattgtatgtgttaaaaagaaatttgcaactgtgaataaaaggacttctttagaagaagcttcatttaaaacatgaaaggataatctgacttaagaaactttttgctaagaaaaggtaatattttattaaattttaaatttgtgttgtcacagaaatacctgaaattcagtagtacttcattcaattaattttgttttctattattttgagttatactgttttcaaagtcattatgcagtatgtataaacttataagaattaaattgatgtgataattttatgtttttataattaaatatagaatctttatgatttatgttaattcattaatttagtgtaagaagaaagttaagtctgaatgtaaattcagtgtaagatgaaaatttatcaatacttatgaaattaggctgggcgctgtggctcacgcctgtaatcccaacactttgggaggctgaggtgggcagatcacttgaggtcaggagttcgagaccagcctggccagcatggtgaaaccccgtcactactaaaaatacaaagaataattagccgggcatggtggttcacgcctggagtcccagctacttgggaggctgaggcaggagaatcgcttgaacccaggaggcggaggttgcagggagccgagattgtgccactgcactccaccctagagtgagactccctctcaaaaaaaaaaaaagttatgaaattaatacatatgaaatgatgtactgctacatccaccagagaggtctttttaggtttaaccaaacatctggaatatgtttatcaagttagtacatctgaaattatttgtggctatgaccaacagaagtcactttacattaaacattcaaactcacaagactgccatggccatacttggtacccgcttactcagaaggatattaaacagaaacaacagcctgccagcacagcatcaagcagtcctcattagcagtggaagtccttgtagcagtccactagtacaatttgggtgcaaggagataagatcctccacaggcatcaaggaaccaatatctcttaacaattccataaacacagcttccaggtatccacaagggatgtgtcaatttcaagagtcactacactcaggaaagcctaaagcttgaagactccatttatttatagtgcatcccaatccagatacgtaacaattaacgagttatttttactataagcaaagttgcctaaaatcatagttgatactaaccatggttaacagagctctaaagtttgacagaaagtgagattcaaatcctttcactctcatatgctaaaccttttgccttactctgggtcatcagagaaatttaggtgagaatgtatgatgaagtctgtgttttagattcaatgcagatatatcattgtgggcagaactctttctggttatatccagttaagagtaaatcaggctttcagccgggcgcggtggctcacgcct

SEQ ID NO: 356534 - DNA, 1633 bp, Homo sapiens
gcggaatgacttccggggcgcccctaaagcggcggagaggagtgtcgggcggagtttccggctgagagtccttctagcggcgccgattattgaataataaaatacagttttgaaaaaaatggatgaagaacctgaaagaactaagcgatgggaaggaggctatgaaagaacatgggagattcttaaagaagatgaatctggatcacttaaagctacaatagaagacattctattcaaggcaaagagaaaaagagtatttgagcaccatggacaagttcgacttggaatgatgcgccacctttatgtggtagtagatggatcaagaacaatggaagaccaagatttaaagcctaatagactgacgtgtactttaaagttgttggaatactttgtagaggaatattttgatcaaaatcctattagtcagattggaataattgtaactaagagtaaaagagctgaaaaattgactgaactttcaggaaacccaagaaaacatataacgtctttgaagaaagctgtggatatgacctgccatggagagccatctctttataattccctaagcatggctatgcagactctaaaacacatgcctggacatacaagtcgagaagtactaatcatctttagcagccttacaacttgcgatccatctaatatttatgatctaatcaagaccctaaaggcagctaaaattagagtatctgttattggattgtctgcagaagttcgcgtttgcactgtacttgctcgtgaaactggtggcacgtaccatgttattttagatgaaagccattacaaagagttgctcacacatcatgttagtcctcctcctgctagctcaagttctgaatgctcacttattcgtatgggatttcctcagcacaccattgcttctttatctgaccaggatgcaaaaccctctttcagcatggcgcatttggatggcaatactgagccagggcttacattaggaggctatttctgcccacagtgtcgggcaaagtactgtgagctacctgttgaatgtaaaatctgtggtcttactttggtgtctgctccccacttggcacggtcttaccatcatttgtttcctttggatgcttttcaagaaattcccctagaagaatataatggagaaagattttgttatggatgtcagggggaattgaaagaccaacatgtttatgtttgtgctgtgtgccaaaatgttttctgtgtggactgtgatgtttttgttcatgattctctacactgttgccctggctgtattcataagattccagctccttcaggtgtttgattccagcatgtagtatacattgtatgtgttaaaaagaaatttgcaactgtgaataaaaggacttctttagaagaagcttcatttaaaacatgaaaggataatctgacttaagaaactttttgctaagaaaaggtaatattttattaaattttaaatttgtgttgtcacagaaatacctgaaattcagtagtacttcattcaattaattttgttttctattattttgagttatactgttttcaaagtcattatgcagtatgtataaacttataagaattaaattgatgtgataattttatgtttttataattaaatatagaatcttta

SEQ ID NO: 356535 - DNA, 2046 bp, Homo sapiens
caggcaattagaaaaagagtatttgagcaccatggacaagttcgacttggaatagctggaaagcggcggagaggagtgtcgggcggagtttccggctgagagtccttctagcggcgccggtgagtccgcgtgtggaagtctgtgaggcgcagaggtggggcaggccgtctggctagctaggcggctgggagcgttttcgtggcggggaacggaggttgaattgccctgcctgggctcatagggaaggaggatgtgaaggagcttgtgaaggcagaggaagattattgaataataaaatacagttttgaaaaaaatggatgaagaacctgaaagaactaagcgatgggaaggaggctatgaaagaacatgggagattcttaaagaagatgaatctggatcacttaaagctacaatagaagacattctattcaaggcaaagagaaaaagagtatttgagcaccatggacaagttcgacttggaatgatgcgccacctttatgtggtagtagatggatcaagaacaatggaagaccaagatttaaagcctaatagactgacgtgtactttaaagttgttggaatactttgtagaggaatattttgatcaaaatcctattagtcagattggaataattgtaactaagagtaaaagagctgaaaaattgactgaactttcaggaaacccaagaaaacatataacgtctttgaagaaagctgtggatatgacctgccatggagagccatctctttataattccctaagcatggctatgcagactctaaaacacatgcctggacatacaagtcgagaagtactaatcatctttagcagccttacaacttgcgatccatctaatatttatgatctaatcaaggtagaccaaaaaatcaaaaccaaagttataactgtaaagagaattctgtagcaaattgatttatatatatatgtatttttgtatgtgtgattcatctttgtggtagatgtattgaatttattactagttttcagagcattctttatttttcaaatacattaaatcttaaatgtttttcttctttcctaaaactatctatctacttggattttatgaagaccctaaaggcagctaaaattagagtatctgttattggattgtctgcagaagttcgcgtttgcactgtacttgctcgtgaaactggtggcacgtaccatgttattttagatgaaagccattacaaagagttgctcacacatcatgttagtcctcctcctgctagctcaagttctgaatgctcacttattcgtatgggatttcctcagcacaccattgcttctttatctgaccaggatgcaaaaccctctttcagcatggcgcatttggatggcaatactgagccagggcttacattaggaggctatttctgcccacagtgtcgggcaaagtactgtgagctacctgttgaatgtaaaatctgtggtcttactttggtgtctgctccccacttggcacggtcttaccatcatttgtttcctttggatgcttttcaagaaattcccctagaagaatataatggagaaagattttgttatggatgtcagggggaattgaaagaccaacatgtttatgtttgtgctgtgtgccaaaatgttttctgtgtggactgtgatgtttttgttcatgattctctacactgttgccctggctgtattcataagattccagctccttcaggtgtttgattccagcatgtagtatacattgtatgtgttaaaaagaaatttgcaactgtgaataaaaggacttctttagaagaagcttcatttaaaacatgaaaggataatctgacttaagaaactttttgctaagaaaaggtaatattttattaaattttaaatttgtgttgtcacagaaatacctgaaattcagtagtacttcattcaattaattttgttttctattattttgagttatactgttttcaaagtcattatgcagtatgtataaacttataagaattaaattgatgtgataattttatgtttttataattaaatatagaatcttta

SEQ ID NO: 356536 - DNA, 1681 bp, Homo sapiens
caggcaattagaaaaagagtatttgagcaccatggacaagttcgacttggaatagctggaaagcggcggagaggagtgtcgggcggagtttccggctgagagtccttctagcggcgccggtgagtccgcgtgtggaagtctgtgaggcgcagaggtggggcaggccgtctggctagctaggcggctgggagcgttttcgtggcggggaacggaggttgaattgccctgcctgggctcatagggaaggaggatgtgaaggagcttgtgaaggcagaggaagattattgaataataaaatacagttttgaaaaaaatggatgaagaacctgaaagaactaagcgatgggaaggaggctatgaaagaacatgggagattcttaaagaagatgaatctggatcacttaaagctacaatagaagacattctattcaaggcaaagagaaaaagagtatttgagcaccatggacaagttcgacttggaatgatgcgccacctttatgtggtagtagatggatcaagaacaatggaagaccaagatttaaagcctaatagactgacgtgtactttaaagttgttggaatactttgtagaggaatattttgatcaaaatcctattagtcagattggaataattgtaactaagagtaaaagagctgaaaaattgactgaactttcaggaaacccaagaaaacatataacgtctttgaagaaagctgtggatatgacctgccatggagagccatctctttataattccctaagcatggctatgcagactctaaaacacatgcctggacatacaagtcgagaagtactaatcatctttagcagccttacaacttgcgatccatctaatatttatgatctaatcaagaccctaaaggcagctaaaattagagtatctgttattggattgtctgcagaagttcgcgtttgcactgtacttgctcgtgaaactggtggcacgtaccatgttattttagatgaaagccattacaaagagttgctcacacatcatgttagtcctcctcctgctagctcaagttctgaatgctcacttattcgtatgggatttcctcagcacaccattgcttctttatctgaccaggatgcaaaaccctctttcagcatggctcatttgtttcctttggatgcttttcaagaaattcccctagaagaatataatggagaaagattttgttatggatgtcagggggaattgaaagaccaacatgtttatgtttgtgctgtgtgccaaaatgttttctgtgtggactgtgatgtttttgttcatgattctctacactgttgccctggctgtattcataagattccagctccttcaggtgtttgattccagcatgtagtatacattgtatgtgttaaaaagaaatttgcaactgtgaataaaaggacttctttagaagaagcttcatttaaaacatgaaaggataatctgacttaagaaactttttgctaagaaaaggtaatattttattaaattttaaatttgtgttgtcacagaaatacctgaaattcagtagtacttcattcaattaattttgttttctattattttgagttatactgttttcaaagtcattatgcagtatgtataaacttataagaattaaattgatgtgataattttatgtttttataattaaatatagaatcttta

SEQ ID NO: 356537 - DNA, 1869 bp, Homo sapiens
caggcaattagaaaaagagtatttgagcaccatggacaagttcgacttggaatagctggaaagcggcggagaggagtgtcgggcggagtttccggctgagagtccttctagcggcgccggtgagtccgcgtgtggaagtctgtgaggcgcagaggtggggcaggccgtctggctagctaggcggctgggagcgttttcgtggcggggaacggaggttgaattgccctgcctgggctcatagggaaggaggatgtgaaggagcttgtgaaggcagaggaagattattgaataataaaatacagttttgaaaaaaatggatgaagaacctgaaagaactaagcgatgggaaggaggctatgaaagaacatgggagattcttaaagaagatgaatctggatcacttaaagctacaatagaagacattctattcaaggcaaagagaaaaagagtatttgagcaccatggacaagttcgacttggaatgatgcgccacctttatgtggtagtagatggatcaagaacaatggaagaccaagatttaaagcctaatagactgacgtgtactttaaagttgttggaatactttgtagaggaatattttgatcaaaatcctattagtcagattggaataattgtaactaagagtaaaagagctgaaaaattgactgaactttcaggaaacccaagaaaacatataacgtctttgaagaaagctgtggatatgacctgccatggagagccatctctttataattccctaagcatggctatgcagactctaaaacacatgcctggacatacaagtcgagaagtactaatcatctttagcagccttacaacttgcgatccatctaatatttatgatctaatcaagaccctaaaggcagctaaaattagagtatctgttattggattgtctgcagaagttcgcgtttgcactgtacttgctcgtgaaactggtggcacgtaccatgttattttagatgaaagccattacaaagagttgctcacacatcatgttagtcctcctcctgctagctcaagttctgaatgctcacttattcgtatgggatttcctcagcacaccattgcttctttatctgaccaggatgcaaaaccctctttcagcatggcgcatttggatggcaatactgagccagggcttacattaggaggctatttctgcccacagtgtcgggcaaagtactgtgagctacctgttgaatgtaaaatctgtggtcttactttggtgtctgctccccacttggcacggtcttaccatcatttgtttcctttggatgcttttcaagaaattcccctagaagaatataatggagaaaggtatttcagtttggactaatttatatctgttataagtggtaagctaatgtttgaatagattgttactaccttaaaaaataatctgattaacttggacaagagtacttctaatatggaagatgagataaagaatgccatagttatgattgaaatgactcgttgctaaatagatctgaatctccagaaaccaaataatttcactaaacccacctatgtataaataggggtgatgattgtactactaaatcagttttccagaaggaaaagaaaaaaagccctgattggtagtatttgctgatttccatggtttgaatactcccaccatggccaatttttagctacaattaacaaccagctttcttgaatacatatttaacaatatatccttttgatccagtacaatccagtcctagcacactactgaaaataagaggctcattcagcactttgggaggctgaggtgggaggatcacttgaggccaggagttgaagactagctggggcaacatagtgagacactgtctctta

SEQ ID NO: 356538 - DNA, 1243 bp, Homo sapiens
caggcaattagaaaaagagtatttgagcaccatggacaagttcgacttggaatagctggaaagcggcggagaggagtgtcgggcggagtttccggctgagagtccttctagcggcgccggtgagtccgcgtgtggaagtctgtgaggcgcagaggtggggcaggccgtctggctagctaggcggctgggagcgttttcgtggcggggaacggaggttgaattgccctgcctgggctcatagggaaggaggatgtgaaggagcttgtgaaggcagaggaagattattgaataataaaatacagttttgaaaaaaatggatgaagaacctgaaagaactaagcgatgggaaggaggctatgaaagaacatgggagattcttaaagaagatgaatctggatcacttaaagctacaatagaagacattctattcaaggcaaagagaaaaagagtatttgagcaccatggacaagttcgacttggaatgatgcgccacctttatgtggtagtagatggatcaagaacaatggaagaccaagatttaaagcctaatagactgacgtgtactttaaagttgttggaatactttgtagaggaatattttgatcaaaatcctattagtcagattggaataattgtaactaagagtaaaagagctgaaaaattgactgaactttcaggaaacccaagaaaacatataacgtctttgaagaaagctgtggatatgacctgccatggagagccatctctttataattccctaagcatggctatgcagactctaaagttagtattatacattatgtataattgaattagaagttttttaaatgagttaagctgaagtgatgtgttaatatggggcccataaacccagctataacaaaattgttaagtacaagaattatgtagtgttatttatgatgtttagtgtggtgttggttagtaatctttattttacattttagtaagatattgttaaaggttttataaaaatataatttaaaactgtcggcagtatcaatagtacaaaaaatatgttgatgaaaaaatattttattaaaatgagatttaatatagtataataattgtaagttggttgtacctttattaacatttattaatttattttgaaagtaatggccaaaaccacagttccttttgcaccaatgtcatatatctgtaaattaatagatatggcaagttcagctatatggaatagagctaagaccccaaaggaaatact

SEQ ID NO: 356539 - DNA, 1013 bp, Homo sapiens
caggcaattagaaaaagagtatttgagcaccatggacaagttcgacttggaatagctggaaagcggcggagaggagtgtcgggcggagtttccggctgagagtccttctagcggcgccggtgagtccgcgtgtggaagtctgtgaggcgcagaggtggggcaggccgtctggctagctaggcggctgggagcgttttcgtggcggggaacggaggttgaattgccctgcctgggctcatagggaaggaggatgtgaaggagcttgtgaaggcagaggaagattattgaataataaaatacagttttgaaaaaaatggatgaagaacctgaaagaactaagcgatgggaaggaggctatgaaagaacatgggagattcttaaagaagatgaatctggatcacttaaagctacaatagaagacattctattcaaggcaaagagaaaaagagtatttgagcaccatggacaagttcgacttggaatgatgcgccacctttatgtggtagtagatggatcaagaacaatggaagaccaagatttaaagcctaatagactgacgtgtactttaaaggtaaaatttaagtttatactaaatcatttaaatttgtaccaaaatcacttaaacttttactaaaaaagtggggaagaacactggattctaaaggatatttttaaagaatgcaatattttttattttttgccttgtatttttagttaatgctaatgatagctaagtagaagtactgccaggttatttagggaaattttaaaccaacatagctaattatttgtgtttttaatttctatcctcccaccccacatcaggatcttggtttatcagttatcccttttctttcttgaatcttcattctcctttgccttacttaactctgtctcctcagattacaaatatgttcgtattcctaatttatcaaaacctattctcaattctgctcgttctcccatctctcttcattggatcttttcctcattgaaatttcttctgacacatc

SEQ ID NO: 356540 - DNA, 734 bp, Homo sapiens
tctctctgtttcagacttttattacgttgccatggatttcggaggtcatgggctctcgtcccattacagcccaggtgtcccatattacctccagacttttgtgagtgagatccgaagagttgtggcaggtaagaaacagagtgtgtattttcggcggtgtggggggtgctctagggcaccccctcttatcactggaggcggggtaggatccaggaagcagcgctggcctgagagtggggcctgggctctggccccaggtctgccagcaattcacgggagatcttgggaaagttgaagagttcgcttcctccagtgggtcccccaagctagtgtcctgggtggacaccccagatgctgggaagggatttcctgagcctggggactagaagcaagatcgtgggctgagcctgtgcccagccggaccttctggctccttgcatttccagccttgaaatggaatcgattctccattctgggccacagcttcggtgagtacagtggccaggagctgaccgggcccggagtagggctgggagggaaggataggagctgctgccccacccctttcccctgcacttatgagatctgcaaagagagatgagagggtcagtcagaggttgaccactgtaccctctgacctcaggcaactgccgcaagggacacagggatgagggaaatgtggtcttttgagtggtcaggtctgatgaaggggacatcatggcccagatgctgag

SEQ ID NO: 356541 - DNA, 885 bp, Homo sapiens
agcggctcctgagtgggggcggggactgctggagttgcggggcctgcctggggtagggcggggcaggacagcttggagatagggcccggaattgcgggcgtcactctgctcctgcgacctagccaggcgtgagggagtgacagcagcgcattcgcgggacgagagcgatgagtgagaacgccgcaccagcttctcctgcaaagaggaaccacgaaggtggccacaggtctggttctgaacagagaccagaggctcgcctgggcagagaacagcattgacttcatcagcagggagctgtgtgcgcattccatcaggaagctgcaggcccatgtcctgttgatcaaagcagtccacggatattttgattcaagacagaattactctgagaaggagtccctgtcgttcatgatagacacgatgaaatccaccctcaaagagcagttccagtttgtggaagtcccaggcaatcactgtgtccacatgagcgaaccccagcacgtggccagtatcatcagctccttcttacagtgcacacacatgctcccagcccagctgtagctctgggcctggaactatgaagacctagtgctcccagactcaacactgggactctgagttcctgagccccacaacaaggccagggatggtggggacaggcctcactagtcttgaggcccagcctaggatggtagtcaggggaaggagcgagattccaacttcaacatctgtgacctcaagggggagacagagtctgggttccagggctgctttctcctggctaataataaatatccagccagctggaggaaggaagggcaggctgggcccacctagcctttccctgctgcccaactggatggaaaataaaaggttcttgtattctca

SEQ ID NO: 356542 - DNA, 745 bp, Homo sapiens
tttcttgcaaaggaacatttcacaattttcgtatcacgcttgcacaggggccacgctaatcatctctttgttgttccaatttagcagtatatgtgctgctgaagcaaagcacctaccttctatttatttatttatttagagaccaagtcttactctgtcatccagggtggagtgcggtggcccgagtttggctgcctgcaacttctgccttgtgacgagaattcaccatgtttttgtctctgcaggcagagaacagcattgacttcatcagcagggagctgtgtgcgcattccatcaggaagctgcaggcccatgtcctgttgatcaagtaagtctggacccatccccttcagccacccgccaaggagacatgggcgccaggaatctccgggagggggccctggcatgaggctccaagttctctgcgtgtcgaccacatcgctaaggctcaagatcttttttgggaagcccccctggcagcagggtcatggaaggaggaaggtcagaggaggggagggctcgggcagcaggggatgggccggggctgtcccatgcctttccacaggtgtcagcggggggcatgcccaggtaaggctccataaccagtgagcccagtctcggctgactgcaacctctgtctcctggattcaaacgattctcctgcctcagcctcccgagtagctgggactacaggcgcccgccaccaggcctggcttatttttgtatttttagtagagacgaggtt

SEQ ID NO: 356543 - DNA, 1223 bp, Homo sapiens
ctacaggcgcccgccaccacgcctggcttatttttgtatttttagtagagacgaggtttcgccatgttggccaggctgctctccatctcctgacctcatgatccgcctgcctcggcctcccagtgttgggattacaggcgagagccaccgtgcgtggcccaccatagacgatttttaagccataaaaagaaacgaagcactgacatgggctccagcatggatgagccttgaaaacatcgcactaagtggatgaagtcagacacaaccgtctacgtgttgtatggctgcattcacgttcaagtccaaataggacacacggcagagacaaagccaggtcatggttgctcaggaccggaagcctgttgggggtgggggggtggggtgtgtgtgtgtgtgtgtaagctcagaggtttgcgatttctttgggggcgatgaaaatgtcctgtaattgtgacgatggtctcacaactcaatgtattaaaaaccacagaattgtagactatcaacgggaggattgtgaagacataaattctctctcagagcaagtatgggctccagcgcctgttcagatcccagctctgcttttcagggctgactgtgaccaagtcctgaactccctgtgccccagaaaggctgtgccttcagcattcacttgtgcctggcttgtgccagctgagcatgagctgagattaactgagcctcaaatccaacccagggtcaagggacccagctgtgggagttggggtagcccaggctttggtttctcctcagaggcctgaacccagggcaggatgggggcaccgctgggaggcggttctaagatgaaccccaacaacccccaactcctcactttccagagcagtccacggatattttgattcaagacagaattactctgagaaggagtccctgtcgttcatgatagacacgatgaaatccaccctcaaagaggtaagacggggctcaggcagctggtgtccagccactgtcgcccactctggtcccacctcacccatctcttctcatgcactgggaagaccctgggtctgcccccaggcccaacaagtgaccaccaggatctatcaggcctcatgctccactgtggtcagtccctagaggcctagggacacatgtaatcagaattaaggaaacagagacctttggtggggaacccctgccaggttcaagctactctcgtgcctcagcctcctgagtagctggga

SEQ ID NO: 356544 - DNA, 1223 bp, Homo sapiens
atgagacacaggagcgacacaaacgaaagatgttttttcctcgaccccaaacaccttataacaaaagggggggtggggtgtgtgtgtgtgtgtgtaagctcagaggtttgcgatttctttgggggtgatgaaaatgtaattgtgacgatggtctcacaactcaatgtattaaaaaccacgggattgtagacttttttttttttttttttgagatggagtctggctctgtcgcccaggctggagtgtagtggtgcaatctcagctcactgcaaggtccgcctcccgggttcacgccattctcctgcctcagcctccggagtagctgggactacaggcacccaccaccaagcccggctaatttttgtatttttagtacagacagggtttcaccatgttagccaggatggtctcatctcctgacctcgtgatccacccgcctcagcctcccaaagtgctgggattacaggcgtgagccaccatacccggccaggattgtagactttcaatgggaggattgtgaagacataaattctctctcagagcaagtgtgggctccagcgcctgttcagatcccagctctgctgttcagggctgactgtgaccaagtcctgaactccctgcgccccagcaaggctgtgccttcagcacttgcttgcgcctggcttgtgccagctgagcgtgagctgagattaactgagcctcaaatccaacccagggtcaagggacccagctgtgggagttggggtagcccaggctttggtttctcctcagaggcctgaacccagggcaggatgggggcaccgctgggaggcggttctaagatgaaccccaacaacccccaactcctcactttccagagcagtccacggatattttgattcaagacagaattactctgagaaggagtccctgtcgttcatgatagacacgatgaaatccaccctcaaagaggtaagacggggctcaggcagctggtgtccagccactgtcgcccactctggtcccacctcacccatctcttctcatgcactgggaagaccctgggtctgcccccaggcccaacaagtgaccaccaggatctatcaggcctcatgctccactgtggtcagtccctagaggcctagggacacatgtaatcagaattaaggaaacagagacctttggtggggaacccctgccaggttcaagctactctcgtgcctcagcctcctgagtagctggga

SEQ ID NO: 356545 - DNA, 1165 bp, Homo sapiens
aaaagaacattctggcacgtgggtggagaacagaagcaggggcaagaggagaaggagggcaaccgagtaggagggcctataacagcccaggtctgatctcagagctgaagctggctgtgccctggggccacatcgcagccaaagcctggggctccctgcagggccctccagttctctgcctgcacggctggctggacaatgccagctccttcgacagactcatccctcttctcccgcaagacttttattacgttgccatggatttcggaggtcatgggctctcgtcccattacagcccaggtgtcccatattacctccagacttttgtgagtgagatccgaagagttgtggcagccttgaaatggaatcgattctccattctgggccacagcttcggtggcgtcgtgggcggaatgtttttctgtaccttccccgagatggtggataaacttatcttgctggacacgccgctctttctcctggaatcagatgaaatggagaacttgctgacctacaagcggagagccatagagcacgtgctgcaggtagaggcctcccaggagccctcgcacgtgttcagcctgaagcagctgctgcagaggttactgaagagcaatagccacttgagtgaggagtgcggggagcttctcctgcaaagaggaaccacgaaggtggccacaggtctggttctgaacagagaccagaggctcgcctgggcagagaacagcattgacttcatcagcagggagctgtgtgcgcattccatcaggaagctgcaggcccatgtcctgttgatcaaagcagtccacggatattttgattcaagacagaattactctgagaaggagtccctgtcgttcatgatagacacgatgaaatccaccctcaaagaggtaagacggggctcaggcagctggtgtccagccactgtcgcccactctggtcccacctcacccatctcttctcatgcactgggaagaccctgggtctgcccccaggcccaacaagtgaccaccaggatctatcaggcctcatgctccactgtggtcagtccctagaggcctagggacacatgtaatcagaattaaggaaacagagacctttggtggggaacccctgccaggttcaagctactctcgtgcctcagcctcctgagtagctggga

SEQ ID NO: 356546 - DNA, 132 bp, Homo sapiens
acttttattacgttgccatggatttcggaggtcatgggctctcgtcccattacagcccaggtgtcccatattacctccagacttttgtgagtgagatccgaagagttgtggcaggtaagaaacagagtgtgt

SEQ ID NO: 356547 - DNA, 1439 bp, Homo sapiens
agcggctcctgagtgggggcggggactgctggagttgcggggcctgcctggggtagggcggggcaggacagcttggagatagggcccggaattgcgggcgtcactctgctcctgcgacctagccaggcgtgagggagtgacagcagcgcattcgcgggacgagagcgatgagtgagaacgccgcaccaggtctgatctcagagctgaagctggctgtgccctggggccacatcgcagccaaagcctggggctccctgcagggccctccagttctctgcctgcacggctggctggacaatgccagctccttcgacagactcatccctcttctcccgcaagacttttattacgttgccatggatttcggaggtcatgggctctcgtcccattacagcccaggtgtcccatattacctccagacttttgtgagtgagatccgaagagttgtggcagccttgaaatggaatcgattctccattctgggccacagcttcggtggcgtcgtgggcggaatgtttttctgtaccttccccgagatggtggataaacttatcttgctggacacgccgctctttctcctggaatcagatgaaatggagaacttgctgacctacaagcggagagccatagagcacgtgctgcaggtagaggcctcccaggagccctcgcacgtgttcagcctgaagcagctgctgcagaggttactgaagagcaatagccacttgagtgaggagtgcggggagcttctcctgcaaagaggaaccacgaaggtggccacaggtctggttctgaacagagaccagaggctcgcctgggcagagaacagcattgacttcatcagcagggagctgtgtgcgcattccatcaggaagctgcaggcccatgtcctgttgatcaaagcagtccacggatattttgattcaagacagaattactctgagaaggagtccctgtcgttcatgatagacacgatgaaatccaccctcaaagagcagttccagtttgtggaagtcccaggcaatcactgtgtccacatgagcgaaccccagcacgtggccagtatcatcagctccttcttacagtgcacacacatgctcccagcccagctgtagctctgggcctggaactatgaagacctagtgctcccagactcaacactgggactctgagttcctgagccccacaacaaggccagggatggtggggacaggcctcactagtcttgaggcccagcctaggatggtagtcaggggaaggagcgagattccaacttcaacatctgtgacctcaagggggagacagagtctgggttccagggctgctttctcctggctaataataaatatccagccagctggaggaaggaagggcaggctgggcccacctagcctttccctgctgcccaactggatggaaaataaaaggttcttgtattctca

SEQ ID NO: 356548 - DNA, 1280 bp, Homo sapiens
agcggctcctgagtgggggcggggactgctggagttgcggggcctgcctggggtagggcggggcaggacagcttggagatagggcccggaattgcgggcgtcactctgctcctgcgacctagccaggcgtgagggagtgacagcagcgcattcgcgggacgagagcgatgagtgagaacgccgcaccaggtctgatctcagagctgaagctggctgtgccctggggccacatcgcagccaaagcctggggctccctgcagggccctccagttctctgcctgcacggctggctggacaatgccagctccttcgacagactcatccctcttctcccgcaagacttttattacgttgccatggatttcggaggtcatgggctctcgtcccattacagcccaggtgtcccatattacctccagacttttgtgagtgagatccgaagagttgtggcagccttgaaatggaatcgattctccattctgggccacagcttcggtggcgtcgtgggcggaatgtttttctgtaccttccccgagatggtggataaacttatcttgctggacacgccgctctttctcctggaatcagatgaaatggagaacttgctgacctacaagcggagagccatagagcacgtgctgcaggtagaggcctcccaggagccctcgcacgtgttcagcctgaagcagctgctgcagaggttactgaagagcaatagccacttgagtgaggagtgcggggagcttctcctgcaaagaggaaccacgaaggtggccacaggcagagaacagcattgacttcatcagcagggagctgtgtgcgcattccatcaggaagctgcaggcccatgtcctgttgatcaagtaagtctggacccatccccttcagccacccgccaaggagacatgggcgccaggaatctccgggagggggccctggcatgaggctccaagttctctgcgtgtcgaccacatcgctaaggctcaagatcttttttgggaagcccccctggcagcagggtcatggaaggaggaaggtcagaggaggggagggctcgggcagcaggggatgggccggggctgtcccatgcctttccacaggtgtcagcggggggcatgcccaggtaaggctccataaccagtgagcccagtctcggctgactgcaacctctgtctcctggattcaaacgattctcctgcctcagcctcccgagtagctgggactacaggcgcccgccaccaggcctggcttatttttgtatttttagtagagacgaggtt

SEQ ID NO: 356549 - DNA, 1957 bp, Homo sapiens
tctctctgtttcagacttttattacgttgccatggatttcggaggtcatgggctctcgtcccattacagcccaggtgtcccatattacctccagacttttgtgagtgagatccgaagagttgtggcaggtaagaaacagagtgtgtattttcggcggtgtggggggtgctctagggcaccccctcttatcactggaggcggggtaggatccaggaagcagcgctggcctgagagtggggcctgggctctggccccaggtctgccagcaattcacgggagatcttgggaaagttgaagagttcgcttcctccagtgggtcccccaagctagtgtcctgggtggacaccccagatgctgggaagggatttcctgagcctggggactagaagcaagatcgtgggctgagcctgtgcccagccggaccttctggctccttgcatttccagccttgaaatggaatcgattctccattctgggccacagcttcggtgagtacagtggccaggagctgaccgggcccggagtagggctgggagggaaggataggagctgctgccccacccctttcccctgcacttatgagatctgcaaagagagatgagagggtcagtctgatgaaggggacatcatggcccagatgctgagcccccagccacccatatggtgccccccccccccaactggtgggaagaagctttagggtatgcagctggggagggagtgagggaatgtcacccacagctcttttgtcccccaggtggcgtcgtgggcggaatggtgagtagatggctttgtctggccaactggggctcccttgggtggagtggggaggggagcacaaaggaggaaggagaaggtacctgggacagaaagtgcctcctcctgtcacagtgacagtccttataccaggaagttggtgtaaacggtggagactcctggtagagttcatgtttccacgcccccatacccggtcccaccgcaccctggagtccagccatcaccaaggtctggagctcagtgctgggtgcagacttaggggtggtgggggaaggcacaccatagatagaagattctcctctggcctcttggtcagcaccctccccccagcctaaaagatgtttcggggaactccagggtccccagggaaaggcgggagtgtcctttccttcttccccctattcattctccccttttggcatcctcacatgtttttctgtaccttccccgagatggtggataaacttatcttgctggacacgccgctctttctcctggaatcagatgaaatggagaacttgctgacctacaagcggagagccatagagcacgtgctgcaggtagaggcctcccaggagccctcgcacgtgttcagcctgaagcagctgctgcagaggttactgaagagcaatagccacttgagtgaggagtgcggggagcttctcctgcaaagaggaaccacgaaggtggccacaggtctggttctgaacagagaccagaggctcgcctgggcagagaacagcattgacttcatcagcagggagctgtgtgcgcattccatcaggaagctgcaggcccatgtcctgttgatcaaagcagtccacggatattttgattcaagacagaattactctgagaaggagtccctgtcgttcatgatagacacgatgaaatccaccctcaaagaggtaagacggggctcaggcagctggtgtccagccactgtcgcccactctggtcccacctcacccatctcttctcatgcactgggaagaccctgggtctgcccccaggcccaacaagtgaccaccaggatctatcaggcctcatgctccactgtggtcagtccctagaggcctagggacacatgtaatcagaattaaggaaacagagacctttggtggggaacccctgccaggttcaagctactctcgtgcctcagcctcctgagtagctggga

SEQ ID NO: 356550 - DNA, 1192 bp, Homo sapiens
  misc_feature (1)..(1): n is a, c, g, or t
  misc_feature (50)..(50): n is a, c, g, or t
ngaatcttgagaacattttgttgaatgaaataagccaataataaaaagcnaaatactgtatgatttcatttaaatgaggtatttagagtagtctaaatcatagagacagatagtagaatggtagttgctagacgctggggggaggggaaaagaggagtaattgtataatgggtatagagtttcttttttatgttttgagatggagtctcactctgtcgcccaggttcccaggttagagggcgacgctgcatcctccacctcctgggttcaagcgattctcctgcctcagcctcccgagtagctgggattacagacatgtgccaccacgcccagctaattttgtatttttagtagagacggggtttctccatgttggtcaggctggtctcgaattcccgacctcaggtaatccacctgccttggccccccaattataggtgtgagccacagcacccagccaaaaaagtaattttttttagagtaataatgctataatgttggtgtgattccaacctccagctccccccacccgctgcctgcggttttgtttctgttaaaacgtcacctgatgaaatagaatgaatcctgaaatgcacctctgggatcgggaatggtctgtgtgttatcagctgcgactggttcactgcgtctggacaagcctcatggggactggggattctggccagtgtaatttctgtcaaccacggacgtttgccttcatgtgtagaatttactgttgttatgcaaattatattttcaattataaatgaaacaagtttgcagatattttagaaatcagagaagggaaacatcacccacagtccctctgctggaacagccacagttggccttgtcctacttacgtccttcagtggatgcttctgggtgctggggttctccattcaggacactgcactctcggaggtgggaggagactgggttgcgtctgtgccgacctgggatgcagtttcaggtcagaatcagaagatgtgcaagttacgcatgacacagctttttaaagtgcttttcccctgcactaatcaagagggaggtcagccctcaggtgtgctggacccgggagggactgtgagctgtaagaagtaacgagccccttgaacttcacaagctggccagggagccatatcccgaatgccactgccacttcctcgtggtgcaaggcttgttgggacct

SEQ ID NO: 356551 - DNA, 879 bp, Homo sapiens
gcatctattaggcagaggtggggctttgttcttacccacaattggaagttctctatggagtaaaggcggtatgtgtgccacctgattcctttccccatgtgtatctggttagggtcggccacgtgagatccgcaagcattttagaaggtgggaggggaggtgggagctggctacaggccaggcgttggcgtggttccgtgagtgtgctccagccaggcccaaagcttctcctgcccagagggaccgtttcctccagcgtgggtcgggtgcttctgcgcccggaaagagcgccagctcctccttcgggtgacccagggagcggggctgcaggcaaaggcgcaggcggccaaaaaggtgccaaccgggtcctgtggctttcagttgtctctgcccacccaattcacaccatctttccccctcagccgcctgtcctgggacttcaggctcagcaccaaacgcagcaaaagtaggtgcacagagagcggggtcagctcacgcagcccgagcagaatggctgtgctgccgccccaggcccgcggccaccgctgtgtgtgtggcaggagtcagccccccagcgtggggccccgaagcccgcggtccttccacggggagggccaggcccgcagggcgcagacgatgggggacaggctgcgccagcgctcgcctgaggccccgcacacaaacctcaggcccatgggtccgctccgcggggcaggcgtcgtgggcccaaggaggccaggccaggagtctcggcctcggggttacgcggcggcgggcagctcttccgctccgctcagggtgctgctaacccacagccgagcagcgacccgcaggaccggcagacctcggccgattcacacccagccctacctagccttt

SEQ ID NO: 356552 - DNA, 2658 bp, Homo sapiens
gcatctattaggcagaggtggggctttgttcttacccacaattggaagttctctatggagtaaaggcggtatgtgtgccacctgattcctttccccatgtgtatctggttagggtcggccacgtgagatccgcaagcattttagaaggtgggaggggaggtgggagctggctacaggccaggcgttggcgtggttccgtgagtgtgctccagccaggcccaaagcttctcctgcccagagggaccgtttcctccagcgtgggtcgggtgcttctgcgcccggaaagagcgccagctcctccttcgggtgacccagggagcggggctgcaggcaaaggcgcaggcggccaaaaaggtgccaaccgggtcctgtggctttcagttgtctctgcccacccaattcacaccatctttccccctcagccgcctgtcctgggacttcaggctcagcaccaaacgcagcaaaagtaggtgcacagagagcggggtcagctcacgcagcccgagcagaatggctgtgctgccgccccaggcccgcggccaccgctgtgtgtgtggcaggagtcagccccccagcgtggggccccgaagcccgcggtccttccacggggagggccaggcccgcagggcgcagacgatgggggacaggctgcgccagcgctcgcctgaggccccgcacacaaacctcaggcccatgggtccgctccgcggggcaggcgtcgtgggcccaaggaggccaggccaggagtctcggcctcggggttacgcggcggcgggcagctcttccgctccgctcagggtgctgctaacccacagccgagcagcgacccgcaggaccggcgagaaccccgccactgcctccggccggaagagaacgtgcagagatgtacgtcacttccggggcgtggcgtggcgggcgtggcgtcccgcccctggcggcgtgcctggtgccctgttccgcgtctgtgcgaccgtccgtcccgagcgcgcagccgcggcaggccaggtcagagcagcccaccatgggatggggagggggtggaggctgcaccccgcgcccacccatccaccagcagccgccggagcgccgcgtggtcaccgttgtctttctcggcctcctgctggacctcctggccttcacgctgctgctgcccctgctgcccgggctgttggagagccacggccgtgcccacgaccccctctatggctcctggcagggcggggtggactggtttgccaccgccatcgggatgccagtggagaagaggtacaacagtgtcctgttcggaggtctcattggctcggcattctctgtcctgcagtttctgtgtgcgccactcactggggccacctctgactgcttggggaggcgcccggtgatgctgctgtgcctgatgggtgtggccacctcatatgcagtctgggccacctctcggagctttgcggccttcctggcctccaggctgattgggggcatcagcaaagggaacgtcagcctctccacggccatcgttgctgacctgggctcgcctctggcccgcagtcaaggcatggcggtcattggggtggccttctcactgggcttcaccctgggccctatgctcggagcctccctgcccctggaaatggcaccctggtttgccctgctcttcgcagcctccgacctgctgttcatcttctgcttcctgccagagacgctgcccctggagaaacgggcgccctctatcgccctggggttccgtgatgcggctgatctgctcagccccctggccctgctgcgcttctcggctgtcgctcgtggccaggacccaccctctggagacaggctcagcagcctgcgccgcctgggcctagtctacttcctctacctcttcctgttctcgggcctggagtacacgctgagcttcctcacacaccagcgcttccagttcagtagcctacagcaggggaagatgtttttcctcatcggcctcaccatggccaccatccagggtgcctatgcccggcggatccaccctggcggggaagttgctgccgtgaagcgggccctcctgctgctggtgcccgccttcctcctcatcggctggggacgttctctgcccgtgctgggcctggggctgctgctctactcctttgccgccgccgttgtggtgccctgcctgtcctccgtggtcgctggctatggctcaccagggcagaagggcacggtcatgggtacactgcgcagcctaggtgctctggccagggccgcggggcccctggtggccgcttcagtgtactggctggccggggcccaggcctgcttcaccacgtggtccgggctctttttgctccccttcttcctcctgcagaagctgagttacccggcacagacgctcaaggctgagtagctgagccactgtgcccaggctgtgggcaccaggcagagtgggagcctaggtcaggcccctgcccactgcctgacccccaccccccgccagtccagggagaccctgtgggtgggggccggcccctaagcaggaagctcaggcagctcctccagacttacttactccttcagtgactccgagctgcagcactccaaggctgtcagggcttctgtttgttttttaaactatgtaaccgtttgctgatataagacccgctatgcttcaccctc

SEQ ID NO: 356553 - DNA, 2557 bp, Homo sapiens
gcatctattaggcagaggtggggctttgttcttacccacaattggaagttctctatggagtaaaggcggtatgtgtgccacctgattcctttccccatgtgtatctggttagggtcggccacgtgagatccgcaagcattttagaaggtgggaggggaggtgggagctggctacaggccaggcgttggcgtggttccgtgagtgtgctccagccaggcccaaagcttctcctgcccagagggaccgtttcctccagcgtgggtcgggtgcttctgcgcccggaaagagcgccagctcctccttcgggtgacccagggagcggggctgcaggcaaaggcgcaggcggccaaaaaggtgccaaccgggtcctgtggctttcagttgtctctgcccacccaattcacaccatctttccccctcagccgcctgtcctgggacttcaggctcagcaccaaacgcagcaaaagtaggtgcacagagagcggggtcagctcacgcagcccgagcagaatggctgtgctgccgccccaggcccgcggccaccgctgtgtgtgtggcaggagtcagccccccagcgtggggccccgaagcccgcggtccttccacggggagggccaggcccgcagggcgcagacgatgggggacaggctgcgccagcgctcgcctgaggccccgcacacaaacctcaggcccatgggtccgctccgcggggcaggcgtcgtgggcccaaggaggccaggccaggagtctcggcctcggggttacgcggcggcgggcagctcttccgctccgctcagggtgctgctaacccacagccgagcagcgacccgcaggaccggcgagaaccccgccactgcctccggccggaagagaacgtgcagagatgtacgtcacttccggggcgtggcgtggcgggcgtggcgtcccgcccctggcggcgtgcctggtgccctgttccgcgtctgtgcgaccgtccgtcccgagcgcgcagccgcggcaggccaggtcagagcagcccaccatgggatggggagggggtggaggctgcaccccgcgcccacccatccaccagcagccgccggagcgccgcgtggtcaccgttgtctttctcggcctcctgctggacctcctggccttcacgctgctgctgcccctgctgcccgggctgttggagagccacggccgtgcccacgaccccctctatggctcctggcagggcggggtggactggtttgccaccgccatcgggatgccagtggagaagaggtacaacagtgtcctgttcggaggtctcattggctcggcattctctgtcctgcagtttctgtgtgcgccactcactggggccacctctgactgcttggggaggcgcccggtgatgctgctgtgcctgatgggtgtggccacctcatatgcagtctgggccacctctcggagctttgcggccttcctggcctccaggctgattgggggcatcagcaaagggaacgtcagcctctccacggccatcgttgctgacctgggctcgcctctggcccgcagtcaaggcatggcggtcattggggtggccttctcactgggcttcaccctgggccctatgctcggagcctccctgcccctggaaatggcaccctggtttgccctgctcttcgcagcctccgacctgctgttcatcttctgcttcctgccagagacgctgcccctggagaaacgggcgccctctatcgccctggggttccgtgatgcggctgatctgctcagccccctggccctgctgcgcttctcggctgtcgctcgtggccaggacccaccctctggagacaggctcagcagcctgcgccgcctgggcctagtctacttcctctacctcttcctgttctcgggcctggagtacacgctgagcttcctcacacaccagcgcttccagttcagtaggccctcctgctgctggtgcccgccttcctcctcatcggctggggacgttctctgcccgtgctgggcctggggctgctgctctactcctttgccgccgccgttgtggtgccctgcctgtcctccgtggtcgctggctatggctcaccagggcagaagggcacggtcatgggtacactgcgcagcctaggtgctctggccagggccgcggggcccctggtggccgcttcagtgtactggctggccggggcccaggcctgcttcaccacgtggtccgggctctttttgctccccttcttcctcctgcagaagctgagttacccggcacagacgctcaaggctgagtagctgagccactgtgcccaggctgtgggcaccaggcagagtgggagcctaggtcaggcccctgcccactgcctgacccccaccccccgccagtccagggagaccctgtgggtgggggccggcccctaagcaggaagctcaggcagctcctccagacttacttactccttcagtgactccgagctgcagcactccaaggctgtcagggcttctgtttgttttttaaactatgcaccaggtttctgatgatgaaataaagcacctgtttgttttataccaa

SEQ ID NO: 356554 - DNA, 2589 bp, Homo sapiens
gcatctattaggcagaggtggggctttgttcttacccacaattggaagttctctatggagtaaaggcggtatgtgtgccacctgattcctttccccatgtgtatctggttagggtcggccacgtgagatccgcaagcattttagaaggtgggaggggaggtgggagctggctacaggccaggcgttggcgtggttccgtgagtgtgctccagccaggcccaaagcttctcctgcccagagggaccgtttcctccagcgtgggtcgggtgcttctgcgcccggaaagagcgccagctcctccttcgggtgacccagggagcggggctgcaggcaaaggcgcaggcggccaaaaaggtgccaaccgggtcctgtggctttcagttgtctctgcccacccaattcacaccatctttccccctcagccgcctgtcctgggacttcaggctcagcaccaaacgcagcaaaagtaggtgcacagagagcggggtcagctcacgcagcccgagcagaatggctgtgctgccgccccaggcccgcggccaccgctgtgtgtgtggcaggagtcagccccccagcgtggggccccgaagcccgcggtccttccacggggagggccaggcccgcagggcgcagacgatgggggacaggctgcgccagcgctcgcctgaggccccgcacacaaacctcaggcccatgggtccgctccgcggggcaggcgtcgtgggcccaaggaggccaggccaggagtctcggcctcggggttacgcggcggcgggcagctcttccgctccgctcagggtgctgctaacccacagccgagcagcgacccgcaggaccggcgagaaccccgccactgcctccggccggaagagaacgtgcagagatgtacgtcacttccggggcgtggcgtggcgggcgtggcgtcccgcccctggcggcgtgcctggtgccctgttccgcgtctgtgcgaccgtccgtcccgagcgcgcagccgcggcaggccaggtcagagcagcccaccatgggatggggagggggtggaggctgcaccccgcgcccacccatccaccagcagccgccggagcgccgcgtggtcaccgttgtctttctcggcctcctgctggacctcctggccttcacgctgctgctgcccctgctgcccgggctgttggagagccacggccgtgcccacgaccccctctatggctcctggcagggcggggtggactggtttgccaccgccatcgggatgccagtggagaagaggtacaacagtgtcctgttcggaggtctcattggctcggcattctctgtcctgcagtttctgtgtgcgccactcactggggccacctctgactgcttggggaggcgcccggtgatgctgctgtgcctgatgggtgtggccacctcatatgcagtctgggccacctctcggagctttgcggccttcctggcctccaggctgattgggggcatcagcaaagggaacgtcagcctctccacggccatcgttgctgacctgggctcgcctctggcccgcagtcaaggcatggcggtcattggggtggccttctcactgggcttcaccctgggccctatgctcggagcctccctgcccctggaaatggcaccctggtttgccctgctcttcgcagcctccgacctgctgttcatcttctgcttcctgccagagacgctgcccctggagaaacgggcgccctctatcgccctggggttccgtgatgcggctgatctgctcagccccctggccctgctgcgcttctcggctgtcgctcgtggccaggacccaccctctggagacaggctcagcagcctgcgccgcctgggcctagtctacttcctctacctcttcctgttctcgggcctggagtacacgctgagcttcctcacacaccagcgcttccagttcagtagcctacagcaggggaagatgtttttcctcatcggcctcaccatggccaccatccagggtgcctatgcccggcggatccaccctggcggggaagttgctgccgtgaagcgggccctcctgctgctggtgcccgccttcctcctcatcggctggggacgttctctgcccgtgctgggcctggggctgctgctctactcctttgccgccgccgttgtggtgccctgcctgtcctccgtggtcgctggctatggctcaccagggcagaagggcacggtcatgggtacactgcgcagcctaggtgctctggccagggccgcggggcccctggtggccgcttcagaagctgagttacccggcacagacgctcaaggctgagtagctgagccactgtgcccaggctgtgggcaccaggcagagtgggagcctaggtcaggcccctgcccactgcctgacccccaccccccgccagtccagggagaccctgtgggtgggggccggcccctaagcaggaagctcaggcagctcctccagacttacttactccttcagtgactccgagctgcagcactccaaggctgtcagggcttctgtttgttttttaaactatgcaccaggtttctgatgatgaaataaagcacctgtttgttttataccaa

SEQ ID NO: 356555 - DNA, 4010 bp, Homo sapiens
  misc_feature (11)..(11): n is a, c, g, or t
  misc_feature (13)..(13): n is a, c, g, or t
  misc_feature (21)..(21): n is a, c, g, or t
  misc_feature (42)..(42): n is a, c, g, or t
  misc_feature (49)..(49): n is a, c, g, or t
tccaggttaancntacccccnccggggttatgtagcgaggcngggtggngccgtgtcttagggtagcgcgcgcctgtctctcttcgggtctcgggcccttgggcgcagcggggcgcgcgccatggcgaaggcgaagaaggtcggggcgcgaaggaaggcctccggggcgccggcgggagcgcgagggggcccggcgaaggccaactccaatccgttcgaggtgaaagttaacaggcagaagttccagatcctgggccggaagacgcgccacgacgtgggactgcccggggtgtctcgcgcacgggccctcaggaagcgtacacagactttactaaaagagtacaaagaaagggataaatccaatgtattcagagataaacgcttcggagaatacaacagcaacatgagccccgaggagaagatgatgaagaggtttgctctggaacagcagcgacatcatgagaaaaaaagcatctacaatctaaatgaagatgaagaattgactcattatggccagtctttggcagacatcgagaagcataatgacattgtggacagtgacagcgatgctgaggatcgaggaacgttgtctgctgagctgactgctgcccactttggaggaggcggtgggctccttcacaagaagactcaacaggaaggcgaggagcgggagaaaccgaagtcccggaaagagctgattgaagagctcattgccaagtcaaaacaagagaagagggagagacaagctcaacgagaagatgccctcgagctcacggagaagctagaccaagactggaaagaaattcagactctcctgtcccacaaaactcccaagtcagagaacagagacaaaaaggaaaaacccaagcccgatgcatatgacatgatggttcgcgagcttggctttgaaatgaaggcgcagccctctaacaggatgaagacggaggcagaattggcaaaggaagagcaggagcacctcaggaagctggaggctgagagacttcgaagaatgcttggaaaggatgaggatgaaaatgttaagaaaccaaaacatatgtcagcagatgatctgaatgatggcttcgtgctagataaagatgacaggcgtttgctttcctacaaagatggaaagatgaatgtcgaggaagatgtccaggaagagcaaagcaaggaagccagtgaccctgagagcaacgaggaagaaggtgacagttcaggcggggaggacacagaggagagcgacagcccagatagccacttggacctggaatccaacgtggagagtgaggaagaaaacgagaagccagcaaaagagcagaggcagactcctgggaaagggttgataagcggcaaggaaagagctggaaaagctaccagagacgagctgccctacacgttcgcagcccctgaatcctatgaggaactgagatctctgttgttaggaagatcgatggaagagcagcttttggtggtggagagaattcagaagtgcaaccacccgagtctcgcagaaggaaacaaagcaaaattagaaaaactgtttggctttcttttggaatacgttggcgatttggctacagatgacccaccagacctcacagtcattgataagttggttgtgcacttatatcatctttgccagatgtttcctgaatctgcaagtgacgctatcaaatttgttctccgagatgcgatgcatgagatggaagaaatgattgagaccaaaggccgggcggcattgccagggttggatgtgctcatttatttgaaaatcactgggctgctatttccaacttccgacttctggcacccagtggtgacccctgccctcgtgtgcctcagtcagctgctcaccaagtgccccatcctgtccctccaggacgtggtgaagggcctgttcgtgtgctgcctgttcctggagtatgtggctttgtcccagaggtttatacctgagcttattaattttcttcttgggattctttacatagcaactccaaacaaagcaagccaaggttccactctggtgcaccctttcagagcgcttgggaagaactcggaactgctcgtggtgtctgctagagaggatgtggccacgtggcagcagagcagcctctccctccgctgggcgagtagactgagggccccaacttcgacagaggccaatcacatccgactgtcctgcctggctgtgggcctggccctgctgaagcgctgcgtgctcatgtacgggtccctgccatccttccacgccatcatggggcctctccgagccctcctcacggatcacctggcggactgcagccacccgcaggagctccaggagctgtgtcagagcacactgaccgaaatggaaagccagaagcagctctgccggccgctgacctgtgagaagagcaagcctgtcccactgaagcttttcacaccccggctggtcaaagtcctcgagtttggaagaaaacaaggcagtagtaaggaggaacaggaaaggaagaggctgatccacaaacacaagcgtgaatttaaaggggccgttcgagaaatccgcaaggacaatcagttcctggcgaggatgcaactctcagaaatcatggaacgggatgcggaaagaaagcggaaagtaaagcagctttttaacagcctggctacacaggaaggcgaatggaaggctctgaagaggaaaaagttcaaaaaataaattacattttataaataaggcaaggaactggacattacctcacatctgcaattccaaccctctgggaggccaaggcaggaagattgcttcagcccaggagttcgagaccagcctgggcaacacaggaagaccccgtctctaccaaaaaaacataaaaattagccaagtgtggtggcacgcacctgtagtcccaactactcgggaggctgaagcaggaggactgcttgagctgagtccaaggttacagtgagccgtgattgagccactgcactccagcctcggccacagtgcaagactgtgtcgcttaaaaaaaaatttttttttttgagacggagttttgctcttgttgcccaggctggagtgcaatggcacaacctccacctcctgggttcaagcgattctcctgcctcagcctcccgagtagctgggattacagacatgtgccaccacgcccagctaattttgtatttttagtagagacggggtttctccatgttggtcaggctggtctcgaattcccgacctcaggtaatccacctgccttggccccccaattataggtgtgagccacagcacccagccaaaaaagtaattttttttagagtaataatgctataatgttggtgtgattccaacctccagctccccccacccgctgcctgcggttttgtttctgttaaaacgtcacctgatgaaatagaatgaatcctgaaatgcacctctgggatcgggaatggtctgtgtgttatcagctgcgactggttcactgcgtctggacaagcctcatggggactggggattctggccagtgtaatttctgtcaaccacggacgtttgccttcatgtgtagaatttactgttgttatgcaaattatattttcaattataaatgaaacaagtttgcagatattttagaaatcagagaagggaaacatcacccacagtccctctgctggaacagccacagttggccttgtcctacttacgtccttcagtggatgcttctgggtgctggggttctccattcaggacactgcactctcggaggtgggaggagactgggttgcgtctgtgccgacctgggatgcagtttcaggtcagaatcagaagatgtgcaagttacgcatgacacagctttttaaagtgcttttcccctgcactaatcaagagggaggtcagccctcaggtgtgctggacccgggagggactgtgagctgtaagaagtaacgagccccttgaacttcacaagctggccagggagccatatcccgaatgccactgccacttcctcgtggtgcaaggcttgttgggacct

SEQ ID NO: 356556 - DNA, 3384 bp, Homo sapiens
tccccccctcccccattccgctaggtacgaggctgggtggtgcacgtgtcttagggtagcgcgcgcctgtctctcttcgggtctcgggcccttgggcgcagcggggcgcgcgccatggcgaaggcgaagaaggtcggggcgcgaaggaaggcctccggggcgccggcgggagcgcgagggggcccggcgaaggccaactccaatccgttcgaggtgaaagttaacaggcagaagttccagatcctgggccggaagacgcgccacgacgtgggactgcccggggtgtctcgcgcacgggccctcaggaagcgtacacagactttactaaaagagtacaaagaaagggataaatccaatgtattcagagataaacgcttcggagaatacaacagcaacatgagccccgaggagaagatgatgaagaggtttgctctggaacagcagcgacatcatgagaaaaaaagcatctacaatctaaatgaagatgaagaattgactcattatggccagtctttggcagacatcgagaagcataatgacattgtggacagtgacagcgatgctgaggatcgaggaacgttgtctgctgagctgactgctgcccactttggaggaggcggtgggctccttcacaagaagactcaacaggaaggcgaggagcgggagaaaccgaagtcccggaaagagctgattgaagagctcattgccaagtcaaaacaagagaagagggagagacaagctcaacgagaagatgccctcgagctcacggagaagctagaccaagactggaaagaaattcagactctcctgtcccacaaaactcccaagtcagagaacagagacaaaaaggaaaaacccaagcccgatgcatatgacatgatggttcgcgagcttggctttgaaatgaaggcgcagccctctaacaggatgaagacggaggcagaattggcaaaggaagagcaggagcacctcaggaagctggaggctgagagacttcgaagaatgcttggaaaggatgaggatgaaaatgttaagaaaccaaaacatatgtcagcagatgatctgaatgatggcttcgtgctagataaagatgacaggcgtttgctttcctacaaagatggaaagatgaatgtcgaggaagatgtccaggaagagcaaagcaaggaagccagtgaccctgagagcaacgaggaagaaggtgacagttcaggcggggaggacacagaggagagcgacagcccagatagccacttggacctggaatccaacgtggagagtgaggaagaaaacgagaagccagcaaaagagcagaggcagactcctgggaaagggttgataagcggcaaggaaagagctggaaaagctaccagagacgagctgccctacacgttcgcagcccctgaatcctatgaggaactgagatctctgttgttaggaagatcgatggaagagcagcttttggtggtggagagaattcagaagtgcaaccacccgagtctcgcagaaggaaacaaagcaaaattagaaaaactgtttggctttcttttggaatacgttggcgatttggctacagatgacccaccagacctcacagtcattgataagttggttgtgcacttatatcatctttgccagatgtttcctgaatctgcaagtgacgctatcaaatttgttctccgagatgcgatgcatgagatggaagaaatgattgagaccaaaggccgggcggcattgccagggttggatgtgctcatttatttgaaaatcactgggctgctatttccaacttccgacttctggcacccagtggtgacccctgccctcgtgtgcctcagtcagctgctcaccaagtgccccatcctgtccctccaggacgtggtgaagggcctgttcgtgtgctgcctgttcctggagtatgtggctttgtcccagaggtttatacctgagcttattaattttcttcttgggattctttacatagcaactccaaacaaagcaagccaaggttccactctggtgcaccctttcagagcgcttgggaagaactcggaactgctcgtggtgtctgctagagaggatgtggccacgtggcagcagagcagcctctccctccgctgggcgagtagactgagggccccaacttcgacagaggccaatcacatccgactgtcctgcctggctgtgggcctggccctgctgaagcgctgcgtgctcatgtacgggtccctgccatccttccacgccatcatggggcctctccgagccctcctcacggatcacctggcggactgcagccacccgcaggagctccaggagctgtgtcagagcacactgaccgaaatggaaagccagaagcagctctgccggccgctgacctgtgagaagagcaagcctgtcccactgaagcttttcacaccccggctggtcaaagtcctcgagtttggaagaaaacaaggcagtagtaaggaggaacaggaaaggaagaggctgatccacaaacacaagcgtgaatttaaaggggccgttcgagaaatccgcaaggacaatcagttcctggcgaggatgcaactctcagaaatcatggaacgggatgcggaaagaaagcggaaagtaaagcagctttttaacagcctggctacacaggaaggcgaatggaaggctctgaagaggaaaaagttcaaaaaataaattacattttataaataaggcaactccccccacccgctgcctgcggttttgtttctgttaaaacgtcacctgatgaaatagaatgaatcctgaaatgcacctctgggatcgggaatggtctgtgtgttatcagctgcgactggttcactgcgtctggacaagcctcatggggactggggattctggccagtgtaatttctgtcaaccacggacgtttgccttcatgtgtagaatttactgttgttatgcaaattatattttcaattataaatgaaacaagtttgcagatattttagaaatcagagaagggaaacatcacccacagtccctctgctggaacagccacagttggccttgtcctacttacgtccttcagtggatgcttctgggtgctggggttctccattcaggacactgcactctcggaggtgggaggagactgggttgcgtctgtgccgacctgggatgcagtttcaggtcagaatcagaagatgtgcaagttacgcatgacacagctttttaaagtgcttttcccctgcactaatcaagagggaggtcagccctcaggtgtgctggacccgggagggactgtgagctgtaagaagtaacgagccccttgaacttcacaagctggccagggagccatatcccgaatgccactgccacttcctcgtggtgcaaggcttgttgggacct

SEQ ID NO: 356557 - DNA, 3523 bp, Homo sapiens
tccccccctcccccattccgctaggtacgaggctgggtggtgcacgtgtcttagggtagcgcgcgcctgtctctcttcgggtctcgggcccttgggcgcagcggggcgcgcgccatggcgaaggcgaagaaggtcggggcgcgaaggaaggcctccggggcgccggcgggagcgcgagggggcccggcgaaggccaactccaatccgttcgaggtgaaagttaacaggcagaagttccagatcctgggccggaagacgcgccacgacgtgggactgcccggggtgtctcgcgcacgggccctcaggaagcgtacacagactttactaaaagagtacaaagaaagggataaatccaatgtattcagagataaacgcttcggagaatacaacagcaacatgagccccgaggagaagatgatgaagaggtttgctctggaacagcagcgacatcatgagaaaaaaagcatctacaatctaaatgaagatgaagaattgactcattatggccagtctttggcagacatcgagaagcataatgacattgtggacagtgacagcgatgctgaggatcgaggaacgttgtctgctgagctgactgctgcccactttggaggaggcggtgggctccttcacaagaagactcaacaggaaggcgaggagcgggagaaaccgaagtcccggaaagagctgattgaagagctcattgccaagtcaaaacaagagaagagggagagacaagctcaacgagaagatgccctcgagctcacggagaagctagaccaagactggaaagaaattcagactctcctgtcccacaaaactcccaagtcagagaacagagacaaaaaggaaaaacccaagcccgatgcatatgacatgatggttcgcgagcttggctttgaaatgaaggcgcagccctctaacaggatgaagacggaggcagaattggcaaaggaagagcaggagcacctcaggaagctggaggctgagagacttcgaagaatgcttggaaaggatgaggatgaaaatgttaagaaaccaaaacatatgtcagcagatgatctgaatgatggcttcgtgctagataaagatgacaggcgtttgctttcctacaaagatggaaagatgaatgtcgaggaagatgtccaggaagagcaaagcaaggaagccagtgaccctgagagcaacgaggaagaaggtgacagttcaggcggggaggacacagaggagagcgacagcccagatagccacttggacctggaatccaacgtggagagtgaggaagaaaacgagaagccagcaaaagagcagaggcagactcctgggaaagggttgataagcggcaaggaaagagctggaaaagctaccagagacgagctgccctacacgttcgcagcccctgaatcctatgaggaactgagatctctgttgttaggaagatcgatggaagagcagcttttggtggtggagagaattcagaagtgcaaccacccgagtctcgcagaaggaaacaaagcaaaattagaaaaactgtttggctttcttttggaatacgttggcgatttggctacagatgacccaccagacctcacagtcattgataagttggttgtgcacttatatcatctttgccagatgtttcctgaatctgcaagtgacgctatcaaatttgttctccgagatgcgatgcatgagatggaagaaatgattgagaccaaaggccgggcggcattgccagggttggatgtgctcatttatttgaaaatcactgggctgctatttccaacttccgacttctggcacccagtggtgacccctgccctcgtgtgcctcagtcagctgctcaccaagtgccccatcctgtccctccaggacgtggtgaagggcctgttcgtgtgctgcctgttcctggagtatgtggctttgtcccagaggtttatacctgagcttattaattttcttcttgggattctttacatagcaactccaaacaaagcaagccaaggttccactctggtgcaccctttcagagcgcttgggaagaactcggaactgctcgtggtgtctgctagagaggatgtggccacgtggcagcagagcagcctctccctccgctgggcgagtagactgagggccccaacttcgacagaggccaatcacatccgactgtcctgcctggctgtgggcctggccctgctgaagcgctgcgtgctcatgtacgggtccctgccatccttccacgccatcatggggcctctccgagccctcctcacggatcacctggcggactgcagccacccgcaggagctccaggagctgtgtcagagcacactgaccgaaatggaaagccagaagcagctctgccggccgctgacctgtgagaagagcaagcctgtcccactgaagcttttcacaccccggctggtcaaagtcctcgagtttggaagaaaacaaggcagtagtaaggaggaacaggaaaggaagaggctgatccacaaacacaagcgtgaatttaaaggggccgttcgagaaatccgcaaggacaatcagttcctggcgaggatgcaactctcagaaatcatggaacgggatgcggaaagaaagcggaaagtaaagcagctttttaacagcctggctacacaggaaggcgaatggaaggctctgaagaggaaaaagttcaaaaaataaattacattttataaataaggcaagctggtctcgaattcccgacctcaggtaatccacctgccttggccccccaattataggtgtgagccacagcacccagccaaaaaagtaattttttttagagtaataatgctataatgttggtgtgattccaacctccagctccccccacccgctgcctgcggttttgtttctgttaaaacgtcacctgatgaaatagaatgaatcctgaaatgcacctctgggatcgggaatggtctgtgtgttatcagctgcgactggttcactgcgtctggacaagcctcatggggactggggattctggccagtgtaatttctgtcaaccacggacgtttgccttcatgtgtagaatttactgttgttatgcaaattatattttcaattataaatgaaacaagtttgcagatattttagaaatcagagaagggaaacatcacccacagtccctctgctggaacagccacagttggccttgtcctacttacgtccttcagtggatgcttctgggtgctggggttctccattcaggacactgcactctcggaggtgggaggagactgggttgcgtctgtgccgacctgggatgcagtttcaggtcagaatcagaagatgtgcaagttacgcatgacacagctttttaaagtgcttttcccctgcactaatcaagagggaggtcagccctcaggtgtgctggacccgggagggactgtgagctgtaagaagtaacgagccccttgaacttcacaagctggccagggagccatatcccgaatgccactgccacttcctcgtggtgcaaggcttgttgggacct

SEQ ID NO: 356558 - DNA, 3561 bp, Homo sapiens
tccccccctcccccattccgctaggtacgaggctgggtggtgcacgtgtcttagggtagcgcgcgcctgtctctcttcgggtctcgggcccttgggcgcagcggggcgcgcgccatggcgaaggcgaagaaggtcggggcgcgaaggaaggcctccggggcgccggcgggagcgcgagggggcccggcgaaggccaactccaatccgttcgaggtgaaagttaacaggcagaagttccagatcctgggccggaagacgcgccacgacgtgggactgcccggggtgtctcgcgcacgggccctcaggaagcgtacacagactttactaaaagagtacaaagaaagggataaatccaatgtattcagagataaacgcttcggagaatacaacagcaacatgagccccgaggagaagatgatgaagaggtttgctctggaacagcagcgacatcatgagaaaaaaagcatctacaatctaaatgaagatgaagaattgactcattatggccagtctttggcagacatcgagaagcataatgacattgtggacagtgacagcgatgctgaggatcgaggaacgttgtctgctgagctgactgctgcccactttggaggaggcggtgggctccttcacaagaagactcaacaggaaggcgaggagcgggagaaaccgaagtcccggaaagagctgattgaagagctcattgccaagtcaaaacaagagaagagggagagacaagctcaacgagaagatgccctcgagctcacggagaagctagaccaagactggaaagaaattcagactctcctgtcccacaaaactcccaagtcagagaacagagacaaaaaggaaaaacccaagcccgatgcatatgacatgatggttcgcgagcttggctttgaaatgaaggcgcagccctctaacaggatgaagacggaggcagaattggcaaaggaagagcaggagcacctcaggaagctggaggctgagagacttcgaagaatgcttggaaaggatgaggatgaaaatgttaagaaaccaaaacatatgtcagcagatgatctgaatgatggcttcgtgctagataaagatgacaggcgtttgctttcctacaaagatggaaagatgaatgtcgaggaagatgtccaggaagagcaaagcaaggaagccagtgaccctgagagcaacgaggaagaaggtgacagttcaggcggggaggacacagaggagagcgacagcccagatagccacttggacctggaatccaacgtggagagtgaggaagaaaacgagaagccagcaaaagagcagaggcagactcctgggaaagggttgataagcggcaaggaaagagctggaaaagctaccagagacgagctgccctacacgttcgcagcccctgaatcctatgaggaactgagatctctgttgttaggaagatcgatggaagagcagcttttggtggtggagagaattcagaagtgcaaccacccgagtctcgcagaaggaaacaaagcaaaattagaaaaactgtttggctttcttttggaatacgttggcgatttggctacagatgacccaccagacctcacagtcattgataagttggttgtgcacttatatcatctttgccagatgtttcctgaatctgcaagtgacgctatcaaatttgttctccgagatgcgatgcatgagatggaagaaatgattgagaccaaaggccgggcggcattgccagggttggatgtgctcatttatttgaaaatcactgggctgctatttccaacttccgacttctggcacccagtggtgacccctgccctcgtgtgcctcagtcagctgctcaccaagtgccccatcctgtccctccaggacgtggtgaagggcctgttcgtgtgctgcctgttcctggagtatgtggctttgtcccagaggtttatacctgagcttattaattttcttcttgggattctttacatagcaactccaaacaaagcaagccaaggttccactctggtgcaccctttcagagcgcttgggaagaactcggaactgctcgtggtgtctgctagagaggatgtggccacgtggcagcagagcagcctctccctccgctgggcgagtagactgagggccccaacttcgacagaggccaatcacatccgactgtcctgcctggctgtgggcctggccctgctgaagcgctgcgtgctcatgtacgggtccctgccatccttccacgccatcatggggcctctccgagccctcctcacggatcacctggcggactgcagccacccgcaggagctccaggagctgtgtcagagcacactgaccgaaatggaaagccagaagcagctctgccggccgctgacctgtgagaagagcaagcctgtcccactgaagcttttcacaccccggctggtcaaagtcctcgagtttggaagaaaacaaggcagtagtaaggaggaacaggaaaggaagaggctgatccacaaacacaagcgtgaatttaaaggggccgttcgagaaatccgcaaggacaatcagttcctggcgaggatgcaactctcagaaatcatggaacgggatgcggaaagaaagcggaaagtaaagcagctttttaacagcctggctacacaggaaggcgaatggaaggctctgaagaggaaaaagttcaaaaaataaattacattttataaataaggcaaggaactggacattacctcacatctgcaattccaaccctgctggtctcgaattcccgacctcaggtaatccacctgccttggccccccaattataggtgtgagccacagcacccagccaaaaaagtaattttttttagagtaataatgctataatgttggtgtgattccaacctccagctccccccacccgctgcctgcggttttgtttctgttaaaacgtcacctgatgaaatagaatgaatcctgaaatgcacctctgggatcgggaatggtctgtgtgttatcagctgcgactggttcactgcgtctggacaagcctcatggggactggggattctggccagtgtaatttctgtcaaccacggacgtttgccttcatgtgtagaatttactgttgttatgcaaattatattttcaattataaatgaaacaagtttgcagatattttagaaatcagagaagggaaacatcacccacagtccctctgctggaacagccacagttggccttgtcctacttacgtccttcagtggatgcttctgggtgctggggttctccattcaggacactgcactctcggaggtgggaggagactgggttgcgtctgtgccgacctgggatgcagtttcaggtcagaatcagaagatgtgcaagttacgcatgacacagctttttaaagtgcttttcccctgcactaatcaagagggaggtcagccctcaggtgtgctggacccgggagggactgtgagctgtaagaagtaacgagccccttgaacttcacaagctggccagggagccatatcccgaatgccactgccacttcctcgtggtgcaaggcttgttgggacct

SEQ ID NO: 356559 - DNA, 2863 bp, Homo sapiens
gcatctattaggcagaggtggggctttgttcttacccacaattggaagttctctatggagtaaaggcggtatgtgtgccacctgattcctttccccatgtgtatctggttagggtcggccacgtgagatccgcaagcattttagaaggtgggaggggaggtgggagctggctacaggccaggcgttggcgtggttccgtgagtgtgctccagccaggcccaaagcttctcctgcccagagggaccgtttcctccagcgtgggtcgggtgcttctgcgcccggaaagagcgccagctcctccttcgggtgacccagggagcggggctgcaggcaaaggcgcaggcggccaaaaaggtgccaaccgggtcctgtggctttcagttgtctctgcccacccaattcacaccatctttccccctcagccgcctgtcctgggacttcaggctcagcaccaaacgcagcaaaagtaggtgcacagagagcggggtcagctcacgcagcccgagcagaatggctgtgctgccgccccaggcccgcggccaccgctgtgtgtgtggcaggagtcagccccccagcgtggggccccgaagcccgcggtccttccacggggagggccaggcccgcagggcgcagacgatgggggacaggctgcgccagcgctcgcctgaggccccgcacacaaacctcaggcccatgggtccgctccgcggggcaggcgtcgtgggcccaaggaggccaggccaggagtctcggcctcggggttacgcggcggcgggcagctcttccgctccgctcagggtgctgctaacccacagccgagcagcgacccgcaggaccggcgagaaccccgccactgcctccggccggaagagaacgtgcagagatgtacgtcacttccggggcgtggcgtggcgggcgtggcgtcccgcccctggcggcgtgcctggtgccctgttccgcgtctgtgcgaccgtccgtcccgagcgcgcagccgcggcaggccaggtcagagcagcccaccatgggatggggagggggtggaggctgcaccccgcgcccacccatccaccagcagccgccggagcgccgcgtggtcaccgttgtctttctcggcctcctgctggacctcctggccttcacgctgctgctgcccctgctgcccgggctgttggagagccacggccgtgcccacgaccccctctatggctcctggcagggcggggtggactggtttgccaccgccatcgggatgccagtggagaagaggtacaacagtgtcctgttcggaggtctcattggctcggcattctctgtcctgcagtttctgtgtgcgccactcactggggccacctctgactgcttggggaggcgcccggtgatgctgctgtgcctgatgggtgtggccacctcatatgcagtctgggccacctctcggagctttgcggccttcctggcctccaggctgattgggggcatcagcaaagggaacgtcagcctctccacggccatcgttgctgacctgggctcgcctctggcccgcagtcaaggcatggcggtcattggggtggccttctcactgggcttcaccctgggccctatgctcggagcctccctgcccctggaaatggcaccctggtttgccctgctcttcgcagcctccgacctgctgttcatcttctgcttcctgccagagacgctgcccctggagaaacgggtagggctgtggtctgggacccacaggcctaggggctggaggcttgattccatagcgatgtaaagtgcccctgtgtgccagccccagatgccagggaggctgggccgctctcttggtgttgggacccttgaggccacagtccgtgggttgccaggccagcagccgctcctgcaggctctccaatgccatccccacaggcgccctctatcgccctggggttccgtgatgcggctgatctgctcagccccctggccctgctgcgcttctcggctgtcgctcgtggccaggacccaccctctggagacaggctcagcagcctgcgccgcctgggcctagtctacttcctctacctcttcctgttctcgggcctggagtacacgctgagcttcctcacacaccagcgcttccagttcagtagcctacagcaggggaagatgtttttcctcatcggcctcaccatggccaccatccagggtgcctatgcccggcggatccaccctggcggggaagttgctgccgtgaagcgggccctcctgctgctggtgcccgccttcctcctcatcggctggggacgttctctgcccgtgctgggcctggggctgctgctctactcctttgccgccgccgttgtggtgccctgcctgtcctccgtggtcgctggctatggctcaccagggcagaagggcacggtcatgggtacactgcgcagcctaggtgctctggccagggccgcggggcccctggtggccgcttcagtgtactggctggccggggcccaggcctgcttcaccacgtggtccgggctctttttgctccccttcttcctcctgcagaagctgagttacccggcacagacgctcaaggctgagtagctgagccactgtgcccaggctgtgggcaccaggcagagtgggagcctaggtcaggcccctgcccactgcctgacccccaccccccgccagtccagggagaccctgtgggtgggggccggcccctaagcaggaagctcaggcagctcctccagacttacttactccttcagtgactccgagctgcagcactccaaggctgtcagggcttctgtttgttttttaaactatgcaccaggtttctgatgatgaaataaagcacctgtttgttttataccaa

SEQ ID NO: 356560 - DNA, 2703 bp, Homo sapiens
gcatctattaggcagaggtggggctttgttcttacccacaattggaagttctctatggagtaaaggcggtatgtgtgccacctgattcctttccccatgtgtatctggttagggtcggccacgtgagatccgcaagcattttagaaggtgggaggggaggtgggagctggctacaggccaggcgttggcgtggttccgtgagtgtgctccagccaggcccaaagcttctcctgcccagagggaccgtttcctccagcgtgggtcgggtgcttctgcgcccggaaagagcgccagctcctccttcgggtgacccagggagcggggctgcaggcaaaggcgcaggcggccaaaaaggtgccaaccgggtcctgtggctttcagttgtctctgcccacccaattcacaccatctttccccctcagccgcctgtcctgggacttcaggctcagcaccaaacgcagcaaaagtaggtgcacagagagcggggtcagctcacgcagcccgagcagaatggctgtgctgccgccccaggcccgcggccaccgctgtgtgtgtggcaggagtcagccccccagcgtggggccccgaagcccgcggtccttccacggggagggccaggcccgcagggcgcagacgatgggggacaggctgcgccagcgctcgcctgaggccccgcacacaaacctcaggcccatgggtccgctccgcggggcaggcgtcgtgggcccaaggaggccaggccaggagtctcggcctcggggttacgcggcggcgggcagctcttccgctccgctcagggtgctgctaacccacagccgagcagcgacccgcaggaccggcgagaaccccgccactgcctccggccggaagagaacgtgcagagatgtacgtcacttccggggcgtggcgtggcgggcgtggcgtcccgcccctggcggcgtgcctggtgccctgttccgcgtctgtgcgaccgtccgtcccgagcgcgcagccgcggcaggccaggtcagagcagcccaccatgggatggggagggggtggaggctgcaccccgcgcccacccatccaccagcagccgccggagcgccgcgtggtcaccgttgtctttctcggcctcctgctggacctcctggccttcacgctgctgctgcccctgctgcccgggctgttggagagccacggccgtgcccacgaccccctctatggctcctggcagggcggggtggactggtttgccaccgccatcgggatgccagtggagaagaggtacaacagtgtcctgttcggaggtctcattggctcggcattctctgtcctgcagtttctgtgtgcgccactcactggggccacctctgactgcttggggaggcgcccggtgatgctgctgtgcctgcgaccgcccctgcctcttggcccctgcccctgggcagatgggtgtggccacctcatatgcagtctgggccacctctcggagctttgcggccttcctggcctccaggctgattgggggcatcagcaaagggaacgtcagcctctccacggccatcgttgctgacctgggctcgcctctggcccgcagtcaaggcatggcggtcattggggtggccttctcactgggcttcaccctgggccctatgctcggagcctccctgcccctggaaatggcaccctggtttgccctgctcttcgcagcctccgacctgctgttcatcttctgcttcctgccagagacgctgcccctggagaaacgggcgccctctatcgccctggggttccgtgatgcggctgatctgctcagccccctggccctgctgcgcttctcggctgtcgctcgtggccaggacccaccctctggagacaggctcagcagcctgcgccgcctgggcctagtctacttcctctacctcttcctgttctcgggcctggagtacacgctgagcttcctcacacaccagcgcttccagttcagtagcctacagcaggggaagatgtttttcctcatcggcctcaccatggccaccatccagggtgcctatgcccggcggatccaccctggcggggaagttgctgccgtgaagcgggccctcctgctgctggtgcccgccttcctcctcatcggctggggacgttctctgcccgtgctgggcctggggctgctgctctactcctttgccgccgccgttgtggtgccctgcctgtcctccgtggtcgctggctatggctcaccagggcagaagggcacggtcatgggtacactgcgcagcctaggtgctctggccagggccgcggggcccctggtggccgcttcagtgtactggctggccggggcccaggcctgcttcaccacgtggtccgggctctttttgctccccttcttcctcctgcagaagctgagttacccggcacagacgctcaaggctgagtagctgagccactgtgcccaggctgtgggcaccaggcagagtgggagcctaggtcaggcccctgcccactgcctgacccccaccccccgccagtccagggagaccctgtgggtgggggccggcccctaagcaggaagctcaggcagctcctccagacttacttactccttcagtgactccgagctgcagcactccaaggctgtcagggcttctgtttgttttttaaactatgcaccaggtttctgatgatgaaataaagcacctgtttgttttataccaa

SEQ ID NO: 356561 - DNA, 3300 bp, Homo sapiens
tgtgtctgttattttttccccagagggagagacaagctcaacgagaagatgccctcgagctcacggagaagctagaccaagactggaaagaaattcagactctcctgtcccacaaaactcccaagtcagagaacagagacaaaaaggaaaaacccaagcccgatgcatatgacatgatggttcgcgagcttggctttgaaatgaaggcgcagccctctaacaggatgaagacggaggcagaattggcaaaggaagagcaggagcacctcaggaagctggaggctgagagacttcgaagaatgcttggaaaggatgaggatgaaaatgttaagaaaccaaaacatatgtcagcagatgatctgaatgatggcttcgtgctagataaagatgacaggcgtttgctttcctacaaagatggaaagatgaatgtcgaggaagatgtccaggaagagcaaagcaaggaagccagtgaccctgagagcaacgaggaagaaggtgacagttcaggcggggaggacacagaggagagcgacagcccagatagccacttggacctggaatccaacgtggagagtgaggaagaaaacgagaagccagcaaaagagcagaggcagactcctgggaaagggttgataagcggcaaggaaagagctggaaaagctaccagagacgagctgccctacacgttcgcagcccctgaatcctatgaggaactgagatctctgttgttaggaagatcgatggaagagcagcttttggtggtggagagaattcagaagtgcaaccacccgagtctcgcagaaggaaacaaagcaaaattagaaaaactgtttggctttcttttggaatacgttggcgatttggctacagatgacccaccagacctcacagtcattgataagttggttgtgcacttatatcatctttgccagatgtttcctgaatctgcaagtgacgctatcaaatttgttctccgagatgcgatgcatgagatggaagaaatgattgagaccaaaggccgggcggcattgccagggttggatgtgctcatttatttgaaaatcactgggctgctatttccaacttccgacttctggcacccagtggtgacccctgccctcgtgtgcctcagtcagctgctcaccaagtgccccatcctgtccctccaggacgtggtgaagggcctgttcgtgtgctgcctgttcctggagtatgtggctttgtcccagaggtttatacctgagcttattaattttcttcttgggattctttacatagcaactccaaacaaagcaagccaaggttccactctggtgcaccctttcagagcgcttgggaagaactcggaactgctcgtggtgtctgctagagaggatgtggccacgtggcagcagagcagcctctccctccgctgggcgagtagactgagggccccaacttcgacagaggccaatcacatccgactgtcctgcctggctgtgggcctggccctgctgaagcgctgcgtgctcatgtacgggtccctgccatccttccacgccatcatggggcctctccgagccctcctcacggatcacctggcggactgcagccacccgcaggagctccaggagctgtgtcagagcacactgaccgaaatggaaagccagaagcagctctgccggccgctgacctgtgagaagagcaagcctgtcccactgaagcttttcacaccccggctggtcaaagtcctcgagtttggaagaaaacaaggcagtagtaaggaggaacaggaaaggaagaggctgatccacaaacacaagcgtgaatttaaaggggccgttcgagaaatccgcaaggacaatcagttcctggcgaggatgcaactctcagaaatcatggaacgggatgcggaaagaaagcggaaagtaaagcagctttttaacagcctggctacacaggaaggcgaatggaaggctctgaagaggaaaaagttcaaaaaataaattacattttataaataaggcaaggaactggacattacctcacatctgcaattccaaccctctgggaggccaaggcaggaagattgcttcagcccaggagttcgagaccagcctgggcaacacaggaagaccccgtctctaccaaaaaaacataaaaattagccaagtgtggtggcacgcacctgtagtcccaactactcgggaggctgaagcaggaggactgcttgagctgagtccaaggttacagtgagccgtgattgagccactgcactccagcctcggccacagtgcaagactgtgtcgcttaaaaaaaaatttttttttttgagacggagttttgctcttgttgcccaggctggagtgcaatggcacaacctccacctcctgggttcaagcgattctcctgcctcagcctcccgagtagctgggattacagacatgtgccaccacgcccagctaattttgtatttttagtagagacggggtttctccatgttggtcaggctggtctcgaattcccgacctcaggtaatccacctgccttggccccccaattataggtgtgagccacagcacccagccaaaaaagtaattttttttagagtaataatgctataatgttggtgtgattccaacctccagctccccccacccgctgcctgcggttttgtttctgttaaaacgtcacctgatgaaatagaatgaatcctgaaatgcacctctgggatcgggaatggtctgtgtgttatcagctgcgactggttcactgcgtctggacaagcctcatggggactggggattctggccagtgtaatttctgtcaaccacggacgtttgccttcatgtgtagaatttactgttgttatgcaaattatattttcaattataaatgaaacaagtttgcagatattttagaaatcagagaagggaaacatcacccacagtccctctgctggaacagccacagttggccttgtcctacttacgtccttcagtggatgcttctgggtgctggggttctccattcaggacactgcactctcggaggtgggaggagactgggttgcgtctgtgccgacctgggatgcagtttcaggtcagaatcagaagatgtgcaagttacgcatgacacagctttttaaagtgcttttcccctgcactaatcaagagggaggtcagccctcaggtgtgctggacccgggagggactgtgagctgtaagaagtaacgagccccttgaacttcacaagctggccagggagccatatcccgaatgccactgccacttcctcgtggtgcaaggcttgttgggacct

SEQ ID NO: 356562 - DNA, 2598 bp, Homo sapiens
gcatctattaggcagaggtggggctttgttcttacccacaattggaagttctctatggagtaaaggcggtatgtgtgccacctgattcctttccccatgtgtatctggttagggtcggccacgtgagatccgcaagcattttagaaggtgggaggggaggtgggagctggctacaggccaggcgttggcgtggttccgtgagtgtgctccagccaggcccaaagcttctcctgcccagagggaccgtttcctccagcgtgggtcgggtgcttctgcgcccggaaagagcgccagctcctccttcgggtgacccagggagcggggctgcaggcaaaggcgcaggcggccaaaaaggtgccaaccgggtcctgtggctttcagttgtctctgcccacccaattcacaccatctttccccctcagccgcctgtcctgggacttcaggctcagcaccaaacgcagcaaaagtaggtgcacagagagcggggtcagctcacgcagcccgagcagaatggctgtgctgccgccccaggcccgcggccaccgctgtgtgtgtggcaggagtcagccccccagcgtggggccccgaagcccgcggtccttccacggggagggccaggcccgcagggcgcagacgatgggggacaggctgcgccagcgctcgcctgaggccccgcacacaaacctcaggcccatgggtccgctccgcggggcaggcgtcgtgggcccaaggaggccaggccaggagtctcggcctcggggttacgcggcggcgggcagctcttccgctccgctcagggtgctgctaacccacagccgagcagcgacccgcaggaccggcgagaaccccgccactgcctccggccggaagagaacgtgcagagatgtacgtcacttccggggcgtggcgtggcgggcgtggcgtcccgcccctggcggcgtgcctggtgccctgttccgcgtctgtgcgaccgtccgtcccgagcgcgcagccgcggcaggccaggtcagagcagcccaccatgggatggggagggggtggaggctgcaccccgcgcccacccatccaccagcagccgccggagcgccgcgtggtcaccgttgtctttctcggcctcctgctggacctcctggccttcacgctgctgctgcccctgctgcccgggctgttggagagccacggccgtgcccacgaccccctctatggctcctggcagggcggggtggactggtttgccaccgccatcgggatgccagtggagaagaggtacaacagtgtcctgttcggaggtctcattggctcggcattctctgtcctgcagtttctgtgtgcgccactcactggggccacctctgactgcttggggaggcgcccggtgatgctgctgtgcctggctgattgggggcatcagcaaagggaacgtcagcctctccacggccatcgttgctgacctgggctcgcctctggcccgcagtcaaggcatggcggtcattggggtggccttctcactgggcttcaccctgggccctatgctcggagcctccctgcccctggaaatggcaccctggtttgccctgctcttcgcagcctccgacctgctgttcatcttctgcttcctgccagagacgctgcccctggagaaacgggcgccctctatcgccctggggttccgtgatgcggctgatctgctcagccccctggccctgctgcgcttctcggctgtcgctcgtggccaggacccaccctctggagacaggctcagcagcctgcgccgcctgggcctagtctacttcctctacctcttcctgttctcgggcctggagtacacgctgagcttcctcacacaccagcgcttccagttcagtagcctacagcaggggaagatgtttttcctcatcggcctcaccatggccaccatccagggtgcctatgcccggcggatccaccctggcggggaagttgctgccgtgaagcgggccctcctgctgctggtgcccgccttcctcctcatcggctggggacgttctctgcccgtgctgggcctggggctgctgctctactcctttgccgccgccgttgtggtgccctgcctgtcctccgtggtcgctggctatggctcaccagggcagaagggcacggtcatgggtacactgcgcagcctaggtgctctggccagggccgcggggcccctggtggccgcttcagtgtactggctggccggggcccaggcctgcttcaccacgtggtccgggctctttttgctccccttcttcctcctgcagaagctgagttacccggcacagacgctcaaggctgagtagctgagccactgtgcccaggctgtgggcaccaggcagagtgggagcctaggtcaggcccctgcccactgcctgacccccaccccccgccagtccagggagaccctgtgggtgggggccggcccctaagcaggaagctcaggcagctcctccagacttacttactccttcagtgactccgagctgcagcactccaaggctgtcagggcttctgtttgttttttaaactatgcaccaggtttctgatgatgaaataaagcacctgtttgttttataccaa

SEQ ID NO: 356563 - DNA, 3964 bp, Homo sapiens
tccccccctcccccattccgctaggtacgaggctgggtggtgcacgtgtcttagggtagcgcgcgcctgtctctcttcgggtctcgggcccttgggcgcagcggggcgcgcgccatggcgaaggcgaagaaggtcggggcgcgaaggaaggcctccggggcgccggcgggagcgcgagggggcccggcgaaggccaactccaatccgttcgaggtgaaagttaacaggcagaagttccagatcctgggccggaagacgcgccacgacgtgggactgcccggggtgtctcgcgcacgggccctcaggaagcgtacacagactttactaaaagagtacaaagaaagggataaatccaatgtattcagagataaacgcttcggagaatacaacagcaacatgagccccgaggagaagatgatgaagaggtttgctctggaacagcagcgacatcatgagaaaaaaagcatctacaatctaaatgaagatgaagaattgactcattatggccagtctttggcagacatcgagaagcataatgacattgtggacagtgacagcgatgctgaggatcgaggaacgttgtctgctgagctgactgctgcccactttggaggaggcggtgggctccttcacaagaagactcaacaggaaggcgaggagcgggagaaaccgaagtcccggaaagagctgattgaagagctcattgccaagtcaaaacaagagaagagggagagacaagctcaacgagaagatgccctcgagctcacggagaagctagaccaagactggaaagaaattcagactctcctgtcccacaaaactcccaagtcagagaacagagacaaaaaggaaaaacccaagcccgatgcatatgacatgatggttcgcgagcttggctttgaaatgaaggcgcagccctctaacaggatgaagacggaggcagaattggcaaaggaagagcaggagcacctcaggaagctggaggctgagagacttcgaagaatgcttggaaaggatgaggatgaaaatgttaagaaaccaaaacatatgtcagcagatgatctgaatgatggcttcgtgctagataaagatgacaggcgtttgctttcctacaaagatggaaagatgaatgtcgaggaagatgtccaggaagagcaaagcaaggaagccagtgaccctgagagcaacgaggaagaaggtgacagttcaggcggggaggacacagaggagagcgacagcccagatagccacttggacctggaatccaacgtggagagtgaggaagaaaacgagaagccagcaaaagagcagaggcagactcctgggaaagggttgataagcggcaaggaaagagctggaaaagctaccagagacgagctgccctacacgttcgcaggaagatcgatggaagagcagcttttggtggtggagagaattcagaagtgcaaccacccgagtctcgcagaaggaaacaaagcaaaattagaaaaactgtttggctttcttttggaatacgttggcgatttggctacagatgacccaccagacctcacagtcattgataagttggttgtgcacttatatcatctttgccagatgtttcctgaatctgcaagtgacgctatcaaatttgttctccgagatgcgatgcatgagatggaagaaatgattgagaccaaaggccgggcggcattgccagggttggatgtgctcatttatttgaaaatcactgggctgctatttccaacttccgacttctggcacccagtggtgacccctgccctcgtgtgcctcagtcagctgctcaccaagtgccccatcctgtccctccaggacgtggtgaagggcctgttcgtgtgctgcctgttcctggagtatgtggctttgtcccagaggtttatacctgagcttattaattttcttcttgggattctttacatagcaactccaaacaaagcaagccaaggttccactctggtgcaccctttcagagcgcttgggaagaactcggaactgctcgtggtgtctgctagagaggatgtggccacgtggcagcagagcagcctctccctccgctgggcgagtagactgagggccccaacttcgacagaggccaatcacatccgactgtcctgcctggctgtgggcctggccctgctgaagcgctgcgtgctcatgtacgggtccctgccatccttccacgccatcatggggcctctccgagccctcctcacggatcacctggcggactgcagccacccgcaggagctccaggagctgtgtcagagcacactgaccgaaatggaaagccagaagcagctctgccggccgctgacctgtgagaagagcaagcctgtcccactgaagcttttcacaccccggctggtcaaagtcctcgagtttggaagaaaacaaggcagtagtaaggaggaacaggaaaggaagaggctgatccacaaacacaagcgtgaatttaaaggggccgttcgagaaatccgcaaggacaatcagttcctggcgaggatgcaactctcagaaatcatggaacgggatgcggaaagaaagcggaaagtaaagcagctttttaacagcctggctacacaggaaggcgaatggaaggctctgaagaggaaaaagttcaaaaaataaattacattttataaataaggcaaggaactggacattacctcacatctgcaattccaaccctctgggaggccaaggcaggaagattgcttcagcccaggagttcgagaccagcctgggcaacacaggaagaccccgtctctaccaaaaaaacataaaaattagccaagtgtggtggcacgcacctgtagtcccaactactcgggaggctgaagcaggaggactgcttgagctgagtccaaggttacagtgagccgtgattgagccactgcactccagcctcggccacagtgcaagactgtgtcgcttaaaaaaaaatttttttttttgagacggagttttgctcttgttgcccaggctggagtgcaatggcacaacctccacctcctgggttcaagcgattctcctgcctcagcctcccgagtagctgggattacagacatgtgccaccacgcccagctaattttgtatttttagtagagacggggtttctccatgttggtcaggctggtctcgaattcccgacctcaggtaatccacctgccttggccccccaattataggtgtgagccacagcacccagccaaaaaagtaattttttttagagtaataatgctataatgttggtgtgattccaacctccagctccccccacccgctgcctgcggttttgtttctgttaaaacgtcacctgatgaaatagaatgaatcctgaaatgcacctctgggatcgggaatggtctgtgtgttatcagctgcgactggttcactgcgtctggacaagcctcatggggactggggattctggccagtgtaatttctgtcaaccacggacgtttgccttcatgtgtagaatttactgttgttatgcaaattatattttcaattataaatgaaacaagtttgcagatattttagaaatcagagaagggaaacatcacccacagtccctctgctggaacagccacagttggccttgtcctacttacgtccttcagtggatgcttctgggtgctggggttctccattcaggacactgcactctcggaggtgggaggagactgggttgcgtctgtgccgacctgggatgcagtttcaggtcagaatcagaagatgtgcaagttacgcatgacacagctttttaaagtgcttttcccctgcactaatcaagagggaggtcagccctcaggtgtgctggacccgggagggactgtgagctgtaagaagtaacgagccccttgaacttcacaagctggccagggagccatatcccgaatgccactgccacttcctcgtggtgcaaggcttgttgggacct

SEQ ID NO: 356564 - DNA, 3244 bp, Homo sapiens
tccccccctcccccattccgctaggtacgaggctgggtggtgcacgtgtcttagggtagcgcgcgcctgtctctcttcgggtctcgggcccttgggcgcagcggggcgcgcgccatggcgaaggcgaagaaggtcggggcgcgaaggaaggcctccggggcgccggcgggagcgcgagggggcccggcgaaggccaactccaatccgttcgaggtgaaagttaacaggcagaagttccagatcctgggccggaagacgcgccacgacgtgggactgcccggggtgtctcgcgcacgggccctcaggaagcgtacacagactttactaaaagagtacaaagaaagggataaatccaatgtattcagagataaacgcttcggagaatacaacagcaacatgagccccgaggagaagatgatgaagaggtttgctctggaacagcagcgacatcatgagaaaaaaagcatctacaatctaaatgaagatgaagaattgactcattatggccagtctttggcagacatcgagaagcataatgacattgtggacagtgacagcgatgctgaggatcgaggaacgttgtctgctgagctgactgctgcccactttggaggaggcggtgggctccttcacaagaagactcaacaggaaggcgaggagcgggagaaaccgaagtcccggaaagagctgattgaagagctcattgccaagtcaaaacaagagaagagggagagacaagctcaacgagaagatgccctcgagctcacggagaagctagaccaagactggaaagaaattcagactctcctgtcccacaaaactcccaagtcagagaacagagacaaaaaggaaaaacccaagcccgatgcatatgacatgatggttcgcgagcttggctttgaaatgaaggcgcagccctctaacaggatgaagacggaggcagaattggcaaaggaagagcaggagcacctcaggaagctggaggctgagagacttcgaagaatgcttggaaaggatgaggatgaaaatgttaagaaaccaaaacatatgtcagcagatgatctgaatgatggcttcgtgctagataaagatgacaggcgtttgctttcctacaaagatggaaagatgaatgtcgaggaagatgtccaggaagagcaaagcaaggaagccagtgaccctgagagcaacgaggaagaaggtgacagttcaggcggggaggacacagaggagagcgacagcccagatagccacttggacctggaatccaacgtggagagtgaggaagaaaacgagaagccagcaaaagagcagaggcagactcctgggaaagggttgataagcggcaaggaaagagctggaaaagctaccagagacgagctgccctacacgttcgcagcccctgaatcctatgaggaactgagatctctgttgttaggaagatcgatggaagagcagcttttggtggtggagagaattcagaagtgcaaccacccgagtctcgcagaaggaaacaaagcaaaattagaaaaactgtttggctttcttttggaatacgttggcgatttggctacagatgacccaccagacctcacagtcattgataagttggttgtgcacttatatcatctttgccagatgtttcctgaatctgcaagtgacgctatcaaatttgttctccgagatgcgatgcatgagatggaagaaatgattgagaccaaaggccgggcggcattgccagggttggatgtgctcatttatttgaaaatcactgggctgctatttccaacttccgacttctggcacccagtggtgacccctgccctcgtgtgcctcagtcagctgctcaccaagtgccccatcctgtccctccaggacgtggtgaagggcctgttcgtgtgctgcctgttcctggagtatgtggctttgtcccagaggtttatacctgagcttattaattttcttcttgggattctttacatagcaactccaaacaaagcaagccaaggttccactctggtgcaccctttcagagcgcttgggaagaactcggaactgctcgtggtgtctgctagagaggatgtggccacgtggcagcagagcagcctctccctccgctgggcgagtagactgagggccccaacttcgacagaggccaatcacatccgactgtcctgcctggctgtgggcctggccctgctgaagcgctgcgtgctcatgtacgggtccctgccatccttccacgccatcatggggcctctccgagccctcctcacggatcacctggcggactgcagccacccgcaggagctccaggagctgtgtcagagcacactgaccgaaatggaaagccagaagcagctctgccggccgctgacctgtgagaagagcaagcctgtcccactgaagcttttcacaccccggctggtcaaagtgctggtctcgaattcccgacctcaggtaatccacctgccttggccccccaattataggtgtgagccacagcacccagccaaaaaagtaattttttttagagtaataatgctataatgttggtgtgattccaacctccagctccccccacccgctgcctgcggttttgtttctgttaaaacgtcacctgatgaaatagaatgaatcctgaaatgcacctctgggatcgggaatggtctgtgtgttatcagctgcgactggttcactgcgtctggacaagcctcatggggactggggattctggccagtgtaatttctgtcaaccacggacgtttgccttcatgtgtagaatttactgttgttatgcaaattatattttcaattataaatgaaacaagtttgcagatattttagaaatcagagaagggaaacatcacccacagtccctctgctggaacagccacagttggccttgtcctacttacgtccttcagtggatgcttctgggtgctggggttctccattcaggacactgcactctcggaggtgggaggagactgggttgcgtctgtgccgacctgggatgcagtttcaggtcagaatcagaagatgtgcaagttacgcatgacacagctttttaaagtgcttttcccctgcactaatcaagagggaggtcagccctcaggtgtgctggacccgggagggactgtgagctgtaagaagtaacgagccccttgaacttcacaagctggccagggagccatatcccgaatgccactgccacttcctcgtggtgcaaggcttgttgggacct

SEQ ID NO: 356565 - DNA, 4188 bp, Homo sapiens
tccccccctcccccattccgctaggtacgaggctgggtggtgcacgtgtcttagggtagcgcgcgcctgtctctcttcgggtctcgggcccttgggcgcagcggggcgcgcgccatggcgaaggcgaagaaggtcggggcgcgaaggaaggcctccggggcgccggcgggagcgcgagggggcccggcgaaggccaactccaatccgttcgaggtgaaagttaacaggcagaagttccagatcctgggccggaagacgcgccacgacgtgggactgcccggggtgtctcgcgcacgggccctcaggaagcgtacacagactttactaaaagagtacaaagaaagggataaatccaatgtattcagagataaacgcttcggagaatacaacagcaacatgagccccgaggagaagatgatgaagaggtttgctctggaacagcagcgacatcatgagaaaaaaagcatctacaatctaaatgaagatgaagaattgactcattatggccagtctttggcagacatcgagaagcataatgacattgtggacagtgacagcgatgctgaggatcgaggaacgttgtctgctgagctgactgctgcccactttggaggaggcggtgggctccttcacaagaagactcaacaggaaggcgaggagcgggagaaaccgaagtcccggaaagagctgattgaagagctcattgccaagtcaaaacaagagaagagggagagacaagctcaacgagaagatgccctcgagctcacggagaagctagaccaagactggaaagaaattcagactctcctgtcccacaaaactcccaagtcagagaacagagacaaaaaggaaaaacccaagcccgatgcatatgacatgatggttcgcgagcttggctttgaaatgaaggcgcagccctctaacaggatgaagacggaggcagaattggcaaaggaagagcaggagcacctcaggaagctggaggctgagagacttcgaagaatgcttggaaaggatgaggatgaaaatgttaagaaaccaaaacatatgtcagcagatgatctgaatgatggcttcgtgctagataaagatgacaggcgtttgctttcctacaaagatggaaagatgaatgtcgaggaagatgtccaggaagagcaaagcaaggaagccagtgaccctgagagcaacgaggaagaaggtgacagttcaggcggggaggacacagaggagagcgacagcccagatagccacttggacctggaatccaacgtggagagtgaggaagaaaacgagaagccagcaaaagagcagaggcagactcctgggaaagggttgataagcggcaaggaaagagctggaaaagctaccagagacgagctgccctacacgttcgcagcccctgaatcctatgaggaactgagatctctgttgttaggaagatcgatggaagagcagcttttggtggtggagagaattcagaagtgcaaccacccgagtctcgcagaaggaaacaaagcaaaattagaaaaactgtttggctttcttttggaatacgttggcgatttggctacagatgacccaccagacctcacagtcattgataagttggttgtgcacttatatcatctttgccagatgtttcctgaatctgcaagtgacgctatcaaatttgttctccgagatgcgatgcatgagatggaagaaatgattgagaccaaaggccgggcggcattgccagggttggatgtgctcatttatttgaaaatcactgggctgctatttccaacttccgacttctggcacccagtggtgacccctgccctcgtgtgcctcagtcagctgctcaccaagtgccccatcctgtccctccaggacgtggtgaagggcctgttcgtgtgctgcctgttcctggagtatgtggctttgtcccagaggtttatacctgagcttattaattttcttcttgggattctttacatagcaactccaaacaaagcaagccaaggttccactctggtgcaccctttcagagcgcttgggaagaactcggaactgctcgtggtgtctgctagagaggatgtggccacgtggcagcagagcagcctctccctccgctgggcgagtagactgagggccccaacttcgacagaggccaatcacatccgactgtcctgcctggctgtgggcctggccctgctgaagcgctgcgtgctcatgtacgggtccctgccatccttccacgccatcatggggcctctccgagccctcctcacggatcacctggcggactgcagccacccgcaggagctccaggagctgtgtcagagcacactgaccgaaatggaaagccagaagcagctctgccggccgctgacctgtgagaagagcaagcctgtcccactgaagcttttcacaccccggctggtcaaagtgtgtgggtgctggcagcatctccctgggaggccagggctgtgggctcagtgggagctgacggggggcgtctgccagttctgcagttgagcagatgactacggagtgaagccacactcccaagcaggctctggctgagaggtggggacagactcttgcttccttaacagtggctttctggttgtagcctcgagtttggaagaaaacaaggcagtagtaaggaggaacaggaaaggaagaggctgatccacaaacacaagcgtgaatttaaaggggccgttcgagaaatccgcaaggacaatcagttcctggcgaggatgcaactctcagaaatcatggaacgggatgcggaaagaaagcggaaagtaaagcagctttttaacagcctggctacacaggaaggcgaatggaaggctctgaagaggaaaaagttcaaaaaataaattacattttataaataaggcaaggaactggacattacctcacatctgcaattccaaccctctgggaggccaaggcaggaagattgcttcagcccaggagttcgagaccagcctgggcaacacaggaagaccccgtctctaccaaaaaaacataaaaattagccaagtgtggtggcacgcacctgtagtcccaactactcgggaggctgaagcaggaggactgcttgagctgagtccaaggttacagtgagccgtgattgagccactgcactccagcctcggccacagtgcaagactgtgtcgcttaaaaaaaaatttttttttttgagacggagttttgctcttgttgcccaggctggagtgcaatggcacaacctccacctcctgggttcaagcgattctcctgcctcagcctcccgagtagctgggattacagacatgtgccaccacgcccagctaattttgtatttttagtagagacggggtttctccatgttggtcaggctggtctcgaattcccgacctcaggtaatccacctgccttggccccccaattataggtgtgagccacagcacccagccaaaaaagtaattttttttagagtaataatgctataatgttggtgtgattccaacctccagctccccccacccgctgcctgcggttttgtttctgttaaaacgtcacctgatgaaatagaatgaatcctgaaatgcacctctgggatcgggaatggtctgtgtgttatcagctgcgactggttcactgcgtctggacaagcctcatggggactggggattctggccagtgtaatttctgtcaaccacggacgtttgccttcatgtgtagaatttactgttgttatgcaaattatattttcaattataaatgaaacaagtttgcagatattttagaaatcagagaagggaaacatcacccacagtccctctgctggaacagccacagttggccttgtcctacttacgtccttcagtggatgcttctgggtgctggggttctccattcaggacactgcactctcggaggtgggaggagactgggttgcgtctgtgccgacctgggatgcagtttcaggtcagaatcagaagatgtgcaagttacgcatgacacagctttttaaagtgcttttcccctgcactaatcaagagggaggtcagccctcaggtgtgctggacccgggagggactgtgagctgtaagaagtaacgagccccttgaacttcacaagctggccagggagccatatcccgaatgccactgccacttcctcgtggtgcaaggcttgttgggacct

SEQ ID NO: 356566 - DNA, 3298 bp, Homo sapiens
tccccccctcccccattccgctaggtacgaggctgggtggtgcacgtgtcttagggtagcgcgcgcctgtctctcttcgggtctcgggcccttgggcgcagcggggcgcgcgccatggcgaaggcgaagaaggtcggggcgcgaaggaaggcctccggggcgccggcgggagcgcgagggggcccggcgaaggccaactccaatccgttcgaggtgaaagttaacaggcagaagttccagatcctgggccggaagacgcgccacgacgtgggactgcccggggtgtctcgcgcacgggccctcaggaagcgtacacagactttactaaaagagtacaaagaaagggataaatccaatgtattcagagataaacgcttcggagaatacaacagcaacatgagccccgaggagaagatgatgaagaggtttgctctggaacagcagcgacatcatgagaaaaaaagcatctacaatctaaatgaagatgaagaattgactcattatggccagtctttggcagacatcgagaagcataatgacattgtggacagtgacagcgatgctgaggatcgaggaacgttgtctgctgagctgactgctgcccactttggaggaggcggtgggctccttcacaagaagactcaacaggaaggcgaggagcgggagaaaccgaagtcccggaaagagctgattgaagagctcattgccaagtcaaaacaagagaagagggagagacaagctcaacgagaagatgccctcgagctcacggagaagctagaccaagactggaaagaaattcagactctcctgtcccacaaaactcccaagtcagagaacagagacaaaaaggaaaaacccaagcccgatgcatatgacatgatggttcgcgagcttggctttgaaatgaaggcgcagccctctaacaggatgaagacggaggcagaattggcaaaggaagagcaggagcacctcaggaagctggaggctgagagacttcgaagaatgcttggaaaggatgaggatgaaaatgttaagaaaccaaaacatatgtcagcagatgatctgaatgatggcttcgtgctagataaagatgacaggcgtttgctttcctacaaagatggaaagatgaatgtcgaggaagatgtccaggaagagcaaagcaaggaagccagtgaccctgagagcaacgaggaagaaggtgacagttcaggcggggaggacacagaggagagcgacagcccagatagccacttggacctggaatccaacgtggagagtgaggaagaaaacgagaagccagcaaaagagcagaggcagactcctgggaaagggttgataagcggcaaggaaagagctggaaaagctaccagagacgagctgccctacacgttcgcagcccctgaatcctatgaggaactgagatctctgttgttaggaagatcgatggaagagcagcttttggtggtggagagaattcagaagtgcaaccacccgagtctcgcagaaggaaacaaagcaaaattagaaaaactgtttggctttcttttggaatacgttggcgatttggctacagatgacccaccagacctcacagtcattgataagttggttgtgcacttatatcatctttgccagatgtttcctgaatctgcaagtgacgctatcaaatttgttctccgagatgcgatgcatgagatggaagaaatgattgagaccaaaggccgggcggcattgccagggttggatgtgctcatttatttgaaaatcactgggctgctatttccaacttccgacttctggcacccagtggtgacccctgccctcgtgtgcctcagtcagctgctcaccaagtgccccatcctgtccctccaggacgtggtgaagggcctgttcgtgtgctgcctgttcctggagtatgtggctttgtcccagaggtttatacctgagcttattaattttcttcttgggattctttacatagcaactccaaacaaagcaagccaaggttccactctggtgcaccctttcagagcgcttgggaagaactcggaactgctcgtggtgtctgctagagaggatgtggccacgtggcagcagagcagcctctccctccgctgggcgagtagactgagggccccaacttcgacagaggccaatcacatccgactgtcctgcctggctgtgggcctggccctgctgaagcgctgcgtgctcatgtacgggtccctgccatccttccacgccatcatggggcctctccgagccctcctcacggatcacctggcggactgcagccacccgcaggagctccaggagctgtgtcagagcacactgaccgaaatggaaagccagaagcagctctgccggccgctgacctgtgagaagagcaagcctgtcccactgaagcttttcacaccccggctggtcaaagtcctcgagtttggaagaaaacaaggcagtagtaaggaggaacaggaaaggaagaggctggtctcgaattcccgacctcaggtaatccacctgccttggccccccaattataggtgtgagccacagcacccagccaaaaaagtaattttttttagagtaataatgctataatgttggtgtgattccaacctccagctccccccacccgctgcctgcggttttgtttctgttaaaacgtcacctgatgaaatagaatgaatcctgaaatgcacctctgggatcgggaatggtctgtgtgttatcagctgcgactggttcactgcgtctggacaagcctcatggggactggggattctggccagtgtaatttctgtcaaccacggacgtttgccttcatgtgtagaatttactgttgttatgcaaattatattttcaattataaatgaaacaagtttgcagatattttagaaatcagagaagggaaacatcacccacagtccctctgctggaacagccacagttggccttgtcctacttacgtccttcagtggatgcttctgggtgctggggttctccattcaggacactgcactctcggaggtgggaggagactgggttgcgtctgtgccgacctgggatgcagtttcaggtcagaatcagaagatgtgcaagttacgcatgacacagctttttaaagtgcttttcccctgcactaatcaagagggaggtcagccctcaggtgtgctggacccgggagggactgtgagctgtaagaagtaacgagccccttgaacttcacaagctggccagggagccatatcccgaatgccactgccacttcctcgtggtgcaaggcttgttgggacct

SEQ ID NO: 356567 - DNA, 1385 bp, Homo sapiens
gcatctattaggcagaggtggggctttgttcttacccacaattggaagttctctatggagtaaaggcggtatgtgtgccacctgattcctttccccatgtgtatctggttagggtcggccacgtgagatccgcaagcattttagaaggtgggaggggaggtgggagctggctacaggccaggcgttggcgtggttccgtgagtgtgctccagccaggcccaaagcttctcctgcccagagggaccgtttcctccagcgtgggtcgggtgcttctgcgcccggaaagagcgccagctcctccttcgggtgacccagggagcggggctgcaggcaaaggcgcaggcggccaaaaaggtgccaaccgggtcctgtggctttcagttgtctctgcccacccaattcacaccatctttccccctcagccgcctgtcctgggacttcaggctcagcaccaaacgcagcaaaagtaggtgcacagagagcggggtcagctcacgcagcccgagcagaatggctgtgctgccgccccaggcccgcggccaccgctgtgtgtgtggcaggagtcagccccccagcgtggggccccgaagcccgcggtccttccacggggagggccaggcccgcagggcgcagacgatgggggacaggctgcgccagcgctcgcctgaggccccgcacacaaacctcaggcccatgggtccgctccgcggggcaggcgtcgtgggcccaaggaggccaggccaggagtctcggcctcggggttacgcggcggcgggcagctcttccgctccgctcagggtgctgctaacccacagccgagcagcgacccgcaggaccggcgagaaccccgccactgcctcccgacgcgtgggtcgacccacgcgtccggacccacgcgtccggctcaccagggcagaagggcacggtcatgggtacactgcgcagcctaggtgctctggccagggccgcggggcccctggtggccgcttcagtgtactggctggccggggcccaggcctgcttcaccacgtggtccgggctctttttgctccccttcttcctcctgcagaagctgagttacccggcacagacgctcaaggctgagtagctgagccactgtgcccaggctgtgggcaccaggcagagtgggagcctaggtcaggcccctgcccactgcctgacccccaccccccgccagtccagggagaccctgtgggtgggggccggcccctaagcaggaagctcaggcagctcctccagacttacttactccttcagtgactccgagctgcagcactccaaggctgtcagggcttctgtttgttttttaaactatgcaccaggtttctgatgatgaaataaagcacctgtttgttttataccaa

SEQ ID NO: 356568 - DNA, 2019 bp, Homo sapiens
acgtttctggctgtgaggagcacaggctatggtgacctccaactccccaagtcccctcctttcagagagtgctctcaggggccagcccacggccctccctcttcaagaagacagtggctttacttcgttccggctgtgccaggacttgagcagccacagccttggcttacccccccgcccaccggtaggcgcacagcaagggcaccatcctgctgcagggagctcgcagcactgtcctcacgctgccttgacaccacagaacccgtgcgtggagctcagggcacgcagcaggtgagtcatcgcagagtcggggatttcgtgtttttcaggagctgtgtcagagcacactgaccgaaatggaaagccagaagcagctctgccggccgctgacctgtgagaagagcaagcctgtcccactgaagcttttcacaccccggctggtcaaagtcctcgagtttggaagaaaacaaggcagtagtaaggaggaacaggaaaggaagaggctgatccacaaacacaagcgtgaatttaaaggggccgttcgagaaatccgcaaggacaatcagttcctggcgaggatgcaactctcagaaatcatggaacgggatgcggaaagaaagcggaaagtaaagcagctttttaacagcctggctacacaggaaggcgaatggaaggctctgaagaggaaaaagttcaaaaaataaattacattttataaataaggcaaggaactggacattacctcacatctgcaattccaaccctctgggaggccaaggcaggaagattgcttcagcccaggagttcgagaccagcctgggcaacacaggaagaccccgtctctaccaaaaaaacataaaaattagccaagtgtggtggcacgcacctgtagtcccaactactcgggaggctgaagcaggaggactgcttgagctgagtccaaggttacagtgagccgtgattgagccactgcactccagcctcggccacagtgcaagactgtgtcgcttaaaaaaaaatttttttttttgagacggagttttgctcttgttgcccaggctggagtgcaatggcacaacctccacctcctgggttcaagcgattctcctgcctcagcctcccgagtagctgggattacagacatgtgccaccacgcccagctaattttgtatttttagtagagacggggtttctccatgttggtcaggctggtctcgaattcccgacctcaggtaatccacctgccttggccccccaattataggtgtgagccacagcacccagccaaaaaagtaattttttttagagtaataatgctataatgttggtgtgattccaacctccagctccccccacccgctgcctgcggttttgtttctgttaaaacgtcacctgatgaaatagaatgaatcctgaaatgcacctctgggatcgggaatggtctgtgtgttatcagctgcgactggttcactgcgtctggacaagcctcatggggactggggattctggccagtgtaatttctgtcaaccacggacgtttgccttcatgtgtagaatttactgttgttatgcaaattatattttcaattataaatgaaacaagtttgcagatattttagaaatcagagaagggaaacatcacccacagtccctctgctggaacagccacagttggccttgtcctacttacgtccttcagtggatgcttctgggtgctggggttctccattcaggacactgcactctcggaggtgggaggagactgggttgcgtctgtgccgacctgggatgcagtttcaggtcagaatcagaagatgtgcaagttacgcatgacacagctttttaaagtgcttttcccctgcactaatcaagagggaggtcagccctcaggtgtgctggacccgggagggactgtgagctgtaagaagtaacgagccccttgaacttcacaagctggccagggagccatatcccgaatgccactgccacttcctcgtggtgcaaggcttgttgggacct

SEQ ID NO: 356569 - DNA, 1450 bp, Homo sapiens
tccaaaaatgggcatttgccttttgtttcttttagggatgcggaaagaaagcggaaagtaaagcagctttttaacagcctggctacacaggaaggcgaatggaaggctctgaagaggaaaaagttcaaaaaataaattacattttataaataaggcaaggaactggacattacctcacatctgcaattccaaccctctgggaggccaaggcaggaagattgcttcagcccaggagttcgagaccagcctgggcaacacaggaagaccccgtctctaccaaaaaaacataaaaattagccaagtgtggtggcacgcacctgtagtcccaactactcgggaggctgaagcaggaggactgcttgagctgagtccaaggttacagtgagccgtgattgagccactgcactccagcctcggccacagtgcaagactgtgtcgcttaaaaaaaaatttttttttttgagacggagttttgctcttgttgcccaggctggagtgcaatggcacaacctccacctcctgggttcaagcgattctcctgcctcagcctcccgagtagctgggattacagacatgtgccaccacgcccagctaattttgtatttttagtagagacggggtttctccatgttggtcaggctggtctcgaattcccgacctcaggtaatccacctgccttggccccccaattataggtgtgagccacagcacccagccaaaaaagtaattttttttagagtaataatgctataatgttggtgtgattccaacctccagctccccccacccgctgcctgcggttttgtttctgttaaaacgtcacctgatgaaatagaatgaatcctgaaatgcacctctgggatcgggaatggtctgtgtgttatcagctgcgactggttcactgcgtctggacaagcctcatggggactggggattctggccagtgtaatttctgtcaaccacggacgtttgccttcatgtgtagaatttactgttgttatgcaaattatattttcaattataaatgaaacaagtttgcagatattttagaaatcagagaagggaaacatcacccacagtccctctgctggaacagccacagttggccttgtcctacttacgtccttcagtggatgcttctgggtgctggggttctccattcaggacactgcactctcggaggtgggaggagactgggttgcgtctgtgccgacctgggatgcagtttcaggtcagaatcagaagatgtgcaagttacgcatgacacagctttttaaagtgcttttcccctgcactaatcaagagggaggtcagccctcaggtgtgctggacccgggagggactgtgagctgtaagaagtaacgagccccttgaacttcacaagctggccagggagccatatcccgaatgccactgccacttcctcgtggtgcaaggcttgttgggacct

SEQ ID NO: 356570 - DNA, 346 bp, Homo sapiens
gtaaaataagaaataaatatatttttaaaatgaagaatttcttctttctaccttagcccgatgcatatgacatgatggttcgcgagcttggctttgaaatgaaggcgcagccctctaacaggatgaagacggaggcagaattggcaaaggaagagcaggagcacctcaggaagctggaggtagggtggcagcacctcaggagcagggctgtgctgctgtccgtccacagccccttctgctccattttgcaggatgggctgaagagaatactctgtttgatcagtggaatattttagtctatttaaagtttatatttattcatgaatacctttttttttttttttct

SEQ ID NO: 356571 - DNA, 251 bp, Homo sapiens
aagctgtgtgcctgtggctttgttcttggtgctgagcactgagctttatttcccaattcatgttcctgcagaaactgtttggctttcttttggaatacgttggcgatttggctacagatgacccaccagacctcacagtcattgataagttggttgtgtaagtaaaaatggtgtgtcatctgggatgtggggttaagcagaacaatttttctcccatttagagtcataaaaatacattccagagttactaa

SEQ ID NO: 356572 - DNA, 423 bp, Homo sapiens
tgcctgtggctttgttcttggtgctgagcactgagctttatttcccaattcatgttcctgcagaaactgtttggctttcttttggaatacgttggcgatttggctacagatgacccaccagacctcacagtcattgataagttggttgtgtaagtaaaaatggtgtgtcatctgggatgtggggttaagcagaacaatttttctcccatttagagtcataaaaatacattccagagttactaaggtaggtggaatgatggtgtcagcatgccaagtgggcaggtggtcacccagggcttgtgagcctcacagcgcaagccggcttctcacacgtgccgctccagccactgtagagctgggactgacttttaaccacaaacaagttgattttgaaacaagtgaacccctttagatttgtggctg

SEQ ID NO: 356573 - DNA, 250 bp, Homo sapiens
gttttcatctcatttgatgctctcgacactgctataaggtgcgggggttccctctgtacttgtgaagctcagtggggtgcgtggttcatcagggaagcccggtggtcggcctagcatggcatgacatcgtcccaggacagtaaccccccatatgttcctttccagtgccccatcctgtccctccaggacgtggtgaagggcctgttcgtgtgctgcctgttcctggagtatgtggctttgtcccagaggt

SEQ ID NO: 356574 - DNA, 448 bp, Homo sapiens
tccctgcccacgctgaaaccctcagtgtctggcacaacccagaaacataaaaatcggtgtgcgtctgttagagggtgaacttccacaggctcggtgccgcagagcctgctgggagcccagtaatgttcaggccatctctgtcctgtcgcacttggaattcaggttccactctggtgcaccctttcagagcgcttgggaagaactcggaactgctcgtggtgtctgctagagaggatgtggccacgtggcagcagagcagcctctccctccgctgggcgagtagactgagggccccaacttcgacagaggccaatcacatccggtatgtgaggggaccccgctttggggcctgtgccctacagcgtccccagaggcaggagaagccactcgtgctttctgatgtgctgttcttagtgaacttgccgcccggccgtttggtttgatggag

SEQ ID NO: 356575 - DNA, 1959 bp, Homo sapiens
gtgggaggcgcggccgtggggtggggtggggccaggtccgcgatgtgctcaccctggtctctcaggaccgttgcctttgcggctattttttgtgcaatccccgaagcctgcgtttcctgctgcctgggttcggggcgggggcatcgcgcaggccagaacggcccctgcgtccgtaggccagagcccctgccatcagcccctttagggtgctcgccggctgtcgggtgtgggggtatgccaggccccggaggactcggcttccccgctaacccgacccgccgcaccccacccaggccaggtcagagcagcccaccatgggatggggagggggtggaggctgcaccccgcgcccacccatccaccagcagccgccggagcgccgcgtggtcaccgttgtctttctcggcctcctgctggacctcctggccttcacgctgctgctgcccctgctgcccgggctgttggagagccacggccgtgcccacgaccccctctatggctcctggcagggcggggtggactggtttgccaccgccatcgggatgccagtggagaagaggtacaacagtgtcctgttcggaggtctcattggctcggcattctctgtcctgcagtttctgtgtgcgccactcactggggccacctctgactgcttggggaggcgcccggtgatgctgctgtgcctgatgggtgtggccacctcatatgcagtctgggccacctctcggagctttgcggccttcctggcctccaggctgattgggggcatcagcaaagggaacgtcagcctctccacggccatcgttgctgacctgggctcgcctctggcccgcagtcaaggcatggcggtcattggggtggccttctcactgggcttcaccctgggccctatgctcggagcctccctgcccctggaaatggcaccctggtttgccctgctcttcgcagcctccgacctgctgttcatcttctgcttcctgccagagacgctgcccctggagaaacgggcgccctctatcgccctggggttccgtgatgcggctgatctgctcagccccctggccctgctgcgcttctcggctgtcgctcgtggccaggacccaccctctggagacaggctcagcagcctgcgccgcctgggcctagtctacttcctctacctcttcctgttctcgggcctggagtacacgctgagcttcctcacacaccagcgcttccagttcagtagcctacagcaggggaagatgtttttcctcatcggcctcaccatggccaccatccagggtgcctatgcccggcggatccaccctggcggggaagttgctgccgtgaagcgggccctcctgctgctggtgcccgccttcctcctcatcggctggggacgttctctgcccgtgctgggcctggggctgctgctctactcctttgccgccgccgttgtggtgccctgcctgtcctccgtggtcgctggctatggctcaccagggcagaagggcacggtcatgggtacactgcgcagcctaggtgctctggccagggccgcggggcccctggtggccgcttcagtgtactggctggccggggcccaggcctgcttcaccacgtggtccgggctctttttgctccccttcttcctcctgcagaagctgagttacccggcacagacgctcaaggctgagtagctgagccactgtgcccaggctgtgggcaccaggcagagtgggagcctaggtcaggcccctgcccactgcctgacccccaccccccgccagtccagggagaccctgtgggtgggggccggcccctaagcaggaagctcaggcagctcctccagacttacttactccttcagtgactccgagctgcagcactccaaggctgtcagggcttctgtttgttttttaaactatgcaccaggtttctgatgatgaaataaagcacctgtttgttttataccaa

SEQ ID NO: 356576 - DNA, 2666 bp, Homo sapiens
gcatctattaggcagaggtggggctttgttcttacccacaattggaagttctctatggagtaaaggcggtatgtgtgccacctgattcctttccccatgtgtatctggttagggtcggccacgtgagatccgcaagcattttagaaggtgggaggggaggtgggagctggctacaggccaggcgttggcgtggttccgtgagtgtgctccagccaggcccaaagcttctcctgcccagagggaccgtttcctccagcgtgggtcgggtgcttctgcgcccggaaagagcgccagctcctccttcgggtgacccagggagcggggctgcaggcaaaggcgcaggcggccaaaaaggtgccaaccgggtcctgtggctttcagttgtctctgcccacccaattcacaccatctttccccctcagccgcctgtcctgggacttcaggctcagcaccaaacgcagcaaaagtaggtgcacagagagcggggtcagctcacgcagcccgagcagaatggctgtgctgccgccccaggcccgcggccaccgctgtgtgtgtggcaggagtcagccccccagcgtggggccccgaagcccgcggtccttccacggggagggccaggcccgcagggcgcagacgatgggggacaggctgcgccagcgctcgcctgaggccccgcacacaaacctcaggcccatgggtccgctccgcggggcaggcgtcgtgggcccaaggaggccaggccaggagtctcggcctcggggttacgcggcggcgggcagctcttccgctccgctcagggtgctgctaacccacagccgagcagcgacccgcaggaccggcgagaaccccgccactgcctccggccggaagagaacgtgcagagatgtacgtcacttccggggcgtggcgtggcgggcgtggcgtcccgcccctggcggcgtgcctggtgccctgttccgcgtctgtgcgaccgtccgtcccgagcgcgcagccgcggcaggccaggtcagagcagcccaccatgggatggggagggggtggaggctgcaccccgcgcccacccatccaccagcagccgccggagcgccgcgtggtcaccgttgtctttctcggcctcctgctggacctcctggccttcacgctgctgctgcccctgctgcccgggctgttggagagccacggccgtgcccacgaccccctctatggctcctggcagggcggggtggactggtttgccaccgccatcgggatgccagtggagaagaggtacaacagtgtcctgttcggaggtctcattggctcggcattctctgtcctgcagtttctgtgtgcgccactcactggggccacctctgactgcttggggaggcgcccggtgatgctgctgtgcctgatgggtgtggccacctcatatgcagtctgggccacctctcggagctttgcggccttcctggcctccaggctgattgggggcatcagcaaagggaacgtcagcctctccacggccatcgttgctgacctgggctcgcctctggcccgcagtcaaggcatggcggtcattggggtggccttctcactgggcttcaccctgggccctatgctcggagcctccctgcccctggaaatggcaccctggtttgccctgctcttcgcagcctccgacctgctgttcatcttctgcttcctgccagagacgctgcccctggagaaacgggcgccctctatcgccctggggttccgtgatgcggctgatctgctcagccccctggccctgctgcgcttctcggctgtcgctcgtggccaggacccaccctctggagacaggctcagcagcctgcgccgcctgggcctagtctacttcctctacctcttcctgttctcgggcctggagtacacgctgagcttcctcacacaccagcgcttccagttcagtagcctacagcaggggaagatgtttttcctcatcggcctcaccatggccaccatccagggtgcctatgcccggcggatccaccctggcggggaagttgctgccgtgaagcgggccctcctgctgctggtgcccgccttcctcctcatcggctggggacgttctctgcccgtgctgggcctggggctgctgctctactcctttgccgccgccgttgtggtgccctgcctgtcctccgtggtcgctggctatggctcaccagggcagaagggcacggtcatgggtacactgcgcagcctaggtgctctggccagggccgcggggcccctggtggccgcttcagtgtactggctggccggggcccaggcctgcttcaccacgtggtccgggctctttttgctccccttcttcctcctgcagaagctgagttacccggcacagacgctcaaggctgagtagctgagccactgtgcccaggctgtgggcaccaggcagagtgggagcctaggtcaggcccctgcccactgcctgacccccaccccccgccagtccagggagaccctgtgggtgggggccggcccctaagcaggaagctcaggcagctcctccagacttacttactccttcagtgactccgagctgcagcactccaaggctgtcagggcttctgtttgttttttaaactatgcaccaggtttctgatgatgaaataaagcacctgtttgttttataccaa

SEQ ID NO: 356577 - DNA, 2773 bp, Homo sapiens
gcatctattaggcagaggtggggctttgttcttacccacaattggaagttctctatggagtaaaggcggtatgtgtgccacctgattcctttccccatgtgtatctggttagggtcggccacgtgagatccgcaagcattttagaaggtgggaggggaggtgggagctggctacaggccaggcgttggcgtggttccgtgagtgtgctccagccaggcccaaagcttctcctgcccagagggaccgtttcctccagcgtgggtcgggtgcttctgcgcccggaaagagcgccagctcctccttcgggtgacccagggagcggggctgcaggcaaaggcgcaggcggccaaaaaggtgccaaccgggtcctgtggctttcagttgtctctgcccacccaattcacaccatctttccccctcagccgcctgtcctgggacttcaggctcagcaccaaacgcagcaaaagtaggtgcacagagagcggggtcagctcacgcagcccgagcagaatggctgtgctgccgccccaggcccgcggccaccgctgtgtgtgtggcaggagtcagccccccagcgtggggccccgaagcccgcggtccttccacggggagggccaggcccgcagggcgcagacgatgggggacaggctgcgccagcgctcgcctgaggccccgcacacaaacctcaggcccatgggtccgctccgcggggcaggcgtcgtgggcccaaggaggccaggccaggagtctcggcctcggggttacgcggcggcgggcagctcttccgctccgctcagggtgctgctaacccacagccgagcagcgacccgcaggaccggcgagaaccccgccactgcctccggccggaagagaacgtgcagagatgtacgtcacttccggggcgtggcgtggcgggcgtggcgtcccgcccctggcggcgtgcctggtgccctgttccgcgtctgtgcgaccgtccgtcccgagcgcgcagccgcggcaggccaggtcagagcagcccaccatgggatggggagggggtggaggctgcaccccgcgcccacccatccaccagcagccgccggagcgccgcgtggtcaccgttgtctttctcggcctcctgctggacctcctggccttcacgctgctgctgcccctgctgcccgggctgttggagagccacggccgtgcccacgaccccctctatggctcctggcagggcggggtggactggtttgccaccgccatcgggatgccagtggagaagaggtacaacagtgtcctgttcggaggtctcattggctcggcattctctgtcctgcagtttctgtgtgcgccactcactggggccacctctgactgcttggggaggcgcccggtgatgctgctgtgcctgatgggtgtggccacctcatatgcagtctgggccacctctcggagctttgcggccttcctggcctccaggctgattgggggcatcagcaaagggaacgtcagcctctccacggccatcgttgctgacctgggctcgcctctggcccgcagtcaaggcatggcggtcattggggtggccttctcactgggcttcaccctgggccctatgctcggagcctccctgcccctggaaatggcaccctggtttgccctgctcttcgcagcctccgacctgctgttcatcttctgcttcctgccagagacgctgcccctggagaaacgggcgccctctatcgccctggggttccgtgatgcggctgatctgctcagccccctggccctgctgcgcttctcggctgtcgctcgtggccaggacccaccctctggagacaggctcagcagcctgcgccgcctgggcctagtctacttcctctacctcttcctgttctcgggcctggagtacacgctgagcttcctcacacaccagcgcttccagttcagtagcctacagcaggggaagatgtttttcctcatcggcctcaccatggccaccatccagggtgcctatgcccggcggatccaccctggcggggaagttgctgccgtgaagcgggccctcctgctgctggtgcccgccttcctcctcatcggctggggacgttctctgcccgtgctgggcctggggctgctgctctactcctttgccgccgccgttgtggtgccctgcctgtcctccgtggtcgctggctatggctcaccagggcagaagggcacggtcatgggtacactgcgcagcctaggtgctctggccagggccgcggggcccctggtggccgcttcaggtgagggcgcgggatggtgctggggcaggctgggggccaagcacctgccctcgcctcccaagtgccagccccctcggggactgggtgacgccaccgtctctccgcagtgtactggctggccggggcccaggcctgcttcaccacgtggtccgggctctttttgctccccttcttcctcctgcagaagctgagttacccggcacagacgctcaaggctgagtagctgagccactgtgcccaggctgtgggcaccaggcagagtgggagcctaggtcaggcccctgcccactgcctgacccccaccccccgccagtccagggagaccctgtgggtgggggccggcccctaagcaggaagctcaggcagctcctccagacttacttactccttcagtgactccgagctgcagcactccaaggctgtcagggcttctgtttgttttttaaactatgcaccaggtttctgatgatgaaataaagcacctgtttgttttataccaa

SEQ ID NO: 356578 - DNA, 4003 bp, Homo sapiens
tccccccctcccccattccgctaggtacgaggctgggtggtgcacgtgtcttagggtagcgcgcgcctgtctctcttcgggtctcgggcccttgggcgcagcggggcgcgcgccatggcgaaggcgaagaaggtcggggcgcgaaggaaggcctccggggcgccggcgggagcgcgagggggcccggcgaaggccaactccaatccgttcgaggtgaaagttaacaggcagaagttccagatcctgggccggaagacgcgccacgacgtgggactgcccggggtgtctcgcgcacgggccctcaggaagcgtacacagactttactaaaagagtacaaagaaagggataaatccaatgtattcagagataaacgcttcggagaatacaacagcaacatgagccccgaggagaagatgatgaagaggtttgctctggaacagcagcgacatcatgagaaaaaaagcatctacaatctaaatgaagatgaagaattgactcattatggccagtctttggcagacatcgagaagcataatgacattgtggacagtgacagcgatgctgaggatcgaggaacgttgtctgctgagctgactgctgcccactttggaggaggcggtgggctccttcacaagaagactcaacaggaaggcgaggagcgggagaaaccgaagtcccggaaagagctgattgaagagctcattgccaagtcaaaacaagagaagagggagagacaagctcaacgagaagatgccctcgagctcacggagaagctagaccaagactggaaagaaattcagactctcctgtcccacaaaactcccaagtcagagaacagagacaaaaaggaaaaacccaagcccgatgcatatgacatgatggttcgcgagcttggctttgaaatgaaggcgcagccctctaacaggatgaagacggaggcagaattggcaaaggaagagcaggagcacctcaggaagctggaggctgagagacttcgaagaatgcttggaaaggatgaggatgaaaatgttaagaaaccaaaacatatgtcagcagatgatctgaatgatggcttcgtgctagataaagatgacaggcgtttgctttcctacaaagatggaaagatgaatgtcgaggaagatgtccaggaagagcaaagcaaggaagccagtgaccctgagagcaacgaggaagaaggtgacagttcaggcggggaggacacagaggagagcgacagcccagatagccacttggacctggaatccaacgtggagagtgaggaagaaaacgagaagccagcaaaagagcagaggcagactcctgggaaagggttgataagcggcaaggaaagagctggaaaagctaccagagacgagctgccctacacgttcgcagcccctgaatcctatgaggaactgagatctctgttgttaggaagatcgatggaagagcagcttttggtggtggagagaattcagaagtgcaaccacccgagtctcgcagaaggaaacaaagcaaaattagaaaaactgtttggctttcttttggaatacgttggcgatttggctacagatgacccaccagacctcacagtcattgataagttggttgtgcacttatatcatctttgccagatgtttcctgaatctgcaagtgacgctatcaaatttgttctccgagatgcgatgcatgagatggaagaaatgattgagaccaaaggccgggcggcattgccagggttggatgtgctcatttatttgaaaatcactgggctgctatttccaacttccgacttctggcacccagtggtgacccctgccctcgtgtgcctcagtcagctgctcaccaagtgccccatcctgtccctccaggacgtggtgaagggcctgttcgtgtgctgcctgttcctggagtatgtggctttgtcccagaggtttatacctgagcttattaattttcttcttgggattctttacatagcaactccaaacaaagcaagccaaggttccactctggtgcaccctttcagagcgcttgggaagaactcggaactgctcgtggtgtctgctagagaggatgtggccacgtggcagcagagcagcctctccctccgctgggcgagtagactgagggccccaacttcgacagaggccaatcacatccgactgtcctgcctggctgtgggcctggccctgctgaagcgctgcgtgctcatgtacgggtccctgccatccttccacgccatcatggggcctctccgagccctcctcacggatcacctggcggactgcagccacccgcaggagctccaggagctgtgtcagagcacactgaccgaaatggaaagccagaagcagctctgccggccgctgacctgtgagaagagcaagcctgtcccactgaagcttttcacaccccggctggtcaaagtcctcgagtttggaagaaaacaaggcagtagtaaggaggaacaggaaaggaagaggctgatccacaaacacaagcgtgaatttaaaggggccgttcgagaaatccgcaaggacaatcagttcctggcgaggatgcaactctcagaaatcatggaacgggatgcggaaagaaagcggaaagtaaagcagctttttaacagcctggctacacaggaaggcgaatggaaggctctgaagaggaaaaagttcaaaaaataaattacattttataaataaggcaaggaactggacattacctcacatctgcaattccaaccctctgggaggccaaggcaggaagattgcttcagcccaggagttcgagaccagcctgggcaacacaggaagaccccgtctctaccaaaaaaacataaaaattagccaagtgtggtggcacgcacctgtagtcccaactactcgggaggctgaagcaggaggactgcttgagctgagtccaaggttacagtgagccgtgattgagccactgcactccagcctcggccacagtgcaagactgtgtcgcttaaaaaaaaatttttttttttgagacggagttttgctcttgttgcccaggctggagtgcaatggcacaacctccacctcctgggttcaagcgattctcctgcctcagcctcccgagtagctgggattacagacatgtgccaccacgcccagctaattttgtatttttagtagagacggggtttctccatgttggtcaggctggtctcgaattcccgacctcaggtaatccacctgccttggccccccaattataggtgtgagccacagcacccagccaaaaaagtaattttttttagagtaataatgctataatgttggtgtgattccaacctccagctccccccacccgctgcctgcggttttgtttctgttaaaacgtcacctgatgaaatagaatgaatcctgaaatgcacctctgggatcgggaatggtctgtgtgttatcagctgcgactggttcactgcgtctggacaagcctcatggggactggggattctggccagtgtaatttctgtcaaccacggacgtttgccttcatgtgtagaatttactgttgttatgcaaattatattttcaattataaatgaaacaagtttgcagatattttagaaatcagagaagggaaacatcacccacagtccctctgctggaacagccacagttggccttgtcctacttacgtccttcagtggatgcttctgggtgctggggttctccattcaggacactgcactctcggaggtgggaggagactgggttgcgtctgtgccgacctgggatgcagtttcaggtcagaatcagaagatgtgcaagttacgcatgacacagctttttaaagtgcttttcccctgcactaatcaagagggaggtcagccctcaggtgtgctggacccgggagggactgtgagctgtaagaagtaacgagccccttgaacttcacaagctggccagggagccatatcccgaatgccactgccacttcctcgtggtgcaaggcttgttgggacct

SEQ ID NO: 356579 - DNA, 2250 bp, Homo sapiens
gcatctattaggcagaggtggggctttgttcttacccacaattggaagttctctatggagtaaaggcggtatgtgtgccacctgattcctttccccatgtgtatctggttagggtcggccacgtgagatccgcaagcattttagaaggtgggaggggaggtgggagctggctacaggccaggcgttggcgtggttccgtgagtgtgctccagccaggcccaaagcttctcctgcccagagggaccgtttcctccagcgtgggtcgggtgcttctgcgcccggaaagagcgccagctcctccttcgggtgacccagggagcggggctgcaggcaaaggcgcaggcggccaaaaaggtgccaaccgggtcctgtggctttcagttgtctctgcccacccaattcacaccatctttccccctcagccgcctgtcctgggacttcaggctcagcaccaaacgcagcaaaagtaggtgcacagagagcggggtcagctcacgcagcccgagcagaatggctgtgctgccgccccaggcccgcggccaccgctgtgtgtgtggcaggagtcagccccccagcgtggggccccgaagcccgcggtccttccacggggagggccaggcccgcagggcgcagacgatgggggacaggctgcgccagcgctcgcctgaggccccgcacacaaacctcaggcccatgggtccgctccgcggggcaggcgtcgtgggcccaaggaggccaggccaggagtctcggcctcggggttacgcggcggcgggcagctcttccgctccgctcagggtgctgctaacccacagccgagcagcgacccgcaggaccggcgagaaccccgccactgcctccggccggaagagaacgtgcagagatgtacgtcacttccggggcgtggcgtggcgggcgtggcgtcccgcccctggcggcgtgcctggtgccctgttccgcgtctgtgcgaccgtccgtcccgagcgcgcagccgcggcaggccaggtcagagcagcccaccatgggatggggagggggtggaggctgcaccccgcgcccacccatccaccagcagccgccggagcgccgcgtggtcaccgttgtctttctcggcctcctgctggacctcctggccttcacgctgctgctgcccctgctgcccgggctgttggagagccacggccgtgcccacgaccccctctatggctcctggcagggcggggtggactggtttgccaccgccatcgggatgccagtggagaagaggtacaacagtgtcctgttcggaggtctcattggctcggcattctctgtcctgcagtttctgtgtgcgccactcactggggccacctctgactgcttggggaggcgcccggtgatgctgctgtgcctgatgggtgtggccacctcatatgcagtctgggccacctctcggagctttgcggccttcctggcctccaggctgattgggggcatcagcaaagggaacgtcagcctctccacggccatcgttgctgacctgggctcgcctctggcccgcagtcaaggcatggcggtcattggggtggccttctcactgggcttcaccctgggccctatgctcggagcctccctgcccctggaaatggcaccctggtttgccctgctcttcgcagcctccgacctgctgttcatcttctgcttcctgccagagacgctgcccctggagaaacgggcgccctctatcgccctggggttccgtgatgcggctgatctgctcagccccctggccctgctgcgcttctcggctgtcgctcgtggccaggacccaccctctggagacaggctcagcagcctgcgccgcctgggcctagtctacttcctctacctcttcctgttctcgggcctggagtacacgctgagcttcctcacacaccagcgcttccagttcagtagcctacagcaggggaagatgtttttcctcatcggcctcaccatggccaccatccagggtgcctatgcccggcggatccaccctggcggggaagttgctgccgtgaagcgggccctcctgctgctggtgcccgccttcctcctcatcggctggggacgttctctgcccgtgctgggcctggggctgctgctctactcctttgcggcggcgttgtggtgccttctgtctccgtggtcgtggtatggtcacagggcgagggccgcatggtaactgggagcagtgtcggcaggccggggccggggcgaagtaaggggaag

SEQ ID NO: 356580 - DNA, 3769 bp, Homo sapiens
tccccccctcccccattccgctaggtacgaggctgggtggtgcacgtgtcttagggtagcgcgcgcctgtctctcttcgggtctcgggcccttgggcgcagcggggcgcgcgccatggcgaaggcgaagaaggtcggggcgcgaaggaaggcctccggggcgccggcgggagcgcgagggggcccggcgaaggccaactccaatccgttcgaggtgaaagttaacaggcagaagttccagatcctgggccggaagacgcgccacgacgtgggactgcccggggtgtctcgcgcacgggccctcaggaagcgtacacagactttactaaaagagtacaaagaaagggataaatccaatgtattcagagataaacgcttcggagaatacaacagcaacatgagccccgaggagaagatgatgaagaggtttgctctggaacagcagcgacatcatgagaaaaaaagcatctacaatctaaatgaagatgaagaattgactcattatggccagtctttggcagacatcgagaagcataatgacattgtggacagtgacagcgatgctgaggatcgaggaacgttgtctgctgagctgactgctgcccactttggaggaggcggtgggctccttcacaagaagactcaacaggaaggcgaggagcgggagaaaccgaagtcccggaaagagctgattgaagagctcattgccaagtcaaaacaagagaagagggagagacaagctcaacgagaagatgccctcgagctcacggagaagctagaccaagactggaaagaaattcagactctcctgtcccacaaaactcccaagtcagagaacagagacaaaaaggaaaaacccaagcccgatgcatatgacatgatggttcgcgagcttggctttgaaatgaaggcgcagccctctaacaggatgaagacggaggcagaattggcaaaggaagagcaggagcacctcaggaagctggaggctgagagacttcgaagaatgcttggaaaggatgaggatgaaaatgttaagaaaccaaaacatatgtcagcagatgatctgaatgatggcttcgtgctagataaagatgacaggcgtttgctttcctacaaagatggaaagatgaatgtcgaggaagatgtccaggaagagcaaagcaaggaagccagtgaccctgagagcaacgaggaagaaggtgacagttcaggcggggaggacacagaggagagcgacagcccagatagccacttggacctggaatccaacgtggagagtgaggaagaaaacgagaagccagcaaaagagcagaggcagactcctgggaaagggttgataagcggcaaggaaagagctggaaaagctaccagagacgagctgccctacacgttcgcagcccctgaatcctatgaggaactgagatctctgttgttaggaagatcgatggaagagcagcttttggtggtggagagaattcagaagtgcaaccacccgagtctcgcagaaggaaacaaagcaaaattagaaaaactgtttggctttcttttggaatacgttggcgatttggctacagatgacccaccagacctcacagtcattgataagttggttgtgcacttatatcatctttgccagatgtttcctgaatctgcaagtgacgctatcaaatttgttctccgagatgcgatgcatgagatggaagaaatgattgagaccaaaggccgggcggcattgccagggttggatgtgctcatttatttgaaaatcactgggctgctatttccaacttccgacttctggcacccagtggtgacccctgccctcgtgtgcctcagtcagctgctcaccaagtgccccatcctgtccctccaggacgtggtgaagggcctgttcgtgtgctgcctgttcctggagtatgtggctttgtcccagaggtttatacctgagcttattaattttcttcttgggattctttacatagcaactccaaacaaagcaagccaaggttccactctggtgcaccctttcagagcgcttgggaagaactcggaactgctcgtggtgtctgctagagaggatgtggccacgtggcagcagagcagcctctccctccgctgggcgagtagactgagggccccaacttcgacagaggccaatcacatccgactgtcctgcctggctgtgggcctggccctgctgaagcgctgcgtgctcatgtacgggtccctgccatccttccacgccatcatggggcctctccgagccctcctcacggatcacctggcggactgcagccacccgcaggagctccaggagctgtgtcagagcacactgaccgaaatggaaagccagaagcagctctgccggccgctgacctgtgagaagagcaagcctgtcccactgaagcttttcacaccccggctggtcaaagtcctcgagtttggaagaaaacaaggcagtagtaaggaggaacaggaaaggaagaggctgatccacaaacacaagcgtgaatttaaaggggccgttcgagaaatccgcaaggacaatcagttcctggcgaggatgcaactctcagaaatcatggaacgggatgcggaaagaaagcggaaagtaaagcagctttttaacagcctggctacacaggaaggcgaatggaaggctctgaagaggaaaaagttcaaaaaataaattacattttataaataaggcaaggaactggacattacctcacatctgcaattccaaccctctgggaggccaaggcaggaagattgcttcagcccaggagttcgagaccagcctgggcaacacaggaagaccccgtctctaccaaaaaaacataaaaattagccaagtgtggtggcacgcacccgagtagctgggattacagacatgtgccaccacgcccagctaattttgtatttttagtagagacggggtttctccatgttggtcaggctggtctcgaattcccgacctcaggtaatccacctgccttggccccccaattataggtgtgagccacagcacccagccaaaaaagtaattttttttagagtaataatgctataatgttggtgtgattccaacctccagctccccccacccgctgcctgcggttttgtttctgttaaaacgtcacctgatgaaatagaatgaatcctgaaatgcacctctgggatcgggaatggtctgtgtgttatcagctgcgactggttcactgcgtctggacaagcctcatggggactggggattctggccagtgtaatttctgtcaaccacggacgtttgccttcatgtgtagaatttactgttgttatgcaaattatattttcaattataaatgaaacaagtttgcagatattttagaaatcagagaagggaaacatcacccacagtccctctgctggaacagccacagttggccttgtcctacttacgtccttcagtggatgcttctgggtgctggggttctccattcaggacactgcactctcggaggtgggaggagactgggttgcgtctgtgccgacctgggatgcagtttcaggtcagaatcagaagatgtgcaagttacgcatgacacagctttttaaagtgcttttcccctgcactaatcaagagggaggtcagccctcaggtgtgctggacccgggagggactgtgagctgtaagaagtaacgagccccttgaacttcacaagctggccagggagccatatcccgaatgccactgccacttcctcgtggtgcaaggcttgttgggacct

SEQ ID NO: 356581 - DNA, 3456 bp, Homo sapiens
tccccccctcccccattccgctaggtacgaggctgggtggtgcacgtgtcttagggtagcgcgcgcctgtctctcttcgggtctcgggcccttgggcgcagcggggcgcgcgccatggcgaaggcgaagaaggtcggggcgcgaaggaaggcctccggggcgccggcgggagcgcgagggggcccggcgaaggccaactccaatccgttcgaggtgaaagttaacaggcagaagttccagatcctgggccggaagacgcgccacgacgtgggactgcccggggtgtctcgcgcacgggccctcaggaagcgtacacagactttactaaaagagtacaaagaaagggataaatccaatgtattcagagataaacgcttcggagaatacaacagcaacatgagccccgaggagaagatgatgaagaggtttgctctggaacagcagcgacatcatgagaaaaaaagcatctacaatctaaatgaagatgaagaattgactcattatggccagtctttggcagacatcgagaagcataatgacattgtggacagtgacagcgatgctgaggatcgaggaacgttgtctgctgagctgactgctgcccactttggaggaggcggtgggctccttcacaagaagactcaacaggaaggcgaggagcgggagaaaccgaagtcccggaaagagctgattgaagagctcattgccaagtcaaaacaagagaagagggagagacaagctcaacgagaagatgccctcgagctcacggagaagctagaccaagactggaaagaaattcagactctcctgtcccacaaaactcccaagtcagagaacagagacaaaaaggaaaaacccaagcccgatgcatatgacatgatggttcgcgagcttggctttgaaatgaaggcgcagccctctaacaggatgaagacggaggcagaattggcaaaggaagagcaggagcacctcaggaagctggaggctgagagacttcgaagaatgcttggaaaggatgaggatgaaaatgttaagaaaccaaaacatatgtcagcagatgatctgaatgatggcttcgtgctagataaagatgacaggcgtttgctttcctacaaagatggaaagatgaatgtcgaggaagatgtccaggaagagcaaagcaaggaagccagtgaccctgagagcaacgaggaagaaggtgacagttcaggcggggaggacacagaggagagcgacagcccagatagccacttggacctggaatccaacgtggagagtgaggaagaaaacgagaagccagcaaaagagcagaggcagactcctgggaaagggttgataagcggcaaggaaagagctggaaaagctaccagagacgagctgccctacacgttcgcagcccctgaatcctatgaggaactgagatctctgttgttaggaagatcgatggaagagcagcttttggtggtggagagaattcagaagtgcaaccacccgagtctcgcagaaggaaacaaagcaaaattagaaaaactgtttggctttcttttggaatacgttggcgatttggctacagatgacccaccagacctcacagtcattgataagttggttgtgcacttatatcatctttgccagatgtttcctgaatctgcaagtgacgctatcaaatttgttctccgagatgcgatgcatgagatggaagaaatgattgagaccaaaggccgggcggcattgccagggttggatgtgctcatttatttgaaaatcactgggctgctatttccaacttccgacttctggcacccagtggtgacccctgccctcgtgtgcctcagtcagctgctcaccaagtgccccatcctgtccctccaggacgtggtgaagggcctgttcgtgtgctgcctgttcctggagtatgtggctttgtcccagaggtttatacctgagcttattaattttcttcttgggattctttacatagcaactccaaacaaagcaagccaaggttccactctggtgcaccctttcagagcgcttgggaagaactcggaactgctcgtggtgtctgctagagaggatgtggccacgtggcagcagagcagcctctccctccgctgggcgagtagactgagggccccaacttcgacagaggccaatcacatccgactgtcctgcctggctgtgggcctggccctgctgaagcgctgcgtgctcatgtacgggtccctgccatccttccacgccatcatggggcctctccgagccctcctcacggatcacctggcggactgcagccacccgcaggagctccaggagctgtgtcagagcacactgaccgaaatggaaagccagaagcagctctgccggccgctgacctgtgagaagagcaagcctgtcccactgaagcttttcacaccccggctggtcaaagtcctcgagtttggaagaaaacaaggcagtagtaaggaggaacaggaaaggaagaggctgatccacaaacacaagcgtgaatttaaaggggccgttcgagaaatccgcaaggacaatcagttcctggcgaggatgcaactctcagaaatcatggaacgggatgcggaaagaaagcggaaagtaaagcagctttttaacagcctggctacacaggaaggcgaatggaaggctctgaagaggaaaaagttcaaaaaataaattacattttataaataaggcaaggaactggacattacctcacatctgcaattccaaccctctgggaggccaaggcaggaagattgcttcagcccaggagttcgagaccagcctgggcaacacaggaagaccccgtctctaccaaaaaaacataaaaattagccaagtgtggtggcacgcacctgtagtcccaactactcgggaggctgaagcaggaggactgcttgagctgagtccaaggttacagtgagccgtgattgagccactgcactccagcctcggccacagtgcaagactgtgtcgcttaaaaaaaaatttttttttttgagacggagttttgctcttgttgcccaggctggagtgcaatggcacaacctccacctcctgggttcaagcgattctcctgcctcagcctcccgagtagctgggattacagacatgtgccaccacgcccagctaattttgtatttttagtagagacggggtttctccatgttggtcaggctggtctcgaattcccgacctcaggtaatccacctgccttggccccccaattataggtgtgagccacagcacccagccaaaaaagtaattttttttagagtaataatgctataatgttggtgtgattccaacctccagctccccccacccgctgcctgcggttttgtttctgttaaaacgtcacctgatgaaatagaatgaatcctgatgcggccggacggcaatattgaataaaaccagataagtgtgacgaaagggtggtgc

SEQ ID NO: 356582 - DNA, 3014 bp, Homo sapiens
gcatctattaggcagaggtggggctttgttcttacccacaattggaagttctctatggagtaaaggcggtatgtgtgccacctgattcctttccccatgtgtatctggttagggtcggccacgtgagatccgcaagcattttagaaggtgggaggggaggtgggagctggctacaggccaggcgttggcgtggttccgtgagtgtgctccagccaggcccaaagcttctcctgcccagagggaccgtttcctccagcgtgggtcgggtgcttctgcgcccggaaagagcgccagctcctccttcgggtgacccagggagcggggctgcaggcaaaggcgcaggcggccaaaaaggtgccaaccgggtcctgtggctttcagttgtctctgcccacccaattcacaccatctttccccctcagccgcctgtcctgggacttcaggctcagcaccaaacgcagcaaaagtaggtgcacagagagcggggtcagctcacgcagcccgagcagaatggctgtgctgccgccccaggcccgcggccaccgctgtgtgtgtggcaggagtcagccccccagcgtggggccccgaagcccgcggtccttccacggggagggccaggcccgcagggcgcagacgatgggggacaggctgcgccagcgctcgcctgaggccccgcacacaaacctcaggcccatgggtccgctccgcggggcaggcgtcgtgggcccaaggaggccaggccaggagtctcggcctcggggttacgcggcggcgggcagctcttccgctccgctcagggtgctgctaacccacagccgagcagcgacccgcaggaccggcgagaaccccgccactgcctccggccggaagagaacgtgcagagatgtacgtcacttccggggcgtggcgtggcgggcgtggcgtcccgcccctggcggcgtgcctggtgccctgttccgcgtctgtgcgaccgtccgtcccgagcgcgcagccgcggcaggccaggtcagagcagcccaccatgggatggggagggggtggaggctgcaccccgcgcccacccatccaccagcagccgccggagcgccgcgtggtcaccgttgtctttctcggcctcctgctggacctcctggccttcacgctgctgctgcccctgctgcccgggctgttggagagccacggccgtgcccacgaccccctctatggctcctggcagggcggggtggactggtttgccaccgccatcgggatgccagtggagaagaggtacaacagtgtcctgttcggaggtctcattggctcggcattctctgtcctgcagtttctgtgtgcgccactcactggggccacctctgactgcttggggaggcgcccggtgatgctgctgtgcctggtatgttcctgggcctgggtgcccatggggaagcctcctcccacccagccagtagccccatggggttaggtggggagagggaggtggctgtgggcccctcatggccactggttggccctcatcgcatcctggcagggggttctcgggggaccagtggctcctgttccagagccaggctttcaaggagctgctcctggcccctaggaaggcactgagaacgcaagtggccctcagatgcttcgaaatagggcagggttgaggggtgttgtctgggttgccaagccctactctgagccactcctggccttaagcgaccgcccctgcctcttggcccctgcccctgggcagatgggtgtggccacctcatatgcagtctgggccacctctcggagctttgcggccttcctggcctccaggctgattgggggcatcagcaaagggaacgtcagcctctccacggccatcgttgctgacctgggctcgcctctggcccgcagtcaaggcatggcggtcattggggtggccttctcactgggcttcaccctgggccctatgctcggagcctccctgcccctggaaatggcaccctggtttgccctgctcttcgcagcctccgacctgctgttcatcttctgcttcctgccagagacgctgcccctggagaaacgggcgccctctatcgccctggggttccgtgatgcggctgatctgctcagccccctggccctgctgcgcttctcggctgtcgctcgtggccaggacccaccctctggagacaggctcagcagcctgcgccgcctgggcctagtctacttcctctacctcttcctgttctcgggcctggagtacacgctgagcttcctcacacaccagcgcttccagttcagtagcctacagcaggggaagatgtttttcctcatcggcctcaccatggccaccatccagggtgcctatgcccggcggatccaccctggcggggaagttgctgccgtgaagcgggccctcctgctgctggtgcccgccttcctcctcatcggctggggacgttctctgcccgtgctgggcctggggctgctgctctactcctttgccgccgccgttgtggtgccctgcctgtcctccgtggtcgctggctatggctcaccagggcagaagggcacggtcatgggtacactgcgcagcctaggtgctctggccagggccgcggggcccctggtggccgcttcagtgtactggctggccggggcccaggcctgcttcaccacgtggtccgggctctttttgctccccttcttcctcctgcagaagctgagttacccggcacagacgctcaaggctgagtagctgagccactgtgcccaggctgtgggcaccaggcagagtgggagcctaggtcaggcccctgcccactgcctgacccccaccccccgccagtccagggagaccctgtgggtgggggccggcccctaagcaggaagctcaggcagctcctccagacttacttactccttcagtgactccgagctgcagcactccaaggctgtcagggcttctgtttgttttttaaactatgcaccaggtttctgatgatgaaataaagcacctgtttgttttataccaa

SEQ ID NO: 356583 - DNA, 2641 bp, Homo sapiens
gcatctattaggcagaggtggggctttgttcttacccacaattggaagttctctatggagtaaaggcggtatgtgtgccacctgattcctttccccatgtgtatctggttagggtcggccacgtgagatccgcaagcattttagaaggtgggaggggaggtgggagctggctacaggccaggcgttggcgtggttccgtgagtgtgctccagccaggcccaaagcttctcctgcccagagggaccgtttcctccagcgtgggtcgggtgcttctgcgcccggaaagagcgccagctcctccttcgggtgacccagggagcggggctgcaggcaaaggcgcaggcggccaaaaaggtgccaaccgggtcctgtggctttcagttgtctctgcccacccaattcacaccatctttccccctcagccgcctgtcctgggacttcaggctcagcaccaaacgcagcaaaagtaggtgcacagagagcggggtcagctcacgcagcccgagcagaatggctgtgctgccgccccaggcccgcggccaccgctgtgtgtgtggcaggagtcagccccccagcgtggggccccgaagcccgcggtccttccacggggagggccaggcccgcagggcgcagacgatgggggacaggctgcgccagcgctcgcctgaggccccgcacacaaacctcaggcccatgggtccgctccgcggggcaggcgtcgtgggcccaaggaggccaggccaggagtctcggcctcggggttacgcggcggcgggcagctcttccgctccgctcagggtgctgctaacccacagccgagcagcgacccgcaggaccggcgagaaccccgccactgcctccggccggaagagaacgtgcagagatgtacgtcacttccggggcgtggcgtggcgggcgtggcgtcccgcccctggcggcgtgcctggtgccctgttccgcgtctgtgcgaccgtccgtcccgagcgcgcagccgcggcaggccaggtcagagcagcccaccatgggatggggagggggtggaggctgcaccccgcgcccacccatccaccagcagccgccggagcgccgcgtggtcaccgttgtctttctcggcctcctgctggacctcctggccttcacgctgctgctgcccctgctgcccgggctgttggagagccacggccgtgcccacgaccccctctatggctcctggcagggcggggtggactggtttgccaccgccatcgggatgccagtggagaagaggtacaacagtgtcctgttcggaggtctcattggctcggcattctctgtcctgcagtttctgtgtgcgccactcactggggccacctctgactgcttggggaggcgcccggtgatgctgctgtgcctgtctgggccacctctcggagctttgcggccttcctggcctccaggctgattgggggcatcagcaaagggaacgtcagcctctccacggccatcgttgctgacctgggctcgcctctggcccgcagtcaaggcatggcggtcattggggtggccttctcactgggcttcaccctgggccctatgctcggagcctccctgcccctggaaatggcaccctggtttgccctgctcttcgcagcctccgacctgctgttcatcttctgcttcctgccagagacgctgcccctggagaaacgggcgccctctatcgccctggggttccgtgatgcggctgatctgctcagccccctggccctgctgcgcttctcggctgtcgctcgtggccaggacccaccctctggagacaggctcagcagcctgcgccgcctgggcctagtctacttcctctacctcttcctgttctcgggcctggagtacacgctgagcttcctcacacaccagcgcttccagttcagtagcctacagcaggggaagatgtttttcctcatcggcctcaccatggccaccatccagggtgcctatgcccggcggatccaccctggcggggaagttgctgccgtgaagcgggccctcctgctgctggtgcccgccttcctcctcatcggctggggacgttctctgcccgtgctgggcctggggctgctgctctactcctttgccgccgccgttgtggtgccctgcctgtcctccgtggtcgctggctatggctcaccagggcagaagggcacggtcatgggtacactgcgcagcctaggtgctctggccagggccgcggggcccctggtggccgcttcagtgtactggctggccggggcccaggcctgcttcaccacgtggtccgggctctttttgctccccttcttcctcctgcagaagctgagttacccggcacagacgctcaaggctgagtagctgagccactgtgcccaggctgtgggcaccaggcagagtgggagcctaggtcaggcccctgcccactgcctgacccccaccccccgccagtccagggagaccctgtgggtgggggccggcccctaagcaggaagctcaggcagctcctccagacttacttactccttcagtgactccgagctgcagcactccaaggctgtcagggcttctgtttgttttttaaactatgcaccaggtttctgatgatgaaataaagcacctgtttgttttataccaa

SEQ ID NO: 356584 - DNA, 2563 bp, Homo sapiens
gcatctattaggcagaggtggggctttgttcttacccacaattggaagttctctatggagtaaaggcggtatgtgtgccacctgattcctttccccatgtgtatctggttagggtcggccacgtgagatccgcaagcattttagaaggtgggaggggaggtgggagctggctacaggccaggcgttggcgtggttccgtgagtgtgctccagccaggcccaaagcttctcctgcccagagggaccgtttcctccagcgtgggtcgggtgcttctgcgcccggaaagagcgccagctcctccttcgggtgacccagggagcggggctgcaggcaaaggcgcaggcggccaaaaaggtgccaaccgggtcctgtggctttcagttgtctctgcccacccaattcacaccatctttccccctcagccgcctgtcctgggacttcaggctcagcaccaaacgcagcaaaagtaggtgcacagagagcggggtcagctcacgcagcccgagcagaatggctgtgctgccgccccaggcccgcggccaccgctgtgtgtgtggcaggagtcagccccccagcgtggggccccgaagcccgcggtccttccacggggagggccaggcccgcagggcgcagacgatgggggacaggctgcgccagcgctcgcctgaggccccgcacacaaacctcaggcccatgggtccgctccgcggggcaggcgtcgtgggcccaaggaggccaggccaggagtctcggcctcggggttacgcggcggcgggcagctcttccgctccgctcagggtgctgctaacccacagccgagcagcgacccgcaggaccggcgagaaccccgccactgcctccggccggaagagaacgtgcagagatgtacgtcacttccggggcgtggcgtggcgggcgtggcgtcccgcccctggcggcgtgcctggtgccctgttccgcgtctgtgcgaccgtccgtcccgagcgcgcagccgcggcaggccaggtcagagcagcccaccatgggatggggagggggtggaggctgcaccccgcgcccacccatccaccagcagccgccggagcgccgcgtggtcaccgttgtctttctcggcctcctgctggacctcctggccttcacgctgctgctgcccctgctgcccgggctgttggagagccacggccgtgcccacgaccccctctatggctcctggcagggcggggtggactggtttgccaccgccatcgggatgccagtggagaagaggtacaacagtgtcctgttcggaggtctcattggctcggcattctctgtcctgcagtttctgtgtgcgccactcactggggccacctctgactgcttggggaggcgcccggtgatgctgctgtgcctgatgggtgtggccacctcatatgcagtctgggccacctctcggagctttgcggccttcctggcctccaggctgattgggggcatcagcaaagggaacgtcagcctctccacggccatcgttgctgacctgggctcgcctctggcccgcagtcaaggcatgcctccgacctgctgttcatcttctgcttcctgccagagacgctgcccctggagaaacgggcgccctctatcgccctggggttccgtgatgcggctgatctgctcagccccctggccctgctgcgcttctcggctgtcgctcgtggccaggacccaccctctggagacaggctcagcagcctgcgccgcctgggcctagtctacttcctctacctcttcctgttctcgggcctggagtacacgctgagcttcctcacacaccagcgcttccagttcagtagcctacagcaggggaagatgtttttcctcatcggcctcaccatggccaccatccagggtgcctatgcccggcggatccaccctggcggggaagttgctgccgtgaagcgggccctcctgctgctggtgcccgccttcctcctcatcggctggggacgttctctgcccgtgctgggcctggggctgctgctctactcctttgccgccgccgttgtggtgccctgcctgtcctccgtggtcgctggctatggctcaccagggcagaagggcacggtcatgggtacactgcgcagcctaggtgctctggccagggccgcggggcccctggtggccgcttcagtgtactggctggccggggcccaggcctgcttcaccacgtggtccgggctctttttgctccccttcttcctcctgcagaagctgagttacccggcacagacgctcaaggctgagtagctgagccactgtgcccaggctgtgggcaccaggcagagtgggagcctaggtcaggcccctgcccactgcctgacccccaccccccgccagtccagggagaccctgtgggtgggggccggcccctaagcaggaagctcaggcagctcctccagacttacttactccttcagtgactccgagctgcagcactccaaggctgtcagggcttctgtttgttttttaaactatgcaccaggtttctgatgatgaaataaagcacctgtttgttttataccaa

SEQ ID NO: 356585 - DNA, 2925 bp, Homo sapiens
tccccccctcccccattccgctaggtacgaggctgggtggtgcacgtgtcttagggtagcgcgcgcctgtctctcttcgggtctcgggcccttgggcgcagcggggcgcgcgccatggcgaaggcgaagaaggtcggggcgcgaaggaaggcctccggggcgccggcgggagcgcgagggggcccggcgaaggccaactccaatccgttcgaggtgaaagttaacaggcagaagttccagatcctgggccggaagacgcgccacgacgtgggactgcccggggtgtctcgcgcacgggccctcaggaagcgtacacagactttactaaaagagtacaaagaaagggataaatccaatgtattcagagataaacgcttcggagaatacaacagcaacatgagccccgaggagaagatgatgaagaggtttgctctggaacagcagcgacatcatgagaaaaaaagcatctacaatctaaatgaagatgaagaattgactcattatggccagtctttggcagacatcgagaagcataatgacattgtggacagtgacagcgatgctgaggatcgaggaacgttgtctgctgagctgactgctgcccactttggaggaggcggtgggctccttcacaagaagactcaacaggaaggcgaggagcgggagaaaccgaagtcccggaaagagctgattgaagagctcattgccaagtcaaaacaagagaagagggagagacaagctcaacgagaagatgccctcgagctcacggagaagctagaccaagactggaaagaaattcagactctcctgtcccacaaaactcccaagtcagagaacagagacaaaaaggaaaaacccaagcccgatgcatatgacatgatggttcgcgagcttggctttgaaatgaaggcgcagccctctaacaggatgaagacggaggcagaattggcaaaggaagagcaggagcacctcaggaagctggaggctgagagacttcgaagaatgcttggaaaggatgaggatgaaaatgttaagaaaccaaaacatatgtcagcagatgatctgaatgatggcttcgtgctagataaagatgacaggcgtttgctttcctacaaagatggaaagatgaatgtcgaggaagatgtccaggaagagcaaagcaaggaagccagtgaccctgagagcaacgaggaagaaggtgacagttcaggcggggaggacacagaggagagcgacagcccagatagccacttggacctggaatccaacgtggagagtgaggaagaaaacgagaagccagcaaaagagcagaggcagactcctgggaaagggttgataagcggcaaggaaagagctggaaaagctaccagagacgagctgccctacacgttcgcagcccctgaatcctatgaggaactgagatctctgttgttaggaagatcgatggaagagcagcttttggtggtggagagaattcagaagtgcaaccacccgagtctcgcagaaggaaacaaagcaaaattagaaaaactgtttggctttcttttggaatacgttggcgatttggctacagatgacccaccagacctcacagtcattgataagttggttgtgcacttatatcatctttgccagatgtttcctgaatctgcaagtgacgctatcaaatttgttctccgagatgcgatgcatgagatggaagaaatgattgagaccaaaggccgggcggcattgccagggttggatgtgctcatttatttgaaaatcactgggctgctatttccaacttccgacttctggcacccagtggtgacccctgccctcgtgtgcctcagtcagctgctcaccaagtgccccatcctgtccctccaggacgtggtgaagggcctgttcgtgtgctgcctgttcctggagtatgtggctttgtcccagaggtttatacctgagcttattaattttcttcttgggattctttacatagcaactccaaacaaagcaagccaaggttccactctggtgcaccctttcagagcgcttgggaagaactcggaactgctcgtggtgtctgctagagaggatgtggccacgtggcagcagagcagcctctccctccgctggtctcgaattcccgacctcaggtaatccacctgccttggccccccaattataggtgtgagccacagcacccagccaaaaaagtaattttttttagagtaataatgctataatgttggtgtgattccaacctccagctccccccacccgctgcctgcggttttgtttctgttaaaacgtcacctgatgaaatagaatgaatcctgaaatgcacctctgggatcgggaatggtctgtgtgttatcagctgcgactggttcactgcgtctggacaagcctcatggggactggggattctggccagtgtaatttctgtcaaccacggacgtttgccttcatgtgtagaatttactgttgttatgcaaattatattttcaattataaatgaaacaagtttgcagatattttagaaatcagagaagggaaacatcacccacagtccctctgctggaacagccacagttggccttgtcctacttacgtccttcagtggatgcttctgggtgctggggttctccattcaggacactgcactctcggaggtgggaggagactgggttgcgtctgtgccgacctgggatgcagtttcaggtcagaatcagaagatgtgcaagttacgcatgacacagctttttaaagtgcttttcccctgcactaatcaagagggaggtcagccctcaggtgtgctggacccgggagggactgtgagctgtaagaagtaacgagccccttgaacttcacaagctggccagggagccatatcccgaatgccactgccacttcctcgtggtgcaaggcttgttgggacct

SEQ ID NO: 356586 - DNA, 3978 bp, Homo sapiens
tccccccctcccccattccgctaggtacgaggctgggtggtgcacgtgtcttagggtagcgcgcgcctgtctctcttcgggtctcgggcccttgggcgcagcggggcgcgcgccatggcgaaggcgaagaaggtcggggcgcgaaggaaggcctccggggcgccggcgggagcgcgagggggcccggcgaaggccaactccaatccgttcgaggtgaaagttaacaggcagaagttccagatcctgggccggaagacgcgccacgacgtgggactgcccggggtgtctcgcgcacgggccctcaggaagcgtacacagactttactaaaagagtacaaagaaagggataaatccaatgtattcagagataaacgcttcggagaatacaacagcaacatgagccccgaggagaagatgatgaagaggtttgctctggaacagcagcgacatcatgagaaaaaaagcatctacaatctaaatgaagatgaagaattgactcattatggccagtctttggcagacatcgagaagcataatgacattgtggacagtgacagcgatgctgaggatcgaggaacgttgtctgctgagctgactgctgcccactttggaggaggcggtgggctccttcacaagaagactcaacaggaaggcgaggagcgggagaaaccgaagtcccggaaagagctgattgaagagctcattgccaagtcaaaacaagagaagagggagagacaagctcaacgagaagatgccctcgagctcacggagaagctagaccaagactggaaagaaattcagactctcctgtcccacaaaactcccaagtcagagaacagagacaaaaaggaaaaacccaagcccgatgcatatgacatgatggttcgcgagcttggctttgaaatgaaggcgcagccctctaacaggatgaagacggaggcagaattggcaaaggaagagcaggagcacctcaggaagctggaggctgagagacttcgaagaatgcttggaaaggatgaggatgaaaatgttaagaaaccaaaacatatgtcagcagatgatctgaatgatggcttcgtgctagataaagatgacaggcgtttgctttcctacaaagatggaaagatgaatgtcgaggaagatgtccaggaagagcaaagcaaggaagccagtgaccctgagagcaacgaggaagaaggtgacagttcaggcggggaggacacagaggagagcgacagcccagatagccacttggacctggaatccaacgtggagagtgaggaagaaaacgagaagccagcaaaagagcagaggcagactcctgggaaagggttgataagcggcaaggaaagagctggaaaagctaccagagacgagctgccctacacgttcgcagcccctgaatcctatgaggaactgagatctctgttgttaggaagatcgatggaagagcagcttttggtggtggagagaattcagaagtgcaaccacccgagtctcgcagaaggaaacaaagcaaaattagaaaaactgtttggctttcttttggaatacgttggcgatttggctacagatgacccaccagacctcacagtcattgataagttggttgtgcacttatatcatctttgccagatgtttcctgaatctgcaagtgacgctatcaaatttgttctccgagatgcgatgcatgagatggaagaaatgattgagaccaaaggccgggcggcattgccagggttggatgtgctcatttatttgaaaatcactgggctgctatttccaacttccgacttctggcacccagtggtgacccctgccctcgtgtgcctcagtcagctgctcaccaagtgccccatcctgtccctccaggacgtggtgaagggcctgttcgtgtgctgcctgttcctggagtatgtggctttgtcccagaggtttatacctgagcttattaattttcttcttgggattctttacatagcaactccaaacaaagcaagccaagagcgcttgggaagaactcggaactgctcgtggtgtctgctagagaggatgtggccacgtggcagcagagcagcctctccctccgctgggcgagtagactgagggccccaacttcgacagaggccaatcacatccgactgtcctgcctggctgtgggcctggccctgctgaagcgctgcgtgctcatgtacgggtccctgccatccttccacgccatcatggggcctctccgagccctcctcacggatcacctggcggactgcagccacccgcaggagctccaggagctgtgtcagagcacactgaccgaaatggaaagccagaagcagctctgccggccgctgacctgtgagaagagcaagcctgtcccactgaagcttttcacaccccggctggtcaaagtcctcgagtttggaagaaaacaaggcagtagtaaggaggaacaggaaaggaagaggctgatccacaaacacaagcgtgaatttaaaggggccgttcgagaaatccgcaaggacaatcagttcctggcgaggatgcaactctcagaaatcatggaacgggatgcggaaagaaagcggaaagtaaagcagctttttaacagcctggctacacaggaaggcgaatggaaggctctgaagaggaaaaagttcaaaaaataaattacattttataaataaggcaaggaactggacattacctcacatctgcaattccaaccctctgggaggccaaggcaggaagattgcttcagcccaggagttcgagaccagcctgggcaacacaggaagaccccgtctctaccaaaaaaacataaaaattagccaagtgtggtggcacgcacctgtagtcccaactactcgggaggctgaagcaggaggactgcttgagctgagtccaaggttacagtgagccgtgattgagccactgcactccagcctcggccacagtgcaagactgtgtcgcttaaaaaaaaatttttttttttgagacggagttttgctcttgttgcccaggctggagtgcaatggcacaacctccacctcctgggttcaagcgattctcctgcctcagcctcccgagtagctgggattacagacatgtgccaccacgcccagctaattttgtatttttagtagagacggggtttctccatgttggtcaggctggtctcgaattcccgacctcaggtaatccacctgccttggccccccaattataggtgtgagccacagcacccagccaaaaaagtaattttttttagagtaataatgctataatgttggtgtgattccaacctccagctccccccacccgctgcctgcggttttgtttctgttaaaacgtcacctgatgaaatagaatgaatcctgaaatgcacctctgggatcgggaatggtctgtgtgttatcagctgcgactggttcactgcgtctggacaagcctcatggggactggggattctggccagtgtaatttctgtcaaccacggacgtttgccttcatgtgtagaatttactgttgttatgcaaattatattttcaattataaatgaaacaagtttgcagatattttagaaatcagagaagggaaacatcacccacagtccctctgctggaacagccacagttggccttgtcctacttacgtccttcagtggatgcttctgggtgctggggttctccattcaggacactgcactctcggaggtgggaggagactgggttgcgtctgtgccgacctgggatgcagtttcaggtcagaatcagaagatgtgcaagttacgcatgacacagctttttaaagtgcttttcccctgcactaatcaagagggaggtcagccctcaggtgtgctggacccgggagggactgtgagctgtaagaagtaacgagccccttgaacttcacaagctggccagggagccatatcccgaatgccactgccacttcctcgtggtgcaaggcttgttgggacct

SEQ ID NO: 356587 - DNA, 3981 bp, Homo sapiens
tccccccctcccccattccgctaggtacgaggctgggtggtgcacgtgtcttagggtagcgcgcgcctgtctctcttcgggtctcgggcccttgggcgcagcggggcgcgcgccatggcgaaggcgaagaaggtcggggcgcgaaggaaggcctccggggcgccggcgggagcgcgagggggcccggcgaaggccaactccaatccgttcgaggtgaaagttaacaggcagaagttccagatcctgggccggaagacgcgccacgacgtgggactgcccggggtgtctcgcgcacgggccctcaggaagcgtacacagactttactaaaagagtacaaagaaagggataaatccaatgtattcagagataaacgcttcggagaatacaacagcaacatgagccccgaggagaagatgatgaagaggtttgctctggaacagcagcgacatcatgagaaaaaaagcatctacaatctaaatgaagatgaagaattgactcattatggccagtctttggcagacatcgagaagcataatgacattgtggacagtgacagcgatgctgaggatcgaggaacgttgtctgctgagctgactgctgcccactttggaggaggcggtgggctccttcacaagaagactcaacaggaaggcgaggagcgggagaaaccgaagtcccggaaagagctgattgaagagctcattgccaagtcaaaacaagagaagagggagagacaagctcaacgagaagatgccctcgagctcacggagaagctagaccaagactggaaagaaattcagactctcctgtcccacaaaactcccaagtcagagaacagagacaaaaaggaaaaacccaagcccgatgcatatgacatgatggttcgcgagcttggctttgaaatgaaggcgcagccctctaacaggatgaagacggaggcagaattggcaaaggaagagcaggagcacctcaggaagctggaggctgagagacttcgaagaatgcttggaaaggatgaggatgaaaatgttaagaaaccaaaacatatgtcagcagatgatctgaatgatggcttcgtgctagataaagatgacaggcgtttgctttcctacaaagatggaaagatgaatgtcgaggaagatgtccaggaagagcaaagcaaggaagccagtgaccctgagagcaacgaggaagaaggtgacagttcaggcggggaggacacagaggagagcgacagcccagatagccacttggacctggaatccaacgtggagagtgaggaagaaaacgagaagccagcaaaagagcagaggcagactcctgggaaagggttgataagcggcaaggaaagagctggaaaagctaccagagacgagctgccctacacgttcgcagcccctgaatcctatgaggaactgagatctctgttgttaggaagatcgatggaagagcagcttttggtggtggagagaattcagaagtgcaaccacccgagtctcgcagaaggaaacaaagcaaaattagaaaaactgtttggctttcttttggaatacgttggcgatttggctacagatgacccaccagacctcacagtcattgataagttggttgtatgtttcctgaatctgcaagtgacgctatcaaatttgttctccgagatgcgatgcatgagatggaagaaatgattgagaccaaaggccgggcggcattgccagggttggatgtgctcatttatttgaaaatcactgggctgctatttccaacttccgacttctggcacccagtggtgacccctgccctcgtgtgcctcagtcagctgctcaccaagtgccccatcctgtccctccaggacgtggtgaagggcctgttcgtgtgctgcctgttcctggagtatgtggctttgtcccagaggtttatacctgagcttattaattttcttcttgggattctttacatagcaactccaaacaaagcaagccaaggttccactctggtgcaccctttcagagcgcttgggaagaactcggaactgctcgtggtgtctgctagagaggatgtggccacgtggcagcagagcagcctctccctccgctgggcgagtagactgagggccccaacttcgacagaggccaatcacatccgactgtcctgcctggctgtgggcctggccctgctgaagcgctgcgtgctcatgtacgggtccctgccatccttccacgccatcatggggcctctccgagccctcctcacggatcacctggcggactgcagccacccgcaggagctccaggagctgtgtcagagcacactgaccgaaatggaaagccagaagcagctctgccggccgctgacctgtgagaagagcaagcctgtcccactgaagcttttcacaccccggctggtcaaagtcctcgagtttggaagaaaacaaggcagtagtaaggaggaacaggaaaggaagaggctgatccacaaacacaagcgtgaatttaaaggggccgttcgagaaatccgcaaggacaatcagttcctggcgaggatgcaactctcagaaatcatggaacgggatgcggaaagaaagcggaaagtaaagcagctttttaacagcctggctacacaggaaggcgaatggaaggctctgaagaggaaaaagttcaaaaaataaattacattttataaataaggcaaggaactggacattacctcacatctgcaattccaaccctctgggaggccaaggcaggaagattgcttcagcccaggagttcgagaccagcctgggcaacacaggaagaccccgtctctaccaaaaaaacataaaaattagccaagtgtggtggcacgcacctgtagtcccaactactcgggaggctgaagcaggaggactgcttgagctgagtccaaggttacagtgagccgtgattgagccactgcactccagcctcggccacagtgcaagactgtgtcgcttaaaaaaaaatttttttttttgagacggagttttgctcttgttgcccaggctggagtgcaatggcacaacctccacctcctgggttcaagcgattctcctgcctcagcctcccgagtagctgggattacagacatgtgccaccacgcccagctaattttgtatttttagtagagacggggtttctccatgttggtcaggctggtctcgaattcccgacctcaggtaatccacctgccttggccccccaattataggtgtgagccacagcacccagccaaaaaagtaattttttttagagtaataatgctataatgttggtgtgattccaacctccagctccccccacccgctgcctgcggttttgtttctgttaaaacgtcacctgatgaaatagaatgaatcctgaaatgcacctctgggatcgggaatggtctgtgtgttatcagctgcgactggttcactgcgtctggacaagcctcatggggactggggattctggccagtgtaatttctgtcaaccacggacgtttgccttcatgtgtagaatttactgttgttatgcaaattatattttcaattataaatgaaacaagtttgcagatattttagaaatcagagaagggaaacatcacccacagtccctctgctggaacagccacagttggccttgtcctacttacgtccttcagtggatgcttctgggtgctggggttctccattcaggacactgcactctcggaggtgggaggagactgggttgcgtctgtgccgacctgggatgcagtttcaggtcagaatcagaagatgtgcaagttacgcatgacacagctttttaaagtgcttttcccctgcactaatcaagagggaggtcagccctcaggtgtgctggacccgggagggactgtgagctgtaagaagtaacgagccccttgaacttcacaagctggccagggagccatatcccgaatgccactgccacttcctcgtggtgcaaggcttgttgggacct

SEQ ID NO: 356588 - DNA, 2210 bp, Homo sapiens
gccatcctgtccctccaggatggggcacttggtgagcagctgactgaggcacaccaagtgccccatcctgtccctccaggacgtggtgaagggcctgttcgtgtgctgcctgttcctggagtatgtggctttgtcccagaggtttatacctgagcttattaattttcttcttgggattctttacatagcaactccaaacaaagcaagccaaggttccactctggtgcaccctttcagagcgcttgggaagaactcggaactgctcgtggtgtctgctagagaggatgtggccacgtggcagcagagcagcctctccctccgctgggcgagtagactgagggccccaacttcgacagaggccaatcacatccgactgtcctgcctggctgtgggcctggccctgctgaagcgctgcgtgctcatgtacgggtccctgccatccttccacgccatcatggggcctctccgagccctcctcacggatcacctggcggactgcagccacccgcaggagctccaggagctgtgtcagagcacactgaccgaaatggaaagccagaagcagctctgccggccgctgacctgtgagaagagcaagcctgtcccactgaagcttttcacaccccggctggtcaaagtcctcgagtttggaagaaaacaaggcagtagtaaggaggaacaggaaaggaagaggctgatccacaaacacaagcgtgaatttaaaggggccgttcgagaaatccgcaaggacaatcagttcctggcgaggatgcaactctcagaaatcatggaacgggatgcggaaagaaagcggaaagtaaagcagctttttaacagcctggctacacaggaaggcgaatggaaggctctgaagaggaaaaagttcaaaaaataaattacattttataaataaggcaaggaactggacattacctcacatctgcaattccaaccctctgggaggccaaggcaggaagattgcttcagcccaggagttcgagaccagcctgggcaacacaggaagaccccgtctctaccaaaaaaacataaaaattagccaagtgtggtggcacgcacctgtagtcccaactactcgggaggctgaagcaggaggactgcttgagctgagtccaaggttacagtgagccgtgattgagccactgcactccagcctcggccacagtgcaagactgtgtcgcttaaaaaaaaatttttttttttgagacggagttttgctcttgttgcccaggctggagtgcaatggcacaacctccacctcctgggttcaagcgattctcctgcctcagcctcccgagtagctgggattacagacatgtgccaccacgcccagctaattttgtatttttagtagagacggggtttctccatgttggtcaggctggtctcgaattcccgacctcaggtaatccacctgccttggccccccaattataggtgtgagccacagcacccagccaaaaaagtaattttttttagagtaataatgctataatgttggtgtgattccaacctccagctccccccacccgctgcctgcggttttgtttctgttaaaacgtcacctgatgaaatagaatgaatcctgaaatgcacctctgggatcgggaatggtctgtgtgttatcagctgcgactggttcactgcgtctggacaagcctcatggggactggggattctggccagtgtaatttctgtcaaccacggacgtttgccttcatgtgtagaatttactgttgttatgcaaattatattttcaattataaatgaaacaagtttgcagatattttagaaatcagagaagggaaacatcacccacagtccctctgctggaacagccacagttggccttgtcctacttacgtccttcagtggatgcttctgggtgctggggttctccattcaggacactgcactctcggaggtgggaggagactgggttgcgtctgtgccgacctgggatgcagtttcaggtcagaatcagaagatgtgcaagttacgcatgacacagctttttaaagtgcttttcccctgcactaatcaagagggaggtcagccctcaggtgtgctggacccgggagggactgtgagctgtaagaagtaacgagccccttgaacttcacaagctggccagggagccatatcccgaatgccactgccacttcctcgtggtgcaaggcttgttgggacct

SEQ ID NO: 356589 - DNA, 2204 bp, Homo sapiens
acgtttctggctgtgaggagcacaggctatggtgacctccaactccccaagtcccctcctttcagagagtgctctcaggggccagcccacggccctccctcttcaagaagacagtggctttacttcgttccggctgtgccaggacttgagcagccacagccttggcttacccccccgcccaccggtaggcgcacagcaagggcaccatcctgctgcagggagctcgcagcactgtcctcacgctgccttgacaccacagaacccgtgcgtggagctcagggcacgcagcaggtgagtcatcgcagagtcggggatttcgtgtttttcaggagctgtgtcagagcacactgaccgaaatggaaagccagaagcagctctgccggccgctgacctgtgagaagagcaagcctgtcccactgaagcttttcacaccccggctggtcaaagtgtgtgggtgctggcagcatctccctgggaggccagggctgtgggctcagtgggagctgacggggggcgtctgccagttctgcagttgagcagatgactacggagtgaagccacactcccaagcaggctctggctgagaggtggggacagactcttgcttccttaacagtggctttctggttgtagcctcgagtttggaagaaaacaaggcagtagtaaggaggaacaggaaaggaagaggctgatccacaaacacaagcgtgaatttaaaggggccgttcgagaaatccgcaaggacaatcagttcctggcgaggatgcaactctcagaaatcatggaacgggatgcggaaagaaagcggaaagtaaagcagctttttaacagcctggctacacaggaaggcgaatggaaggctctgaagaggaaaaagttcaaaaaataaattacattttataaataaggcaaggaactggacattacctcacatctgcaattccaaccctctgggaggccaaggcaggaagattgcttcagcccaggagttcgagaccagcctgggcaacacaggaagaccccgtctctaccaaaaaaacataaaaattagccaagtgtggtggcacgcacctgtagtcccaactactcgggaggctgaagcaggaggactgcttgagctgagtccaaggttacagtgagccgtgattgagccactgcactccagcctcggccacagtgcaagactgtgtcgcttaaaaaaaaatttttttttttgagacggagttttgctcttgttgcccaggctggagtgcaatggcacaacctccacctcctgggttcaagcgattctcctgcctcagcctcccgagtagctgggattacagacatgtgccaccacgcccagctaattttgtatttttagtagagacggggtttctccatgttggtcaggctggtctcgaattcccgacctcaggtaatccacctgccttggccccccaattataggtgtgagccacagcacccagccaaaaaagtaattttttttagagtaataatgctataatgttggtgtgattccaacctccagctccccccacccgctgcctgcggttttgtttctgttaaaacgtcacctgatgaaatagaatgaatcctgaaatgcacctctgggatcgggaatggtctgtgtgttatcagctgcgactggttcactgcgtctggacaagcctcatggggactggggattctggccagtgtaatttctgtcaaccacggacgtttgccttcatgtgtagaatttactgttgttatgcaaattatattttcaattataaatgaaacaagtttgcagatattttagaaatcagagaagggaaacatcacccacagtccctctgctggaacagccacagttggccttgtcctacttacgtccttcagtggatgcttctgggtgctggggttctccattcaggacactgcactctcggaggtgggaggagactgggttgcgtctgtgccgacctgggatgcagtttcaggtcagaatcagaagatgtgcaagttacgcatgacacagctttttaaagtgcttttcccctgcactaatcaagagggaggtcagccctcaggtgtgctggacccgggagggactgtgagctgtaagaagtaacgagccccttgaacttcacaagctggccagggagccatatcccgaatgccactgccacttcctcgtggtgcaaggcttgttgggacct

SEQ ID NO: 356590 - DNA, 106 bp, Homo sapiens
gtttaatatagtttctggaatttaatcattagtcattagaatgatgttagaataaaatttaggattaggaatatagctgttttgtattttgccacatatgtttgtc

SEQ ID NO: 356591 - DNA, 229 bp, Homo sapiens
gaaaacagatgctccagggctcctgctccaagccaaggcctcacactgaggagaaagtgctgggactggattcaaaaaggagcaaaacagggacagggacaaagaaaaggcaggtaaaactgggagaggggaagcaggaaacctgtacaaaagccacagccgaaggggctgtaacagggcagtgtatctcccaagtctccttccatgagttgaggaaaactagcgtcac

SEQ ID NO: 356592 - DNA, 1203 bp, Homo sapiens
ccacttagttccctaccacaagaccttgaaagaaactggaaccccaggtctccagcccagagattttgttggaagtttccatttgcaggaaatgactgcagggcacatgtgggaagtgacaggaatttgaggactaacattttagttttcctcatttctttttaaatctgagcaattgttcattgatcgataatctatgttcttacattcagataaataaaaacaccaactggctattttgttcttacttagttttatgtgtatgtccaggcatttgccactgctcctaaatagctctccctgaagtcttctggtcatgagttaggtttcttatccagaagctcatgtagtgccagagcttagctctcctatgacaacacaatcacattattgaaacatctatttagggatctgtcttctctaatagattataaacgccttgagcttgggtatcgtgatttaatgatgaatcctccatggtatctgaatcccagaatcctacaatcctgcatggtatctgaaacatactatgctcttaaaaaaaaaaaaaaaactttgtaaatggaacttccctcaaggagtcagggtttaagtcaaacatgtttccctttcaaagccgtgggcatgagaatagaggctgttaggagacacagtagtagttgactgcaaaagtgtctgtcagtcagttgtgtggcccaagactctttttatcagttccaacaactgaaaaatgagagggttttagtggaagatctctgtactgctaatattttaagatctcgaagtctttattgagcacctagtatgtgtacaacactatgccagttactaagagagagatgaaaaaataagatatctccattgccctaagagagcataaaatcttatctcaaggaaaaacaaggcaaacactcctagcctacctttacagacacgcacagacatgagttaacacagttgtaaactgttctaaagaagataaaggctcaaggagtgaaaaggcatgaaatagaaacaaaagcaactgacctatgagtttgggcaataatcagtaataataccagctaaagtgtatctaaggcttatagtgccaggtactatgcaaaatgaatcataggagctgcaccttttgttcattttacaaatggggaaacggaggtttaggagagtttagtgactcgttcaaggtgacatactaataag

SEQ ID NO: 356593 - DNA, 690 bp, Homo sapiens
  misc_feature (610)..(610): n is a, c, g, or t
caatattgggttcaccttttgtgcacaagttgaaagctcaatgtgaaagtgagaggagaagatataaaatgtctttattatattctataatgtctcgtgaactcttcaatgcatttctgataaaaattttctatttagatggatgtgtgtgtcagcaagaattaaaaatgtatattctttgaatttcaaagcattgcattattcctagactagtaattggaacaaattattatttacatggcaatagctagcacattcaccatctttacagactagaaccagcccctctctgggcagacgtagccctgaaaatgcactgcttggtatacctagaggaatgctttcatgaaaattagagaactgaggaaaatgttcacctttcttcatgctgaacctaccgctcatttgctatcagaagacctgtacaacattaagaaacagcctcgtgtgtttctttaacagctcctaatagttagcaggcttttacaactgccaaagataagcttcaggaattaaaaaatggcaattgtttagctggcaaaaattacagatattagagtcaatatcatttttctcatgctttattatgccagtgagtcacaagttcccncattttaaaactactatggactaatttaattccatgacacagtggctggcttttattttcaggattgccatacaaattca

SEQ ID NO: 356594 - DNA, 5332 bp, Homo sapiens
  misc_feature (473)..(473): n is a, c, g, or t
ggcgggactcttgctgcgcggaggagccgtgcggaacccgaggctgcgcgcgcgcgcgcgctctctggccgcggcgtggggacagcgaggcgcactggggcctcccagcgcggggccggccgcgccgtccagcccgaggtctacggctttgcgctccgagcccagaggaagatgcctgccggcaccgagctcgggctgcggggctgaacgcctgtcttccaggcgcagcggcagcactgccctcggccggtgtcggtagcggcactcggcgtgccccgggcggacgaagagcgcaggctgggtacaccttgcccgaatcggcggagttcgcagctagcgagggcgggccggccggcccggatgggcgcggggtttgcggcccccgccgggtgctccggagcggcccgggcaccgggggcacgctgagtgccggagccgcggccgcagagagaacttggggcgggggccatgcnccggtgcggagtctagagccgagcggagcgccccgcgggcccgcccgcgtctgcggccgttcgggtcctcacagtccccgcgcccggagttcgcagcgcgctccagacaagatggcgcggccggtccggggagggctcggggccccgcgccgctcgccttgccttctccttctctggctgcttttgcttcggctggagccggtgaccgccgcggccggcccgcgggcgccctgcgcggccgcctgcacttgcgctggggactcgctggactgcggtgggcgcgggctggctgcgttgcccggggacctgccctcctggacgcggagcctaaacctgagttacaacaaactctctgagattgaccctgctggttttgaggacttgccgaacctacaggaagtgtacctcaataataatgagttgacagcggtaccatccctgggcgctgcttcatcacatgtcgtctctctctttctgcagcacaacaagattcgcagcgtggaggggagccagctgaaggcctacctttccttagaagtgttagatctgagtttgaacaacatcacggaagtgcggaacacctgctttccacacggaccgcctataaaggagctcaacctggcaggcaatcggattggcaccctggagttgggagcatttgatggtctgtcacggtcgctgctaactcttcgcctgagcaaaaacaggatcacccagcttcctgtaagagcattcaagctacccaggctgacacaactggacctcaatcggaacaggattcggctgatagagggcctcaccttccaggggctcaacagcttggaggtgctgaagcttcagcgaaacaacatcagcaaactgacagatggggccttctggggactgtccaagatgcatgtgctgcacctggagtacaacagcctggtagaagtgaacagcggctcgctctacggcctcacggccctgcatcagctccacctcagcaacaattccatcgctcgcattcaccgcaagggctggagcttctgccagaagctgcatgagttggtcctgtccttcaacaacctgacacggctggacgaggagagcctggccgagctgagcagcctgagtgtcctgcgtctcagccacaattccatcagccacattgcggagggtgccttcaagggactcaggagcctgcgagtcttggatctggaccataacgagatttcgggcacaatagaggacacgagcggcgccttctcagggctcgacagcctcagcaagctgactctgtttggaaacaagatcaagtctgtggctaagagagcattctcggggctggaaggcctggagcacctgaaccttggagggaatgcgatcagatctgtccagtttgatgcctttgtgaagatgaagaatcttaaagagctccatatcagcagcgacagcttcctgtgtgactgccagctgaagtggctgcccccgtggctaattggcaggatgctgcaggcctttgtgacagccacctgtgcccacccagaatcactgaagggtcagagcattttctctgtgccaccagagagtttcgtgtgcgatgacttcctgaagccacagatcatcacccagccagaaaccaccatggctatggtgggcaaggacatccggtttacatgctcagcagccagcagcagcagctcccccatgacctttgcctggaagaaagacaatgaagtcctgaccaatgcagacatggagaactttgtccacgtccacgcgcaggacggggaagtgatggagtacaccaccatcctgcacctccgtcaggtcactttcgggcacgagggccgctaccaatgtgtcatcaccaaccactttggctccacctattcacataaggccaggctcaccgtgaatgtgttgccatcattcaccaaaacgccccacgacataaccatccggaccaccaccatggcccgcctcgaatgtgctgccacaggtcacccaaaccctcagattgcctggcagaaggatggaggcacggatttccccgctgcccgtgagcgacgcatgcatgtcatgccggatgacgacgtgtttttcatcactgatgtgaaaatagatgacgcaggggtttacagctgtactgctcagaactcagccggttctatttcagctaatgccaccctgactgtcctagagaccccatccttggtggtccccttggaagaccgtgtggtatctgtgggagaaacagtggccctccaatgcaaagccacggggaaccctccgccccgcatcacctggttcaagggggaccgcccgctgagcctcactgagcggcaccacttgacccctgacaaccagctcctggtggttcagaacgtggtggcagaggatgcgggccgatatacctgtgagatgtccaacaccctgggcacggagcgagctcacagccagctgagcgtcctgcccgcagcaggctgcaggaaggatgggaccacggtaggcatcttcaccattgctgtcgtgagcagcatcgtcctgacgtcactggtctgggtgtgcatcatctaccagaccaggaagaagagtgaagagtacagtgtcaccaacacagatgaaaccgtcgtgccaccagatgttccaagctacctctcttctcaggggaccctttctgaccgacaagaaaccgtggtcaggaccgagggtggccctcaggccaatgggcacattgagagcaatggtgtgtgtccaagagatgcaagccactttccagagcccgacactcacagcgttgcctgcaggcagccaaagctctgtgctgggtctgcgtatcacaaagagccgtggaaagcgatggagaaagctgaagggacacctgggccacataagatggaacacggtggccgggtcgtatgcagtgactgcaacaccgaagtggactgttactccaggggacaagccttccacccccagcctgtgtccagagacagcgcacagccaagtgcgccaaatggcccggagccgggtgggagtgaccaagagcattctccacatcaccagtgcagcaggactgccgctgggtcctgccccgagtgccaagggtcgctctaccccagtaaccacgatagaatgctgacggctgtgaagaaaaagccaatggcatctctagatgggaaaggggattcttcctggactttagcaaggttgtatcacccggactccacagagctacagcctgcatcttcattaacttcaggcagtccagagcgcgcggaagcccagtacttgcttgtttccaatggccacctccccaaagcatgtgacgccagtcccgagtccacgccactgacaggacagctccccgggaaacagagggtgccactgctgttggcaccaaaaagctaggttttgtctacctcagttcttgtcataccaatctctacgggaaagagaggtaggagaggctgcgaggaagcttgggttcaagcgtcactcatctgtacatagttgtaactcccatgtggagtatcagtcgctcacaggacttggatctgaagcacagtaaacgcaagaggggatttgtgtacaaaaggcaaaaaaagtatttgatatcattgtacataagagttttcagagatttcatatatatcttttacagaggctattttaatctttagtgcatggttaacagaaaaaaattatacaattttgacaatattatttttcgtatcaggttgctgtttaattttggagggggtggggaaatagttctggtgccttaacgcatggctggaatttatagaggctacaaccacatttgttcacaggagtttttggtgcggggtgggaaggatggaaggccttggatttatattgcacttcatagacccctaggctgctgtgcggtgggactccacatgcgccggaaggagcttcaggtgagcactgctcatgtgtggatgcccctgcaacaggcttccctgtctgtagagccaggggtgcaagtgccatccacacttgcagtgaatggcttttccttttaggtttaagtcctgtctgtctgtaaggcgtagaatctgtccgtctgtaaggcgtagaatgagggttgttaatccatcacaagcaaaaggtcagaacagttaaacactgcctttcctcctcctcttattttatgataaaagcaaatgtggccttctcagtatcattcgattgctatttgagacttttaaattaaggtaaaggctgctggtgttggtacctgtggatttttctatactgatgttttcgttttgccaatataatgagtattacattggccttgggggacagaaaggaggaagttctgacttttcagggctaccttatttctactaaggacccagagcaggcctgtccatgccattccttcgcacagatgaaactgagctgggactggaaaggacagcccttgacctgggttctgggtataatttgcacttttgagactggtagctaaccatcttatgagtgccaatgtgtcatttagtaaaacttaaatagaaacaaggtccttcaaatgttcctttggccaaaagctgaagggagttactgagaaaatagttaacaattactgtcaggtgtcatcactgttcaaaaggtaagcacatttagaattttgttcttgacagttaactgactaatcttacttccacaaaatatgtgaatttgctgcttctgagaggcaatgtgaaagagggagtattacttttatgtacaaagttatttatttatagaaattttggtacagtgtacattgaaaaccatgtaaaatattgaagtgtctaacaaatggcattgaagtgtctttaataaaggttcatttataaatgtca

SEQ ID NO: 356595 - DNA, 1023 bp, Homo sapiens
tgggaggggccttttttaggccagacggcacatgcaattccagcctatcatcactattaaattctaataaagataaaagtatttcatttcagaaaggggaaggcctgcgtgcctcaaacccgtaatctcagcgcaggtcagctttccacctgcccctcactggacagacttatcaggtagcactaccttaattgtgtgttttctttttctttttctttctctcaacccttcctgtttcgctttccttccctggccttaatttctggatgtttggaaactacaggactctgtttggaaacaagatcaagtctgtggctaagagagcattctcggggctggaaggcctggagcacctgtgagtatctcaccagccctgccctgaggcacagcctgctgaatgcggctgccggggagttctgctagcaatttaatcgcatctttgtaaactgagaaacaggctatttggaaacaccagctgcttccttctcattatgtcagcttcagctttggcctttatgttgcctatgccaggaacagttacagaacatatggccagtggatgtgctcccagttaattcagttggtatttggataaataccctccccgctcctgctgcgcagcctaacccctgcactggctccttcatggacccctggcctcattgcctcttccaccaacgcgcttcctcctggccaagcctgttgcctccattaaagcagcttaacaatgcagagtaggtgctgggctgaaccagtttggtgtggttgcttctgagaccctgggaggaagggaacagagccacccgagacagtcatgctgttgccatctggggaggatgcctcatgtatgtgattcttagtttgtttcctctttgaatcaagtttgactctaactctgttgggaaaggttttgccttgctgagcaggcctcagcccagctttgatggtgccctaaggctggcttggctcctgagtcattccatgggcttgtgttgcgatttgggaaacaacagccacttatag

SEQ ID NO: 356596 - DNA, 514 bp, Homo sapiens
tctcaggtgggttatatgcactgccctgggaaattggagaggaagtgtgagaaaaaccatttcccccttccagcttgctgatgttcacttgagaagctgattggaggcgactgatcagtgtgtgtgtgaagggagtgtccctcctttgcggctgcacctgaagcatccactgttgtgtttctttcagccatatcagcagcgacagcttcctgtgtgactgccagctgaagtggctgcccccgtggctaattggcaggatgctgcaggcctttgtgacagccacctgtgcccacccagaatcactgaagggtcagagcattttctctgtgccaccagagagtttcgtgtgcggtaagactgtctttgtaactttttctctccttcatgaaggacaaggaagccaggaggtactcttcattatgggagtaattcctgtgatcagagtaaaccccagcccgtggttacagatcagctgctggatgcaatttatttcttgctgaaaccacacacagta

SEQ ID NO: 356597 - DNA, 467 bp, Homo sapiens
tgggaggggccttttttaggccagacggcacatgcaattccagcctatcatcactattaaattctaataaagataaaagtatttcatttcagaaaggggaaggcctgcgtgcctcaaacccgtaatctcagcgcaggtcagctttccacctgcccctcactggacagacttatcaggtagcactaccttaattgtgtgttttctttttctttttctttctctcaacccttcctgtttcgctttccttccctggccttaatttctggatgtttggaaactacaggactctgtttggaaacaagatcaagtctgtggctaagagagcattctcggggctggaaggcctggagcacctgaaccttggagggaatgcgatcagatctgtccagtttgatgcctttgtgaagatgaagaatcttaaagagctgtaagtatctggattccctgggtctgattaatggtagtgg

SEQ ID NO: 356598 - DNA, 5257 bp, Homo sapiens
  misc_feature (473)..(473): n is a, c, g, or t
ggcgggactcttgctgcgcggaggagccgtgcggaacccgaggctgcgcgcgcgcgcgcgctctctggccgcggcgtggggacagcgaggcgcactggggcctcccagcgcggggccggccgcgccgtccagcccgaggtctacggctttgcgctccgagcccagaggaagatgcctgccggcaccgagctcgggctgcggggctgaacgcctgtcttccaggcgcagcggcagcactgccctcggccggtgtcggtagcggcactcggcgtgccccgggcggacgaagagcgcaggctgggtacaccttgcccgaatcggcggagttcgcagctagcgagggcgggccggccggcccggatgggcgcggggtttgcggcccccgccgggtgctccggagcggcccgggcaccgggggcacgctgagtgccggagccgcggccgcagagagaacttggggcgggggccatgcnccggtgcggagtctagagccgagcggagcgccccgcgggcccgcccgcgtctgcggccgttcgggtcctcacagtccccgcgcccggagttcgcagcgcgctccagacaagatggcgcggccggtccggggagggctcggggccccgcgccgctcgccttgccttctccttctctggctgcttttgcttcggctggagccggtgaccgccgcggccggcccgcgggcgccctgcgcggccgcctgcacttgcgctggggactcgctggactgcggtgggcgcgggctggctgcgttgcccggggacctgccctcctggacgcggagcctaaacctgagttacaacaaactctctgagattgaccctgctggttttgaggacttgccgaacctacaggaagtgcagcacaacaagattcgcagcgtggaggggagccagctgaaggcctacctttccttagaagtgttagatctgagtttgaacaacatcacggaagtgcggaacacctgctttccacacggaccgcctataaaggagctcaacctggcaggcaatcggattggcaccctggagttgggagcatttgatggtctgtcacggtcgctgctaactcttcgcctgagcaaaaacaggatcacccagcttcctgtaagagcattcaagctacccaggctgacacaactggacctcaatcggaacaggattcggctgatagagggcctcaccttccaggggctcaacagcttggaggtgctgaagcttcagcgaaacaacatcagcaaactgacagatggggccttctggggactgtccaagatgcatgtgctgcacctggagtacaacagcctggtagaagtgaacagcggctcgctctacggcctcacggccctgcatcagctccacctcagcaacaattccatcgctcgcattcaccgcaagggctggagcttctgccagaagctgcatgagttggtcctgtccttcaacaacctgacacggctggacgaggagagcctggccgagctgagcagcctgagtgtcctgcgtctcagccacaattccatcagccacattgcggagggtgccttcaagggactcaggagcctgcgagtcttggatctggaccataacgagatttcgggcacaatagaggacacgagcggcgccttctcagggctcgacagcctcagcaagctgactctgtttggaaacaagatcaagtctgtggctaagagagcattctcggggctggaaggcctggagcacctgaaccttggagggaatgcgatcagatctgtccagtttgatgcctttgtgaagatgaagaatcttaaagagctccatatcagcagcgacagcttcctgtgtgactgccagctgaagtggctgcccccgtggctaattggcaggatgctgcaggcctttgtgacagccacctgtgcccacccagaatcactgaagggtcagagcattttctctgtgccaccagagagtttcgtgtgcgatgacttcctgaagccacagatcatcacccagccagaaaccaccatggctatggtgggcaaggacatccggtttacatgctcagcagccagcagcagcagctcccccatgacctttgcctggaagaaagacaatgaagtcctgaccaatgcagacatggagaactttgtccacgtccacgcgcaggacggggaagtgatggagtacaccaccatcctgcacctccgtcaggtcactttcgggcacgagggccgctaccaatgtgtcatcaccaaccactttggctccacctattcacataaggccaggctcaccgtgaatgtgttgccatcattcaccaaaacgccccacgacataaccatccggaccaccaccatggcccgcctcgaatgtgctgccacaggtcacccaaaccctcagattgcctggcagaaggatggaggcacggatttccccgctgcccgtgagcgacgcatgcatgtcatgccggatgacgacgtgtttttcatcactgatgtgaaaatagatgacgcaggggtttacagctgtactgctcagaactcagccggttctatttcagctaatgccaccctgactgtcctagagaccccatccttggtggtccccttggaagaccgtgtggtatctgtgggagaaacagtggccctccaatgcaaagccacggggaaccctccgccccgcatcacctggttcaagggggaccgcccgctgagcctcactgagcggcaccacttgacccctgacaaccagctcctggtggttcagaacgtggtggcagaggatgcgggccgatatacctgtgagatgtccaacaccctgggcacggagcgagctcacagccagctgagcgtcctgcccgcagcaggctgcaggaaggatgggaccacggtaggcatcttcaccattgctgtcgtgagcagcatcgtcctgacgtcactggtctgggtgtgcatcatctaccagaccaggaagaagagtgaagagtacagtgtcaccaacacagatgaaaccgtcgtgccaccagatgttccaagctacctctcttctcaggggaccctttctgaccgacaagaaaccgtggtcaggaccgagggtggccctcaggccaatgggcacattgagagcaatggtgtgtgtccaagagatgcaagccactttccagagcccgacactcacagcgttgcctgcaggcagccaaagctctgtgctgggtctgcgtatcacaaagagccgtggaaagcgatggagaaagctgaagggacacctgggccacataagatggaacacggtggccgggtcgtatgcagtgactgcaacaccgaagtggactgttactccaggggacaagccttccacccccagcctgtgtccagagacagcgcacagccaagtgcgccaaatggcccggagccgggtgggagtgaccaagagcattctccacatcaccagtgcagcaggactgccgctgggtcctgccccgagtgccaagggtcgctctaccccagtaaccacgatagaatgctgacggctgtgaagaaaaagccaatggcatctctagatgggaaaggggattcttcctggactttagcaaggttgtatcacccggactccacagagctacagcctgcatcttcattaacttcaggcagtccagagcgcgcggaagcccagtacttgcttgtttccaatggccacctccccaaagcatgtgacgccagtcccgagtccacgccactgacaggacagctccccgggaaacagagggtgccactgctgttggcaccaaaaagctaggttttgtctacctcagttcttgtcataccaatctctacgggaaagagaggtaggagaggctgcgaggaagcttgggttcaagcgtcactcatctgtacatagttgtaactcccatgtggagtatcagtcgctcacaggacttggatctgaagcacagtaaacgcaagaggggatttgtgtacaaaaggcaaaaaaagtatttgatatcattgtacataagagttttcagagatttcatatatatcttttacagaggctattttaatctttagtgcatggttaacagaaaaaaattatacaattttgacaatattatttttcgtatcaggttgctgtttaattttggagggggtggggaaatagttctggtgccttaacgcatggctggaatttatagaggctacaaccacatttgttcacaggagtttttggtgcggggtgggaaggatggaaggccttggatttatattgcacttcatagacccctaggctgctgtgcggtgggactccacatgcgccggaaggagcttcaggtgagcactgctcatgtgtggatgcccctgcaacaggcttccctgtctgtagagccaggggtgcaagtgccatccacacttgcagtgaatggcttttccttttaggtttaagtcctgtctgtctgtaaggcgtagaatctgtccgtctgtaaggcgtagaatgagggttgttaatccatcacaagcaaaaggtcagaacagttaaacactgcctttcctcctcctcttattttatgataaaagcaaatgtggccttctcagtatcattcgattgctatttgagacttttaaattaaggtaaaggctgctggtgttggtacctgtggatttttctatactgatgttttcgttttgccaatataatgagtattacattggccttgggggacagaaaggaggaagttctgacttttcagggctaccttatttctactaaggacccagagcaggcctgtccatgccattccttcgcacagatgaaactgagctgggactggaaaggacagcccttgacctgggttctgggtataatttgcacttttgagactggtagctaaccatcttatgagtgccaatgtgtcatttagtaaaacttaaatagaaacaaggtccttcaaatgttcctttggccaaaagctgaagggagttactgagaaaatagttaacaattactgtcaggtgtcatcactgttcaaaaggtaagcacatttagaattttgttcttgacagttaactgactaatcttacttccacaaaatatgtgaatttgctgcttctgagaggcaatgtgaaagagggagtattacttttatgtacaaagttatttatttatagaaattttggtacagtgtacattgaaaaccatgtaaaatattgaagtgtctaacaaatggcattgaagtgtctttaataaaggttcatttataaatgtca

SEQ ID NO: 356599 - DNA, 5684 bp, Homo sapiens
  misc_feature (473)..(473): n is a, c, g, or t
ggcgggactcttgctgcgcggaggagccgtgcggaacccgaggctgcgcgcgcgcgcgcgctctctggccgcggcgtggggacagcgaggcgcactggggcctcccagcgcggggccggccgcgccgtccagcccgaggtctacggctttgcgctccgagcccagaggaagatgcctgccggcaccgagctcgggctgcggggctgaacgcctgtcttccaggcgcagcggcagcactgccctcggccggtgtcggtagcggcactcggcgtgccccgggcggacgaagagcgcaggctgggtacaccttgcccgaatcggcggagttcgcagctagcgagggcgggccggccggcccggatgggcgcggggtttgcggcccccgccgggtgctccggagcggcccgggcaccgggggcacgctgagtgccggagccgcggccgcagagagaacttggggcgggggccatgcnccggtgcggagtctagagccgagcggagcgccccgcgggcccgcccgcgtctgcggccgttcgggtcctcacagtccccgcgcccggagttcgcagcgcgctccagacaagatggcgcggccggtccggggagggctcggggccccgcgccgctcgccttgccttctccttctctggctgcttttgcttcggctggagccggtgaccgccgcggccggcccgcgggcgccctgcgcggccgcctgcacttgcgctggggactcgctggactgcggtgggcgcgggctggctgcgttgcccggggacctgccctcctggacgcggagcctaaacctgagttacaacaaactctctgagattgaccctgctggttttgaggacttgccgaacctacaggaagtgtacctcaataataatgagttgacagcggtaccatccctgggcgctgcttcatcacatgtcgtctctctctttctgcagcacaacaagattcgcagcgtggaggggagccagctgaaggcctacctttccttagaagtgttagatctgagtttgaacaacatcacggaagtgcggaacacctgctttccacacggaccgcctataaaggagctcaacctggcaggcaatcggattggcaccctggagttgggagcatttgatggtctgtcacggtcgctgctaactcttcgcctgagcaaaaacaggatcacccagcttcctgtaagagcattcaagctacccaggctgacacaactggacctcaatcggaacaggattcggctgatagagggcctcaccttccaggggctcaacagcttggaggtgctgaagcttcagcgaaacaacatcagcaaactgacagatggggccttctggggactgtccaagatgcatgtgctgcacctggagtacaacagcctggtagaagtgaacagcggctcgctctacggcctcacggccctgcatcagctccacctcagcaacaattccatcgctcgcattcaccgcaagggctggagcttctgccagaagctgcatgagttggtcctgtccttcaacaacctgacacggctggacgaggagagcctggccgagctgagcagcctgagtgtcctgcgtctcagccacaattccatcagccacattgcggagggtgccttcaagggactcaggagcctgcgagtcttggatctggaccataacgagatttcgggcacaatagaggacacgagcggcgccttctcagggctcgacagcctcagcaagctgactctgtttggaaacaagatcaagtctgtggctaagagagcattctcggggctggaaggcctggagcacctgaaccttggagggaatgcgatcagatctgtccagtttgatgcctttgtgaagatgaagaatcttaaagagctccatatcagcagcgacagcttcctgtgtgactgccagctgaagtggctgcccccgtggctaattggcaggatgctgcaggcctttgtgacagccacctgtgcccacccagaatcactgaagggtcagagcattttctctgtgccaccagagagtttcgtgtgcgatgacttcctgaagccacagatcatcacccagccagaaaccaccatggctatggtgggcaaggacatccggtttacatgctcagcagccagcagcagcagctcccccatgacctttgcctggaagaaagacaatgaagtcctgaccaatgcagacatggagaactttgtccacgtccacgcgcaggacggggaagtgatggagtacaccaccatcctgcacctccgtcaggtcactttcgggcacgagggccgctaccaatgtgtcatcaccaaccactttggctccacctattcacataaggccaggctcaccgtgaatgtgttgccatcattcaccaaaacgccccacgacataaccatccggaccaccaccatggcccgcctcgaatgtgctgccacaggtcacccaaaccctcagattgcctggcagaaggatggaggcacggatttccccgctgcccgtgagcgacgcatgcatgtcatgccggatgacgacgtgtttttcatcactgatgtgaaaatagatgacgcaggggtttacagctgtactgctcagaactcagccggttctatttcagctaatgccaccctgactgtcctagagaccccatccttggtggtccccttggaagaccgtgtggtatctgtgggagaaacagtggccctccaatgcaaagccacggggaaccctccgccccgcatcacctggttcaagggggaccgcccgctgagcctcactgagcggcaccacttgacccctgacaaccagctcctggtggttcagaacgtggtggcagaggatgcgggccgatatacctgtgagatgtccaacaccctgggcacggagcgagctcacagccagctgagcgtcctgcccgcagcaggctgcaggaaggatgggaccacggtaggcatcttcaccattgctgtcgtgagcagcatcgtcctgacgtcactggtctgggtgtgcatcatctaccagaccaggaagaagagtgaagagtacagtgtcaccaacacagatgaaaccgtcgtgccaccagatgttccaagctacctctcttctcaggggaccctttctgaccgacaagaaaccgtggtcaggaccgagggtggccctcaggccaatgggcacattgagagcaatggtgtgtgtccaagagatgcaagccactttccagagcccgacactcacagcgttgcctgcaggcagccaaagctctgtgctgggtctgcgtatcacaaagagccgtggaaagcgatggagaaagctgaagggacacctgggccacataagatggaacacggtggccgggtcgtatgcagtgactgcaacaccgaagtggactgttactccaggggacaagccttccacccccagcctgtgtccagagacagcgcacagccaagtgcgccaaatggcccggagccgggtgggagtgaccaagagcattctccacatcaccagtgcagcaggactgccgctgggtcctgccccgagtgccaagggtcgctctaccccagtaaccacgatagaatgctgacggctgtgaagaaaaagccaatggcatctctagatgggaaaggggattcttcctggactttagcaaggttgtatcacccggactccacagagctacagcctgcatcttcattaacttcaggcagtccagagcgcgcggaagcccagtacttgcttgtttccaatggccacctccccaaagcatgtgacgccagtcccgagtccacgccactgacaggacagctccccgggaaacagagggtgccactgctgttggcaccaaaaagctaggttttgtctacctcagttcttgtcataccaatctctacgggaaagagaggtaggagaggctgcgaggaagcttgggttcaagcgtcactcatctgtacatagttgtaactcccatgtggagtatcagtcgctcacaggacttggatctgaagcacagtaaacgcaagaggggatttgtgtacaaaaggcaaaaaaagtatttgatatcattgtacataagagttttcagagatttcatatatatcttttacagaggctattttaatctttagtgcatggttaacagaaaaaaattatacaattttgacaatattatttttcgtatcaggttgctgtttaattttggagggggtggggaaatagttctggtgccttaacgcatggctggaatttatagaggctacaaccacatttgttcacaggagtttttggtgcggggtgggaaggatggaaggccttggatttatattgcacttcatagacccctaggctgctgtgcggtgggactccacatgcgccggaaggagcttcaggtgagcactgctcatgtgtggatgcccctgcaacaggcttccctgtctgtagagccaggggtgcaagtgccatccacacttgcagtgaatggcttttccttttaggtttaagtcctgtctgtctgtaaggcgtagaatctgtccgtctgtaaggcgtagaatgagggttgttaatccatcacaagcaaaaggtcagaacagttaaacactgcctttcctcctcctcttattttatgataaaagcaaatgtggccttctcagtatcattcgattgctatttgagacttttaaattaaggtaaaggctgctggtgttggtacctgtggatttttctatactgatgttttcgttttgccaatataatgagtattacattggccttgggggacagaaaggaggaagttctgacttttcagggctaccttatttctactaaggacccagagcaggcctgtccatgccattccttcgcacagatgaaactgagctgggactggaaaggacagcccttgacctgggttctgggtataatttgcacttttgagactggtagctaaccatcttatgagtgccaatgtgtcatttagtaaaacttaaatagaaacaaggtccttcaaatgttcctttggccaaaagctgaagggagttactgagaaaatagttaacaattactgtcaggtgtcatcactgttcaaaaggtaagcacatttagaattttgttcttgacagttaactgactaatcttacttccacaaaatatgtgaatttgctgcttctgagaggcaatgtgaaagagggagtattacttttatgtacaaagttatttatttatagaaattttggtacagtgtacattgaaaaccatgtaaaatattgaagtgtctaacaaatggcattgaagtgtctttaataaaggttcatttataaatgtcaaaaaaaaaaaaaaaaaaaaaaagataaaaaaaaagaaaaaaaaaaaaaagaagagggaaaggggcacaaatcagaaagcaataaacgaacaaacaaactaaaatgacgagtacggcgccaggcaagacgaaggaaaagaggaaacaaaacacaagataatgggtggcgcggacgcgccacgaaagtaatgtagcatagccgtagcaccaatagtccagaaacaacagcggagtatgaagacagagcggggtgttgcccacacacagagaacacggcggggcaaagggttggtagacaaacacagaagacgtggggggcaaccggcctaacagcaaggacggggctaaaaacc

SEQ ID NO: 356600 - DNA, 4000 bp, Homo sapiens
gcaatagcagcagacagtggttaatcggccgagggtacccaaacctgagttacaacaaactctctgagattgaccctgctggttttgaggacttgccgaacctacaggaagtgtacctcaataataatgagttgacagcggtaccatccctgggcgctgcttcatcacatgtcgtctctctctttctggtcctgtccttcaacaacctgacacggctggacgaggagagcctggccgagctgagcagcctgagtgtcctgcgtctcagccacaattccatcagccacattgcggagggtgccttcaagggactcaggagcctgcgagtcttggatctggaccataacgagatttcgggcacaatagaggacacgagcggcgccttctcagggctcgacagcctcagcaagctgactctgtttggaaacaagatcaagtctgtggctaagagagcattctcggggctggaaggcctggagcacctgaaccttggagggaatgcgatcagatctgtccagtttgatgcctttgtgaagatgaagaatcttaaagagctccatatcagcagcgacagcttcctgtgtgactgccagctgaagtggctgcccccgtggctaattggcaggatgctgcaggcctttgtgacagccacctgtgcccacccagaatcactgaagggtcagagcattttctctgtgccaccagagagtttcgtgtgcgatgacttcctgaagccacagatcatcacccagccagaaaccaccatggctatggtgggcaaggacatccggtttacatgctcagcagccagcagcagcagctcccccatgacctttgcctggaagaaagacaatgaagtcctgaccaatgcagacatggagaactttgtccacgtccacgcgcaggacggggaagtgatggagtacaccaccatcctgcacctccgtcaggtcactttcgggcacgagggccgctaccaatgtgtcatcaccaaccactttggctccacctattcacataaggccaggctcaccgtgaatgtgttgccatcattcaccaaaacgccccacgacataaccatccggaccaccaccatggcccgcctcgaatgtgctgccacaggtcacccaaaccctcagattgcctggcagaaggatggaggcacggatttccccgctgcccgtgagcgacgcatgcatgtcatgccggatgacgacgtgtttttcatcactgatgtgaaaatagatgacgcaggggtttacagctgtactgctcagaactcagccggttctatttcagctaatgccaccctgactgtcctagagaccccatccttggtggtccccttggaagaccgtgtggtatctgtgggagaaacagtggccctccaatgcaaagccacggggaaccctccgccccgcatcacctggttcaagggggaccgcccgctgagcctcactgagcggcaccacttgacccctgacaaccagctcctggtggttcagaacgtggtggcagaggatgcgggccgatatacctgtgagatgtccaacaccctgggcacggagcgagctcacagccagctgagcgtcctgcccgcagcaggctgcaggaaggatgggaccacggtaggcatcttcaccattgctgtcgtgagcagcatcgtcctgacgtcactggtctgggtgtgcatcatctaccagaccaggaagaagagtgaagagtacagtgtcaccaacacagatgaaaccgtcgtgccaccagatgttccaagctacctctcttctcaggggaccctttctgaccgacaagaaaccgtggtcaggaccgagggtggccctcaggccaatgggcacattgagagcaatggtgtgtgtccaagagatgcaagccactttccagagcccgacactcacagcgttgcctgcaggcagccaaagctctgtgctgggtctgcgtatcacaaagagccgtggaaagcgatggagaaagctgaagggacacctgggccacataagatggaacacggtggccgggtcgtatgcagtgactgcaacaccgaagtggactgttactccaggggacaagccttccacccccagcctgtgtccagagacagcgcacagccaagtgcgccaaatggcccggagccgggtgggagtgaccaagagcattctccacatcaccagtgcagcaggactgccgctgggtcctgccccgagtgccaagggtcgctctaccccagtaaccacgatagaatgctgacggctgtgaagaaaaagccaatggcatctctagatgggaaaggggattcttcctggactttagcaaggttgtatcacccggactccacagagctacagcctgcatcttcattaacttcaggcagtccagagcgcgcggaagcccagtacttgcttgtttccaatggccacctccccaaagcatgtgacgccagtcccgagtccacgccactgacaggacagctccccgggaaacagagggtgccactgctgttggcaccaaaaagctaggttttgtctacctcagttcttgtcataccaatctctacgggaaagagaggtaggagaggctgcgaggaagcttgggttcaagcgtcactcatctgtacatagttgtaactcccatgtggagtatcagtcgctcacaggacttggatctgaagcacagtaaacgcaagaggggatttgtgtacaaaaggcaaaaaaagtatttgatatcattgtacataagagttttcagagatttcatatatatcttttacagaggctattttaatctttagtgcatggttaacagaaaaaaattatacaattttgacaatattatttttcgtatcaggttgctgtttaattttggagggggtggggaaatagttctggtgccttaacgcatggctggaatttatagaggctacaaccacatttgttcacaggagtttttggtgcggggtgggaaggatggaaggccttggatttatattgcacttcatagacccctaggctgctgtgcggtgggactccacatgcgccggaaggagcttcaggtgagcactgctcatgtgtggatgcccctgcaacaggcttccctgtctgtagagccaggggtgcaagtgccatccacacttgcagtgaatggcttttccttttaggtttaagtcctgtctgtctgtaaggcgtagaatctgtccgtctgtaaggcgtagaatgagggttgttaatccatcacaagcaaaaggtcagaacagttaaacactgcctttcctcctcctcttattttatgataaaagcaaatgtggccttctcagtatcattcgattgctatttgagacttttaaattaaggtaaaggctgctggtgttggtacctgtggatttttctatactgatgttttcgttttgccaatataatgagtattacattggccttgggggacagaaaggaggaagttctgacttttcagggctaccttatttctactaaggacccagagcaggcctgtccatgccattccttcgcacagatgaaactgagctgggactggaaaggacagcccttgacctgggttctgggtataatttgcacttttgagactggtagctaaccatcttatgagtgccaatgtgtcatttagtaaaacttaaatagaaacaaggtccttcaaatgttcctttggccaaaagctgaagggagttactgagaaaatagttaacaattactgtcaggtgtcatcactgttcaaaaggtaagcacatttagaattttgttcttgacagttaactgactaatcttacttccacaaaatatgtgaatttgctgcttctgagaggcaatgtgaaagagggagtattacttttatgtacaaagttatttatttatagaaattttggtacagtgtacattgaaaaccatgtaaaatattgaagtgtctaacaaatggcattgaagtgtctttaataaaggttcatttataaatgtca

SEQ ID NO: 356601 - DNA, 3892 bp, Homo sapiens
agggaagaatggggctttggataagttaaaataccacaaagctcacatttctgagatgttgctatttgcttgaatcaacaatccatggattgttgtaagcctttggttttccagaattctgaaaaagttgcttttgaccatttttccaggtgttttccttgttttaatggaggtgcagatttttggaggtccttattctgacattttggaagtgttttacaccccctccttttggagtaaggtttgtgggtaagatctctgcagtcatgaccagtggtgcctgactgttttgtgtgaaagtcagcaggcagagccagttgtcttaaggaaactgccggctggctggtttgagaactgagaagtggtgggttaatttctaatcaaggagtgtgatcataaaggtgatcagtactcacagacttctaattagatgaggtcagatgtccatggtgcaactcttacggcatctggttggtggggctgaggatgcacagggacctcaagctctggttcctgcttggtgtctgtgtcagtttctgttagcatgaacagcagctggttcctctgtgtaccaagaacccagcgctttacagttgacccttctctccccagatgacttcctgaagccacagatcatcacccagccagaaaccaccatggctatggtgggcaaggacatccggtttacatgctcagcagccagcagcagcagctcccccatgacctttgcctggaagaaagacaatgaagtcctgaccaatgcagacatggagaactttgtccacgtccacgcgcaggacggggaagtgatggagtacaccaccatcctgcacctccgtcaggtcactttcgggcacgagggccgctaccaatgtgtcatcaccaaccactttggctccacctattcacataaggccaggctcaccgtgaatgtgttgccatcattcaccaaaacgccccacgacataaccatccggaccaccaccatggcccgcctcgaatgtgctgccacaggtcacccaaaccctcagattgcctggcagaaggatggaggcacggatttccccgctgcccgtgagcgacgcatgcatgtcatgccggatgacgacgtgtttttcatcactgatgtgaaaatagatgacgcaggggtttacagctgtactgctcagaactcagccggttctatttcagctaatgccaccctgactgtcctagagaccccatccttggtggtccccttggaagaccgtgtggtatctgtgggagaaacagtggccctccaatgcaaagccacggggaaccctccgccccgcatcacctggttcaagggggaccgcccgctgagcctcactgagcggcaccacttgacccctgacaaccagctcctggtggttcagaacgtggtggcagaggatgcgggccgatatacctgtgagatgtccaacaccctgggcacggagcgagctcacagccagctgagcgtcctgcccgcagcaggctgcaggaaggatgggaccacggtaggcatcttcaccattgctgtcgtgagcagcatcgtcctgacgtcactggtctgggtgtgcatcatctaccagaccaggaagaagagtgaagagtacagtgtcaccaacacagatgaaaccgtcgtgccaccagatgttccaagctacctctcttctcaggggaccctttctgaccgacaagaaaccgtggtcaggaccgagggtggccctcaggccaatgggcacattgagagcaatggtgtgtgtccaagagatgcaagccactttccagagcccgacactcacagcgttgcctgcaggcagccaaagctctgtgctgggtctgcgtatcacaaagagccgtggaaagcgatggagaaagctgaagggacacctgggccacataagatggaacacggtggccgggtcgtatgcagtgactgcaacaccgaagtggactgttactccaggggacaagccttccacccccagcctgtgtccagagacagcgcacagccaagtgcgccaaatggcccggagccgggtgggagtgaccaagagcattctccacatcaccagtgcagcaggactgccgctgggtcctgccccgagtgccaagggtcgctctaccccagtaaccacgatagaatgctgacggctgtgaagaaaaagccaatggcatctctagatgggaaaggggattcttcctggactttagcaaggttgtatcacccggactccacagagctacagcctgcatcttcattaacttcaggcagtccagagcgcgcggaagcccagtacttgcttgtttccaatggccacctccccaaagcatgtgacgccagtcccgagtccacgccactgacaggacagctccccgggaaacagagggtgccactgctgttggcaccaaaaagctaggttttgtctacctcagttcttgtcataccaatctctacgggaaagagaggtaggagaggctgcgaggaagcttgggttcaagcgtcactcatctgtacatagttgtaactcccatgtggagtatcagtcgctcacaggacttggatctgaagcacagtaaacgcaagaggggatttgtgtacaaaaggcaaaaaaagtatttgatatcattgtacataagagttttcagagatttcatatatatcttttacagaggctattttaatctttagtgcatggttaacagaaaaaaattatacaattttgacaatattatttttcgtatcaggttgctgtttaattttggagggggtggggaaatagttctggtgccttaacgcatggctggaatttatagaggctacaaccacatttgttcacaggagtttttggtgcggggtgggaaggatggaaggccttggatttatattgcacttcatagacccctaggctgctgtgcggtgggactccacatgcgccggaaggagcttcaggtgagcactgctcatgtgtggatgcccctgcaacaggcttccctgtctgtagagccaggggtgcaagtgccatccacacttgcagtgaatggcttttccttttaggtttaagtcctgtctgtctgtaaggcgtagaatctgtccgtctgtaaggcgtagaatgagggttgttaatccatcacaagcaaaaggtcagaacagttaaacactgcctttcctcctcctcttattttatgataaaagcaaatgtggccttctcagtatcattcgattgctatttgagacttttaaattaaggtaaaggctgctggtgttggtacctgtggatttttctatactgatgttttcgttttgccaatataatgagtattacattggccttgggggacagaaaggaggaagttctgacttttcagggctaccttatttctactaaggacccagagcaggcctgtccatgccattccttcgcacagatgaaactgagctgggactggaaaggacagcccttgacctgggttctgggtataatttgcacttttgagactggtagctaaccatcttatgagtgccaatgtgtcatttagtaaaacttaaatagaaacaaggtccttcaaatgttcctttggccaaaagctgaagggagttactgagaaaatagttaacaattactgtcaggtgtcatcactgttcaaaaggtaagcacatttagaattttgttcttgacagttaactgactaatcttacttccacaaaatatgtgaatttgctgcttctgagaggcaatgtgaaagagggagtattacttttatgtacaaagttatttatttatagaaattttggtacagtgtacattgaaaaccatgtaaaatattgaagtgtctaacaaatggcattgaagtgtctttaataaaggttcatttataaatgtca

SEQ ID NO: 356602 - DNA, 3024 bp, Homo sapiens
agaggacttcctggttttgcatctagctgtcccgtaacccgaccctgtatacgtatgttttccagtgttgccatcattcaccaaaacgccccacgacataaccatccggaccaccaccatggcccgcctcgaatgtgctgccacaggtcacccaaaccctcagattgcctggcagaaggatggaggcacggatttccccgctgcccgtgagcgacgcatgcatgtcatgccggatgacgacgtgtttttcatcactgatgtgaaaatagatgacgcaggggtttacagctgtactgctcagaactcagccggttctatttcagctaatgccaccctgactgtcctagagaccccatccttggtggtccccttggaagaccgtgtggtatctgtgggagaaacagtggccctccaatgcaaagccacggggaaccctccgccccgcatcacctggttcaagggggaccgcccgctgagcctcactgagcggcaccacttgacccctgacaaccagctcctggtggttcagaacgtggtggcagaggatgcgggccgatatacctgtgagatgtccaacaccctgggcacggagcgagctcacagccagctgagcgtcctgcccgcagcaggctgcaggaaggatgggaccacggtaggcatcttcaccattgctgtcgtgagcagcatcgtcctgacgtcactggtctgggtgtgcatcatctaccagaccaggaagaagagtgaagagtacagtgtcaccaacacagatgaaaccgtcgtgccaccagatgttccaagctacctctcttctcaggggaccctttctgaccgacaagaaaccgtggtcaggaccgagggtggccctcaggccaatgggcacattgagagcaatggtgtgtgtccaagagatgcaagccactttccagagcccgacactcacagcgttgcctgcaggcagccaaagctctgtgctgggtctgcgtatcacaaagagccgtggaaagcgatggagaaagctgaagggacacctgggccacataagatggaacacggtggccgggtcgtatgcagtgactgcaacaccgaagtggactgttactccaggggacaagccttccacccccagcctgtgtccagagacagcgcacagccaagtgcgccaaatggcccggagccgggtgggagtgaccaagagcattctccacatcaccagtgcagcaggactgccgctgggtcctgccccgagtgccaagggtcgctctaccccagtaaccacgatagaatgctgacggctgtgaagaaaaagccaatggcatctctagatgggaaaggggattcttcctggactttagcaaggttgtatcacccggactccacagagctacagcctgcatcttcattaacttcaggcagtccagagcgcgcggaagcccagtacttgcttgtttccaatggccacctccccaaagcatgtgacgccagtcccgagtccacgccactgacaggacagctccccgggaaacagagggtgccactgctgttggcaccaaaaagctaggttttgtctacctcagttcttgtcataccaatctctacgggaaagagaggtaggagaggctgcgaggaagcttgggttcaagcgtcactcatctgtacatagttgtaactcccatgtggagtatcagtcgctcacaggacttggatctgaagcacagtaaacgcaagaggggatttgtgtacaaaaggcaaaaaaagtatttgatatcattgtacataagagttttcagagatttcatatatatcttttacagaggctattttaatctttagtgcatggttaacagaaaaaaattatacaattttgacaatattatttttcgtatcaggttgctgtttaattttggagggggtggggaaatagttctggtgccttaacgcatggctggaatttatagaggctacaaccacatttgttcacaggagtttttggtgcggggtgggaaggatggaaggccttggatttatattgcacttcatagacccctaggctgctgtgcggtgggactccacatgcgccggaaggagcttcaggtgagcactgctcatgtgtggatgcccctgcaacaggcttccctgtctgtagagccaggggtgcaagtgccatccacacttgcagtgaatggcttttccttttaggtttaagtcctgtctgtctgtaaggcgtagaatctgtccgtctgtaaggcgtagaatgagggttgttaatccatcacaagcaaaaggtcagaacagttaaacactgcctttcctcctcctcttattttatgataaaagcaaatgtggccttctcagtatcattcgattgctatttgagacttttaaattaaggtaaaggctgctggtgttggtacctgtggatttttctatactgatgttttcgttttgccaatataatgagtattacattggccttgggggacagaaaggaggaagttctgacttttcagggctaccttatttctactaaggacccagagcaggcctgtccatgccattccttcgcacagatgaaactgagctgggactggaaaggacagcccttgacctgggttctgggtataatttgcacttttgagactggtagctaaccatcttatgagtgccaatgtgtcatttagtaaaacttaaatagaaacaaggtccttcaaatgttcctttggccaaaagctgaagggagttactgagaaaatagttaacaattactgtcaggtgtcatcactgttcaaaaggtaagcacatttagaattttgttcttgacagttaactgactaatcttacttccacaaaatatgtgaatttgctgcttctgagaggcaatgtgaaagagggagtattacttttatgtacaaagttatttatttatagaaattttggtacagtgtacattgaaaaccatgtaaaatattgaagtgtctaacaaatggcattgaagtgtctttaataaaggttcatttataaatgtca

SEQ ID NO: 356603 - DNA, 4067 bp, Homo sapiens
  misc_feature (473)..(473): n is a, c, g, or t
ggcgggactcttgctgcgcggaggagccgtgcggaacccgaggctgcgcgcgcgcgcgcgctctctggccgcggcgtggggacagcgaggcgcactggggcctcccagcgcggggccggccgcgccgtccagcccgaggtctacggctttgcgctccgagcccagaggaagatgcctgccggcaccgagctcgggctgcggggctgaacgcctgtcttccaggcgcagcggcagcactgccctcggccggtgtcggtagcggcactcggcgtgccccgggcggacgaagagcgcaggctgggtacaccttgcccgaatcggcggagttcgcagctagcgagggcgggccggccggcccggatgggcgcggggtttgcggcccccgccgggtgctccggagcggcccgggcaccgggggcacgctgagtgccggagccgcggccgcagagagaacttggggcgggggccatgcnccggtgcggagtctagagccgagcggagcgccccgcgggcccgcccgcgtctgcggccgttcgggtcctcacagtccccgcgcccggagttcgcagcgcgctccagacaagatggcgcggccggtccggggagggctcggggccccgcgccgctcgccttgccttctccttctctggctgcttttgcttcggctggagccggtgaccgccgcggccggcccgcgggcgccctgcgcggccgcctgcacttgcgctggggactcgctggactgcggtgggcgcgggctggctgcgttgcccggggacctgccctcctggacgcggagcctaaacctgagttacaacaaactctctgagattgaccctgctggttttgaggacttgccgaacctacaggaagtgtacctcaataataatgagttgacagcggtaccatccctgggcgctgcttcatcacatgtcgtctctctctttctgcagcacaacaagattcgcagcgtggaggggagccagctgaaggcctacctttccttagaagtgttagatctgagtttgaacaacatcacggaagtgcggaacacctgctttccacacggaccgcctataaaggagctcaacctggcaggcaatcggattggcaccctggagttgggagcatttgatggtctgtcacggtcgctgctaactcttcgcctgagcaaaaacaggatcacccagcttcctgtaagagcattcaagctacccaggctgacacaactggacctcaatcggaacaggattcggctgatagagggcctcaccttccaggggctcaacagcttggaggtgctgaagcttcagcgaaacaacatcagcaaactgacagatggggccttctggggactgtccaagatgcatgtgctgcacctggagtacaacagcctggtagaagtgaacagcggctcgctctacggcctcacggccctgcatcagctccacctcagcaacaattccatcgctcgcattcaccgcaagggctggagcttctgccagaagctgcatgagttggtcctgtccttcaacaacctgacacggctggacgaggagagcctggccgagctgagcagcctgagtgtcctgcgtctcagccacaattccatcagccacattgcggagggtgccttcaagggactcaggagcctgcgagtcttggatctggaccataacgagatttcgggcacaatagaggacacgagcggcgccttctcagggctcgacagcctcagcaagctgactctgtttggaaacaagatcaagtctgtggctaagagagcattctcggggctggaaggcctggagcacctgaaccttggagggaatgcgatcagatctgtccagtttgatgcctttgtgaagatgaagaatcttaaagagctccatatcagcagcgacagcttcctgtgtgactgccagctgaagtggctgcccccgtggctaattggcaggatgctgcaggcctttgtgacagccacctgtgcccacccagaatcactgaagggtcagagcattttctctgtgccaccagagagtttcgtgtgcgatgacttcctgaagccacagatcatcacccagccagaaaccaccatggctatggtgggcaaggacatccggtttacatgctcagcagccagcagcagcagctcccccatgacctttgcctggaagaaagacaatgaagtcctgaccaatgcagacatggagaactttgtccacgtccacgcgcaggacggggaagtgatggagtacaccaccatcctgcacctccgtcaggtcactttcgggcacgagggccgctaccaatgtgtcatcaccaaccactttggctccacctattcacataaggccaggctcaccgtgaatgtgttgccatcattcaccaaaacgccccacgacataaccatccggaccaccaccatggcccgcctcgaatgtgctgccacaggtcacccaaaccctcagattgcctggcagaaggatggaggcacggatttccccgctgcccgtgagcgacgcatgcatgtcatgccggatgacaggacagctccccgggaaacagagggtgccactgctgttggcaccaaaaagctaggttttgtctacctcagttcttgtcataccaatctctacgggaaagagaggtaggagaggctgcgaggaagcttgggttcaagcgtcactcatctgtacatagttgtaactcccatgtggagtatcagtcgctcacaggacttggatctgaagcacagtaaacgcaagaggggatttgtgtacaaaaggcaaaaaaagtatttgatatcattgtacataagagttttcagagatttcatatatatcttttacagaggctattttaatctttagtgcatggttaacagaaaaaaattatacaattttgacaatattatttttcgtatcaggttgctgtttaattttggagggggtggggaaatagttctggtgccttaacgcatggctggaatttatagaggctacaaccacatttgttcacaggagtttttggtgcggggtgggaaggatggaaggccttggatttatattgcacttcatagacccctaggctgctgtgcggtgggactccacatgcgccggaaggagcttcaggtgagcactgctcatgtgtggatgcccctgcaacaggcttccctgtctgtagagccaggggtgcaagtgccatccacacttgcagtgaatggcttttccttttaggtttaagtcctgtctgtctgtaaggcgtagaatctgtccgtctgtaaggcgtagaatgagggttgttaatccatcacaagcaaaaggtcagaacagttaaacactgcctttcctcctcctcttattttatgataaaagcaaatgtggccttctcagtatcattcgattgctatttgagacttttaaattaaggtaaaggctgctggtgttggtacctgtggatttttctatactgatgttttcgttttgccaatataatgagtattacattggccttgggggacagaaaggaggaagttctgacttttcagggctaccttatttctactaaggacccagagcaggcctgtccatgccattccttcgcacagatgaaactgagctgggactggaaaggacagcccttgacctgggttctgggtataatttgcacttttgagactggtagctaaccatcttatgagtgccaatgtgtcatttagtaaaacttaaatagaaacaaggtccttcaaatgttcctttggccaaaagctgaagggagttactgagaaaatagttaacaattactgtcaggtgtcatcactgttcaaaaggtaagcacatttagaattttgttcttgacagttaactgactaatcttacttccacaaaatatgtgaatttgctgcttctgagaggcaatgtgaaagagggagtattacttttatgtacaaagttatttatttatagaaattttggtacagtgtacattgaaaaccatgtaaaatattgaagtgtctaacaaatggcattgaagtgtctttaataaaggttcatttataaatgtca

SEQ ID NO: 356604 - DNA, 5204 bp, Homo sapiens
  misc_feature (473)..(473): n is a, c, g, or t
  misc_feature (5181)..(5181): n is a, c, g, or t
ggcgggactcttgctgcgcggaggagccgtgcggaacccgaggctgcgcgcgcgcgcgcgctctctggccgcggcgtggggacagcgaggcgcactggggcctcccagcgcggggccggccgcgccgtccagcccgaggtctacggctttgcgctccgagcccagaggaagatgcctgccggcaccgagctcgggctgcggggctgaacgcctgtcttccaggcgcagcggcagcactgccctcggccggtgtcggtagcggcactcggcgtgccccgggcggacgaagagcgcaggctgggtacaccttgcccgaatcggcggagttcgcagctagcgagggcgggccggccggcccggatgggcgcggggtttgcggcccccgccgggtgctccggagcggcccgggcaccgggggcacgctgagtgccggagccgcggccgcagagagaacttggggcgggggccatgcnccggtgcggagtctagagccgagcggagcgccccgcgggcccgcccgcgtctgcggccgttcgggtcctcacagtccccgcgcccggagttcgcagcgcgctccagacaagatggcgcggccggtccggggagggctcggggccccgcgccgctcgccttgccttctccttctctggctgcttttgcttcggctggagccggtgaccgccgcggccggcccgcgggcgccctgcgcggccgcctgcacttgcgctggggactcgctggactgcggtgggcgcgggctggctgcgttgcccggggacctgccctcctggacgcggagcctaaacctgagttacaacaaactctctgagattgaccctgctggttttgaggacttgccgaacctacaggaagtgtacctcaataataatgagttgacagcggtaccatccctgggcgctgcttcatcacatgtcgtctctctctttctgcagcacaacaagattcgcagcgtggaggggagccagctgaaggcctacctttccttagaagtgttagatctgagtttgaacaacatcacggaagtgcggaacacctgctttccacacggaccgcctataaaggagctcaacctggcaggcaatcggattggcaccctggagttgggagcatttgatggtctgtcacggtcgctgctaactcttcgcctgagcaaaaacaggatcacccagcttcctgtaagagcattcaagctacccaggctgacacaactggacctcaatcggaacaggattcggctgatagagggcctcaccttccaggggctcaacagcttggaggtgctgaagcttcagcgaaacaacatcagcaaactgacagatggggccttctggggactgtccaagatgcatgtgctgcacctggagtacaacagcctggtagaagtgaacagcggctcgctctacggcctcacggccctgcatcagctccacctcagcaacaattccatcgctcgcattcaccgcaagggctggagcttctgccagaagctgcatgagttggtcctgtccttcaacaacctgacacggctggacgaggagagcctggccgagctgagcagcctgagtgtcctgcgtctcagccacaattccatcagccacattgcggagggtgccttcaagggactcaggagcctgcgagtcttggatctggaccataacgagatttcgggcacaatagaggacacgagcggcgccttctcagggctcgacagcctcagcaagctgactctgtttggaaacaagatcaagtctgtggctaagagagcattctcggggctggaaggcctggagcacctgaaccttggagggaatgcgatcagatctgtccagtttgatgcctttgtgaagatgaagaatcttaaagagctccatatcagcagcgacagcttcctgtgtgactgccagctgaagtggctgcccccgtggctaattggcaggatgctgcaggcctttgtgacagccacctgtgcccacccagaatcactgaagggtcagagcattttctctgtgccaccagagagtttcgtgtgcgatgacttcctgaagccacagatcatcacccagccagaaaccaccatggctatggtgggcaaggacatccggtttacatgctcagcagccagcagcagcagctcccccatgacctttgcctggaagaaagacaatgaagtcctgaccaatgcagacatggagaactttgtccacgtccacgcgcaggacggggaagtgatggagtacaccaccatcctgcacctccgtcaggtcactttcgggcacgagggccgctaccaatgtgtcatcaccaaccactttggctccacctattcacataaggccaggctcaccgtgaatgtgttgccatcattcaccaaaacgccccacgacataaccatccggaccaccaccatggcccgcctcgaatgtgctgccacaggtcacccaaaccctcagattgcctggcagaaggatggaggcacggatttccccgctgcccgtgagcgacgcatgcatgtcatgccggatgacgacgtgtttttcatcactgatgtgaaaatagatgacgcaggggtttacagctgtactgctcagaactcagccggttctatttcagctaatgccaccctgactgtcctagagaccccatccttggtggtccccttggaagaccgtgtggtatctgtgggagaaacagtggccctccaatgcaaagccacggggaaccctccgccccgcatcacctggttcaagggggaccgcccgctgagcctcactgagcggcaccacttgacccctgacaaccagctcctggtggttcagaacgtggtggcagaggatgcgggccgatatacctgtgagatgtccaacaccctgggcacggagcgagctcacagccagctgagcgtcctgcccgcagcaggctgcaggaaggatgggaccacggtaggcatcttcaccattgctgtcgtgagcagcatcgtcctgacgtcactggtctgggtgtgcatcatctaccagaccaggaagaagagtgaagagtacagtgtcaccaacacagatgaaaccgtcgtgccaccagatgttccaagctacctctcttctcaggggaccctttctgaccgacaagaaaccgtggtcaggaccgagggtggccctcaggccaatgggcacattgagagcaatggtgtgtgtccaagagatgcaagccactttccagagcccgacactcacagcgttgcctgcaggcagccaaagctctgtgctgggtctgcgtatcacaaagagccgtggaaagcgatggagaaagctgaagggacacctgggccacataagatggaacacggtggccgggtcgtatgcagtgactgcaacaccgaagtggactgttactccaggggacaagccttccacccccagcctgtgtccagagacagcgcacagccaagtgcgccaaatggcccggagccgggtgggagtgaccaagagcattctccacatcaccagtgcagcaggactgccgctgggtcctgccccgagtgccaagggtcgctctaccccagtaaccacgatagaatgctgacggctgtgaagaaaaagccaatggcatctctagatgggaaaggggattcttcctggactttagcaaggttgtatcacccggactccacagagctacagcctgcatcttcattaacttcaggcagtccagagcgcgcggaagcccagtacttgcttgtttccaatggccacctccccaaagcatgtgacgccagtcccgagtccacgccactgacaggacagctccccgggaaacagagggtgccactgctgttggcaccaaaaagctaggttttgtctacctcagttcttgtcataccaatctctacgggaaagagaggtaggagaggctgcgaggaagcttgggttcaagcgtcactcatctgtacatagttgtaactcccatgtggagtatcagtcgctcacaggacttggatctgaagcacagtaaacgcaagaggggatttgtgtacaaaaggcaaaaaaagtatttgatatcattgtacataagagttttcagagatttcatatatatcttttacagaggctattttaatctttagtgcatggttaacagaaaaaaattatacaattttgacaatattatttttcgtatcaggttgctgtttaattttggagggggtggggaaatagttctggtgccttaacgcatggctggaatttatagaggctacaaccacatttgttcacaggagtttttggtgcggggtgggaaggatggaaggccttggatttatattgcacttcatagacccctaggctgctgtgcggtgggactccacatgcgccggaaggagcttcaggtgagcactgctcatgtgtggatgcccctgcaacaggcttccctgtctgtagagccaggggtgcaagtgccatccacacttgcagtgaatggcttttccttttaggtttaagtcctgtctgtctgtaaggcgtagaatctgtccgtctgtaaggcgtagaatgagggttgttaatccatcacaagcaaaaggtcagaacagttaaacactgcctttcctcctcctcttattttatgataaaagcaaatgtggccttctcagtatcattcgattgctatttgagacttttaaattaaggtaaaggctgctggtgttggtacctgtggatttttctatactgatgttttcgttttgccaatataatgagtattacattggccttgggggacagaaaggaggaagttctgacttttcagggctaccttatttctactaaggacccagagcaggcctgtccatgccattccttcgcacagatgaaactgagctgggactggaaaggacagcccttgacctgggttctgggtataatttgcacttttgagactggtagctaaccatcttatgagtgccaatgtgtcatttagtaaaacttaaatagaaacaaggtccttcaaatgttcctttggccaaaagctgaagggagttactgagaaaatagttaacaattactgtcaggtgtcatcactgttcaaaatcctctgtggctttccatctcactcacagtaatgtccatattcctcactgtgacatacagggttctgtagtttgatgcgacctcnccggtatttccgttgattactga

SEQ ID NO: 356605 - DNA, 2484 bp, Homo sapiens
  misc_feature (473)..(473): n is a, c, g, or t
ggcgggactcttgctgcgcggaggagccgtgcggaacccgaggctgcgcgcgcgcgcgcgctctctggccgcggcgtggggacagcgaggcgcactggggcctcccagcgcggggccggccgcgccgtccagcccgaggtctacggctttgcgctccgagcccagaggaagatgcctgccggcaccgagctcgggctgcggggctgaacgcctgtcttccaggcgcagcggcagcactgccctcggccggtgtcggtagcggcactcggcgtgccccgggcggacgaagagcgcaggctgggtacaccttgcccgaatcggcggagttcgcagctagcgagggcgggccggccggcccggatgggcgcggggtttgcggcccccgccgggtgctccggagcggcccgggcaccgggggcacgctgagtgccggagccgcggccgcagagagaacttggggcgggggccatgcnccggtgcggagtctagagccgagcggagcgccccgcgggcccgcccgcgtctgcggccgttcgggtcctcacagtccccgcgcccggagttcgcagcgcgctccagacaagatggcgcggccggtccggggagggctcggggccccgcgccgctcgccttgccttctccttctctggctgcttttgcttcggctggagccggtgaccgccgcggccggcccgcgggcgccctgcgcggccgcctgcacttgcgctggggactcgctggactgcggtgggcgcgggctggctgcgttgcccggggacctgccctcctggacgcggagcctaaacctgagttacaacaaactctctgagattgaccctgctggttttgaggacttgccgaacctacaggaagtgtacctcaataataatgagttgacagcggtaccatccctgggcgctgcttcatcacatgtcgtctctctctttctgcagcacaacaagattcgcagcgtggaggggagccagctgaaggcctacctttccttagaagtgttagatctgagtttgaacaacatcacggaagtgcggaacacctgctttccacacggaccgcctataaaggagctcaacctggcaggcaatcggattggcaccctggagttgggagcatttgatggtctgtcacggtcgctgctaactcttcgcctgagcaaaaacaggatcacccagcttcctgtaagagcattcaagctacccaggctgacacaactggacctcaatcggaacaggattcggctgatagagggcctcaccttccaggggctcaacagcttggaggtgctgaagcttcagcgaaacaacatcagcaaactgacagatggggccttctggggactgtccaagatgcatgtgctgcacctggagtacaacagcctggtagaagtgaacagcggctcgctctacggcctcacggccctgcatcagctccacctcagcaacaattccatcgctcgcattcaccgcaagggctggagcttctgccagaagctgcatgagttggtcctgtccttcaacaacctgacacggctggacgaggagagcctggccgagctgagcagcctgagtgtcctgcgtctcagccacaattccatcagccacattgcggagggtgccttcaagggactcaggagcctgcgagtcttggatctggaccataacgagatttcgggcacaatagaggacacgagcggcgccttctcagggctcgacagcctcagcaagctgactctgtttggaaacaagatcaagtctgtggctaagagagcattctcggggctggaaggcctggagcacctgtgagtatctcaccagccctgccctgaggcacagcctgctgaatgcggctgccggggagttctgctagcaatttaatcgcatctttgtaaactgagaaacaggctatttggaaacaccagctgcttccttctcattatgtcagcttcagctttggcctttatgttgcctatgccaggaacagttacagaacatatggccagtggatgtgctcccagttaattcagttggtatttggataaataccctccccgctcctgctgcgcagcctaacccctgcactggctccttcatggacccctggcctcattgcctcttccaccaacgcgcttcctcctggccaagcctgttgcctccattaaagcagcttaacaatgcagagtaggtgctgggctgaaccagtttggtgtggttgcttctgagaccctgggaggaagggaacagagccacccgagacagtcatgctgttgccatctggggaggatgcctcatgtatgtgattcttagtttgtttcctctttgaatcaagtttgactctaactctgttgggaaaggttttgccttgctgagcaggcctcagcccagctttgatggtgccctaaggctggcttggctcctgagtcattccatgggcttgtgttgcgatttgggaaacaacagccacttatag

SEQ ID NO: 356606 - DNA, 350 bp, Homo sapiens
ccggttctatttcagctaatgccaccctgactgtcctaggtttgcctattgctctactgtgtgtgtgtgtgtgtgtgtgtgagcgagagagagagactctcaaatgctctgtgtggccaggggtggtatgcgttgtgggcctttcgaccctgtttgaaatttggggctgctttttgagttgagttaatttttcttaaacaagtgtttctatctctttaaaagaaatgatagctggtgaattaagagtcttcatagggtttagctacagaacattttaagaattggacaggatggatgtgggcttggtcaagagctacagaacattttaagaattggacaggatggatgtg

SEQ ID NO: 356607 - DNA, 308 bp, Homo sapiens
tttgactcagcttcctctcactgaaaccataatcagtctcatctctccatcactaaacttcaccacccaagggttggtggtccttggagagagactgggccagacaaggtgatttctgcctaacactgggaggggccttttttaggccagacggcacatgcaattccagcctatcatcactattaaattctaataaagataaaagtatttcatttcagaaaggggaaggcctgcgtgcctcaaacccgtaatctcagcgcaggtcagctttccacctgcccctcactggacagacttatcaggtagca

SEQ ID NO: 356608 - DNA, 862 bp, Homo sapiens
agggaagaatggggctttggataagttaaaataccacaaagctcacatttctgagatgttgctatttgcttgaatcaacaatccatggattgttgtaagcctttggttttccagaattctgaaaaagttgcttttgaccatttttccaggtgttttccttgttttaatggaggtgcagatttttggaggtccttattctgacattttggaagtgttttacaccccctccttttggagtaaggtttgtgggtaagatctctgcagtcatgaccagtggtgcctgactgttttgtgtgaaagtcagcaggcagagccagttgtcttaaggaaactgccggctggctggtttgagaactgagaagtggtgggttaatttctaatcaaggagtgtgatcataaaggtgatcagtactcacagacttctaattagatgaggtcagatgtccatggtgcaactcttacggcatctggttggtggggctgaggatgcacagggacctcaagctctggttcctgcttggtgtctgtgtcagtttctgttagcatgaacagcagctggttcctctgtgtaccaagaacccagcgctttacagttgacccttctctccccagatgacttcctgaagccacagatcatcacccagccagaaaccaccatggctatggtgggcaaggacatccggtttacatgctcagcagccagcagcagcagctcccccaagaaccacctggtggagatcccgaccaaactacccagctccctggtggagctccgcatccacggagatcgtgatcctcgaggatcacgatgtccgtcggacatggtgcagggagactcgaagtactgtcgggctagtcgggg

SEQ ID NO: 356609 - DNA, 5639 bp, Homo sapiens
  misc_feature (473)..(473): n is a, c, g, or t
ggcgggactcttgctgcgcggaggagccgtgcggaacccgaggctgcgcgcgcgcgcgcgctctctggccgcggcgtggggacagcgaggcgcactggggcctcccagcgcggggccggccgcgccgtccagcccgaggtctacggctttgcgctccgagcccagaggaagatgcctgccggcaccgagctcgggctgcggggctgaacgcctgtcttccaggcgcagcggcagcactgccctcggccggtgtcggtagcggcactcggcgtgccccgggcggacgaagagcgcaggctgggtacaccttgcccgaatcggcggagttcgcagctagcgagggcgggccggccggcccggatgggcgcggggtttgcggcccccgccgggtgctccggagcggcccgggcaccgggggcacgctgagtgccggagccgcggccgcagagagaacttggggcgggggccatgcnccggtgcggagtctagagccgagcggagcgccccgcgggcccgcccgcgtctgcggccgttcgggtcctcacagtccccgcgcccggagttcgcagcgcgctccagacaagatggcgcggccggtccggggagggctcggggccccgcgccgctcgccttgccttctccttctctggctgcttttgcttcggctggagccggtgaccgccgcggccggcccgcgggcgccctgcgcggccgcctgcacttgcgctggggactcgctggactgcggtgggcgcgggctggctgcgttgcccggggacctgccctcctggacgcggagcctgtgagtgccgccctttccgccctctctgcgccccggggctctgtcacttggggatggagcggcgggggttcgtactcagggagggggtgcggactgggttgtgtgtgtggagttgtgcgtgcttgtgcgtgttggaagactgtcaggttggagtggcggaagggagattctgcgtggaggtccgggggagtaggcgtgcgagagagcctggagaagaagagcgtgcctcgtggggtctggagacgagcgagcgtgggtcgtagagatttgggggttagccagcacgcgtcgtgcgggccatctggggaaacctgagttacaacaaactctctgagattgaccctgctggttttgaggacttgccgaacctacaggaagtgtacctcaataataatgagttgacagcggtaccatccctgggcgctgcttcatcacatgtcgtctctctctttctgcagcacaacaagattcgcagcgtggaggggagccagctgaaggcctacctttccttagaagtgttagatctgagtttgaacaacatcacggaagtgcggaacacctgctttccacacggaccgcctataaaggagctcaacctggcaggcaatcggattggcaccctggagttgggagcatttgatggtctgtcacggtcgctgctaactcttcgcctgagcaaaaacaggatcacccagcttcctgtaagagcattcaagctacccaggctgacacaactggacctcaatcggaacaggattcggctgatagagggcctcaccttccaggggctcaacagcttggaggtgctgaagcttcagcgaaacaacatcagcaaactgacagatggggccttctggggactgtccaagatgcatgtgctgcacctggagtacaacagcctggtagaagtgaacagcggctcgctctacggcctcacggccctgcatcagctccacctcagcaacaattccatcgctcgcattcaccgcaagggctggagcttctgccagaagctgcatgagttggtcctgtccttcaacaacctgacacggctggacgaggagagcctggccgagctgagcagcctgagtgtcctgcgtctcagccacaattccatcagccacattgcggagggtgccttcaagggactcaggagcctgcgagtcttggatctggaccataacgagatttcgggcacaatagaggacacgagcggcgccttctcagggctcgacagcctcagcaagctgactctgtttggaaacaagatcaagtctgtggctaagagagcattctcggggctggaaggcctggagcacctgaaccttggagggaatgcgatcagatctgtccagtttgatgcctttgtgaagatgaagaatcttaaagagctccatatcagcagcgacagcttcctgtgtgactgccagctgaagtggctgcccccgtggctaattggcaggatgctgcaggcctttgtgacagccacctgtgcccacccagaatcactgaagggtcagagcattttctctgtgccaccagagagtttcgtgtgcgatgacttcctgaagccacagatcatcacccagccagaaaccaccatggctatggtgggcaaggacatccggtttacatgctcagcagccagcagcagcagctcccccatgacctttgcctggaagaaagacaatgaagtcctgaccaatgcagacatggagaactttgtccacgtccacgcgcaggacggggaagtgatggagtacaccaccatcctgcacctccgtcaggtcactttcgggcacgagggccgctaccaatgtgtcatcaccaaccactttggctccacctattcacataaggccaggctcaccgtgaatgtgttgccatcattcaccaaaacgccccacgacataaccatccggaccaccaccatggcccgcctcgaatgtgctgccacaggtcacccaaaccctcagattgcctggcagaaggatggaggcacggatttccccgctgcccgtgagcgacgcatgcatgtcatgccggatgacgacgtgtttttcatcactgatgtgaaaatagatgacgcaggggtttacagctgtactgctcagaactcagccggttctatttcagctaatgccaccctgactgtcctagagaccccatccttggtggtccccttggaagaccgtgtggtatctgtgggagaaacagtggccctccaatgcaaagccacggggaaccctccgccccgcatcacctggttcaagggggaccgcccgctgagcctcactgagcggcaccacttgacccctgacaaccagctcctggtggttcagaacgtggtggcagaggatgcgggccgatatacctgtgagatgtccaacaccctgggcacggagcgagctcacagccagctgagcgtcctgcccgcagcaggctgcaggaaggatgggaccacggtaggcatcttcaccattgctgtcgtgagcagcatcgtcctgacgtcactggtctgggtgtgcatcatctaccagaccaggaagaagagtgaagagtacagtgtcaccaacacagatgaaaccgtcgtgccaccagatgttccaagctacctctcttctcaggggaccctttctgaccgacaagaaaccgtggtcaggaccgagggtggccctcaggccaatgggcacattgagagcaatggtgtgtgtccaagagatgcaagccactttccagagcccgacactcacagcgttgcctgcaggcagccaaagctctgtgctgggtctgcgtatcacaaagagccgtggaaagcgatggagaaagctgaagggacacctgggccacataagatggaacacggtggccgggtcgtatgcagtgactgcaacaccgaagtggactgttactccaggggacaagccttccacccccagcctgtgtccagagacagcgcacagccaagtgcgccaaatggcccggagccgggtgggagtgaccaagagcattctccacatcaccagtgcagcaggactgccgctgggtcctgccccgagtgccaagggtcgctctaccccagtaaccacgatagaatgctgacggctgtgaagaaaaagccaatggcatctctagatgggaaaggggattcttcctggactttagcaaggttgtatcacccggactccacagagctacagcctgcatcttcattaacttcaggcagtccagagcgcgcggaagcccagtacttgcttgtttccaatggccacctccccaaagcatgtgacgccagtcccgagtccacgccactgacaggacagctccccgggaaacagagggtgccactgctgttggcaccaaaaagctaggttttgtctacctcagttcttgtcataccaatctctacgggaaagagaggtaggagaggctgcgaggaagcttgggttcaagcgtcactcatctgtacatagttgtaactcccatgtggagtatcagtcgctcacaggacttggatctgaagcacagtaaacgcaagaggggatttgtgtacaaaaggcaaaaaaagtatttgatatcattgtacataagagttttcagagatttcatatatatcttttacagaggctattttaatctttagtgcatggttaacagaaaaaaattatacaattttgacaatattatttttcgtatcaggttgctgtttaattttggagggggtggggaaatagttctggtgccttaacgcatggctggaatttatagaggctacaaccacatttgttcacaggagtttttggtgcggggtgggaaggatggaaggccttggatttatattgcacttcatagacccctaggctgctgtgcggtgggactccacatgcgccggaaggagcttcaggtgagcactgctcatgtgtggatgcccctgcaacaggcttccctgtctgtagagccaggggtgcaagtgccatccacacttgcagtgaatggcttttccttttaggtttaagtcctgtctgtctgtaaggcgtagaatctgtccgtctgtaaggcgtagaatgagggttgttaatccatcacaagcaaaaggtcagaacagttaaacactgcctttcctcctcctcttattttatgataaaagcaaatgtggccttctcagtatcattcgattgctatttgagacttttaaattaaggtaaaggctgctggtgttggtacctgtggatttttctatactgatgttttcgttttgccaatataatgagtattacattggccttgggggacagaaaggaggaagttctgacttttcagggctaccttatttctactaaggacccagagcaggcctgtccatgccattccttcgcacagatgaaactgagctgggactggaaaggacagcccttgacctgggttctgggtataatttgcacttttgagactggtagctaaccatcttatgagtgccaatgtgtcatttagtaaaacttaaatagaaacaaggtccttcaaatgttcctttggccaaaagctgaagggagttactgagaaaatagttaacaattactgtcaggtgtcatcactgttcaaaaggtaagcacatttagaattttgttcttgacagttaactgactaatcttacttccacaaaatatgtgaatttgctgcttctgagaggcaatgtgaaagagggagtattacttttatgtacaaagttatttatttatagaaattttggtacagtgtacattgaaaaccatgtaaaatattgaagtgtctaacaaatggcattgaagtgtctttaataaaggttcatttataaatgtca

SEQ ID NO: 356610 - DNA, 3631 bp, Homo sapiens
tctcaggtgggttatatgcactgccctgggaaattggagaggaagtgtgagaaaaaccatttcccccttccagcttgctgatgttcacttgagaagctgattggaggcgactgatcagtgtgtgtgtgaagggagtgtccctcctttgcggctgcacctgaagcatccactgttgtgtttctttcagccatatcagcagcgacagcttcctgtgtgactgccagctgaagtggctgcccccgtggctaattggcaggatgctgcaggcctttgtgacagccacctgtgcccacccagaatcactgaagggtcagagcattttctctgtgccaccagagagtttcgtgtgcgatgacttcctgaagccacagatcatcacccagccagaaaccaccatggctatggtgggcaaggacatccggtttacatgctcagcagccagcagcagcagctcccccatgacctttgcctggaagaaagacaatgaagtcctgaccaatgcagacatggagaactttgtccacgtccacgcgcaggacggggaagtgatggagtacaccaccatcctgcacctccgtcaggtcactttcgggcacgagggccgctaccaatgtgtcatcaccaaccactttggctccacctattcacataaggccaggctcaccgtgaatgtgttgccatcattcaccaaaacgccccacgacataaccatccggaccaccaccatggcccgcctcgaatgtgctgccacaggtcacccaaaccctcagattgcctggcagaaggatggaggcacggatttccccgctgcccgtgagcgacgcatgcatgtcatgccggatgacgacgtgtttttcatcactgatgtgaaaatagatgacgcaggggtttacagctgtactgctcagaactcagccggttctatttcagctaatgccaccctgactgtcctagagaccccatccttggtggtccccttggaagaccgtgtggtatctgtgggagaaacagtggccctccaatgcaaagccacggggaaccctccgccccgcatcacctggttcaagggggaccgcccgctgagcctcactgagcggcaccacttgacccctgacaaccagctcctggtggttcagaacgtggtggcagaggatgcgggccgatatacctgtgagatgtccaacaccctgggcacggagcgagctcacagccagctgagcgtcctgcccgcagcaggctgcaggaaggatgggaccacggtaggcatcttcaccattgctgtcgtgagcagcatcgtcctgacgtcactggtctgggtgtgcatcatctaccagaccaggaagaagagtgaagagtacagtgtcaccaacacagatgaaaccgtcgtgccaccagatgttccaagctacctctcttctcaggggaccctttctgaccgacaagaaaccgtggtcaggaccgagggtggccctcaggccaatgggcacattgagagcaatggtgtgtgtccaagagatgcaagccactttccagagcccgacactcacagcgttgcctgcaggcagccaaagctctgtgctgggtctgcgtatcacaaagagccgtggaaagcgatggagaaagctgaagggacacctgggccacataagatggaacacggtggccgggtcgtatgcagtgactgcaacaccgaagtggactgttactccaggggacaagccttccacccccagcctgtgtccagagacagcgcacagccaagtgcgccaaatggcccggagccgggtgggagtgaccaagagcattctccacatcaccagtgcagcaggactgccgctgggtcctgccccgagtgccaagggtcgctctaccccagtaaccacgatagaatgctgacggctgtgaagaaaaagccaatggcatctctagatgggaaaggggattcttcctggactttagcaaggttgtatcacccggactccacagagctacagcctgcatcttcattaacttcaggcagtccagagcgcgcggaagcccagtacttgcttgtttccaatggccacctccccaaagcatgtgacgccagtcccgagtccacgccactgacaggacagctccccgggaaacagagggtgccactgctgttggcaccaaaaagctaggttttgtctacctcagttcttgtcataccaatctctacgggaaagagaggtaggagaggctgcgaggaagcttgggttcaagcgtcactcatctgtacatagttgtaactcccatgtggagtatcagtcgctcacaggacttggatctgaagcacagtaaacgcaagaggggatttgtgtacaaaaggcaaaaaaagtatttgatatcattgtacataagagttttcagagatttcatatatatcttttacagaggctattttaatctttagtgcatggttaacagaaaaaaattatacaattttgacaatattatttttcgtatcaggttgctgtttaattttggagggggtggggaaatagttctggtgccttaacgcatggctggaatttatagaggctacaaccacatttgttcacaggagtttttggtgcggggtgggaaggatggaaggccttggatttatattgcacttcatagacccctaggctgctgtgcggtgggactccacatgcgccggaaggagcttcaggtgagcactgctcatgtgtggatgcccctgcaacaggcttccctgtctgtagagccaggggtgcaagtgccatccacacttgcagtgaatggcttttccttttaggtttaagtcctgtctgtctgtaaggcgtagaatctgtccgtctgtaaggcgtagaatgagggttgttaatccatcacaagcaaaaggtcagaacagttaaacactgcctttcctcctcctcttattttatgataaaagcaaatgtggccttctcagtatcattcgattgctatttgagacttttaaattaaggtaaaggctgctggtgttggtacctgtggatttttctatactgatgttttcgttttgccaatataatgagtattacattggccttgggggacagaaaggaggaagttctgacttttcagggctaccttatttctactaaggacccagagcaggcctgtccatgccattccttcgcacagatgaaactgagctgggactggaaaggacagcccttgacctgggttctgggtataatttgcacttttgagactggtagctaaccatcttatgagtgccaatgtgtcatttagtaaaacttaaatagaaacaaggtccttcaaatgttcctttggccaaaagctgaagggagttactgagaaaatagttaacaattactgtcaggtgtcatcactgttcaaaaggtaagcacatttagaattttgttcttgacagttaactgactaatcttacttccacaaaatatgtgaatttgctgcttctgagaggcaatgtgaaagagggagtattacttttatgtacaaagttatttatttatagaaattttggtacagtgtacattgaaaaccatgtaaaatattgaagtgtctaacaaatggcattgaagtgtctttaataaaggttcatttataaatgtca

SEQ ID NO: 356611 - DNA, 2752 bp, Homo sapiens
gctagtacgagggctggtttgaatctggccgaggctcagcggttctatttcagctaatgcaccctgactgtctagagaccccatccttggtggtccccttggaagaccgtgtggtatctgtgggagaaacagtggccctccaatgcaaagccacggggaaccctccgccccgcatcacctggttcaagggggaccgcccgctgagcctcactgagcggcaccacttgacccctgacaaccagctcctggtggttcagaacgtggtggcagaggatgcgggccgatatacctgtgagatgtccaacaccctgggcacggagcgagctcacagccagctgagcgtcctgcccgcagcaggctgcaggaaggatgggaccacggtaggcatcttcaccattgctgtcgtgagcagcatcgtcctgacgtcactggtctgggtgtgcatcatctaccagaccaggaagaagagtgaagagtacagtgtcaccaacacagatgaaaccgtcgtgccaccagatgttccaagctacctctcttctcaggggaccctttctgaccgacaagaaaccgtggtcaggaccgagggtggccctcaggccaatgggcacattgagagcaatggtgtgtgtccaagagatgcaagccactttccagagcccgacactcacagcgttgcctgcaggcagccaaagctctgtgctgggtctgcgtatcacaaagagccgtggaaagcgatggagaaagctgaagggacacctgggccacataagatggaacacggtggccgggtcgtatgcagtgactgcaacaccgaagtggactgttactccaggggacaagccttccacccccagcctgtgtccagagacagcgcacagccaagtgcgccaaatggcccggagccgggtgggagtgaccaagagcattctccacatcaccagtgcagcaggactgccgctgggtcctgccccgagtgccaagggtcgctctaccccagtaaccacgatagaatgctgacggctgtgaagaaaaagccaatggcatctctagatgggaaaggggattcttcctggactttagcaaggttgtatcacccggactccacagagctacagcctgcatcttcattaacttcaggcagtccagagcgcgcggaagcccagtacttgcttgtttccaatggccacctccccaaagcatgtgacgccagtcccgagtccacgccactgacaggacagctccccgggaaacagagggtgccactgctgttggcaccaaaaagctaggttttgtctacctcagttcttgtcataccaatctctacgggaaagagaggtaggagaggctgcgaggaagcttgggttcaagcgtcactcatctgtacatagttgtaactcccatgtggagtatcagtcgctcacaggacttggatctgaagcacagtaaacgcaagaggggatttgtgtacaaaaggcaaaaaaagtatttgatatcattgtacataagagttttcagagatttcatatatatcttttacagaggctattttaatctttagtgcatggttaacagaaaaaaattatacaattttgacaatattatttttcgtatcaggttgctgtttaattttggagggggtggggaaatagttctggtgccttaacgcatggctggaatttatagaggctacaaccacatttgttcacaggagtttttggtgcggggtgggaaggatggaaggccttggatttatattgcacttcatagacccctaggctgctgtgcggtgggactccacatgcgccggaaggagcttcaggtgagcactgctcatgtgtggatgcccctgcaacaggcttccctgtctgtagagccaggggtgcaagtgccatccacacttgcagtgaatggcttttccttttaggtttaagtcctgtctgtctgtaaggcgtagaatctgtccgtctgtaaggcgtagaatgagggttgttaatccatcacaagcaaaaggtcagaacagttaaacactgcctttcctcctcctcttattttatgataaaagcaaatgtggccttctcagtatcattcgattgctatttgagacttttaaattaaggtaaaggctgctggtgttggtacctgtggatttttctatactgatgttttcgttttgccaatataatgagtattacattggccttgggggacagaaaggaggaagttctgacttttcagggctaccttatttctactaaggacccagagcaggcctgtccatgccattccttcgcacagatgaaactgagctgggactggaaaggacagcccttgacctgggttctgggtataatttgcacttttgagactggtagctaaccatcttatgagtgccaatgtgtcatttagtaaaacttaaatagaaacaaggtccttcaaatgttcctttggccaaaagctgaagggagttactgagaaaatagttaacaattactgtcaggtgtcatcactgttcaaaaggtaagcacatttagaattttgttcttgacagttaactgactaatcttacttccacaaaatatgtgaatttgctgcttctgagaggcaatgtgaaagagggagtattacttttatgtacaaagttatttatttatagaaattttggtacagtgtacattgaaaaccatgtaaaatattgaagtgtctaacaaatggcattgaagtgtctttaataaaggttcatttataaatgtca

SEQ ID NO: 356612 - DNA, 5687 bp, Homo sapiens
  misc_feature (473)..(473): n is a, c, g, or t
ggcgggactcttgctgcgcggaggagccgtgcggaacccgaggctgcgcgcgcgcgcgcgctctctggccgcggcgtggggacagcgaggcgcactggggcctcccagcgcggggccggccgcgccgtccagcccgaggtctacggctttgcgctccgagcccagaggaagatgcctgccggcaccgagctcgggctgcggggctgaacgcctgtcttccaggcgcagcggcagcactgccctcggccggtgtcggtagcggcactcggcgtgccccgggcggacgaagagcgcaggctgggtacaccttgcccgaatcggcggagttcgcagctagcgagggcgggccggccggcccggatgggcgcggggtttgcggcccccgccgggtgctccggagcggcccgggcaccgggggcacgctgagtgccggagccgcggccgcagagagaacttggggcgggggccatgcnccggtgcggagtctagagccgagcggagcgccccgcgggcccgcccgcgtctgcggccgttcgggtcctcacagtccccgcgcccggagttcgcagcgcgctccagacaagatggcgcggccggtccggggagggctcggggccccgcgccgctcgccttgccttctccttctctggctgcttttgcttcggctggagccggtgaccgccgcggccggcccgcgggcgccctgcgcggccgcctgcacttgcgctggggactcgctggactgcggtgggcgcgggctggctgcgttgcccggggacctgccctcctggacgcggagcctaaacctgagttacaacaaactctctgagattgaccctgctggttttgaggacttgccgaacctacaggaagtgtacctcaataataatgagttgacagcggtaccatccctgggcgctgcttcatcacatgtcgtctctctctttctgcagcacaacaagattcgcagcgtggaggggagccagctgaaggcctacctttccttagaagtgttagatctgagtttgaacaacatcacggaagtgcggaacacctgctttccacacggaccgcctataaaggagctcaacctggcaggcaatcggattggcaccctggagttgggagcatttgatggtctgtcacggtcgctgctaactcttcgcctgagcaaaaacaggatcacccagcttcctgtaagagcattcaagctacccaggctgacacaactggacctcaatcggaacaggattcggctgatagagggcctcaccttccaggggctcaacagcttggaggtgctgaagcttcagcgaaacaacatcagcaaactgacagatggggccttctggggactgtccaagatgcatgtgctgcacctggagtacaacagcctggtagaagtgaacagcggctcgctctacggcctcacggccctgcatcagctccacctcagcaacaattccatcgctcgcattcaccgcaagggctggagcttctgccagaagctgcatgagttggtcctgtccttcaacaacctgacacggctggacgaggagagcctggccgagctgagcagcctgagtgtcctgcgtctcagccacaattccatcagccacattgcggagggtgccttcaagggactcaggagcctgcgagtcttggatctggaccataacgagatttcgggcacaatagaggacacgagcggcgccttctcagggctcgacagcctcagcaagctgactctgtttggaaacaagatcaagtctgtggctaagagagcattctcggggctggaaggcctggagcacctgaaccttggagggaatgcgatcagatctgtccagtttgatgcctttgtgaagatgaagaatcttaaagagctccatatcagcagcgacagcttcctgtgtgactgccagctgaagtggctgcccccgtggctaattggcaggatgctgcaggcctttgtgacagccacctgtgcccacccagaatcactgaagggtcagagcattttctctgtgccaccagagagtttcgtgtgcgatgacttcctgaagccacagatcatcacccagccagaaaccaccatggctatggtgggcaaggacatccggtttacatgctcagcagccagcagcagcagctcccccatgacctttgcctggaagaaagacaatgaagtcctgaccaatgcagacatggagaactttgtccacgtccacgcgcaggacggggaagtgatggagtacaccaccatcctgcacctccgtcaggtcactttcgggcacgagggccgctaccaatgtgtcatcaccaaccactttggctccacctattcacataaggccaggctcaccgtgaatgtgttgccatcattcaccaaaacgccccacgacataaccatccggaccaccaccatggcccgcctcgaatgtgctgccacaggtcacccaaaccctcagattgcctggcagaaggatggaggcacggatttccccgctgcccgtgagcgacgcatgcatgtcatgccggatgacgacgtgtttttcatcactgatgtgaaaatagatgacgcaggggtttacagctgtactgctcagaactcagccggttctatttcagctaatgccaccctgactgtcctagagaccccatccttggtggtccccttggaagaccgtgtggtatctgtgggagaaacagtggccctccaatgcaaagccacggggaaccctccgccccgcatcacctggttcaagggggaccgcccgctgagcctcactgagcggcaccacttgacccctgacaaccagctcctggtggttcagaacgtggtggcagaggatgcgggccgatatacctgtgagatgtccaacaccctgggcacggagcgagctcacagccagctgagcgtcctgcccgcagcaggctgcaggaaggatgggaccacggtaggcatcttcaccattgctgtcgtgagcagcatcgtcctgacgtcactggtctgggtgtgcatcatctaccagaccaggaagaagagtgaagagtacagtgtcaccaacacagatgaaaccgtcgtgccaccagatgttccaagctacctctcttctcaggggaccctttctgaccgacaagaaaccgtggtcaggaccgagggtggccctcaggccaatgggcacattgagagcaatggtgtgtgtccaagagatgcaagccactttccagagcccgacactcacagcgttgcctgcaggcagccaaagctctgtgctgggtctgcgtatcacaaagagccgtggaaagcgatggagaaagctgaagggacacctgggccacataagatggaacacggtggccgggtcgtatgcagtgactgcaacaccgaagtggactgttactccaggggacaagccttccacccccagcctgtgtccagagacagcgcacagccaagtgcgccaaatggcccggagccgggtgggagtgaccaagagcattctccacatcaccagtgcagcaggactgccgctgggtcctgccccgagtgccaagggtcgctctaccccagtaaccacgatagaatgctgacggctgtgaagaaaaagccaatggcatctctagatgggaaaggggattcttcctggactttagcaaggttgtatcacccggactccacagagctacagcctgcatcttcattaacttcaggcagtccagagcgcgcggaagcccagtacttgcttgtttccaatggccacctccccaaagcatgtgacgccagtcccgagtccacgccactgacaggacagctccccgggaaacagagggtgccactgctgttggcaccaaaaagctaggttttgtctacctcagttcttgtcataccaatctctacgggaaagagaggtaggagaggctgcgaggaagcttgggttcaagcgtcactcatctgtacatagttgtaactcccatgtggagtatcagtcgctcacaggacttggatctgaagcacagtaaacgcaagaggggatttgtgtacaaaaggcaaaaaaagtatttgatatcattgtacataagagttttcagagatttcatatatatcttttacagaggctattttaatctttagtgcatggttaacagaaaaaaattatacaattttgacaatattatttttcgtatcaggttgctgtttaattttggagggggtggggaaatagttctggtgccttaacgcatggctggaatttatagaggctacaaccacatttgttcacaggagtttttggtgcggggtgggaaggatggaaggccttggatttatattgcacttcatagacccctaggctgctgtgcggtgggactccacatgcgccggaaggagcttcaggtgagcactgctcatgtgtggatgcccctgcaacaggcttccctgtctgtagagccaggggtgcaagtgccatccacacttgcagtgaatggcttttccttttaggtttaagtcctgtctgtctgtaaggcgtagaatctgtccgtctgtaaggcgtagaatgagggttgttaatccatcacaagcaaaaggtcagaacagttaaacactgcctttcctcctcctcttattttatgataaaagcaaatgtggccttctcagtatcattcgattgctatttgagacttttaaattaaggtaaaggctgctggtgttggtacctgtggatttttctatactgatgttttcgttttgccaatataatgagtattacattggccttgggggacagaaaggaggaagttctgacttttcagggctaccttatttctactaaggacccagagcaggcctgtccatgccattccttcgcacagatgaaactgagctgggactggaaaggacagcccttgacctgggttctgggtataatttgcacttttgagactggtagctaaccatcttatgagtgccaatgtgtcatttagtaaaacttaaatagaaacaaggtccttcaaatgttcctttggccaaaagctgaagggagttactgagaaaatagttaacaattactgtcaggtgtcatcactgttcaaaaggtaagcacatttagaattttgttcttgacagttaactgactaatcttacttccacaaaatatgtgaatttgctgcttctgagaggcaatgtgaaagagggagtattacttttatgtacaaagttatttatttatagaaattttggtacagtgtacattgaaaaccatgtaaaatattgaagtgtctaacaaatggcattgaagtgtctttaataaaggttcatttataaatgtcagtatagttggtggtccttcttttacaaacgcagtcattctgcctttaattatcttcccccaaaaaagaaaaaaaaaataggcgaagcaaaatcacatactgtttgtttgctccagggcagacaacactgctagattcctgacattttgttttgaatttttctacacctggagcttgttagtcaaggtctaaaatccctaagtgtggtgacctttccatttcatcctgccttttcaaagctggcccaggccctcctttcagtctgacatgagaatggcgagaatggctcacccaccgtgccctcctgcacgaagccagctgggcccacctagtcacttgagttgcagctgctttct

SEQ ID NO: 356613 - DNA, 2789 bp, Homo sapiens
  misc_feature (473)..(473): n is a, c, g, or t
  misc_feature (2759)..(2759): n is a, c, g, or t
  misc_feature (2775)..(2775): n is a, c, g, or t
  misc_feature (2780)..(2780): n is a, c, g, or t
  misc_feature (2783)..(2783): n is a, c, g, or t
ggcgggactcttgctgcgcggaggagccgtgcggaacccgaggctgcgcgcgcgcgcgcgctctctggccgcggcgtggggacagcgaggcgcactggggcctcccagcgcggggccggccgcgccgtccagcccgaggtctacggctttgcgctccgagcccagaggaagatgcctgccggcaccgagctcgggctgcggggctgaacgcctgtcttccaggcgcagcggcagcactgccctcggccggtgtcggtagcggcactcggcgtgccccgggcggacgaagagcgcaggctgggtacaccttgcccgaatcggcggagttcgcagctagcgagggcgggccggccggcccggatgggcgcggggtttgcggcccccgccgggtgctccggagcggcccgggcaccgggggcacgctgagtgccggagccgcggccgcagagagaacttggggcgggggccatgcnccggtgcggagtctagagccgagcggagcgccccgcgggcccgcccgcgtctgcggccgttcgggtcctcacagtccccgcgcccggagttcgcagcgcgctccagacaagatggcgcggccggtccggggagggctcggggccccgcgccgctcgccttgccttctccttctctggctgcttttgcttcggctggagccggtgaccgccgcggccggcccgcgggcgccctgcgcggccgcctgcacttgcgctggggactcgctggactgcggtgggcgcgggctggctgcgttgcccggggacctgccctcctggacgcggagcctaaacctgagttacaacaaactctctgagattgaccctgctggttttgaggacttgccgaacctacaggaagtgtacctcaataataatgagttgacagcggtaccatccctgggcgctgcttcatcacatgtcgtctctctctttctgcagcacaacaagattcgcagcgtggaggggagccagctgaaggcctacctttccttagaagtgttagatctgagtttgaacaacatcacggaagtgcggaacacctgctttccacacggaccgcctataaaggagctcaacctggcaggcaatcggattggcaccctggagttgggagcatttgatggtctgtcacggtcgctgctaactcttcgcctgagcaaaaacaggatcacccagcttcctgtaagagcattcaagctacccaggctgacacaactggacctcaatcggaacaggattcggctgatagagggcctcaccttccaggggctcaacagcttggaggtgctgaagcttcagcgaaacaacatcagcaaactgacagatggggccttctggggactgtccaagatgcatgtgctgcacctggagtacaacagcctggtagaagtgaacagcggctcgctctacggcctcacggccctgcatcagctccacctcagcaacaattccatcgctcgcattcaccgcaagggctggagcttctgccagaagctgcatgagttggtcctgtccttcaacaacctgacacggctggacgaggagagcctggccgagctgagcagcctgagtgtcctgcgtctcagccacaattccatcagccacattgcggagggtgccttcaagggactcaggagcctgcgagtcttggatctggaccataacgagatttcgggcacaatagaggacacgagcggcgccttctcagggctcgacagcctcagcaagctgactctgtttggaaacaagatcaagtctgtggctaagagagcattctcggggctggaaggcctggagcacctgaaccttggagggaatgcgatcagatctgtccagtttgatgcctttgtgaagatgaagaatcttaaagagctccatatcagcagcgacagcttcctgtgtgactgccagctgaagtggctgcccccgtggctaattggcaggatgctgcaggcctttgtgacagccacctgtgcccacccagaatcactgaagggtcagagcattttctctgtgccaccagagagtttcgtgtgcgatgacttcctgaagccacagatcatcacccagccagaaaccaccatggctatggtgggcaaggacatccggtttacatgctcagcagccagcagcagcagctcccccatgacctttgcctggaagaaagacaatgaagtcctgaccaatgcagacatggagaactttgtccacgtccacgcgcaggacggggaagtgatggagtacaccaccatcctgcacctccgtcaggtcactttcgggcacgagggccgctaccaatgtgtcatcaccaaccactttggctccacctattcacataaggccaggctcaccgtgaatgtgttgccatcattcaccaaaacgccccacgacataaccatccggaccaccaccatggcccgcctcgaatgtgctgccacaggtcacccaaaccctcagattgcctggcagaaggatggaggcacggatttccccgctgcccgtgagcgacgcatgcatgtcatgccggatgacgacgtgtttttcatcactgatgtgaaaatagatgacgcaggggtttacagctgtactgctcagaactcagccggttctatttcagctaatgccaccctgactgtcctagagaccccatccttggtggtccccttggaagaccgtgtggtatctgtgggagaaacagtggccctccaatgcaaagccacggggaaccctccgccccgctccccncaatgaaataaagttnttttntcnttccca

SEQ ID NO: 356614 - DNA, 2620 bp, Homo sapiens
  misc_feature (473)..(473): n is a, c, g, or t
ggcgggactcttgctgcgcggaggagccgtgcggaacccgaggctgcgcgcgcgcgcgcgctctctggccgcggcgtggggacagcgaggcgcactggggcctcccagcgcggggccggccgcgccgtccagcccgaggtctacggctttgcgctccgagcccagaggaagatgcctgccggcaccgagctcgggctgcggggctgaacgcctgtcttccaggcgcagcggcagcactgccctcggccggtgtcggtagcggcactcggcgtgccccgggcggacgaagagcgcaggctgggtacaccttgcccgaatcggcggagttcgcagctagcgagggcgggccggccggcccggatgggcgcggggtttgcggcccccgccgggtgctccggagcggcccgggcaccgggggcacgctgagtgccggagccgcggccgcagagagaacttggggcgggggccatgcnccggtgcggagtctagagccgagcggagcgccccgcgggcccgcccgcgtctgcggccgttcgggtcctcacagtccccgcgcccggagttcgcagcgcgctccagacaagatggcgcggccggtccggggagggctcggggccccgcgccgctcgccttgccttctccttctctggctgcttttgcttcggctggagccggtgaccgccgcggccggcccgcgggcgccctgcgcggccgcctgcacttgcgctggggactcgctggactgcggtgggcgcgggctggctgcgttgcccggggacctgccctcctggacgcggagcctaaacctgagttacaacaaactctctgagattgaccctgctggttttgaggacttgccgaacctacaggaagtgtacctcaataataatgagttgacagcggtaccatccctgggcgctgcttcatcacatgtcgtctctctctttctgcagcacaacaagattcgcagcgtggaggggagccagctgaaggcctacctttccttagaagtgttagatctgagtttgaacaacatcacggaagtgcggaacacctgctttccacacggaccgcctataaaggagctcaacctggcaggcaatcggattggcaccctggagttgggagcatttgatggtctgtcacggtcgctgctaactcttcgcctgagcaaaaacaggatcacccagcttcctgtaagagcattcaagctacccaggctgacacaactggacctcaatcggaacaggattcggctgatagagggcctcaccttccaggggctcaacagcttggaggtgctgaagcttcagcgaaacaacatcagcaaactgacagatggggccttctggggactgtccaagatgcatgtgctgcacctggagtacaacagcctggtagaagtgaacagcggctcgctctacggcctcacggccctgcatcagctccacctcagcaacaattccatcgctcgcattcaccgcaagggctggagcttctgccagaagctgcatgagttggtcctgtccttcaacaacctgacacggctggacgaggagagcctggccgagctgagcagcctgagtgtcctgcgtctcagccacaattccatcagccacattgcggagggtgccttcaagggactcaggagcctgcgagtcttggatctggaccataacgagatttcgggcacaatagaggacacgagcggcgccttctcagggctcgacagcctcagcaagctgactctgtttggaaacaagatcaagtctgtggctaagagagcattctcggggctggaaggcctggagcacctgaaccttggagggaatgcgatcagatctgtccagtttgatgcctttgtgaagatgaagaatcttaaagagctccatatcagcagcgacagcttcctgtgtgactgccagctgaagtggctgcccccgtggctaattggcaggatgctgcaggcctttgtgacagccacctgtgcccacccagaatcactgaagggtcagagcattttctctgtgccaccagagagtttcgtgtgcgatgacttcctgaagccacagatcatcacccagccagaaaccaccatggctatggtgggcaaggacatccggtttacatgctcagcagccagcagcagcagctcccccatgacctttgcctggaagaaagacaatgaagtcctgaccaatgcagacatggagaactttgtccacgtccacgcgcaggacggggaagtgatggagtacaccaccatcctgcacctccgtcaggtcactttcgggcacgagggccgctaccaatgtgtcatcaccaaccactttggctccacctattcacataaggccaggctcaccgtgaatgtgttgccatcattcaccaaaacgccccacgacataaccatccggaccaccaccatggcccgcctcgaatgtgctgccacaggtcacccaaaccctcagattgcctggcagaaggatggaggcacggatttccccgctgcccgtgagcgacgcatgcatgtcatgccggatgacgacgtgtttttcatcactgatgtgaaaatagatgacgcaggtgggtactactgggttaattgcaggtggtactt

SEQ ID NO: 356615 - DNA, 2738 bp, Homo sapiens
agcgggtctcctcggccgacaagctctcgcgagacgagccgtgcaggctgaaaaaatggcgccacccagtacccgggagcccagggtcctgtcggcgaccagcgcaaccaaatccgacggagagatggtgctgccaggcttcccggacgccgacagctttgtgaagtttgctcttgggtccgtggtggcagtcaccaaggcatctgggggcctaccacagtttggcgatgagtatgatttttaccgaagttttcctggcttccaagcattttgcgaaacacagggagacaggttgcttcagtgcatgagcagagtaatgcagtaccatgggtgtcgcagcaacattaaggatcgaagtaaagtgactgagctggaagacaagtttgatttactagttgatgccaatgatgtaattctggagagagtgggtattttactggatgaagcctcaggtgtaaacaagaatcaacagcctgtcctccctgccggcttgcaggtccccaaaacggtagtgtccagctggaaccgtaaggcagcagaatatggcaaaaaagcaaaatctgaaactttccggctgcttcatgcaaaaaatatcatccgacctcagctcaagtttcgagagaagattgacaattccaacacaccatttcttcctaaaatcttcatcaaacccaatgctcagaaacctctccctcaagctctctctaaggaaaggcgggaacgcccacaggatcgtcctgaggacttggacgtcccccctgcactggctgatttcatccatcagcagagaacccagcaggttgagcaagacatgtttgcacatccttatcaatatgaactaaatcactttaccccagcagatgcagtgcttcaaaagccacaaccccagttatacagacctatagaagagacaccatgccatttcatatcctccctggatgaactcgtggaactcaacgaaaagctcttgaattgtcaggaatttgcagttgacttggagcaccactcttacaggagcttcctgggactgacctgcctgatgcaaatttctactcggacggaagacttcatcattgacaccctcgagcttcgaagtgacatgtacattctcaatgagagcctcacagacccagccatcgttaaggtctttcatggtgctgattcagacatagaatggctacagaaagactttgggttgtatgtagtaaacatgtttgatactcatcaggcagcacgccttcttaacctgggcaggcactcactcgatcatctcctgaaactctactgcaacgtggactcaaacaagcaatatcagctggctgattggagaatacgccctctgcccgaggagatgctcagctacgcccgggatgacacccattacctgctatatatctatgacaaaatgaggctggagatgtgggagcgcggcaacgggcagcccgtgcagctgcaggtggtgtggcaacggagcagggacatctgcctcaagaaattcatcaaacctatcttcacggatgagtcctaccttgaactctataggaagcagaagaagcaccttaacacacagcagttgacagcctttcagctgctgtttgcctggagggataaaacagctcgcagggaagatgaaagttacggatatgtactgccaaaccacatgatgctgaaaatagctgaagaactgcctaaggaacctcagggcatcatagcttgctgcaacccagtaccgccccttgtgcggcagcagatcaacgaaatgcaccttttaatccagcaggcccgagagatgcccctgctcaagtctgaagttgcagccggagtgaagaagagcggaccgctgcccagtgctgagagattggagaatgttctctttggacctcacgactgctcccatgcccctccggatggctatccaatcatcccaaccagtggatctgtgccagttcagaagcaggcgagcctcttccctgatgaaaaagaagataacttgctgggtaccacatgcctgattgccacagctgtcatcacgttatttaatgaacctagtgctgaagacagtaaaaagggtccattgacagttgcacagaaaaaagcccagaacatcatggagtcctttgaaaatccatttaggatgatcagcaaccgttggaagctggcccaggtacaagtacaaaaagactctaaagaagctgtcaagaagaaggcagctgagcaaacagctgcccgggaacaggcaaaggaggcgtgcaaagctgcagcagaacaggccatctccgtccgacagcaggtcgtgctagaaaatgctgcaaagaagagagagcgagcaacaagcgacccaaggaccacagaacagaaacaagagaagaaacgactcaaaatttccaagaagccaaaggacccagagccaccagaaaaagagtttacgccttacgactacagccagtcagacttcaaggcttttgctggaaacagcaaatccaaagtttcttctcagtttgatccaaataaacagaccccgtctggcaagaaatgcattgcagccaaaaaaattaaacagtcggtgggaaacaaaagcatgtcctttccaactggaaagtcagacagaggcttcaggtacaactggccacagagatagtcctggaagacacgtggcgcctgtggaccggaagcaccaaatgctggtgctgcttttgtacatacatatttttaaaccattaaaattcttcctgaagaaa

SEQ ID NO: 356616 - DNA, 1145 bp, Homo sapiens
acactgaacaactgcacgtcctgtgtgttatgcccagtgtcacctccatgtgttgtaacgccataggtccgtggggtgtcataaagaaacacagcagacttgcggaagcccagccttgagtctgcttctgtcatttactgaccatgccccttggacaagttatttagtctcccggagtctgtttgctcatctctaaagagagggtgatgacagtacctttttcccagggttacagagggattgaatgagatgatggatggcccagtgcctggaggacagtagcactttgtccttaatagggattttagcaataaagccagcatgaaatttatttttcatgcccttagatttgaaaatttatgacttagaatgtgtgtacttcttaggttaacctgcccttcgtcacctcatgaaaagtaagacagacttaggtggctgactttggagggttttttttgttatatttgctttcattatatcagcaaccgttggaagctggcccaggtacaagtacaaaaagactctaaagaagctgtcaagaagaaggcagctgagcaaacaggtaacactcacttccttgcaactcagtcggctgttaaagaatggctgttgcacacccgctgtttcagccaagtgccagatacggcgatgaatgaagcccctgtggggcttcccttctgctgagggatggtgggcaatcagtatctatcctggcagatggcagcaggtgctgtgcagagagattggtggggagtgctggaggtgctgtagctgtctcggtggttggagaaggcagtctaatgaatgcgacattgacgagacctgcagtgacctagagaagagttctggagccacagcacagcgagcccagaggccctggggctagttcactgggcatgctgagcagcagcaagtgggcctgcatgagcagaggcgggtagagaagagcaggagatggggaaggagccagcagaggcccacgggatgacgctgccttttactctgagttcagaagccaggagggtgctgagcagacaggggggaagtgactgacatgtggcactctggctgctgtgtcaacagtagactatagaggacaggatgggagtccaggaagggataggagacatggcagtggctcaggc

SEQ ID NO: 356617 - DNA, 360 bp, Homo sapiens
agccgaccctgaggtcaggggacttgcccgagggcaggaaaaacaggtctgccttctcaagatgctgctcagctcagccaactctggtgggccgccgagttctctggggcccctgagcaaaccattcttcctctgttctgcatgattaagatttgcaccattttgtaaaccatctgagaacatccaaccagcccggaagaaataactgttgtttttgtactctctgcagaggcttcaggtacaactggccacagagatagtcctggaagacacgtggcgcctgtggaccggaagcaccaaatgctggtgctgcttttgtacatacatatttttaaaccattaaaattcttcctgaagaaa

SEQ ID NO: 356618 - DNA, 500 bp, Homo sapiens
acactgaacaactgcacgtcctgtgtgttatgcccagtgtcacctccatgtgttgtaacgccataggtccgtggggtgtcataaagaaacacagcagacttgcggaagcccagccttgagtctgcttctgtcatttactgaccatgccccttggacaagttatttagtctcccggagtctgtttgctcatctctaaagagagggtgatgacagtacctttttcccagggttacagagggattgaatgagatgatggatggcccagtgcctggaggacagtagcactttgtccttaatagggattttagcaataaagccagcatgaaatttatttttcatgcccttagatttgaaaatttatgacttagaatgtgtgtacttcttaggttaacctgcccttcgtcacctcatgaaaagtaagacagacttaggtggctgactttggagggttttttttgttatatttgctttcattatcgcgtcagtgtgggggatcctct

SEQ ID NO: 356619 - DNA, 216 bp, Homo sapiens
gcggccgcctactactactactgctcgaattcaagcttctaacgatgtacggggacatgtcctttccaactggaaagtcagacagaggcttcaggtacaactggccacagagatagtcctggaagacacgtggcgcctgtggaccggaagcaccaaatgctggtgctgcttttgtacatacatatttttaaaccattaaaattcttcctgaagaaa

SEQ ID NO: 356620 - DNA, 3229 bp, Homo sapiens
agcgggtctcctcggccgacaagctctcgcgagacgagccgtgcaggctgaaaaaatggcgccacccagtacccgggagcccagggtcctgtcggcgaccagcgcaaccaaatccgacggagagatggtgctgccaggcttcccggacgccgacagctttgtgaagtttgctcttgggtccgtggtggcagtcaccaaggcatctgggggcctaccacagtttggcgatgagtatgatttttaccgaagttttcctggcttccaagcattttgcgaaacacagggagacaggttgcttcagtgcatgagcagagtaatgcagtaccatgggtgtcgcagcaacattaaggatcgaagtaaagtgactgagctggaagacaagtttgatttactagttgatgccaatgatgtaattctggagagagtgggtattttactggatgaagcctcaggtgtaaacaagaatcaacagcctgtcctccctgccggcttgcaggtccccaaaacggtagtgtccagctggaaccgtaaggcagcagaatatggcaaaaaagcaaaatctgaaactttccggctgcttcatgcaaaaaatatcatccgacctcagctcaagtttcgagagaagattgacaattccaacacaccatttcttcctaaaatcttcatcaaacccaatgctcagaaacctctccctcaagctctctctaaggaaaggcgggaacgcccacaggatcgtcctgaggacttggacgtcccccctgcactggctgatttcatccatcagcagagaacccagcaggttgagcaagacatgtttgcacatccttatcaatatgaactaaatcactttaccccagcagatgcagtgcttcaaaagccacaaccccagttatacagacctatagaagagacaccatgccatttcatatcctccctggatgaactcgtggaactcaacgaaaagctcttgaattgtcaggaatttgcagttgacttggagcaccactcttacaggagcttcctgggactgacctgcctgatgcaaatttctactcggacggaagacttcatcattgacaccctcgagcttcgaagtgacatgtacattctcaatgagagcctcacagacccagccatcgttaaggtctttcatggtgctgattcagacatagaatggctacagaaagactttgggttgtatgtagtaaacatgtttgatactcatcaggcagcacgccttcttaacctgggcaggcactcactcgatcatctcctgaaactctactgcaacgtggactcaaacaagcaatatcagctggctgattggagaatacgccctctgcccgaggagatgctcagctacgcccgggatgacacccattacctgctatatatctatgacaaaatgaggctggagatgtgggagcgcggcaacgggcagcccgtgcagctgcaggtggtgtggcaacggagcagggacatctgcctcaagaaattcatcaaacctatcttcacggatgagtcctaccttgaactctataggaagcagaagaagcaccttaacacacagcagttgacagcctttcagctgctgtttgcctggagggataaaacagctcgcagggaagatgaaagttacggatatgtactgccaaaccacatgatgctgaaaatagctgaagaactgcctaaggaacctcagggcatcatagcttgctgcaacccagtaccgccccttgtgcggcagcagatcaacgaaatgcaccttttaatccagcaggcccgagagatgcccctgctcaagtctgaagttgcagccggagtgaagaagagcggaccgctgcccagtgctgagagattggagaatgttctctttggacctcacgactgctcccatgcccctccggatggctatccaatcatcccaaccagtggtaaagtcgagagccctcctgactgtcccgaagaggttgggacacagctaccttgtctaaaattctgtaggcttggccgggcgtggtggcttatgcctgtaatgccagcatattggaaggctgaggcgggtagatcacctgaggtcaggagtttgagaccagcctggccaacatggtgaaaccccatctctactaaaaatacaaaaattagctggcatggtggtgggcacctgtaatcttagctacttaggaggcagaggcaggagaatcacttgaaccgaggaggcggaggttgcagtgagccgagattgtgccattgtactccagcctaggggactacactaaaactccatctcaaaaagaaaaaataaacaaaattctgtaggctttgaccttactatcttctgctcctctaggatctgtgccagttcagaagcaggcgagcctcttccctgatgaaaaagaagataacttgctgggtaccacatgcctgattgccacagctgtcatcacgttatttaatgaacctagtgctgaagacagtaaaaagggtccattgacagttgcacagaaaaaagcccagaacatcatggagtcctttgaaaatccatttaggatgtttctgccctcactgggacaccgtgctcccgtctctcaggcagcgaagttcgatccatcaaccaaaatctatgaaatcagcaaccgttggaagctggcccaggtacaagtacaaaaagactctaaagaagctgtcaagaagaaggcagctgagcaaacagctgcccgggaacaggcaaaggaggcgtgcaaagctgcagcagaacaggccatctccgtccgacagcaggtcgtgctagaaaatgctgcaaagaagagagagcgagcaacaagcgacccaaggaccacagaacagaaacaagagaagaaacgactcaaaatttccaagaagccaaaggacccagagccaccagaaaaagagtttacgccttacgactacagccagtcagacttcaaggcttttgctggaaacagcaaatccaaagtttcttctcagtttgatccaaataaacagaccccgtctggcaagaaatgcattgcagccaaaaaaattaaacagtcggtgggaaacaaaagcatgtcctttccaactggaaagtcagacagaggcttcaggtacaactggccacagagatagtcctggaagacacgtggcgcctgtggaccggaagcaccaaatgctggtgctgcttttgtacatacatatttttaaaccattaaaattcttcctgaagaaa

SEQ ID NO: 356621 - DNA, 3013 bp, Homo sapiens
agcgggtctcctcggccgacaagctctcgcgagacgagccgtgcaggctgaaaaaatggcgccacccagtacccgggagcccagggtcctgtcggcgaccagcgcaaccaaatccgacggagagatggtgctgccaggcttcccggacgccgacagctttgtgaagtttgctcttgggtccgtggtggcagtcaccaaggcatctgggggcctaccacagtttggcgatgagtatgatttttaccgaagttttcctggcttccaagcattttgcgaaacacagggagacaggttgcttcagtgcatgagcagagtaatgcagtaccatgggtgtcgcagcaacattaaggatcgaagtaaagtgactgagctggaagacaagtttgatttactagttgatgccaatgatgtaattctggagagagtgggtattttactggatgaagcctcaggtgtaaacaagaatcaacagcctgtcctccctgccggcttgcaggtccccaaaacggtagtgtccagctggaaccgtaaggcagcagaatatggcaaaaaagcaaaatctgaaactttccggctgcttcatgcaaaaaatatcatccgacctcagctcaagtttcgagagaagattgacaattccaacacaccatttcttcctaaaatcttcatcaaacccaatgctcagaaacctctccctcaagctctctctaaggaaaggcgggaacgcccacaggatcgtcctgaggacttggacgtcccccctgcactggctgatttcatccatcagcagagaacccagcaggttgagcaagacatgtttgcacatccttatcaatatgaactaaatcactttaccccagcagatgcagtgcttcaaaagccacaaccccagttatacagacctatagaagagacaccatgccatttcatatcctccctggatgaactcgtggaactcaacgaaaagctcttgaattgtcaggaatttgcagttgacttggagcaccactcttacaggagcttcctgggactgacctgcctgatgcaaatttctactcggacggaagacttcatcattgacaccctcgagcttcgaagtgacatgtacattctcaatgagagcctcacagacccagccatcgttaaggtctttcatggtgctgattcagacatagaatggctacagaaagactttgggttgtatgtagtaaacatgtttgatactcatcaggcagcacgccttcttaacctgggcaggcactcactcgatcatctcctgaaactctactgcaacgtggactcaaacaagcaatatcagctggctgattggagaatacgccctctgcccgaggagatgctcagctacgcccgggatgacacccattacctgctatatatctatgacaaaatgaggctggagatgtgggagcgcggcaacgggcagcccgtgcagctgcaggtggtgtggcaacggagcagggacatctgcctcaagaaattcatcaaacctatcttcacggatgagtcctaccttgaactctataggaagcagaagaagcaccttaacacacagcagttgacagcctttcagctgctgtttgcctggagggataaaacagctcgcagggaagatgaaagttacgggtaagggattagaggttcttttaatacttgtttccagactgaggagatctaataacaagtaaataatgggcttttttcttttgctatgaaagctggttatttcccctatgtgacagcatctaatggaacttactggctgaatgtaatgtgtccccactgtgtgtgtgtgtgtgtgtgtgtgtgtgtgtgtttttttccagatatgtactgccaaaccacatgatgctgaaaatagctgaagaactgcctaaggaacctcagggcatcatagcttgctgcaacccagtaccgccccttgtgcggcagcagatcaacgaaatgcaccttttaatccagcaggcccgagagatgcccctgctcaagtctgaagttgcagccggagtgaagaagagcggaccgctgcccagtgctgagagattggagaatgttctctttggacctcacgactgctcccatgcccctccggatggctatccaatcatcccaaccagtggatctgtgccagttcagaagcaggcgagcctcttccctgatgaaaaagaagataacttgctgggtaccacatgcctgattgccacagctgtcatcacgttatttaatgaacctagtgctgaagacagtaaaaagggtccattgacagttgcacagaaaaaagcccagaacatcatggagtcctttgaaaatccatttaggatgtttctgccctcactgggacaccgtgctcccgtctctcaggcagcgaagttcgatccatcaaccaaaatctatgaaatcagcaaccgttggaagctggcccaggtacaagtacaaaaagactctaaagaagctgtcaagaagaaggcagctgagcaaacagctgcccgggaacaggcaaaggaggcgtgcaaagctgcagcagaacaggccatctccgtccgacagcaggtcgtgctagaaaatgctgcaaagaagagagagcgagcaacaagcgacccaaggaccacagaacagaaacaagagaagaaacgactcaaaatttccaagaagccaaaggacccagagccaccagaaaaagagtttacgccttacgactacagccagtcagacttcaaggcttttgctggaaacagcaaatccaaagtttcttctcagtttgatccaaataaacagaccccgtctggcaagaaatgcattgcagccaaaaaaattaaacagtcggtgggaaacaaaagcatgtcctttccaactggaaagtcagacagaggcttcaggtacaactggccacagagatagtcctggaagacacgtggcgcctgtggaccggaagcaccaaatgctggtgctgcttttgtacatacatatttttaaaccattaaaattcttcctgaagaaa

SEQ ID NO: 356622 - DNA, 2889 bp, Homo sapiens
  misc_feature (2824)..(2824): n is a, c, g, or t
  misc_feature (2850)..(2850): n is a, c, g, or t
  misc_feature (2853)..(2853): n is a, c, g, or t
agcgggtctcctcggccgacaagctctcgcgagacgagccgtgcaggctgaaaaaatggcgccacccagtacccgggagcccagggtcctgtcggcgaccagcgcaaccaaatccgacggagagatggtgctgccaggcttcccggacgccgacagctttgtgaagtttgctcttgggtccgtggtggcagtcaccaaggcatctgggggcctaccacagtttggcgatgagtatgatttttaccgaagttttcctggcttccaagcattttgcgaaacacagggagacaggttgcttcagtgcatgagcagagtaatgcagtaccatgggtgtcgcagcaacattaaggatcgaagtaaagtgactgagctggaagacaagtttgatttactagttgatgccaatgatgtaattctggagagagtgggtattttactggatgaagcctcaggtgtaaacaagaatcaacagcctgtcctccctgccggcttgcaggtccccaaaacggtagtgtccagctggaaccgtaaggcagcagaatatggcaaaaaagcaaaatctgaaactttccggctgcttcatgcaaaaaatatcatccgacctcagctcaagtttcgagagaagattgacaattccaacacaccatttcttcctaaaatcttcatcaaacccaatgctcagaaacctctccctcaagctctctctaaggaaaggcgggaacgcccacaggatcgtcctgaggacttggacgtcccccctgcactggctgatttcatccatcagcagagaacccagcaggttgagcaagacatgtttgcacatccttatcaatatgaactaaatcactttaccccagcagatgcagtgcttcaaaagccacaaccccagttatacagacctatagaagagacaccatgccatttcatatcctccctggatgaactcgtggaactcaacgaaaagctcttgaattgtcaggaatttgcagttgacttggagcaccactcttacaggagcttcctgggactgacctgcctgatgcaaatttctactcggacggaagacttcatcattgacaccctcgagcttcgaagtgacatgtacattctcaatgagagcctcacagacccagccatcgttaaggtctttcatggtgctgattcagacatagaatggctacagaaagactttgggttgtatgtagtaaacatgtttgatactcatcaggcagcacgccttcttaacctgggcaggcactcactcgatcatctcctgaaactctactgcaacgtggactcaaacaagcaatatcagctggctgattggagaatacgccctctgcccgaggagatgctcagctacgcccgggatgacacccattacctgctatatatctatgacaaaatgaggctggagatgtgggagcgcggcaacgggcagcccgtgcagctgcaggtggtgtggcaacggagcagggacatctgcctcaagaaattcatcaaacctatcttcacggatgagtcctaccttgaactctataggaagcagaagaagcaccttaacacacagcagttgacagcctttcagctgctgtttgcctggagggataaaacagctcgcagggaagatgaaagttacggatatgtactgccaaaccacatgatgctgaaaatagctgaagaactgcctaaggaacctcagggcatcatagcttgctgcaacccagtaccgccccttgtgcggcagcagatcaacgaaatgcaccttttaatccagcaggcccgagagatgcccctgctcaagtctgaagttgcagccggagtgaagaagagcggaccgctgcccagtgctgagagattggagaatgttctctttggacctcacgactgctcccatgcccctccggatggctatccaatcatcccaaccagtggatctgtgccagttcagaagcaggcgagcctcttccctgatgaaaaagaagataacttgctgggtaccacatgcctgattgccacagctgtcatcacgttatttaatgaacctagtgctgaagacagtaaaaagggtccattgacagttgcacagaaaaaagcccagaacatcatggagtcctttgaaaatccatttaggatgtttctgccctcactgggacaccgtgctcccgtctctcaggcagcgaagttcgatccatcaaccaaaatctatgaaatcagcaaccgttggaagctggcccaggtacaagtacaaaaagactctaaagaagctgtcaagaagaaggcagctgagcaaacagctgcccgggaacaggcaaaggaggcgtgcaaagctgcagcagaacaggccatctccgtccgacagcaggtcgtgctagaaaatgctgcaaagaagagagagcgagcaacaagcgacccaaggaccacagaacagaaacaagagaagaaacgactcaaaatttccaagaagccaaaggacccagagccaccagaaaaagagtttacgccttacgactacagccagtcagacttcaaggcttttgctggaaacagcaaatccaaagtttcttctcagtttgatccaaataaacagaccccgtctggcaagaaatgcattgcagccaaaaaaattaaacagtcggtgggaaacaaaagcatgtcctttccaactggaaagtcagacagaggcttcaggtacaactggccacagagatagtcctggaagacacgtggcgcctgtggaccggaagcaccaaatgctggtgctgcttttgtacatacatatttttaaaccattaaaattcttcctgaagaaaaaaaaaaaaanaaaaaaaaaaaaaaaaaaaaaaaaanaanaaacaaaaaaaaaaaaaaaaaaaagaaaaaaaaaaa

SEQ ID NO: 356623 - DNA, 2728 bp, Homo sapiens
agcgggtctcctcggccgacaagctctcgcgagacgagccgtgcaggctgaaaaaatggcgccacccagtacccgggagcccagggtcctgtcggcgaccagcgcaaccaaatccgacggagagatggtgctgccaggcttcccggacgccgacagctttgtgaagtttgctcttgggtccgtggtggcagtcaccaaggcatctgggggcctaccacagtttggcgatgagtatgatttttaccgaagttttcctggcttccaagcattttgcgaaacacagggagacaggttgcttcagtgcatgagcagagtaatgcagtaccatgggtgtcgcagcaacattaaggatcgaagtaaagtgactgagctggaagacaagtttgatttactagttgatgccaatgatgtaattctggagagagtgggtattttactggatgaagcctcaggtgtaaacaagaatcaacagcctgtcctccctgccggcttgcaggtccccaaaacggtagtgtccagctggaaccgtaaggcagcagaatatggcaaaaaagcaaaatctgaaactttccggctgcttcatgcaaaaaatatcatccgacctcagctcaagtttcgagagaagattgacaattccaacacaccatttcttcctaaaatcttcatcaaacccaatgctcagaaacctctccctcaagctctctctaaggaaaggcgggaacgcccacaggatcgtcctgaggacttggacgtcccccctgcactggctgatttcatccatcagcagagaacccagcaggttgagcaagacatgtttgcacatccttatcaatatgaactaaatcactttaccccagcagatgcagtgcttcaaaagccacaaccccagttatacagacctatagaagagacaccatgccatttcatatcctccctggatgaactcgtggaactcaacgaaaagctcttgaattgtcaggaatttgcagttgacttggagcaccactcttacaggagcttcctgggactgacctgcctgatgcaaatttctactcggacggaagacttcatcattgacaccctcgagcttcgaagtgacatgtacattctcaatgagagcctcacagacccagccatcgttaaggtctttcatggtgctgattcagacatagaatggctacagaaagactttgggttgtatgtagtaaacatgtttgatactcatcaggcagcacgccttcttaacctgggcaggcactcactcgatcatctcctgaaactctactgcaacgtggactcaaacaagcaatatcagctggctgattggagaatacgccctctgcccgaggagatgctcagctacgcccgggatgacacccattacctgctatatatctatgacaaaatgaggctggagatgtgggagcgcggcaacgggcagcccgtgcagctgcaggtggtgtggcaacggagcagggacatctgcctcaagaaattcatcaaacctatcttcacggatgagtcctaccttgaactctataggaagcagaagaagcaccttaacacacagcagttgacagcctttcagctgctgtttgcctggagggataaaacagctcgcagggaagatgaaagttacggatatgtactgccaaaccacatgatgctgaaaatagctgaagaactgcctaaggaacctcagggcatcatagcttgctgcaacccagtaccgccccttgtgcggcagcagatcaacgaaatgcaccttttaatccagcaggcccgagagatgcccctgctcaagtctgaagttgcagccggagtgaagaagagcggaccgctgcccagtgctgagagattggagaatgttctctttggacctcacgactgctcccatgcccctccggatggctatccaatcatcccaaccagtggatctgtgccagttcagaagcaggcgagcctcttccctgatgaaaaagaagataacttgctgggtaccacatgcctgattgccacagctgtcatcacgttatttaatgaacctagtgctgaagacagtaaaaagggtccattgacagttgcacagaaaaaagcccagaacatcatggagtcctttgaaaatccatttaggatgtttctgccctcactgggacaccgtgctcccgtctctcaggcagcgaagttcgatccatcaaccaaaatctatgaactgcccgggaacaggcaaaggaggcgtgcaaagctgcagcagaacaggccatctccgtccgacagcaggtcgtgctagaaaatgctgcaaagaagagagagcgagcaacaagcgacccaaggaccacagaacagaaacaagagaagaaacgactcaaaatttccaagaagccaaaggacccagagccaccagaaaaagagtttacgccttacgactacagccagtcagacttcaaggcttttgctggaaacagcaaatccaaagtttcttctcagtttgatccaaataaacagaccccgtctggcaagaaatgcattgcagccaaaaaaattaaacagtcggtgggaaacaaaagcatgtcctttccaactggaaagtcagacagaggcttcaggtacaactggccacagagatagtcctggaagacacgtggcgcctgtggaccggaagcaccaaatgctggtgctgcttttgtacatacatatttttaaaccattaaaattcttcctgaagaaa

SEQ ID NO: 356624 - DNA, 2481 bp, Homo sapiens
agcgggtctcctcggccgacaagctctcgcgagacgagccgtgcaggctgaaaaaatggcgccacccagtacccgggagcccagggtcctgtcggcgaccagcgcaaccaaatccgacggagagatggtgctgccaggcttcccggacgccgacagctttgtgaagtttgctcttgggtccgtggtggcagtcaccaaggcatctgggggcctaccacagtttggcgatgagtatgatttttaccgaagttttcctggcttccaagcattttgcgaaacacagggagacaggttgcttcagtgcatgagcagagtaatgcagtaccatgggtgtcgcagcaacattaaggatcgaagtaaagtgactgagctggaagacaagtttgatttactagttgatgccaatgatgtaattctggagagagtgggtattttactggatgaagcctcaggtgtaaacaagaatcaacagcctgtcctccctgccggcttgcaggtccccaaaacggtagtgtccagctggaaccgtaaggcagcagaatatggcaaaaaagcaaaatctgaaactttccggctgcttcatgcaaaaaatatcatccgacctcagctcaagtttcgagagaagattgacaattccaacacaccatttcttcctaaaatcttcatcaaacccaatgctcagaaacctctccctcaagctctctctaaggaaaggcgggaacgcccacaggatcgtcctgaggacttggacgtcccccctgcactggctgatttcatccatcagcagagaacccagcaggttgagcaagacatgtttgcacatccttatcaatatgaactaaatcactttaccccagcagatgcagtgcttcaaaagccacaaccccagttatacagacctatagaagagacaccatgccatttcatatcctccctggatgaactcgtggaactcaacgaaaagctcttgaattgtcaggaatttgcagttgacttggagcaccactcttacaggagcttcctgggactgacctgcctgatgcaaatttctactcggacggaagacttcatcattgacaccctcgagcttcgaagtgacatgtacattctcaatgagagcctcacagacccagccatcgttaaggtctttcatggtgctgattcagacatagaatggctacagaaagactttgggttgtatgtagtaaacatgtttgatactcatcaggcagcacgccttcttaacctgggcaggcactcactcgatcatctcctgaaactctactgcaacgtggactcaaacaagcaatatcagctggctgattggagaatacgccctctgcccgaggagatgctcagctacgcccgggatgacacccattacctgctatatatctatgacaaaatgaggctggagatgtgggagcgcggcaacgggcagcccgtgcagctgcaggtggtgtggcaacggagcagggacatctgcctcaagaaattcatcaaacctatcttcacggatgagtcctaccttgaactctataggaagcagaagaagcaccttaacacacagcagttgacagcctttcagctgctgtttgcctggagggataaaacagctcgcagggaagatgaaagttacggatatgtactgccaaaccacatgatgctgaaaatagctgaagaactgcctaaggaacctcagggcatcatagcttgctgcaacccagtaccgccccttgtgcggcagcagatcaacgaaatgcaccttttaatccagcaggcccgagagatgcccctgctcaagtctgaagttgcagccggagtgaagaagagcggaccgctgcccagtgctgagagattggagaatgttctctttggacctcacgactgctcccatgcccctccggatggctatccaatcatcccaaccagtggatctgtgccagttcagaagcaggcgagcctcttccctgatgaaaaagaagataacttgctgggtaccacatgcctgattgccacagctgtcatcacgttatttaatgaacctagtgctgaagacagtaaaaagggtccattgacagttgcacagaaaaaagcccagaacatcatggagtcctttgaaaatccatttaggatgtttctgccctcactgggacaccgtgctcccgtctctcaggcagcgaagttcgatccatcaaccaaaatctatgaaatcagcaaccgttggaagctggcccaggtacaagtacaaaaagactctaaagaagctgtcaagaagaaggcagctgagcaaacagctgcccggacagcagggctgaacgtgagaaacggccactcgcgacaggtggcacaaatgtgagaggaagcgacagggccggccgaagaacagagaggtcatcagagaggcgggcgaaaatgcttacgcacccggtgggcacactcttccaacggcggtgaaagcggggccggaggcaacgcggg

SEQ ID NO: 356625 - DNA, 2880 bp, Homo sapiens
agcgggtctcctcggccgacaagctctcgcgagacgagccgtgcaggctgaaaaaatggcgccacccagtacccgggagcccagggtcctgtcggcgaccagcgcaaccaaatccgacggagagatggtgctgccaggcttcccggacgccgacagctttgtgaagtttgctcttgggtccgtggtggcagtcaccaaggcatctgggggcctaccacagtttggcgatgagtatgatttttaccgaagttttcctggcttccaagcattttgcgaaacacagggagacaggttgcttcagtgcatgagcagagtaatgcagtaccatgggtgtcgcagcaacattaaggatcgaagtaaagtgactgagctggaagacaagtttgatttactagttgatgccaatgatgtaattctggagagagtgggtattttactggatgaagcctcaggtgtaaacaagaatcaacagcctgtcctccctgccggcttgcaggtccccaaaacggtagtgtccagctggaaccgtaaggcagcagaatatggcaaaaaagcaaaatctgaaactttccggctgcttcatgcaaaaaatatcatccgacctcagctcaagtttcgagagaagattgacaattccaacacaccatttcttcctaaaatcttcatcaaacccaatgctcagaaacctctccctcaagctctctctaaggaaaggcgggaacgcccacaggatcgtcctgaggacttggacgtcccccctgcactggctgatttcatccatcagcagagaacccagcaggttgagcaagacatgtttgcacatccttatcaatatgaactaaatcactttaccccagcagatgcagtgcttcaaaagccacaaccccagttatacagacctatagaagagacaccatgccatttcatatcctccctggatgaactcgtggaactcaacgaaaagctcttgaattgtcaggaatttgcagttgacttggagcaccactcttacaggagcttcctgggactgacctgcctgatgcaaatttctactcggacggaagacttcatcattgacaccctcgagcttcgaagtgacatgtacattctcaatgagagcctcacagacccagccatcgttaaggtctttcatggtgctgattcagacatagaatggctacagaaagactttgggttgtatgtagtaaacatgtttgatactcatcaggcagcacgccttcttaacctgggcaggcactcactcgatcatctcctgaaactctactgcaacgtggactcaaacaagcaatatcagctggctgattggagaatacgccctctgcccgaggagatgctcagctacgcccgggatgacacccattacctgctatatatctatgacaaaatgaggctggagatgtgggagcgcggcaacgggcagcccgtgcagctgcaggtggtgtggcaacggagcagggacatctgcctcaagaaattcatcaaacctatcttcacggatgagtcctaccttgaactctataggaagcagaagaagcaccttaacacacagcagttgacagcctttcagctgctgtttgcctggagggataaaacagctcgcagggaagatgaaagttacggatatgtactgccaaaccacatgatgctgaaaatagctgaagaactgcctaaggaacctcagggcatcatagcttgctgcaacccagtaccgccccttgtgcggcagcagatcaacgaaatgcaccttttaatccagcaggcccgagagatgcccctgctcaagtctgaagttgcagccggagtgaagaagagcggaccgctgcccagtgctgagagattggagaatgttctctttggacctcacgactgctcccatgcccctccggatggctatccaatcatcccaaccagtggatctgtgccagttcagaagcaggcgagcctcttccctgatgaaaaagaagataacttgctgggtaccacatgcctgattgccacagctgtcatcacgttatttaatgaacctagtgctgaagacagtaaaaagggtccattgacagttgcacagaaaaaagcccagaacatcatggagtcctttgaaaatccatttaggatgtttctgccctcactgggacaccgtgctcccgtctctcaggcagcgaagttcgatccatcaaccaaaatctatgaaatcagcaaccgttggaagctggcccaggtacaagtacaaaaagactctaaagaagctgtcaagaagaaggcagctgagcaaacaggtaacactcacttccttgcaactcagtcggctgttaaagaatggctgttgcacacccgctgtttcagccaagtgccagatacggcgatgaatgaagcccctgtggggcttcccttctgctgagggatggtgggcaatcagtatctatcctggcagatggcagcaggtgctgtgcagagagattggtggggagtgctggaggtgctgtagctgtctcggtggttggagaaggcagtctaatgaatgcgacattgacgagacctgcagtgacctagagaagagttctggagccacagcacagcgagcccagaggccctggggctagttcactgggcatgctgagcagcagcaagtgggcctgcatgagcagaggcgggtagagaagagcaggagatggggaaggagccagcagaggcccacgggatgacgctgccttttactctgagttcagaagccaggagggtgctgagcagacaggggggaagtgactgacatgtggcactctggctgctgtgtcaacagtagactatagaggacaggatgggagtccaggaagggataggagacatggcagtggctcaggc

SEQ ID NO: 356626 - DNA, 1550 bp, Homo sapiens
gagtcaaagcaagtaatatcacgcttggatgcttggggtaatacagccctgctggtccgacgagaatggctcacgctagcgcacgggatgaggatccgaatgcacgcgtggcgtactatatcgatgggacatgacatgagggctgcgagatcgtgggagcgcggaaaagggcacggcgtgtgcgaggtgcacgttggtgtggcgacgggggcaggagatctgcctcaagaaattcatcaaacctatcttcacggatgagtcctaccttgaactctataggaagcagaagaagcaccttaacacacagcagttgacagcctttcagctgctgtttgcctggagggataaaacagctcgcagggaagatgaaagttacggatatgtactgccaaaccacatgatgctgaaaatagctgaagaactgcctaaggaacctcagggcatcatagcttgctgcaacccagtaccgccccttgtgcggcagcagatcaacgaaatgcaccttttaatccagcaggcccgagagatgcccctgctcaagtctgaagttgcagccggagtgaagaagagcggaccgctgcccagtgctgagagattggagaatgttctctttggacctcacgactgctcccatgcccctccggatggctatccaatcatcccaaccagtggatctgtgccagttcagaagcaggcgagcctcttccctgatgaaaaagaagataacttgctgggtaccacatgcctgattgccacagctgtcatcacgttatttaatgaacctagtgctgaagacagtaaaaagggtccattgacagttgcacagaaaaaagcccagaacatcatggagtcctttgaaaatccatttaggatgtttctgccctcactgggacaccgtgctcccgtctctcaggcagcgaagttcgatccatcaaccaaaatctatgaaatcagcaaccgttggaagctggcccaggtacaagtacaaaaagactctaaagaagctgtcaagaagaaggcagctgagcaaacagctgcccgggaacaggcaaaggaggcgtgcaaagctgcagcagaacaggccatctccgtccgacagcaggtcgtgctagaaaatgctgcaaagaagagagagcgagcaacaagcgacccaaggaccacagaacagaaacaagagaagaaacgactcaaaatttccaagaagccaaaggacccagagccaccagaaaaagagtttacgccttacgactacagccagtcagacttcaaggcttttgctggaaacagcaaatccaaagtttcttctcagtttgatccaaataaacagaccccgtctggcaagaaatgcattgcagccaaaaaaattaaacagtcggtgggaaacaaaagcatgtcctttccaactggaaagtcagacagaggcttcaggtacaactggccacagagatagtcctggaagacacgtggcgcctgtggaccggaagcaccaaatgctggtgctgcttttgtacatacatatttttaaaccattaaaattcttcctgaagaaa

SEQ ID NO: 356627 - DNA, 1073 bp, Homo sapiens
tgtggagtaaaatttatccatttaaagtccatgtatgtctcgatgagatgccccgtacttcgggtctgaagttgcagccggagtgaagaagagcggaccgctgcccagtgctgagagattggagaatgttctctttggacctcacgactgctcccatgcccctccggatggctatccaatcatcccaaccagtggatctgtgccagttcagaagcaggcgagcctcttccctgatgaaaaagaagataacttgctgggtaccacatgcctgattgccacagctgtcatcacgttatttaatgaacctagtgctgaagacagtaaaaagggtccattgacagttgcacagaaaaaagcccagaacatcatggagtcctttgaaaatccatttaggatgtttctgccctcactgggacaccgtgctcccgtctctcaggcagcgaagttcgatccatcaaccaaaatctatgaaatcagcaaccgttggaagctggcccaggtacaagtacaaaaagactctaaagaagctgtcaagaagaaggcagctgagcaaacagctgcccgggaacaggcaaaggaggcgtgcaaagctgcagcagaacaggccatctccgtccgacagcaggtcgtgctagaaaatgctgcaaagaagagagagcgagcaacaagcgacccaaggaccacagaacagaaacaagagaagaaacgactcaaaatttccaagaagccaaaggacccagagccaccagaaaaagagtttacgccttacgactacagccagtcagacttcaaggcttttgctggaaacagcaaatccaaagtttcttctcagtttgatccaaataaacagaccccgtctggcaagaaatgcattgcagccaaaaaaattaaacagtcggtgggaaacaaaagcatgtcctttccaactggaaagtcagacagaggcttcaggtacaactggccacagagatagtcctggaagacacgtggcgcctgtggaccggaagcaccaaatgctggtgctgcttttgtacatacatatttttaaaccattaaaattcttcctgaagaaa

SEQ ID NO: 356628 - DNA, 2416 bp, Homo sapiens
agcgggtctcctcggccgacaagctctcgcgagacgagccgtgcaggctgaaaaaatggcgccacccagtacccgggagcccagggtcctgtcggcgaccagcgcaaccaaatccgacggagagatggtgctgccaggcttcccggacgccgacagctttgtgaagtttgctcttgggtccgtggtggcagtcaccaaggcatctgggggcctaccacagtttggcgatgagtatgatttttaccgaagttttcctggcttccaagcattttgcgaaacacagggagacaggttgcttcagtgcatgagcagagtaatgcagtaccatgggtgtcgcagcaacattaaggatcgaagtaaagtgactgagctggaagacaagtttgatttactagttgatgccaatgatgtaattctggagagagtgggtattttactggatgaagcctcaggtgtaaacaagaatcaacagcctgtcctccctgccggcttgcaggtccccaaaacggtagtgtccagctggaaccgtaaggcagcagaatatggcaaaaaagcaaaatctgaaactttccggctgcttcatgcaaaaaatatcatccgacctcagctcaagtttcgagagaagattgacaattccaacacaccatttcttcctaaaatcttcatcaaacccaatgctcagaaacctctccctcaagctctctctaaggaaaggcgggaacgcccacaggatcgtcctgaggacttggacgtcccccctgcactggctgatttcatccatcagcagagaacccagcaggttgagcaagacatgtttgcacatccttatcaatatgaactaaatcactttaccccagcagatgcagtgcttcaaaagccacaaccccagttatacagacctatagaagagacaccatgccatttcatatcctccctggatgaactcgtggaactcaacgaaaagctcttgaattgtcaggaatttgcagttgacttggagcaccactcttacaggagcttcctgggactgacctgcctgatgcaaatttctactcggacggaagacttcatcattgacaccctcgagcttcgaagtgacatgtacattctcaatgagagcctcacagacccagccatcgttaaggtctttcatggtgctgattcagacatagaatggctacagaaagactttgggttgtatgtagtaaacatgtttgatactcatcaggcagcacgccttcttaacctgggcaggcactcactcgatcatctcctgaaactctactgcaacgtggactcaaacaagcaatatcagctggctgattggagaatacgccctctgcccgaggagatgctcagctacgcccgggatgacacccattacctgctatatatctatgacaaaatgaggctggagatgtgggagcgcggcaacgggcagcccgtgcagctgcaggtggtgtggcaacggagcagggacatctgcctcaagaaattcatcaaacctatcttcacggatgagtcctaccttgaactctataggaagcagaagaagcaccttaacacacagcagttgacagcctttcagctgctgtttgcctggagggataaaacagctcgcagggaagatgaaagttacgggtaagggattagaggttcttttaatacttgtttccagactgaggagatctaataacaagtaaataatgggcttttttcttttgctatgaaagctggttatttcccctatgtgacagcatctaatggaacttactggctgaatgtaatgtgtccccactgtgtgtgtgtgtgtgtgtgtgtgtgtgtgtgtttttttccagatatgtactgccaaaccacatgatgctgaaaatagctgaagaactgcctaagtgagtttcaaatctgattaatatgttctgactttctcagtagatctgatgttcttcaaaatcaagcttttctggttgctattacccaaggctgcttactcagagattaatgctccaagcttggaaggtagcaagttgaaggaatatagaatttctgccctcaggctgccatttaagcactaaaacttctgaactggaatcatttcaatgattatgccttagtttgagtttattttaagtctctgagccttatagcatctacttgcaagggaagaaaatgtcccagattctcatctgtactttcttccaaattaaagcagctcatgatcttaaacgttttgtgatcttgattgaagtataagcaagaatgaaaatccaccacgcccggccaagataaagtcagtttttccattgattatgcatgtttcttttaatttggatctcctaaatgtaaggtagaaggtttaggttcaatcttgatatcttttcattatttttcagctcacttgcaaatgtcgctggta

SEQ ID NO: 356629 - DNA, 653 bp, Homo sapiens
tgggtggctgctctagagcgatccctttgatccatcagccaaaatctataaaatcagcaaccgttggaagctggcccaggtacaagtacaaaaagactctaaagaagctgtcaagaagaaggcagctgagcaaacagctgcccgggaacaggcaaaggaggcgtgcaaagctgcagcagaacaggccatctccgtccgacagcaggtcgtgctagaaaatgctgcaaagaagagagagcgagcaacaagcgacccaaggaccacagaacagaaacaagagaagaaacgactcaaaatttccaagaagccaaaggacccagagccaccagaaaaagagtttacgccttacgactacagccagtcagacttcaaggcttttgctggaaacagcaaatccaaagtttcttctcagtttgatccaaataaacagaccccgtctggcaagaaatgcattgcagccaaaaaaattaaacagtcggtgggaaacaaaagcatgtcctttccaactggaaagtcagacagaggcttcaggtacaactggccacagagatagtcctggaagacacgtggcgcctgtggaccggaagcaccaaatgctggtgctgcttttgtacatacatatttttaaaccattaaaattcttcctgaagaaa

SEQ ID NO: 356630 - DNA, 1078 bp, Homo sapiens
acactgaacaactgcacgtcctgtgtgttatgcccagtgtcacctccatgtgttgtaacgccataggtccgtggggtgtcataaagaaacacagcagacttgcggaagcccagccttgagtctgcttctgtcatttactgaccatgccccttggacaagttatttagtctcccggagtctgtttgctcatctctaaagagagggtgatgacagtacctttttcccagggttacagagggattgaatgagatgatggatggcccagtgcctggaggacagtagcactttgtccttaatagggattttagcaataaagccagcatgaaatttatttttcatgcccttagatttgaaaatttatgacttagaatgtgtgtacttcttaggttaacctgcccttcgtcacctcatgaaaagtaagacagacttaggtggctgactttggagggttttttttgttatatttgctttcattatatcagcaaccgttggaagctggcccaggtacaagtacaaaaagactctaaagaagctgtcaagaagaaggcagctgagcaaacagctgcccgggaacaggcaaaggaggcgtgcaaagctgcagcagaacaggccatctccgtccgacagcaggtcgtgctagaaaatgctgcaaagaagagagagcgagcaacaagcgacccaaggaccacagaacagaaacaagagaagaaacgactcaaaatttccaagaagccaaaggacccagagccaccagaaaaagagtttacgccttacgactacagccagtcagacttcaaggcttttgctggaaacagcaaatccaaagtttcttctcagtttgatccaaataaacagaccccgtctggcaagaaatgcattgcagccaaaaaaattaaacagtcggtgggaaacaaaagcatgtcctttccaactggaaagtcagacagaggcttcaggtacaactggccacagagatagtcctggaagacacgtggcgcctgtggaccggaagcaccaaatgctggtgctgcttttgtacatacatatttttaaaccattaaaattcttcctgaagaaa

SEQ ID NO: 356631 - DNA, 1068 bp, Homo sapiens
agcgggtctcctcggccgacaagctctcgcgagacgagccgtgcaggctgaaaaaatggcgccacccagtacccgggagcccagggtcctgtcggcgaccagcgcaaccaaatccgacggagagatggtgctgccaggcttcccggacgccgacagctttgtgaagtttgctcttgggtccgtggtggcagtcaccaaggcatctgggggcctaccacagtttggcgatgagtatgatttttaccgaagttttcctggcttccaagcattttgcgaaacacagggagacaggttgcttcagtgcatgagcagagtaatgcagtaccatgggtgtcgcagcaacattaaggatcgaagtaaagtgactgagctggaagacaagtttgatttactagttgatgccaatgatgtaattctggagagagtgggtattttactggatgaagcctcaggtgtaaacaagaatcaacagcctgtcctccctgccggcttgcaggtccccaaaacggtagtgtccagctggaaccgtaaggcagcagaatatggcaaaaaagcaaaatctgaaactttccggctgcttcatgcaaaaaatatcatccgacctcagctcaagtttcgagagaagattgacaattccaacacaccattcataatgtattgatatgacgttggagagctggggcttaggatctaagccgatgaggaagaggtgggctgaggagcctgtaggtgtgtgatgagaactgaaacaatttccctccacacagctggctttctacattgacatcattttactattgcgctgtcttcattaacatgactttactattccaggaaactctttcccagaaagatatatgttacaaataccttgtggttcatttcaggaatttcccaaactcatttaaatgaatatcaaatggttaaacttttcagtagaaagtgtgaaacaacagtttgctccccagaatcttttgaaccctttgcctcaaaatccccacctcactgtgtactccaatcctaaactcatatcaagatcattatcaacccaatcagccctccgtgaat

SEQ ID NO: 356632 - DNA, 531 bp, Homo sapiens
tgaggaagtaatggggccccatacagggacatctgtgcgcgtcagctgagagaaatgggcctggttttcagactgcccacagggaccaggatcgctatgtattcatttatgtgagccatgagccctagcccctcatcgtgacaggggtgctctcacagccaaggcttccctgagtgtcatggtcccggcctcgctgtgagcctgtgatgtgtggtaactcattgacctgaccgcaggtctctctcatctcttacctttcaggaaacagcaaatccaaagtttcttctcagtttgatccaaataaacagaccccgtctggcaagaaatgcattgcagccaaaaaaattaaacagtcggtgggaaacaaaagcatgtcctttccaactggaaagtcagacagaggcttcaggtacaactggccacagagatagtcctggaagacacgtggcgcctgtggaccggaagcaccaaatgctggtgctgcttttgtacatacatatttttaaaccattaaaattcttcctgaagaaa

SEQ ID NO: 356633 - DNA, 287 bp, Homo sapiens
ccggactgaagaactgaaccgggaggtcgctggccacacggagcagctccagatgagcaggtccgaggttactgacctgcggcgcacccttcagggtcttgagattgagctgcagtcacagctgagcatgtcctttccaactggaaagtcagacagaggcttcaggtacaactggccacagagatagtcctggaagacacgtggcgcctgtggaccggaagcaccaaatgctggtgctgcttttgtacatacatatttttaaaccattaaaattcttcctgaagaaa

SEQ ID NO: 356634 - DNA, 328 bp, Homo sapiens
gaagttggcctaggctggcctgacatcagtgtttccttagtcacctacctgtagcttcagcttaggtggcagcctggctttacccagtcattattcttatctggaagcctttaagggctgcgtttctgagtgacaagttgagtgtgttcttacttgtcttcagggaacctcagggcatcatagcttgctgcaacccagtaccgccccttgtgcggcagcagatcaacgaaatgcaccttttaatccagcaggcccgagagatgcccctgctcaaggtaagaagcttttctgcggctgggcacagtggctcacgcctataatctcagca

SEQ ID NO: 356635 - DNA, 729 bp, Homo sapiens
taatttcagtgttctaataaactagaggcagagttaatttctgagcatgagtggcctgctaccagtgtactgcatgactttggttctgttttcaggtctttcatggtgctgattcagacatagaatggctacagaaagactttgggttgtatgtagtaaacatgtttgatactcatcaggcagcacgccttcttaacctgggcaggcactcactcgatcatctcctgaaactctactgcaacgtggactcaaacaagcaatatcagctggctgattggagaatacggtcagtttgctcttactgaggaaatgtgggtggcagaagaaagtgattattcattaacctgtcgtccagagagacctgggtttgagccctaccacgctcattgagatgaatggcatcaggcttttcgccaggcatcttcagcagcgtaaaagtggtaggaaattttttaatgctaaggtggactttatgatgggctgatgcagttacactgtgttccatggaaatagtggttgaaaaagaggtgccgcaccagtatttgcccatgctggtcttttgtttgaaactgggatctttctaccagatgattttgtgtgtgtgtaagatcttctgtagggatgattgtgtgtgtgtgtgtgtgtgcaagatgaccttccataggtgggaaagaattctaagggacactgttgtttagctttacactgagcgtttttttgtggcataag

SEQ ID NO: 356636 - DNA, 2813 bp, Homo sapiens
agcgggtctcctcggccgacaagctctcgcgagacgagccgtgcaggctgaaaaaatggcgccacccagtacccgggagcccagggtcctgtcggcgaccagcgcaaccaaatccgacggagagatggtgctgccaggcttcccggacgccgacagctttgtgaagtttgctcttgggtccgtggtggcagtcaccaaggcatctgggggcctaccacagtttggcgatgagtatgatttttaccgaagttttcctggcttccaagcattttgcgaaacacagggagacaggttgcttcagtgcatgagcagagtaatgcagtaccatgggtgtcgcagcaacattaaggatcgaagtaaagtgactgagctggaagacaagtttgatttactagttgatgccaatgatgtaattctggagagagtgggtattttactggatgaagcctcaggtgtaaacaagaatcaacagcctgtcctccctgccggcttgcaggtccccaaaacggtagtgtccagctggaaccgtaaggcagcagaatatggcaaaaaagcaaaatctgaaactttccggctgcttcatgcaaaaaatatcatccgacctcagctcaagtttcgagagaagattgacaattccaacacaccatttcttcctaaaatcttcatcaaacccaatgctcagaaacctctccctcaagctctctctaaggaaaggcgggaacgcccacaggatcgtcctgaggacttggacgtcccccctgcactggctgatttcatccatcagcagagaacccagcaggttgagcaagacatgtttgcacatccttatcaatatgaactaaatcactttaccccagcagatgcagtgcttcaaaagccacaaccccagttatacagacctatagaagagacaccatgccatttcatatcctccctggatgaactcgtggaactcaacgaaaagctcttgaattgtcaggaatttgcagttgacttggagcaccactcttacaggagcttcctgggactgacctgcctgatgcaaatttctactcggacggaagacttcatcattgacaccctcgagcttcgaagtgacatgtacattctcaatgagagcctcacagacccagccatcgttaaggtctttcatggtgctgattcagacatagaatggctacagaaagactttgggttgtatgtagtaaacatgtttgatactcatcaggcagcacgccttcttaacctgggcaggcactcactcgatcatctcctgaaactctactgcaacgtggactcaaacaagcaatatcagctggctgattggagaatacgccctctgcccgaggagatgctcagctacgcccgggatgacacccattacctgctatatatctatgacaaaatgaggctggagatgtgggagcgcggcaacgggcagcccgtgcagctgcaggtggtgtggcaacggagcagggacatctgcctcaagaaattcatcaaacctatcttcacggatgagtcctaccttgaactctataggaagcagaagaagcaccttaacacacagcagttgacagcctttcagctgctgtttgcctggagggataaaacagctcgcagggaagatgaaagttacggatatgtactgccaaaccacatgatgctgaaaatagctgaagaactgcctaaggaacctcagggcatcatagcttgctgcaacccagtaccgccccttgtgcggcagcagatcaacgaaatgcaccttttaatccagcaggcccgagagatgcccctgctcaagtctgaagttgcagccggagtgaagaagagcggaccgctgcccagtgctgagagattggagaatgttctctttggacctcacgactgctcccatgcccctccggatggctatccaatcatcccaaccagtggatctgtgccagttcagaagcaggcgagcctcttccctgatgaaaaagaagataacttgctgggtaccacatgcctgattgccacagctgtcatcacgttatttaatgaacctagtgctgaagacagtaaaaagggtccattgacagttgcacagaaaaaagcccagaacatcatggagtcctttgaaaatccatttaggatgtttctgccctcactgggacaccgtgctcccgtctctcaggcagcgaagttcgatccatcaaccaaaatctatgaaatcagcaaccgttggaagctggcccaggtacaagtacaaaaagactctaaagaagctgtcaagaagaaggcagctgagcaaacagctgcccgggaacaggcaaaggaggcgtgcaaagctgcagcagaacaggccatctccgtccgacagcaggtcgtgctagaaaatgctgcaaagaagagagagcgagcaacaagcgacccaaggaccacagaacagaaacaagagaagaaacgactcaaaatttccaagaagccaaaggacccagagccaccagaaaaagagtttacgccttacgactacagccagtcagacttcaaggcttttgctggaaacagcaaatccaaagtttcttctcagtttgatccaaataaacagaccccgtctggcaagaaatgcattgcagccaaaaaaattaaacagtcggtgggaaacaaaagcatgtcctttccaactggaaagtcagacagaggcttcaggtacaactggccacagagatagtcctggaagacacgtggcgcctgtggaccggaagcaccaaatgctggtgctgcttttgtacatacatatttttaaaccattaaaattcttcctgaagaaa

SEQ ID NO: 356637 - DNA, 2848 bp, Homo sapiens
agcgggtctcctcggccgacaagctctcgcgagacgagccgtgcaggctgaaaaaatggcgccacccagtacccgggagcccagggtcctgtcggcgaccagcgcaaccaaatccgacggagagatggtgctgccaggcttcccggacgccgacagctttgtgaagtttgctcttgggtccgtggtggcagtcaccaaggcatctgggggcctaccacagtttggcgatgagtatgatttttaccgaagttttcctggcttccaagcattttgcgaaacacagggagacaggttgcttcagtgcatgagcagagtaatgcagtaccatgggtgtcgcagcaacattaaggatcgaagtaaagtgactgagctggaagacaagtttgatttactagttgatgccaatgatgtaattctggagagagtgggtattttactggatgaagcctcaggtgtaaacaagaatcaacagcctgtcctccctgccggcttgcaggtccccaaaacggtagtgtccagctggaaccgtaaggcagcagaatatggcaaaaaagcaaaatctgaaactttccggctgcttcatgcaaaaaatatcatccgacctcagctcaagtttcgagagaagattgacaattccaacacaccatttcttcctaaaatcttcatcaaacccaatgctcagaaacctctccctcaagctctctctaaggaaaggcgggaacgcccacaggatcgtcctgaggacttggacgtcccccctgcactggctgatttcatccatcagcagagaacccagcaggttgagcaagacatgtttgcacatccttatcaatatgaactaaatcactttaccccagcagatgcagtgcttcaaaagccacaaccccagttatacagacctatagaagagacaccatgccatttcatatcctccctggatgaactcgtggaactcaacgaaaagctcttgaattgtcaggaatttgcagttgacttggagcaccactcttacaggagcttcctgggactgacctgcctgatgcaaatttctactcggacggaagacttcatcattgacaccctcgagcttcgaagtgacatgtacattctcaatgagagcctcacagacccagccatcgttaaggtctttcatggtgctgattcagacatagaatggctacagaaagactttgggttgtatgtagtaaacatgtttgatactcatcaggcagcacgccttcttaacctgggcaggcactcactcgatcatctcctgaaactctactgcaacgtggactcaaacaagcaatatcagctggctgattggagaatacgccctctgcccgaggagatgctcagctacgcccgggatgacacccattacctgctatatatctatgacaaaatgaggctggagatgtgggagcgcggcaacgggcagcccgtgcagctgcaggtggtgtggcaacggagcagggacatctgcctcaagaaattcatcaaacctatcttcacggatgagtcctaccttgaactctataggaagcagaagaagcaccttaacacacagcagttgacagcctttcagctgctgtttgcctggagggataaaacagctcgcagggaagatgaaagttacggatatgtactgccaaaccacatgatgctgaaaatagctgaagaactgcctaaggaacctcagggcatcatagcttgctgcaacccagtaccgccccttgtgcggcagcagatcaacgaaatgcaccttttaatccagcaggcccgagagatgcccctgctcaagtctgaagttgcagccggagtgaagaagagcggaccgctgcccagtgctgagagattggagaatgttctctttggacctcacgactgctcccatgcccctccggatggctatccaatcatcccaaccagtggtaaagtcgagagccctcctgactgtcccgaagaggatctgtgccagttcagaagcaggcgagcctcttccctgatgaaaaagaagataacttgctgggtaccacatgcctgattgccacagctgtcatcacgttatttaatgaacctagtgctgaagacagtaaaaagggtccattgacagttgcacagaaaaaagcccagaacatcatggagtcctttgaaaatccatttaggatgtttctgccctcactgggacaccgtgctcccgtctctcaggcagcgaagttcgatccatcaaccaaaatctatgaaatcagcaaccgttggaagctggcccaggtacaagtacaaaaagactctaaagaagctgtcaagaagaaggcagctgagcaaacagctgcccgggaacaggcaaaggaggcgtgcaaagctgcagcagaacaggccatctccgtccgacagcaggtcgtgctagaaaatgctgcaaagaagagagagcgagcaacaagcgacccaaggaccacagaacagaaacaagagaagaaacgactcaaaatttccaagaagccaaaggacccagagccaccagaaaaagagtttacgccttacgactacagccagtcagacttcaaggcttttgctggaaacagcaaatccaaagtttcttctcagtttgatccaaataaacagaccccgtctggcaagaaatgcattgcagccaaaaaaattaaacagtcggtgggaaacaaaagcatgtcctttccaactggaaagtcagacagaggcttcaggtacaactggccacagagatagtcctggaagacacgtggcgcctgtggaccggaagcaccaaatgctggtgctgcttttgtacatacatatttttaaaccattaaaattcttcctgaagaaa

SEQ ID NO: 356638 - DNA, 2762 bp, Homo sapiens
agcgggtctcctcggccgacaagctctcgcgagacgagccgtgcaggctgaaaaaatggcgccacccagtacccgggagcccagggtcctgtcggcgaccagcgcaaccaaatccgacggagagatggtgctgccaggcttcccggacgccgacagctttgtgaagtttgctcttgggtccgtggtggcagtcaccaaggcatctgggggcctaccacagtttggcgatgagtatgatttttaccgaagttttcctggcttccaagcattttgcgaaacacagggagacaggttgcttcagtgcatgagcagagtaatgcagtaccatgggtgtcgcagcaacattaaggatcgaagtaaagtgactgagctggaagacaagtttgatttactagttgatgccaatgatgtaattctggagagagtgggtattttactggatgaagcctcaggtgtaaacaagaatcaacagcctgtcctccctgccggcttgcaggtccccaaaacggtagtgtccagctggaaccgtaaggcagcagaatatggcaaaaaagcaaaatctgaaactttccggctgcttcatgcaaaaaatatcatccgacctcagctcaagtttcgagagaagattgacaattccaacacaccatctctctctaaggaaaggcgggaacgcccacaggatcgtcctgaggacttggacgtcccccctgcactggctgatttcatccatcagcagagaacccagcaggttgagcaagacatgtttgcacatccttatcaatatgaactaaatcactttaccccagcagatgcagtgcttcaaaagccacaaccccagttatacagacctatagaagagacaccatgccatttcatatcctccctggatgaactcgtggaactcaacgaaaagctcttgaattgtcaggaatttgcagttgacttggagcaccactcttacaggagcttcctgggactgacctgcctgatgcaaatttctactcggacggaagacttcatcattgacaccctcgagcttcgaagtgacatgtacattctcaatgagagcctcacagacccagccatcgttaaggtctttcatggtgctgattcagacatagaatggctacagaaagactttgggttgtatgtagtaaacatgtttgatactcatcaggcagcacgccttcttaacctgggcaggcactcactcgatcatctcctgaaactctactgcaacgtggactcaaacaagcaatatcagctggctgattggagaatacgccctctgcccgaggagatgctcagctacgcccgggatgacacccattacctgctatatatctatgacaaaatgaggctggagatgtgggagcgcggcaacgggcagcccgtgcagctgcaggtggtgtggcaacggagcagggacatctgcctcaagaaattcatcaaacctatcttcacggatgagtcctaccttgaactctataggaagcagaagaagcaccttaacacacagcagttgacagcctttcagctgctgtttgcctggagggataaaacagctcgcagggaagatgaaagttacggatatgtactgccaaaccacatgatgctgaaaatagctgaagaactgcctaaggaacctcagggcatcatagcttgctgcaacccagtaccgccccttgtgcggcagcagatcaacgaaatgcaccttttaatccagcaggcccgagagatgcccctgctcaagtctgaagttgcagccggagtgaagaagagcggaccgctgcccagtgctgagagattggagaatgttctctttggacctcacgactgctcccatgcccctccggatggctatccaatcatcccaaccagtggatctgtgccagttcagaagcaggcgagcctcttccctgatgaaaaagaagataacttgctgggtaccacatgcctgattgccacagctgtcatcacgttatttaatgaacctagtgctgaagacagtaaaaagggtccattgacagttgcacagaaaaaagcccagaacatcatggagtcctttgaaaatccatttaggatgtttctgccctcactgggacaccgtgctcccgtctctcaggcagcgaagttcgatccatcaaccaaaatctatgaaatcagcaaccgttggaagctggcccaggtacaagtacaaaaagactctaaagaagctgtcaagaagaaggcagctgagcaaacagctgcccgggaacaggcaaaggaggcgtgcaaagctgcagcagaacaggccatctccgtccgacagcaggtcgtgctagaaaatgctgcaaagaagagagagcgagcaacaagcgacccaaggaccacagaacagaaacaagagaagaaacgactcaaaatttccaagaagccaaaggacccagagccaccagaaaaagagtttacgccttacgactacagccagtcagacttcaaggcttttgctggaaacagcaaatccaaagtttcttctcagtttgatccaaataaacagaccccgtctggcaagaaatgcattgcagccaaaaaaattaaacagtcggtgggaaacaaaagcatgtcctttccaactggaaagtcagacagaggcttcaggtacaactggccacagagatagtcctggaagacacgtggcgcctgtggaccggaagcaccaaatgctggtgctgcttttgtacatacatatttttaaaccattaaaattcttcctgaagaaa

SEQ ID NO: 356639 - DNA, 1790 bp, Homo sapiens
gtgattattcattaacctgtcgtccagagagacctgggtttgagccctaccacgctcattgagatgaatggcatcaggcttttcgccaggcatcttcagcagcgtaaaagtgccctctgcccgaggagatgctcagctacgcccgggatgacacccattacctgctatatatctatgacaaaatgaggctggagatgtgggagcgcggcaacgggcagcccgtgcagctgcaggtggtgtggcaacggagcagggacatctgcctcaagaaattcatcaaacctatcttcacggatgagtcctaccttgaactctataggaagcagaagaagcaccttaacacacagcagttgacagcctttcagctgctgtttgcctggagggataaaacagctcgcagggaagatgaaagttacgggtaagggattagaggttcttttaatacttgtttccagactgaggagatctaataacaagtaaataatgggcttttttcttttgctatgaaagctggttatttcccctatgtgacagcatctaatggaacttactggctgaatgtaatgtgtccccactgtgtgtgtgtgtgtgtgtgtgtgtgtgtgtgtttttttccagatatgtactgccaaaccacatgatgctgaaaatagctgaagaactgcctaaggaacctcagggcatcatagcttgctgcaacccagtaccgccccttgtgcggcagcagatcaacgaaatgcaccttttaatccagcaggcccgagagatgcccctgctcaagtctgaagttgcagccggagtgaagaagagcggaccgctgcccagtgctgagagattggagaatgttctctttggacctcacgactgctcccatgcccctccggatggctatccaatcatcccaaccagtggatctgtgccagttcagaagcaggcgagcctcttccctgatgaaaaagaagataacttgctgggtaccacatgcctgattgccacagctgtcatcacgttatttaatgaacctagtgctgaagacagtaaaaagggtccattgacagttgcacagaaaaaagcccagaacatcatggagtcctttgaaaatccatttaggatgtttctgccctcactgggacaccgtgctcccgtctctcaggcagcgaagttcgatccatcaaccaaaatctatgaaatcagcaaccgttggaagctggcccaggtacaagtacaaaaagactctaaagaagctgtcaagaagaaggcagctgagcaaacagctgcccgggaacaggcaaaggaggcgtgcaaagctgcagcagaacaggccatctccgtccgacagcaggtcgtgctagaaaatgctgcaaagaagagagagcgagcaacaagcgacccaaggaccacagaacagaaacaagagaagaaacgactcaaaatttccaagaagccaaaggacccagagccaccagaaaaagagtttacgccttacgactacagccagtcagacttcaaggcttttgctggaaacagcaaatccaaagtttcttctcagtttgatccaaataaacagaccccgtctggcaagaaatgcattgcagccaaaaaaattaaacagtcggtgggaaacaaaagcatgtcctttccaactggaaagtcagacagaggcttcaggtacaactggccacagagatagtcctggaagacacgtggcgcctgtggaccggaagcaccaaatgctggtgctgcttttgtacatacatatttttaaaccattaaaattcttcctgaagaaa

SEQ ID NO: 356640 - DNA, 2187 bp, Homo sapiens
agcgggtctcctcggccgacaagctctcgcgagacgagccgtgcaggctgaaaaaatggcgccacccagtacccgggagcccagggtcctgtcggcgaccagcgcaaccaaatccgacggagagatggtgctgccaggcttcccggacgccgacagctttgtgaagtttgctcttgggtccgtggtggcagtcaccaaggcatctgggggcctaccacagtttggcgatgagtatgatttttaccgaagttttcctggcttccaagcattttgcgaaacacagggagacaggttgcttcagtgcatgagcagagtaatgcagtaccatgggtgtcgcagcaacattaaggatcgaagtaaagtgactgagctggaagacaagtttgatttactagttgatgccaatgatgtaattctggagagagtgggtattttactggatgaagcctcaggtgtaaacaagaatcaacagcctgtcctccctgccggcttgcaggtccccaaaacggtagtgtccagctggaaccgtaaggcagcagaatatggcaaaaaagcaaaatctgaaactttccggctgcttcatgcaaaaaatatcatccgacctcagctcaagtttcgagagaagattgacaattccaacacaccatttcttcctaaaatcttcatcaaacccaatgctcagaaacctctccctcaagctctctctaaggaaaggcgggaacgcccacaggatcgtcctgaggacttggacgtcccccctgcactggctgatttcatccatcagcagagaacccagcaggttgagcaagacatgtttgcacatccttatcaatatgaactaaatcactttaccccagcagatgcagtgcttcaaaagccacaaccccagttatacagacctatagaagagacaccatgccatttcatatcctccctggatgaactcgtggaactcaacgaaaagctcttgaattgtcaggaatttgcagttgacttggagcaccactcttacaggagcttcctgggactgacctgcctgatgcaaatttctactcggacggaagacttcatcattgacaccctcgagcttcgaagtgacatgtacattctcaatgagagcctcacagacccagccatcgttaaggtctttcatggtgctgattcagacatagaatggctacagaaagactttgggttgtatgtagtaaacatgtttgatactcatcaggcagcacgccttcttaacctgggcaggcactcactcgatcatctcctgaaactctactgcaacgtggactcaaacaagcaatatcagctggctgattggagaatacgccctctgcccgaggagatgctcagctacgcccgggatgacacccattacctgctatatatctatgacaaaatgaggctggagatgtgggagcgcggcaacgggcagcccgtgcagctgcaggtggtgtggcaacggagcagggacatctgcctcaagaaattcatcaaacctatcttcacggatgagtcctaccttgaactctataggaagcagaagaagcaccttaacacacagcagttgacagcctttcagctgctgtttgcctggagggataaaacagctcgcagggaagatgaaagttacggatatgtactgccaaaccacatgatgctgaaaatagctgaagaactgcctaaggaacctcagggcatcatagcttgctgcaacccagtaccgccccttgtgcggcagcagatcaacgaaatgcaccttttaatccagcaggcccgagagatgcccctgctcaagtctgaagttgcagccggagtgaagaagagcggaccgctgcccagtgctgagagattggagaatgttctctttggacctcacgactgctcccatgcccctccggatggctatccaatcatcccaaccagtggatctgtgccagttcagaagcaggcgagcctcttccctgatgaaaaagaagataacttgctgggtaccacatgcctgattgccacagctgtcatcacgttatttaatgaacctagtgctgaagacagtaaaaagggtccattgacagttgcacagaaaaaagcccagaacatcatggagtcctttgaaaatccatttaggatgtttctgccctctactggacaccgcactccctaagaccctagtgatcctgg

SEQ ID NO: 356641 - DNA, 984 bp, Homo sapiens
cagcctgctggtgtcttttaatgcagagattggagaatgttctctttggacctcacgactgctcccatgcccctccggatggctatccaatcatcccaaccagtggatctgtgccagttcagaagcaggcgagcctcttccctgatgaaaaagaagataacttgctgggtaccacatgcctgattgccacagctgtcatcacgttatttaatgaacctagtgctgaagacagtaaaaagggtccattgacagttgcacagaaaaaagcccagaacatcatggagtcctttgaaaatccatttaggatgtttctgccctcactgggacaccgtgctcccgtctctcaggcagcgaagttcgatccatcaaccaaaatctatgaaatcagcaaccgttggaagctggcccaggtacaagtacaaaaagactctaaagaagctgtcaagaagaaggcagctgagcaaacagctgcccgggaacaggcaaaggaggcgtgcaaagctgcagcagaacaggccatctccgtccgacagcaggtcgtgctagaaaatgctgcaaagaagagagagcgagcaacaagcgacccaaggaccacagaacagaaacaagagaagaaacgactcaaaatttccaagaagccaaaggacccagagccaccagaaaaagagtttacgccttacgactacagccagtcagacttcaaggcttttgctggaaacagcaaatccaaagtttcttctcagtttgatccaaataaacagaccccgtctggcaagaaatgcattgcagccaaaaaaattaaacagtcggtgggaaacaaaagcatgtcctttccaactggaaagtcagacagaggcttcaggtacaactggccacagagatagtcctggaagacacgtggcgcctgtggaccggaagcaccaaatgctggtgctgcttttgtacatacatatttttaaaccattaaaattcttcctgaagaaa

SEQ ID NO: 356642 - DNA, 807 bp, Homo sapiens
gatcctgttaaacgccctcaggtccacaggccactgagcatttaggttcacagaagaggagcaggcagggctggggaggatcagctcacgtgtagctgaaggtgggcagagcacctgagcctgagctctgaggcagcctgtcctgcagagatgggggaccggggacctgagagggaggaggaatcagccgtgacaacccctgtggctaggccaagtcggagggggatggagatggaggggagggtggttgctggattcaccaactccagagacaagttctctcccttgcagctgcccgggaacaggcaaaggaggcgtgcaaagctgcagcagaacaggccatctccgtccgacagcaggtcgtgctagaaaatgctgcaaagaagagagagcgagcaacaagcgacccaaggaccacagaacagaaacaagagaagaaacgactcaaaatttccaagaagccaaaggacccagagccaccagaaaaagagtttacgccttacgactacagccagtcagacttcaaggcttttgctggaaacagcaaatccaaagtttcttctcagtttgatccaaataaacagaccccgtctggcaagaaatgcattgcagccaaaaaaattaaacagtcggtgggaaacaaaagcatgtcctttccaactggaaagtcagacagaggcttcaggtacaactggccacagagatagtcctggaagacacgtggcgcctgtggaccggaagcaccaaatgctggtgctgcttttgtacatacatatttttaaaccattaaaattcttcctgaagaaa

SEQ ID NO: 356643 - DNA, 1912 bp, Homo sapiens
gaattctagcggcgctttctcccgctctcgcctccgcgctagcgccctgctgcttcggggcggaagtagcggagccgggctcggcccccttaaagggacagggactgctgcaacctacggggtgtacttgggaacgaggggtgaagcggcccaggtgaggctcgccatggccaaacagctgcaggcccgaaggctagacgggatcgactacaacccctgggtggagtttgtgaaactggccagtgagcatgacgtcgtgaacttgggccagggcttcccggatttcccaccaccagactttgccgtggaagcctttcagcacgctgtcagtggagacttcatgcttaaccagtacaccaagacatttggttacccaccactgacgaagatcctggcaagtttctttggggagctgctgggtcaggagatagacccgctcaggaatgtgctggtgactgttggtggctatggggccctgttcacagccttccaggccctggtggacgaaggagacgaggtcatcatcatcgaacccttttttgactgctacgagcccatgacaatgatggcagggggtcgtcctgtgtttgtgtccctgaagccgggtcccatccagaatggagaactgggttccagcagcaactggcagctggaccccatggagctggccggcaaattcacatcacgcaccaaagccctggtcctcaacacccccaacaaccccctgggcaaggtgttctccagggaagagctggagctggtggccagcctttgccagcagcatgacgtggtgtgtatcactgatgaagtctaccagtggatggtctacgacgggcaccagcacatcagcattgccagcctccctggcatgtgggaacggaccctgaccatcggcagcgccggcaagaccttcagcgccactggctggaaggtgggctgggtcctgggtccagatcacatcatgaagcacctgcggaccgtgcaccagaactccgtcttccactgccccacgcagagccaggctgcagtagccgagagctttgaacgggagcagctgctcttccgccaacccagcagctactttgtgcagttcccgcaggccatgcagcgctgccgtgaccacatgatacgtagcctacagtcagtgggcctgaagcccatcatccctcagggcagctacttcctcatcacagacatctcagacttcaagaggaagatgcctgacttgcctggagctgtggatgagccctatgacagacgcttcgtcaagtggatgatcaagaacaagggcttggtggccatccctgtctccatcttctatagtgtgccacatcagaagcactttgaccactatatccgcttctgttttgtgaaggatgaagccacgctccaggccatggacgagaagctgcggaagtggaaggtggaactctagccctgaagtcacgccttggccctgacatccccacatgcccgcagagatcctctttgagtgtctgtctttgtccaggtttcagacatttctaggttggggaagatgctattgggaaacctcttctccgtgacacagaatgttctgggtgggagccgcccttcttcatcttagagaaccaagtgcctcctgtctgaaaggtgagggtggcctgacctgggcctctccctgcccctccataggtgggtttgtagggtcttgtgttgcttctggtctctccaggcttggctgagacggacggtagacttccaccatgtaccgatcacatcccagctctgcatggcccctgctaaggctcaggtataacctcaccttccctggctcatcttggccttggggagttgcctttaggcttgagtcctcaagcctctccttttcgtccataataaaatgtttaagttattaagatccttaatgacg

SEQ ID NO: 356644 - DNA, 1762 bp, Homo sapiens
gaattctagcggcgctttctcccgctctcgcctccgcgctagcgccctgctgcttcggggcggaagtagcggagccgggctcggcccccttaaagggacagggactgctgcaacctacggggtgtacttgggaacgaggggtgaagcggcccaggtgaggctcgccatggccaaacagctgcaggcccgaaggctagacgggatcgactacaacccctgggtggagtttgtgaaactggccagtgagcatgacgtcgtgaacttgggccagggcttcccggatttcccaccaccagactttgccgtggaagcctttcagcacgctgtcagtggagacttcatgcttaaccagtacaccaagacatttgtcatcatcatcgaacccttttttgactgctacgagcccatgacaatgatggcagggggtcgtcctgtgtttgtgtccctgaagccgggtcccatccagaatggagaactgggttccagcagcaactggcagctggaccccatggagctggccggcaaattcacatcacgcaccaaagccctggtcctcaacacccccaacaaccccctgggcaaggtgttctccagggaagagctggagctggtggccagcctttgccagcagcatgacgtggtgtgtatcactgatgaagtctaccagtggatggtctacgacgggcaccagcacatcagcattgccagcctccctggcatgtgggaacggaccctgaccatcggcagcgccggcaagaccttcagcgccactggctggaaggtgggctgggtcctgggtccagatcacatcatgaagcacctgcggaccgtgcaccagaactccgtcttccactgccccacgcagagccaggctgcagtagccgagagctttgaacgggagcagctgctcttccgccaacccagcagctactttgtgcagttcccgcaggccatgcagcgctgccgtgaccacatgatacgtagcctacagtcagtgggcctgaagcccatcatccctcagggcagctacttcctcatcacagacatctcagacttcaagaggaagatgcctgacttgcctggagctgtggatgagccctatgacagacgcttcgtcaagtggatgatcaagaacaagggcttggtggccatccctgtctccatcttctatagtgtgccacatcagaagcactttgaccactatatccgcttctgttttgtgaaggatgaagccacgctccaggccatggacgagaagctgcggaagtggaaggtggaactctagccctgaagtcacgccttggccctgacatccccacatgcccgcagagatcctctttgagtgtctgtctttgtccaggtttcagacatttctaggttggggaagatgctattgggaaacctcttctccgtgacacagaatgttctgggtgggagccgcccttcttcatcttagagaaccaagtgcctcctgtctgaaaggtgagggtggcctgacctgggcctctccctgcccctccataggtgggtttgtagggtcttgtgttgcttctggtctctccaggcttggctgagacggacggtagacttccaccatgtaccgatcacatcccagctctgcatggcccctgctaaggctcaggtataacctcaccttccctggctcatcttggccttggggagttgcctttaggcttgagtcctcaagcctctccttttcgtccataataaaatgtttaagttattaagatccttaatgacg

SEQ ID NO: 356645 - DNA, 1445 bp, Homo sapiens
gaattctagcggcgctttctcccgctctcgcctccgcgctagcgccctgctgcttcggggcggaagtagcggagccgggctcggcccccttaaagggacagggactgctgcaacctacggggtgtacttgggaacgaggggtgaagcggcccaggtgaggctcgccatggccaaacagctgcaggcccgaaggctagacgggatcgactacaacccctgggtggagtttgtgaaactggccagtgagcatgacgtcgtgaacttgggccagggcttcccggatttcccaccaccagactttgccgtggaagcctttcagcacgctgtcagtggagacttcatgcttaaccagtacaccaagacatttggttacccaccactgacgaagatcctggcaagtttctttggggagctgctgggtcaggagatagacccgctcaggaatgtgctggtgactgttggtggctatggggccctgttcacagccttccaggccctggtggacgaaggagacgaggtcatcatcatcgaacccttttttgactgctacgagcccatgacaatgatggcagggggtcgtcctgtgtttgtgtccctgaagccgggtcccatccagaatggagaactgggttccagcagcaactggcagctggaccccatggagctggccggcaaattcacatcacgcaccaaagccctggtcctcaacacccccaacaaccccctgggcaaggtgttctccagggaagagctggagctggtggccagcctttgccagcagcatgacgtggtgtgtatcactgatgaagtctaccagtggatggtctacgacgggcaccagcacatcagcattgccagcctccctggcatgtgggaacggaccctgaccatcggcagcgccggcaagaccttcagcgccactggctggaaggtgggctgggtcctgggtccagatcacatcatgaagcacctgcggaccgtgcaccagaactccgtcttccactgccccacgcagagccaggctgcagtagccgagagctttgaacgggagcagctgctcttccgccaacccagcagctactttgtgcagttcccgcaggccatgcagcgctgccgtgaccacatgatacgtagcctacagtcagtgggcctgaagcccatcatccctcagggcagctacttcctcatcacagacatctcagacttcaagaggaagatgcctgacttgcctggagctgtggatgagccctatgacagacgcttcgtcaagtggatgatcaagaacaaggtgggctgggcctctgccaggcagccatgtatggtttcacaggttgtgtgctgctcaagggtgcccaggcaagaggctcctgggctagatcttagtccagcctctgccgtcaaccttggggcagggttgtatccacttcagagaaagtacggttgca

SEQ ID NO: 356646 - DNA, 638 bp, Homo sapiens
accacagtgcttctgatgtggcacactatagaagatggagacagggatggccaccaagcccttgttcttgatcatccacctgacgaagcgtctgtcatagggatgaagccacgctccaggccatggacgagaagctgcggaagtggaaggtggaactctagccctgaagtcacgccttggccctgacatccccacatgcccgcagagatcctctttgagtgtctgtctttgtccaggtttcagacatttctaggttggggaagatgctattgggaaacctcttctccgtgacacagaatgttctgggtgggagccgcccttcttcatcttagagaaccaagtgcctcctgtctgaaaggtgagggtggcctgacctgggcctctccctgcccctccataggtgggtttgtagggtcttgtgttgcttctggtctctccaggcttggctgagacggacggtagacttccaccatgtaccgatcacatcccagctctgcatggcccctgctaaggctcaggtataacctcaccttccctggctcatcttggccttggggagttgcctttaggcttgagtcctcaagcctctccttttcgtccataataaaatgtttaagttattaagatccttaatgacg

SEQ ID NO: 356647 - DNA, 185 bp, Homo sapiens
tgcaaactctatctcttccccctcctgggagcagacaggatggcgctgtggcctgaaagcagctgtccctcctgtgtgcaagctcggactgctgcacccagacagattccatctctgaccttccacttgttcgtctccagctcgccatggccaaacagctgcaggcccgaaggctagacgggatc

SEQ ID NO: 356648 - DNA, 1037 bp, Homo sapiens
  misc_feature (1)..(1): n is a, c, g, or t
ngggattacaggcatgcgccaccacacccggccaatttttgtatttttggtagagacggggtttagccatgttggccaggctggtcttgaactcctgacctcaggtgatccacccgtctcagcctcccaaagtgctgggattataggcgtgagccaccgcacctggccttgttcctctgactttgatgcagctctaggtgctggattggagctaactctccttccccgcctggtcgtgggaacctctctgtcccctccggagccaaggcctgctgggccacgaggccgtgttgagacatgtccttcctcctccccagggcttggtggccatccctgtctccatcttctatagtgtgccacatcagaagcactttgaccactatatccgcttctgttttgtgaaggtaaagggcagggctgggggaggaaagacctcacagagcttcccaaggccggctgggcacatggggagagtgtaggactaatctgtgctggcgcaggatgaagccacgctccaggccatggacgagaagctgcggaagtggaaggtggaactctagccctgaagtcacgccttggccctgacatccccacatgcccgcagagatcctctttgagtgtctgtctttgtccaggtttcagacatttctaggttggggaagatgctattgggaaacctcttctccgtgacacagaatgttctgggtgggagccgcccttcttcatcttagagaaccaagtgcctcctgtctgaaaggtgagggtggcctgacctgggcctctccctgcccctccataggtgggtttgtagggtcttgtgttgcttctggtctctccaggcttggctgagacggacggtagacttccaccatgtaccgatcacatcccagctctgcatggcccctgctaaggctcaggtataacctcaccttccctggctcatcttggccttggggagttgcctttaggcttgagtcctcaagcctctccttttcgtccataataaaatgtttaagttattaagatccttaatgacg

SEQ ID NO: 356649 - DNA, 798 bp, Homo sapiens
aggtggctgagaagaatgttggatccccagctccacggcccaccagccatctgggactggcaaacccacaggaacggaaggttcctcagggaccacaaagcccatgtgaggtccctgctgctgaagggattctgaggacaggaggagccaaattacctatccagggtcacccagccaagctcgccatggccaaacagctgcaggcccgaaggctagacgggatcgactacaacccctgggtggagtttgtgaaactggccagtgagcatgacgtcgtgaacttgggccagggcttcccggatttcccaccaccagactttgccgtggaagcctttcagcacgctgtcagtggagacttcatgcttaaccagtacaccaagacatttggttacccaccactgacgaagatcctggcaagtttctttggggagctgctgggtcaggagatagacccgctcaggaatgtgctggtgactgttggtggctatggggccctgttcacagccttccaggccctggtggacgaaggagacgaggtcatcatcatcgaacccttttttgactgctacgagcccatgacaatgatggcagggggtcgtcctgtgtttgtgtccctgaagccgggtcccatccagaatggagaactgggttccagcagcaactggcagctggaccccatggagctggccggcaaattcacatcacgcaccaaagccctggtcctcaacacccccaacaaccccctgggcaaggtgtctccgggaaaagctcggaagttggtggcaaccatttgcacag

SEQ ID NO: 356650 - DNA, 1840 bp, Homo sapiens
cacaggggtgcctgggagggggctcgcgcgccgcggagccggcgagaaggtggtgccccggagactccgggcactggggagcccatagctcgccatggccaaacagctgcaggcccgaaggctagacgggatcgactacaacccctgggtggagtttgtgaaactggccagtgagcatgacgtcgtgaacttgggccagggcttcccggatttcccaccaccagactttgccgtggaagcctttcagcacgctgtcagtggagacttcatgcttaaccagtacaccaagacatttggttacccaccactgacgaagatcctggcaagtttctttggggagctgctgggtcaggagatagacccgctcaggaatgtgctggtgactgttggtggctatggggccctgttcacagccttccaggccctggtggacgaaggagacgaggtcatcatcatcgaacccttttttgactgctacgagcccatgacaatgatggcagggggtcgtcctgtgtttgtgtccctgaagccgggtcccatccagaatggagaactgggttccagcagcaactggcagctggaccccatggagctggccggcaaattcacatcacgcaccaaagccctggtcctcaacacccccaacaaccccctgggcaaggtgttctccagggaagagctggagctggtggccagcctttgccagcagcatgacgtggtgtgtatcactgatgaagtctaccagtggatggtctacgacgggcaccagcacatcagcattgccagcctccctggcatgtgggaacggaccctgaccatcggcagcgccggcaagaccttcagcgccactggctggaaggtgggctgggtcctgggtccagatcacatcatgaagcacctgcggaccgtgcaccagaactccgtcttccactgccccacgcagagccaggctgcagtagccgagagctttgaacgggagcagctgctcttccgccaacccagcagctactttgtgcagttcccgcaggccatgcagcgctgccgtgaccacatgatacgtagcctacagtcagtgggcctgaagcccatcatccctcagggcagctacttcctcatcacagacatctcagacttcaagaggaagatgcctgacttgcctggagctgtggatgagccctatgacagacgcttcgtcaagtggatgatcaagaacaagggcttggtggccatccctgtctccatcttctatagtgtgccacatcagaagcactttgaccactatatccgcttctgttttgtgaaggatgaagccacgctccaggccatggacgagaagctgcggaagtggaaggtggaactctagccctgaagtcacgccttggccctgacatccccacatgcccgcagagatcctctttgagtgtctgtctttgtccaggtttcagacatttctaggttggggaagatgctattgggaaacctcttctccgtgacacagaatgttctgggtgggagccgcccttcttcatcttagagaaccaagtgcctcctgtctgaaaggtgagggtggcctgacctgggcctctccctgcccctccataggtgggtttgtagggtcttgtgttgcttctggtctctccaggcttggctgagacggacggtagacttccaccatgtaccgatcacatcccagctctgcatggcccctgctaaggctcaggtataacctcaccttccctggctcatcttggccttggggagttgcctttaggcttgagtcctcaagcctctccttttcgtccataataaaatgtttaagttattaagatccttaatgacg

SEQ ID NO: 356651 - DNA, 805 bp, Homo sapiens
cacaggggtgcctgggagggggctcgcgcgccgcggagccggcgagaaggtggtgccccggagactccgggcactggggagcccatagctcgccatggccaaacagctgcaggcccgaaggctagacgggatcgactacaacccctgggtggagtttgtgaaactggccagtgagcatgacgtcgtgaacttgggccagggcttcccggatttcccaccaccagactttgccgtggaagcctttcagcacgctgtcagtggagacttcatgcttaaccagtacaccaagacatttggttacccaccactgacgaagatcctggcaagtttctttggggagctgctgggtcaggagatagacccgctcaggaatgtgctggtgactgttggtggctatggggccctgttcacagccttccaggccctggtggacgaaggagacgaggtcatcatcatcgaacccttttttgactgctacgaccgcccttcttcatcttagagaaccaagtgcctcctgtctgaaaggtgagggtggcctgacctgggcctctccctgcccctccataggtgggtttgtagggtcttgtgttgcttctggtctctccaggcttggctgagacggacggtagacttccaccatgtaccgatcacatcccagctctgcatggcccctgctaaggctcaggtataacctcaccttccctggctcatcttggccttggggagttgcctttaggcttgagtcctcaagcctctccttttcgtccataataaaatgtttaagttattaagatccttaatgacg

SEQ ID NO: 356652 - DNA, 589 bp, Homo sapiens
attaaacaatgggcaaattattggaatagacctttttccagagggcatacaggtggtcagtaaccacatggaaagctgctcaaaatcagtacttatcagggaaaagcaaatcaaaaccccttcaaatctgctaagcactaggatcatcagagtcaataaaatacagaaaataacaagtgttgagggtttggagaaatgggagacttaggacaccgccattgagactgtaaaacggtggcaaccattttggaaaacattctggcagtttttcaaaagattaagcatttatgtgacccagaaatttcactccctaggtatacctagaagaaatgaggctgggcgcagtgtctcacgtctgtaatcctagcactttgggaggccgagatgggcagatcacctgaggtcaggagttcaagaccagcctggccaacatggtgaaactccatctctactaaaaatacaaaaattagccaggcgtggtggcacacacctgtaatcccaactacttgggaggctgaggcaggagaagcgcttgaacctgggaggcggaggttgctgtgagccgaaatcttgccgcagcactccagcc

SEQ ID NO: 356653 - DNA, 1356 bp, Homo sapiens
agtgatgtcgagcgtcgagctcccaaaaccgagctggtgaggggctgcaggtggcggcgcagtctcggtaggcggtatgagtttggctgggggccgggcaccccggaagaccgctgggaaccggctttctgggcttttggaggcagaggaggaagatgagttctaccagacgacttatgggggtttcacagaggaatccggagatgatgagtatcaaggggaccagtcagacacagaggacgaagtggactctgactttgacattgatgaaggggatgaaccatccagtgatggagaagcagaagagccaagaaggaagcgccgagtagtcaccaaggcctataaggaacctctcaagagcttaaggcctcgaaaggtcaacaccccggctggtagctctcagaaggcgcgagaagagaaggcactactgccattagaactacaagatgacggctctgacagtcggaagtctatgcgtcagtctacagctgagcatacacgacaaacgttccttcgggtacaggagaggcagggccagtcaagacggcgaaaggggccccactgtgagcggccactaacccaggaggaactgctccgggaggccaagatcacagaagagcttaatttacggtcactggagacatatgagcggctcgaggctgataaaaagaagcaggttcataagaagcggaagtgccccgggcccataatcacctatcattcagtgacagtgccacttgttggggagccaggccccaaggaagagaacgttgacatagaaggacttgatcctgctccctcggtgtctgcattgactcctcatgctgggactggacccgtcaacccccctgctcgctgctcacgtaccttcatcacttttagtgatgatgcaactttcgaggaatggttcccccaagggcggcccccaaaagtccctgttcgtgaggtctgtccagtgacccatcgtccagccctataccgggaccctgttacagacataccctatgccactgctcgagccttcaagatcattcgtgaggcttacaagaagtacattactgcccatggactgccgcccactgcctcagccctgggccccggcccgccacctcctgagcccctccctggctctgggccccgagccttgcgccagaaaattgtcattaaatgaagagatgtctagtcctcagaaacttctttcctgccctgattggggctcttgctgttccgtttcttctccctgcttctcccctttgtcatctctgatctttgcctaatctgtttctttttccttttcccctagttcttacaggtttcgttgtgttttttaatctaataaaatagaaagatcccttt

SEQ ID NO: 356654 - DNA, 613 bp, Homo sapiens
gtgtctagccgatcccttctttggtcaggacatagaaggcacttgatcctgctccctcggtgtctgcattgactcctcatgctgggactggacccgtcaacccccctgctcgctgctcacgtaccttcatcacttttagtgatgatgcaactttcgaggaatggttcccccaagggcggcccccaaaagtccctgttcgtgaggtctgtccagtgacccatcgtccagccctataccgggaccctgttacagacataccctatgccactgctcgagccttcaagatcattcgtgaggcttacaagaagtacattactgcccatggactgccgcccactgcctcagccctgggccccggcccgccacctcctgagcccctccctggctctgggccccgagccttgcgccagaaaattgtcattaaatgaagagatgtctagtcctcagaaacttctttcctgccctgattggggctcttgctgttccgtttcttctccctgcttctcccctttgtcatctctgatctttgcctaatctgtttctttttccttttcccctagttcttacaggtttcgttgtgttttttaatctaataaaatagaaagatcccttt

SEQ ID NO: 356655 - DNA, 3609 bp, Homo sapiens
  misc_feature (1636)..(1636): n is a, c, g, or t
aaaaaaaaaggtctttagtttcaagggtttaagttaaataaggtgaaacaaatttaaagaaaatgtcttcctttttttaaaaaaacttctaaaagaggatattggttaaattgacagtttattatttctctggtttagtagtgactgttctttaaaaaaaatttaaaaaaactttattgagataatttatgtattaacctattttaaatgtacagttcaatgatttttagtaaatttaattgtgactcttgagtcaaattttactactttttagaattcctctgaaggatagatcaaagattaggaaacatctaaggtcagttagttgaaatttctttcctgtggcttcgtaaccctattgggatttctcctgtgtccttgagttctcactagggtggggctcactttgggctcactttggctcacattgagccatggctttgtcatgatttttttgtgaaactcagtgcttcctaagatgaaaatgtgttcatgctaagactggtttcttccttagcactttgtctggcttagtggagtttgatggctattacctggagagcgatccctgcctggtgtgtaataacccggaagtaccgttctgttatatcaagctgtcttccattaaagtggacacgcggtacaccaccacccagcaggttgtgaagctcattggcagtcacaccatcagcaaagtgacagtgaaaatcggggatctgaaacggaccaagatggtgcggaccatcaacctgtattataacaaccgaaccgtgcaggccatcgtggagttgaaaaacaagccagctcgctggcacaaagccaagaaggttcagctgacccctggacagacagaggtgaagattgacctgccgttgcccattgtggcctccaatctgatgattgagtttgcagacttctatgaaaactaccaggcctccacagagaccctgcagtgccctcgctgtagtgcctcggtccctgccaacccaggagtctgtggcaactgtggagagaatgtgtaccagtgtcacaaatgcagatccatcaactacgatgaaaaggatcccttcctctgcaatgcctgtggcttctgtaaatatgcccgcttcgacttcatgctctatgccaagccttgctgtgcagtggatcccattgagaatgaagaagaccggaagaaggctgtatccaacatcaatacacttttggacaaagctgatcgagtgtatcatcagctgatgggacaccggccacagctggagaacctgctctgcaaagtgaatgaggcagctccagaaaagccacaggtagtcccacgctgcaaagggcatttggataagggcttgggtcttgatcagaagactgcctcctaggtgagatcaccttaggtggggagcctgacagcttacctcttggggttgcaggatgactcaggaacagcagggggcatcagctccacttctgccagtgtgaatcgttacatcctgcagttggctcaggagtattgtggagactgcaagaactcttttgatgaactctccaaaatcatccaggtagagagcggggagcagcttttgggtgtgttttgtccaagtgttactggtgttgttttcacagcagtcctgctgctctctcatcnagcagtccaggtcttggtgttgtccctgcccaatctagctgaaaaggcaggcagatggctgcaccaaacggcatctcccccaccgtgatttatggcgctggtcagaatgctgagttcatgctagataactgaacatactggtgatgggaaggtaacacagataagggttttttttagccattaacaacccatctcttagtagaggggttactggtcttaaaaaatttgatgccaagattctgttccctcttctgataacgccgtgtttgcaggctgtagggtaagggcataccaactgcaatcaaccagggtgggccttgtgtcagttgcaatgtcacagacctaatctccatgagatgggaggctggccatagacagaggtacctcatataaggagagcatccagtttaccttccccctcaaccccaaattgctggagtgccatctttgctacacgtgtattagcttctgacctttgtctttgttacatgggagttaagagcataagcctgccatctgagtctgagttctgactctgccacttatcttggtcaagccactttctccaagcttcagtttccttctctgtaaaatggagataaagcatctaaccagttgggttattgagaagattaagttatataatgcatgtaaagttttttctaaagcaaaactaattttctaattaacatcctcttcttattttaattgctaattcccattattgttgcctttttgttcttagaaagtctttgcttcgcgcaaagagttgttggaatatgacctacagcagagggaagcagccactaaatcatcccggacctccgtgcagcccacattcactgccagccagtaccgtgccttatccgtcctgggctgtggccacacatcctccaccaagtgctatggctgcgcctcggctgtcacagaacattgtatcacactacttcgggccctggccaccaacccagccttgaggcacatccttgtctcccagggccttatccgggagctctttgattataatcttcgccgaggggctgcggccatgcgggaggaggtccgccagctcatgtgcctcctaactcggtcagtacctacaccatggttatgggcctagtggttcctactgacactggcagccatgccaggagcgttagagagtgcacagaatagtgcttctgaccacccagcaagttaggtagcttataacaaaggaaagatggaaagagacacagggtgtaggtgagcgagcttggggagcattgaaacccaggtttccttgtaaatggcatgattggcttgtgcttttttggttccagtacagtgtcttgaggaaactctccctgaggccttgtgagggaagggaagggagacacttgaactcgagaaagactcacatgaaagaagcagagcagtggggcctggagattaagagcttggactctggattggaaaggctcagtttcagtatctgataccttgtactatacgccttggacagattccttaatttctctgagtctgtgttttcctcatctgaaaaatactgacagtaggctgggcacagtggctcttgcccgtaatcccagcactttggcacctgaggctggcagatcacttgaggtcaggagttcaagaccagcctggccaacatggtaaaacctcgtctccattaaaaatacaaaaatagggccaggtgctgtggctcatgcctgtaatcccagcactttggcaggccaaggcgggtggatcacctgaggtcgggagttcaagaccagcctgaccaacatggagaaaccccatctccactgaaaatacaaaattagacaggtgtagtggtgcatgcctgtaatctcagctacttgggaggctgagacaggagaatcgcttgaacctgggaggcggagattgtggtgagtcgaaatcgtgccattgcactccagcctgggcaacaagcgagactccgtctc

SEQ ID NO: 356656 - DNA, 715 bp, Homo sapiens
tgccttccactcctaggtcaggttttgacagcaccactttattactttgtttaagctgttagaaaatttcagaacatcagacacaccctattcaaatgtgagaacaaaaacaccttccagcagtgcctgcttctggaacaggactcctcctgcggaacagggttttgctcaatgactacctccccggtcatgctgctgtccagtgagcagccgggccagagcttgtcggaccgcagtgtgttctctgctagatgcggcagctgtgactcagggggaatgggggctgtatgcctgctcctgacacacctctgcccgttgtgctttgcaggtcttttatcagaaatcaccgatccagagagcttcctgaaggacctgttgaactcagtcccctgaccaccacacagcagctgcggcggcgaagacgaagctggcttgccttccaccctctgttctccctccttgtgcattaagttccctccgcgggatgctgcattgttaccccgccctcccctctctcatttttcttggtgtggcttggggtttttaggcttcctgttttatctcgtgtgtgtggtgcaccagctatgaggttgtctgtaacccaagccatcaaagggcctgtacatacctaggagccatgagttgtcccggccagcttcatacttgagtgtgcacatcttgagaaataaacaagtgacttaacacacattgaaaa

SEQ ID NO: 356657 - DNA, 1533 bp, Homo sapiens
cactgagtctggtgtggtcatcatcatcatcatcattgcaacttaggacgcatgaggacaagaagcagcgctcatctggaagaggctgttctaacgaaggcgggaggatcctagatcagaagaagacaaaccggaagagggagcctaggaaaggaaccacatgcacatttagtgcaaaccatgtaaacataacataacaagactatgtggagcaagggggagtcaggctgtggacccaccagggaatcttgattcatgtttttggccccatcactcactagcttgctgactttgggcaagtcacttcacttttctgggcctctggagttactagcacagttccatgttggggagattgtgaacgtccctgatatatggtgctcaggaaccagtagttgcttggaattgtattagagctggggtaggagctagacatggggccagggaagaagggaagatgccgcgaagaagggcctggaaggggacgaagggcgtggattatcagaggaagtgggagtagtcggcaaggatgggtggggagtgttgagtcatccaagcgttcagcaaatgtcacaagacaacgacaaattgagcaaattcttcctgctcttgctgccgggtcctgcttccaccctgcttttattttatcatgccgcttttcttctagaacccgagcaacttcccgagaagagaagaacctccaaggctttctggaacagcccaaggagaagtgggtggagagtgcctttgaagtggacgggccctactatttcacagtcttggcccttcacatcctgccccctgagcagtggagagccacacgtgtggaaatcttgcggaggctgttggtgacctcgcaggctcgggcagtggctccaggtggagccaccaggctgacagataaggcagtgaaggactattccgcttaccgttcttcccttctcttttgggccctcgtcgatctcatttacaacatgtttaagaaggtgcctaccagtaacacagagggaggctggtcctgctctctcgctgagtacatccgccacaacgacatgcccatctacgaagctgccgacaaagccctgaaaaccttccaggaggagttcatgccagtggagaccttctcagagttcctcgatgtggccggtcttttatcagaaatcaccgatccagagagcttcctgaaggacctgttgaactcagtcccctgaccaccacacagcagctgcggcggcgaagacgaagctggcttgccttccaccctctgttctccctccttgtgcattaagttccctccgcgggatgctgcattgttaccccgccctcccctctctcatttttcttggtgtggcttggggtttttaggcttcctgttttatctcgtgtgtgtggtgcaccagctatgaggttgtctgtaacccaagccatcaaagggcctgtacatacctaggagccatgagttgtcccggccagcttcatacttgagtgtgcacatcttgagaaataaacaagtgacttaacacacattgaaaa

SEQ ID NO: 356658 - DNA, 12589 bp, Homo sapiens
gtgacctagaggttccgccacaagcgcgatctcaaaggtccaggtctctttggatgagcatttttctaagatggctgctgagactgatcctcataagtcgtctgagattaccaagaacctacttccagccacgctgcaactcattgacacctatgcatcgttcaccagagcctatttgctgcaaaactttaatgaagagggaacaactgagaaaccttccaaggagaaactgcaaggctttgctgctgttttggctattggctctagcaggtgcaaggcaaatactctgggtccgacactggttcagaatttgccatcgtcagtgcagactgtgtgtgagtcctggaacaacatcaataccaatgaatttcccaatattggatcctggcgcaatgcctttgccaatgacaccatcccttcagagagttatattagtgcagtgcaggctgcacacctggggactctctgtagccaaagtctgcccctggctgcttccctgaagcataccctcctctcactggtcaggttgactggagatcttattgtttggtcagatgagatgaacccaccacaggtaattcggacactgctacctcttcttttggaatcaagcactgagagtgttgccgagatcagtagcaactccctggaacgcatcttgggccctgctgagtctgatgagttcttggctcgtgtttatgagaagctgatcactggttgttacaacattctggccaatcatgcagatcctaacagtggactggatgaatccatcctggaggaatgtctccagtacttggaaaagcagctggaaagtagccaggctcgtaaagctatggaggagtttttctctgacagtggagaacttgtacagatcatgatggcaacagccaatgagaacctctctgctaaattctgtaaccgagttttgaaattcttcaccaaactcttccagctgactgagaagagccctaacccgagcctgttgcatctctgtggctccctggcacaactggcctgtgtggaacctgtgcgcctgcaggcctggctcacccgcatgactacatcgcccccaaaagattctgatcagctggatgtaattcaggagaaccggcagctgctgcagttactgaccacatacattgttcgggaaaacagccaagttggggaaggtgtgtgtgctgttcttctgggcaccctgactcccatggcaacagagatgctggccaacggtgatgggactggcttccctgaacttatggttgtgatggccactctggccagtgcaggtcaaggtgctggtcaccttcagcttcataatgctgctgtggattggctgagcagatgcaagaaatacctgtcacagaagaatgtagttgaaaaactgaatgccaatgtaatgcatggaaagcatgtgatgatcttggagtgcacatgccatatcatgtcttacttggctgatgtcacgaatgccctgagccagagtaatggtcaaggcccaagtcatctctcagtggatggggaagagcgggccattgaagtagactcagactgggtggaggagttggcggtggaagaggaagattcccaggctgaggattcagatgaagattctctttgcaataaactctgcacttttacgatcacacagaaagaattcatgaaccagcattggtaccactgtcacacctgtaaaatggtggatggcgtgggtgtctgcacagtgtgtgctaaggtgtgccacaaggatcatgagatttcctatgccaagtatggatccttcttctgtgactgtggagccaaggaagatggcagctgtttggctctggtgaagagaactcctagcagtggcatgagctctaccatgaaggagtcggcatttcagagtgaacccaggatttcagagagtctagtgcgtcatgccagcacctcctcgccagctgacaaagccaaggttaccatcagtgatggaaaggttgctgacgaagagaagcccaagaagagcagcctctgccgcacagtagagggctgccgggaggaattacagaaccaggccaatttctccttcgctcctctcgtgttagacatgcttaatttccttatggatgccattcagaccaacttccagcaagcttcagccgtcgggagcagcagccgtgctcagcaagccctcagtgagctacacactgtggagaaggcagtggagatgacagaccagctgatggttcccaccttagggtcccaggaaggtgcctttgagaatgtgcggatgaattacagtggagaccagggccagaccatccggcagctgatcagtgctcatgtgctcaggcgggtggctatgtgtgtgctctcctctccccatgggcgccgccaacatttggctgtcagccatgagaagggcaagatcaccgttctgcagctctctgcactcctgaagcaagcagattccagcaaaaggaagttaactctgacccgcttggcttctgccccagttccttttactgtgttgagcctcacaggaaatccctgcaaggaagactacttggcggtttgtgggctaaaggactgtcatgtgctcacctttagtagctcaggctctgtttcggatcacttggttttgcaccctcagttggcaacggggaacttcatcatcaaagccgtgtggttacctggttcacagaccgagttagcaattgtcaccgcagactttgttaagatttatgacctgtgtgttgatgccttgagtccaaccttctattttctcctgccaagctcaaagataagagatgttaccttccttttcaatgaggagggaaagaacatcattgttataatgtcttcggctgggtacatctatactcagcttatggaagaggccagcagtgcccagcagggacccttctatgtcactaatgtgttggaaatcaatcatgaggacctgaaggacagtaacagccaggtggcgggcggtggtgtgtccgtgtactactcccacgtgttgcagatgttgttcttcagctattgtcaaggcaaatcattcgcagccaccatcagcaggacaaccctggaggtgttgcaactcttccccatcaacatcaaaagttccaatggtggcagtaagacttctcctgctctttgccagtggtctgaggtgatgaaccaccctggcttggtgtgctgtgtccagcaaactacaggggtgccgctggtagttatggtgaaaccagacacttttcttatccaggagattaagactcttcctgctaaagcgaagatccaagacatggttgctattaggcacacggcctgcaatgagcagcagcggacaacaatgattctgctgtgtgaggatggcagcctgcgcatttacatggccaacgtggagaacacctcctactggctgcagccatccctgcagcccagcagtgtcatcagcatcatgaagcctgttcgaaagcgcaaaacagctacaatcacaacccgcacgtctagccaggtgactttccccattgacttttttgaacacaaccagcagctgacagatgtggagtttggtggtaacgacctcctacaggtctataatgcacaacagataaaacaccggctgaattccactggcatgtatgtggccaacaccaagcccggaggcttcaccattgagattagtaacaacaatagcactatggtgatgacaggcatgcggatccagattgggactcaagcaatagaacgggccccgtcatatatcgagatcttcggcagaactatgcagctcaacctgagtcgctcacgctggtttgacttccccttcaccagagaagaagccctgcaggctgataagaagctgaacctcttcattggggcctcggtggatccagcaggtgtcaccatgatagatgctgtaaaaatttatggcaagactaaggagcagtttggctggcctgatgagcccccagaagaattcccttctgcctctgtcagcaacatctgcccttcaaatctgaaccagagcaacggcactggagatagcgactcagctgcccccactacgaccagtggaactgtcctggagaggctggttgtgagttctttagaagccctggaaagctgctttgccgttggcccaatcatcgagaaggagagaaacaagaatgctgctcaggagctggccactttgctgttgtccctgccagcacctgccagtgtccagcagcagtccaagagccttctggccagcctgcacaccagccgctcggcctaccacagccacaaggatcaggccttgctgagcaaagctgtgcagtgtctcaacacatctagcaaagagggcaaggatttggaccctgaggtgttccagaggctagtgatcacagctcgctccattgccatcatgcgccccaacaaccttgtccactttacggagtcaaagctgccccagatggaaacagactgtttttttcctagatgtgcctgctggagtctagggatagttggcatattgattggggccccacttgaaactccctccccaggcaagcttccttgacctgagttaaccttaaaacaaattaaattccatctcagatttaccatcgttgataattttctttctcctgcttagaaggaatggatgaagggaaggaaccgcagaagcagttggaaggagattgctgtagtttcatcacccagcttgtgaaccacttctggaaactccatgcatccaaacccaagaatgccttcttggcacctgcctgccttccaggactaactcatattgaagctactgtcaatgctctggtggacatcatccatggctactgtacctgtgagctggattgtattaacacagcatccaagatctacatgcagatgctcttgtgtcctgatcctgctgtgagcttctcttgtaaacaagctctaattcgagtcctaaggcccaggaacaaacggagacatgtgactttaccctcttcccctcgaagcaacactccaatgggagacaaggatgatgatgacgatgatgatgcagatgagaaaatgcagtcatcagggatcccgaatggtggtcacatccgtcaggaaagccaggaacagagtgaggtggaccatggagattttgagatggtgtctgagtcgatggtcctggagacagctgaaaatgtcaacaatggcaacccctctcccctggaggccctgctggcaggcgcagagggcttcccccccatgctggacatcccacctgatgcagatgacgagaccatggttgaactagccattgccctgagcctgcagcaggaccaacaagctccagcctcagacgacgagggcagtacagcagcgacagatggttctacccttcggacctctcctgctgaccacggtggtagtgtgggctcggagagcgggggcagtgcagtggactcagtggctggcgagcacagtgtatctggccggagcagtgcttatggcgatgctacagctgaggggcatccggctggaccaggaagtgtcagctcaagcactggagccatcagcaccaccactgggcaccaggagggagatggctccgagggagaaggagaaggagaaactgaaggagatgtccacactagcaacaggctgcacatggtccgtctaatgctgttggagagattactgcagaccctgcctcaattacgaaacgttggcggtgtccgggccatcccatacatgcaggtcattctaatgctcactacagatctggatggagaagatgagaaagacaagggggccctagacaacctgctctcccagcttattgctgagttgggtatggataaaaaggatgtctccaagaagaatgagcgcagcgccctgaatgaagtccatctggtagtaatgagactcctgagtgtcttcatgtcccgcaccaaatctggatccaagtcttccatatgtgagtcatcttccctcatctccagtgccacagcagcagctctactgagctctggggctgtggactactgcctgcacgtgctcaaatcactgctggaatattggaagagccaacagaatgacgaggagcctgtggctaccagccagttgctgaaaccacatactacctcctccccacctgacatgagcccattctttctccgccagtatgtgaagggtcatgctgctgatgtgtttgaggcctatactcagcttctaacagaaatggtactgaggcttccttaccaaatcaaaaagattactgacaccaattctcgaatcccacctcctgtctttgaccactcgtggttttactttctctccgagtacctcatgatccagcagactccatttgtgcgccgtcaagtccgcaaacttctgctcttcatctgtggatccaaagagaagtaccgccagctccgggatttgcacaccctggactctcacgtgcgtgggatcaagaagctgctagaagagcaggggatattcctccgggcaagtgtggttacagccagctcaggctccgccttgcaatatgacacactcatcagcctgatggagcacctgaaagcctgtgcagagattgccgcccagcgaaccatcaactggcagaaattctgcatcaaagatgactccgtcctgtacttcctcctccaagtcagtttccttgtggatgagggcgtgtccccagtgctgctgcaactgctctcctgtgctctctgcggcagcaaggtgctcgctgcactggcagcctcttcgggatcctccagtgcttcttcctcctcagcccctgtggctgccagttctggacaagccacaacacagtccaagtcttccactaaaaagagcaagaaagaagaaaaagaaaaggagaaagatggtgagacctctggcagccaggaggaccagctgtgcacagctctggtgaaccagctgaacaaatttgccgataaggaaaccctgatccagttcctgcgttgtttcctgttagagtccaattcttcctcggtgcgctggcaggcccactgtctgacactgcacatctacagaaattccagcaaatctcaacaggagctcctgctagatctgatgtggtccatctggccagaactcccagcctatggtcgtaaggctgcccagtttgtggacctactaggatatttctccctgaaaactccacaaacagagaagaagttgaaggagtattcacagaaggctgtggagattctgcggactcaaaaccatattcttaccaaccaccccaactcgaacatttataacactttgtctggcttagtggagtttgatggctattacctggagagcgatccctgcctggtgtgtaataacccggaagtaccgttctgttatatcaagctgtcttccattaaagtggacacgcggtacaccaccacccagcaggttgtgaagctcattggcagtcacaccatcagcaaagtgacagtgaaaatcggggatctgaaacggaccaagatggtgcggaccatcaacctgtattataacaaccgaaccgtgcaggccatcgtggagttgaaaaacaagccagctcgctggcacaaagccaagaaggttcagctgacccctggacagacagaggtgaagattgacctgccgttgcccattgtggcctccaatctgatgattgagtttgcagacttctatgaaaactaccaggcctccacagagaccctgcagtgccctcgctgtagtgcctcggtccctgccaacccaggagtctgtggcaactgtggagagaatgtgtaccagtgtcacaaatgcagatccatcaactacgatgaaaaggatcccttcctctgcaatgcctgtggcttctgtaaatatgcccgcttcgacttcatgctctatgccaagccttgctgtgcagtggatcccattgagaatgaagaagaccggaagaaggctgtatccaacatcaatacacttttggacaaagctgatcgagtgtatcatcagctgatgggacaccggccacagctggagaacctgctctgcaaagtgaatgaggcagctccagaaaagccacaggatgactcaggaacagcagggggcatcagctccacttctgccagtgtgaatcgttacatcctgcagttggctcaggagtattgtggagactgcaagaactcttttgatgaactctccaaaatcatccagaaagtctttgcttcgcgcaaagagttgttggaatatgacctacagcagagggaagcagccactaaatcatcccggacctccgtgcagcccacattcactgccagccagtaccgtgccttatccgtcctgggctgtggccacacatcctccaccaagtgctatggctgcgcctcggctgtcacagaacattgtatcacactacttcgggccctggccaccaacccagccttgaggcacatccttgtctcccagggccttatccgggagctctttgattataatcttcgccgaggggctgcggccatgcgggaggaggtccgccagctcatgtgcctcctaactcgagacaacccagaagccacccaacagatgaatgacctgattattggcaaggtctccacagccctgaagggccactgggccaaccccgatctggcaagtagcctgcagtatgaaatgctgctgctgacggattctatctccaaggaggacagctgctgggagctccggttacgctgtgctctcagccttttcctcatggctgtgaacattaagactcctgtggtggttgaaaacattaccctcatgtgcctgaggatcttgcagaagctgataaaaccacctgctcccactagcaagaagaacaaggatgtccccgtcgaggccctcaccacggtgaagccatactgcaatgagatccatgcccaggctcaactgtggctcaagagagaccccaaggcatcctatgatgcctggaagaagtgtcttcctatcagagggatagatggcaatgggaaagcccccagcaaatcagagctccgccatctctatttgactgagaagtatgtgtggaggtggaaacagttcctgagtcgtcgggggaagaggacctcccccttggatctcaaactggggcataacaactggctgcgacaagtgcttttcactccagcaacgcaggccgcacggcaggcagcctgtaccattgtggaagctctagccaccattcccagccgcaagcagcaggtcctggacctgcttaccagttacctggatgagctgagcatagctggggagtgtgcagctgagtacctggctctctaccagaagctcatcacttctgcgcactggaaagtctacttggcagctcggggagtcctaccctatgtgggcaacctcatcaccaaggaaatagctcgtctgctggccctggaggaggctaccctgagtaccgatctgcagcagggttatgcccttaaaagtctcacaggccttctctcctcctttgttgaggtggaatccatcaaaagacattttaaaagtcgcttggtgggtactgtgctgaatggatacctgtgcttgcggaagctggtggtgcagaggaccaagctgatcgatgagacgcaggacatgctgctggagatgctggaggacatgaccacaggtacagaatcagaaaccaaggccttcatggctgtgtgcattgagacagccaagcgctacaatctggatgactaccggaccccggtgttcatcttcgagaggctctgcagcatcatttatcctgaggagaatgaagtcactgagttctttgtgaccctggagaaggatccccaacaagaagacttcttacagggcaggatgcctgggaacccgtatagcagcaatgagccaggcatcgggccgctgatgagggatataaagaacaagatttgccaggactgtgacttagtggccctcctggaagatgacagtggcatggagcttctagtgaacaataaaatcattagtttggaccttcctgtggctgaagtttacaagaaagtctggtgtaccacgaatgagggagagcccatgaggattgtttatcgtatgcgggggctgctgggcgatgccacagaggagttcattgagtccctggactctactacagatgaagaagaagatgaagaagaagtgtataaaatggctggtgtgatggcccagtgtgggggcctggaatgcatgcttaacagactcgcagggatcagagatttcaagcagggacgccaccttctaacagtgctactgaaattgttcagttactgcgtgaaggtgaaagtcaaccggcagcaactggtcaaactggaaatgaacaccttgaacgtcatgctggggaccctaaacctggcccttgtagctgaacaagaaagcaaggacagtgggggtgcagctgtggctgagcaggtgcttagcatcatggagatcattctagatgagtccaatgctgagcccctgagtgaggacaagggcaacctcctcctgacaggtgacaaggatcaactggtgatgctcttggaccagatcaacagcacctttgttcgctccaaccccagtgtgctccagggcctgcttcgcatcatcccgtacctttcctttggagaggtggagaaaatgcagatcttggtggagcgattcaaaccatactgcaactttgataaatatgatgaagatcacagtggtgatgataaagtcttcctggactgcttctgtaaaatagctgctggcatcaagaacaacagcaatgggcaccagctgaaggatctgattctccagaaggggatcacccagaatgcacttgactacatgaaaaagcacatccctagcgccaagaatttggatgccgacatctggaaaaagtttttgtctcgcccagccttgccatttatcctaaggctgcttcggggcctggccatccagcaccctggcacccaggttctgattggaactgattccatcccgaacctgcataagctggagcaggtgtccagtgatgagggcattgggaccttggcagagaacctgctggaagccctgcgggaacaccctgacgtaaacaagaagattgacgcagcccgcagggagacccgggcagagaagaaacgcatggccatggcaatgaggcagaaggccctgggcaccctgggcatgacgacaaatgaaaagggccaggtcgtgaccaagacagcactcctgaagcagatggaagagctgatcgaggagcctggcctcacgtgctgcatctgcagggagggatacaagttccagcccacaaaggtcctgggcatttataccttcacgaagcgggtagccttggaggagttggagaataagccccggaaacagcagggctacagcaccgtgtcccacttcaacattgtgcactacgactgccatctggctgccgtcaggttggctcgaggccgggaagagtgggagagtgccgccctgcagaatgccaacaccaagtgcaacgggctccttccggtctggggacctcatgtccctgaatcagcttttgccacttgcttggcaagacacaacacttacctccaggaatgtacaggccagcgggagcccacgtatcagctcaacatccacgacatcaaactgctcttcctgcgcttcgccatggagcagtcgttcagcgcagacactggcgggggcggccgggagagcaacatccacctgatcccgtacatcattcacactgtgctttacgtcctgaacacaacccgagcaacttcccgagaagagaagaacctccaaggctttctggaacagcccaaggagaagtgggtggagagtgcctttgaagtggacgggccctactatttcacagtcttggcccttcacatcctgccccctgagcagtggagagccacacgtgtggaaatcttgcggaggctgttggtgacctcgcaggctcgggcagtggctccaggtggagccaccaggctgacagataaggcagtgaaggactattccgcttaccgttcttcccttctcttttgggccctcgtcgatctcatttacaacatgtttaagaaggtgcctaccagtaacacagagggaggctggtcctgctctctcgctgagtacatccgccacaacgacatgcccatctacgaagctgccgacaaagccctgaaaaccttccaggaggagttcatgccagtggagaccttctcagagttcctcgatgtggccggtcttttatcagaaatcaccgatccagagagcttcctgaaggacctgttgaactcagtcccctgaccaccacacagcagctgcggcggcgaagacgaagctggcttgccttccaccctctgttctccctccttgtgcattaagttccctccgcgggatgctgcattgttaccccgccctcccctctctcatttttcttggtgtggcttggggtttttaggcttcctgttttatctcgtgtgtgtggtgcaccagctatgaggttgtctgtaacccaagccatcaaagggcctgtacatacctaggagccatgagttgtcccggccagcttcatacttgagtgtgcacatcttgagaaataaacaagtgacttaacacacattgaaaa

SEQ ID NO: 356659 - DNA, 12908 bp, Homo sapiens
gtgacctagaggttccgccacaagcgcgatctcaaaggtccaggtctctttggatgagcatttttctaagatggctgctgagactgatcctcataagtcgtctgagattaccaagaacctacttccagccacgctgcaactcattgacacctatgcatcgttcaccagagcctatttgctgcaaaactttaatgaagagggaacaactgagaaaccttccaaggagaaactgcaaggctttgctgctgttttggctattggctctagcaggtgcaaggcaaatactctgggtccgacactggttcagaatttgccatcgtcagtgcagactgtgtgtgagtcctggaacaacatcaataccaatgaatttcccaatattggatcctggcgcaatgcctttgccaatgacaccatcccttcagagagttatattagtgcagtgcaggctgcacacctggggactctctgtagccaaagtctgcccctggctgcttccctgaagcataccctcctctcactggtcaggttgactggagatcttattgtttggtcagatgagatgaacccaccacaggtaattcggacactgctacctcttcttttggaatcaagcactgagagtgttgccgagatcagtagcaactccctggaacgcatcttgggccctgctgagtctgatgagttcttggctcgtgtttatgagaagctgatcactggttgttacaacattctggccaatcatgcagatcctaacagtggactggatgaatccatcctggaggaatgtctccagtacttggaaaagcagctggaaagtagccaggctcgtaaagctatggaggagtttttctctgacagtggagaacttgtacagatcatgatggcaacagccaatgagaacctctctgctaaattctgtaaccgagttttgaaattcttcaccaaactcttccagctgactgagaagagccctaacccgagcctgttgcatctctgtggctccctggcacaactggcctgtgtggaacctgtgcgcctgcaggcctggctcacccgcatgactacatcgcccccaaaagattctgatcagctggatgtaattcaggagaaccggcagctgctgcagttactgaccacatacattgttcgggaaaacagccaagttggggaaggtgtgtgtgctgttcttctgggcaccctgactcccatggcaacagagatgctggccaacggtgatgggactggcttccctgaacttatggttgtgatggccactctggccagtgcaggtcaaggtgctggtcaccttcagcttcataatgctgctgtggattggctgagcagatgcaagaaatacctgtcacagaagaatgtagttgaaaaactgaatgccaatgtaatgcatggaaagcatgtgatgatcttggagtgcacatgccatatcatgtcttacttggctgatgtcacgaatgccctgagccagagtaatggtcaaggcccaagtcatctctcagtggatggggaagagcgggccattgaagtagactcagactgggtggaggagttggcggtggaagaggaagattcccaggctgaggattcagatgaagattctctttgcaataaactctgcacttttacgatcacacagaaagaattcatgaaccagcattggtaccactgtcacacctgtaaaatggtggatggcgtgggtgtctgcacagtgtgtgctaaggtgtgccacaaggatcatgagatttcctatgccaagtatggatccttcttctgtgactgtggagccaaggaagatggcagctgtttggctctggtgaagagaactcctagcagtggcatgagctctaccatgaaggagtcggcatttcagagtgaacccaggatttcagagagtctagtgcgtcatgccagcacctcctcgccagctgacaaagccaaggttaccatcagtgatggaaaggttgctgacgaagagaagcccaagaagagcagcctctgccgcacagtagagggctgccgggaggaattacagaaccaggccaatttctccttcgctcctctcgtgttagacatgcttaatttccttatggatgccattcagaccaacttccagcaagcttcagccgtcgggagcagcagccgtgctcagcaagccctcagtgagctacacactgtggagaaggcagtggagatgacagaccagctgatggttcccaccttagggtcccaggaaggtgcctttgagaatgtgcggatgaattacagtggagaccagggccagaccatccggcagctgatcagtgctcatgtgctcaggcgggtggctatgtgtgtgctctcctctccccatgggcgccgccaacatttggctgtcagccatgagaagggcaagatcaccgttctgcagctctctgcactcctgaagcaagcagattccagcaaaaggaagttaactctgacccgcttggcttctgccccagttccttttactgtgttgagcctcacaggaaatccctgcaaggaagactacttggcggtttgtgggctaaaggactgtcatgtgctcacctttagtagctcaggctctgtttcggatcacttggttttgcaccctcagttggcaacggggaacttcatcatcaaagccgtgtggttacctggttcacagaccgagttagcaattgtcaccgcagactttgttaagatttatgacctgtgtgttgatgccttgagtccaaccttctattttctcctgccaagctcaaagataagagatgttaccttccttttcaatgaggagggaaagaacatcattgttataatgtcttcggctgggtacatctatactcagcttatggaagaggccagcagtgcccagcagggacccttctatgtcactaatgtgttggaaatcaatcatgaggacctgaaggacagtaacagccaggtggcgggcggtggtgtgtccgtgtactactcccacgtgttgcagatgttgttcttcagctattgtcaaggcaaatcattcgcagccaccatcagcaggacaaccctggaggtgttgcaactcttccccatcaacatcaaaagttccaatggtggcagtaagacttctcctgctctttgccagtggtctgaggtgatgaaccaccctggcttggtgtgctgtgtccagcaaactacaggggtgccgctggtagttatggtgaaaccagacacttttcttatccaggagattaagactcttcctgctaaagcgaagatccaagacatggttgctattaggcacacggcctgcaatgagcagcagcggacaacaatgattctgctgtgtgaggatggcagcctgcgcatttacatggccaacgtggagaacacctcctactggctgcagccatccctgcagcccagcagtgtcatcagcatcatgaagcctgttcgaaagcgcaaaacagctacaatcacaacccgcacgtctagccaggtgactttccccattgacttttttgaacacaaccagcagctgacagatgtggagtttggtggtaacgacctcctacaggtctataatgcacaacagataaaacaccggctgaattccactggcatgtatgtggccaacaccaagcccggaggcttcaccattgagattagtaacaacaatagcactatggtgatgacaggcatgcggatccagattgggactcaagcaatagaacgggccccgtcatatatcgagatcttcggcagaactatgcagctcaacctgagtcgctcacgctggtttgacttccccttcaccagagaagaagccctgcaggctgataagaagctgaacctcttcattggggcctcggtggatccagcaggtgtcaccatgatagatgctgtaaaaatttatggcaagactaaggagcagtttggctggcctgatgagcccccagaagaattcccttctgcctctgtcagcaacatctgcccttcaaatctgaaccagagcaacggcactggagatagcgactcagctgcccccactacgaccagtggaactgtcctggagaggctggttgtgagttctttagaagccctggaaagctgctttgccgttggcccaatcatcgagaaggagagaaacaagaatgctgctcaggagctggccactttgctgttgtccctgccagcacctgccagtgtccagcagcagtccaagagccttctggccagcctgcacaccagccgctcggcctaccacagccacaaggatcaggccttgctgagcaaagctgtgcagtgtctcaacacatctagcaaagagggcaaggatttggaccctgaggtgttccagaggctagtgatcacagctcgctccattgccatcatgcgccccaacaaccttgtccactttacggagtcaaagctgccccagatggaaacagactgtttttttcctagatgtgcctgctggagtctagggatagttggcatattgattggggccccacttgaaactccctccccaggcaagcttccttgacctgagttaaccttaaaacaaattaaattccatctcagatttaccatcgttgataattttctttctcctgcttagaaggaatggatgaagggaaggaaccgcagaagcagttggaaggagattgctgtagtttcatcacccagcttgtgaaccacttctggaaactccatgcatccaaacccaagaatgccttcttggcacctgcctgccttccaggactaactcatattgaagctactgtcaatgctctggtggacatcatccatggctactgtacctgtgagctggattgtattaacacagcatccaagatctacatgcagatgctcttgtgtcctgatcctgctgtgagcttctcttgtaaacaagctctaattcgagtcctaaggcccaggaacaaacggagacatgtgactttaccctcttcccctcgaagcaacactccaatgggagacaaggatgatgatgacgatgatgatgcagatgagaaaatgcagtcatcagggatcccgaatggtggtcacatccgtcaggaaagccaggaacagagtgaggtggaccatggagattttgagatggtgtctgagtcgatggtcctggagacagctgaaaatgtcaacaatggcaacccctctcccctggaggccctgctggcaggcgcagagggcttcccccccatgctggacatcccacctgatgcagatgacgagaccatggttgaactagccattgccctgagcctgcagcaggaccaacaaggcagcagcagcagtgccctgggcctgcagagcctgggactgtccggccaggcacccagctcttcctctctggacgcaggaaccctctctgacaccacagcatcagctccagcctcagacgacgagggcagtacagcagcgacagatggttctacccttcggacctctcctgctgaccacggtggtagtgtgggctcggagagcgggggcagtgcagtggactcagtggctggcgagcacagtgtatctggccggagcagtgcttatggcgatgctacagctgaggggcatccggctggaccaggaagtgtcagctcaagcactggagccatcagcaccaccactgggcaccaggagggagatggctccgagggagaaggagaaggagaaactgaaggagatgtccacactagcaacaggctgcacatggtccgtctaatgctgttggagagattactgcagaccctgcctcaattacgaaacgttggcggtgtccgggccatcccatacatgcaggtcattctaatgctcactacagatctggatggagaagatgagaaagacaagggggccctagacaacctgctctcccagcttattgctgagttgggtatggataaaaaggatgtctccaagaagaatgagcgcagcgccctgaatgaagtccatctggtagtaatgagactcctgagtgtcttcatgtcccgcaccaaatctggatccaagtcttccatatgtgagtcatcttccctcatctccagtgccacagcagcagctctactgagctctggggctgtggactactgcctgcacgtgctcaaatcactgctggaatattggaagagccaacagaatgacgaggagcctgtggctaccagccagttgctgaaaccacatactacctcctccccacctgacatgagcccattctttctccgccagtatgtgaaggccaaagagttctggaggacccagccacctgcttgactctagctttgtcacctataacaccctacacgcagccctgccagcctgcacatttcccaagggtcatgctgctgatgtgtttgaggcctatactcagcttctaacagaaatggtactgaggcttccttaccaaatcaaaaagattactgacaccaattctcgaatcccacctcctgtctttgaccactcgtggttttactttctctccgagtacctcatgatccagcagactccatttgtgcgccgtcaagtccgcaaacttctgctcttcatctgtggatccaaagagaagtaccgccagctccgggatttgcacaccctggactctcacgtgcgtgggatcaagaagctgctagaagagcaggggatattcctccgggcaagtgtggttacagccagctcaggctccgccttgcaatatgacacactcatcagcctgatggagcacctgaaagcctgtgcagagattgccgcccagcgaaccatcaactggcagaaattctgcatcaaagatgactccgtcctgtacttcctcctccaagtcagtttccttgtggatgagggcgtgtccccagtgctgctgcaactgctctcctgtgctctctgcggcagcaaggtgctcgctgcactggcagcctcttcgggatcctccagtgcttcttcctcctcagcccctgtggctgccagttctggacaagccacaacacagtccaagtcttccactaaaaagagcaagaaagaagaaaaagaaaaggagaaagatggtgagacctctggcagccaggaggaccagctgtgcacagctctggtgaaccagctgaacaaatttgccgataaggaaaccctgatccagttcctgcgttgtttcctgttagagtccaattcttcctcggtgcgctggcaggcccactgtctgacactgcacatctacagaaattccagcaaatctcaacaggagctcctgctagatctgatgtggtccatctggccagaactcccagcctatggtcgtaaggctgcccagtttgtggacctactaggatatttctccctgaaaactccacaaacagagaagaagttgaaggagtattcacagaaggctgtggagattctgcggactcaaaaccatattcttaccaaccaccccaactcgaacatttataacactttgtctggcttagtggagtttgatggctattacctggagagcgatccctgcctggtgtgtaataacccggaagtaccgttctgttatatcaagctgtcttccattaaagtggacacgcggtacaccaccacccagcaggttgtgaagctcattggcagtcacaccatcagcaaagtgacagtgaaaatcggggatctgaaacggaccaagatggtgcggaccatcaacctgtattataacaaccgaaccgtgcaggccatcgtggagttgaaaaacaagccagctcgctggcacaaagccaagaaggttcagctgacccctggacagacagaggtgaagattgacctgccgttgcccattgtggcctccaatctgatgattgagtttgcagacttctatgaaaactaccaggcctccacagagaccctgcagtgccctcgctgtagtgcctcggtccctgccaacccaggagtctgtggcaactgtggagagaatgtgtaccagtgtcacaaatgcagatccatcaactacgatgaaaaggatcccttcctctgcaatgcctgtggcttctgtaaatatgcccgcttcgacttcatgctctatgccaagccttgctgtgcagtggatcccattgagaatgaagaagaccggaagaaggctgtatccaacatcaatacacttttggacaaagctgatcgagtgtatcatcagctgatgggacaccggccacagctggagaacctgctctgcaaagtgaatgaggcagctccagaaaagccacaggtagtcccacgctgcaaagggcatttggataagggcttgggtcttgatcagaagactgcctcctaggtgagatcaccttaggtggggagcctgacagcttacctcttggggttgcaggatgactcaggaacagcagggggcatcagctccacttctgccagtgtgaatcgttacatcctgcagttggctcaggagtattgtggagactgcaagaactcttttgatgaactctccaaaatcatccagaaagtctttgcttcgcgcaaagagttgttggaatatgacctacagcagagggaagcagccactaaatcatcccggacctccgtgcagcccacattcactgccagccagtaccgtgccttatccgtcctgggctgtggccacacatcctccaccaagtgctatggctgcgcctcggctgtcacagaacattgtatcacactacttcgggccctggccaccaacccagccttgaggcacatccttgtctcccagggccttatccgggagctctttgattataatcttcgccgaggggctgcggccatgcgggaggaggtccgccagctcatgtgcctcctaactcgagacaacccagaagccacccaacagatgaatgacctgattattggcaaggtctccacagccctgaagggccactgggccaaccccgatctggcaagtagcctgcagtatgaaatgctgctgctgacggattctatctccaaggaggacagctgctgggagctccggttacgctgtgctctcagccttttcctcatggctgtgaacattaagactcctgtggtggttgaaaacattaccctcatgtgcctgaggatcttgcagaagctgataaaaccacctgctcccactagcaagaagaacaaggatgtccccgtcgaggccctcaccacggtgaagccatactgcaatgagatccatgcccaggctcaactgtggctcaagagagaccccaaggcatcctatgatgcctggaagaagtgtcttcctatcagagggatagatggcaatgggaaagcccccagcaaatcagagctccgccatctctatttgactgagaagtatgtgtggaggtggaaacagttcctgagtcgtcgggggaagaggacctcccccttggatctcaaactggggcataacaactggctgcgacaagtgcttttcactccagcaacgcaggccgcacggcaggcagcctgtaccattgtggaagctctagccaccattcccagccgcaagcagcaggtcctggacctgcttaccagttacctggatgagctgagcatagctggggagtgtgcagctgagtacctggctctctaccagaagctcatcacttctgcgcactggaaagtctacttggcagctcggggagtcctaccctatgtgggcaacctcatcaccaaggaaatagctcgtctgctggccctggaggaggctaccctgagtaccgatctgcagcagggttatgcccttaaaagtctcacaggccttctctcctcctttgttgaggtggaatccatcaaaagacattttaaaagtcgcttggtgggtactgtgctgaatggatacctgtgcttgcggaagctggtggtgcagaggaccaagctgatcgatgagacgcaggacatgctgctggagatgctggaggacatgaccacaggtacagaatcagaaaccaaggccttcatggctgtgtgcattgagacagccaagcgctacaatctggatgactaccggaccccggtgttcatcttcgagaggctctgcagcatcatttatcctgaggagaatgaagtcactgagttctttgtgaccctggagaaggatccccaacaagaagacttcttacagggcaggatgcctgggaacccgtatagcagcaatgagccaggcatcgggccgctgatgagggatataaagaacaagatttgccaggactgtgacttagtggccctcctggaagatgacagtggcatggagcttctagtgaacaataaaatcattagtttggaccttcctgtggctgaagtttacaagaaagtctggtgtaccacgaatgagggagagcccatgaggattgtttatcgtatgcgggggctgctgggcgatgccacagaggagttcattgagtccctggactctactacagatgaagaagaagatgaagaagaagtgtataaaatggctggtgtgatggcccagtgtgggggcctggaatgcatgcttaacagactcgcagggatcagagatttcaagcagggacgccaccttctaacagtgctactgaaattgttcagttactgcgtgaaggtgaaagtcaaccggcagcaactggtcaaactggaaatgaacaccttgaacgtcatgctggggaccctaaacctggcccttgtagctgaacaagaaagcaaggacagtgggggtgcagctgtggctgagcaggtgcttagcatcatggagatcattctagatgagtccaatgctgagcccctgagtgaggacaagggcaacctcctcctgacaggtgacaaggatcaactggtgatgctcttggaccagatcaacagcacctttgttcgctccaaccccagtgtgctccagggcctgcttcgcatcatcccgtacctttcctttggagaggtggagaaaatgcagatcttggtggagcgattcaaaccatactgcaactttgataaatatgatgaagatcacagtggtgatgataaagtcttcctggactgcttctgtaaaatagctgctggcatcaagaacaacagcaatgggcaccagctgaaggatctgattctccagaaggggatcacccagaatgcacttgactacatgaaaaagcacatccctagcgccaagaatttggatgccgacatctggaaaaagtttttgtctcgcccagccttgccatttatcctaaggctgcttcggggcctggccatccagcaccctggcacccaggttctgattggaactgattccatcccgaacctgcataagctggagcaggtgtccagtgatgagggcattgggaccttggcagagaacctgctggaagccctgcgggaacaccctgacgtaaacaagaagattgacgcagcccgcagggagacccgggcagagaagaaacgcatggccatggcaatgaggcagaaggccctgggcaccctgggcatgacgacaaatgaaaagggccaggtcgtgaccaagacagcactcctgaagcagatggaagagctgatcgaggagcctggcctcacgtgctgcatctgcagggagggatacaagttccagcccacaaaggtcctgggcatttataccttcacgaagcgggtagccttggaggagttggagaataagccccggaaacagcagggctacagcaccgtgtcccacttcaacattgtgcactacgactgccatctggctgccgtcaggttggctcgaggccgggaagagtgggagagtgccgccctgcagaatgccaacaccaagtgcaacgggctccttccggtctggggacctcatgtccctgaatcagcttttgccacttgcttggcaagacacaacacttacctccaggaatgtacaggccagcgggagcccacgtatcagctcaacatccacgacatcaaactgctcttcctgcgcttcgccatggagcagtcgttcagcgcagacactggcgggggcggccgggagagcaacatccacctgatcccgtacatcattcacactgtgctttacgtcctgaacacaacccgagcaacttcccgagaagagaagaacctccaaggctttctggaacagcccaaggagaagtgggtggagagtgcctttgaagtggacgggccctactatttcacagtcttggcccttcacatcctgccccctgagcagtggagagccacacgtgtggaaatcttgcggaggctgttggtgacctcgcaggctcgggcagtggctccaggtggagccaccaggctgacagataaggcagtgaaggactattccgcttaccgttcttcccttctcttttgggccctcgtcgatctcatttacaacatgtttaagaaggtgcctaccagtaacacagagggaggctggtcctgctctctcgctgagtacatccgccacaacgacatgcccatctacgaagctgccgacaaagccctgaaaaccttccaggaggagttcatgccagtggagaccttctcagagttcctcgatgtggccggtcttttatcagaaatcaccgatccagagagcttcctgaaggacctgttgaactcagtcccctgaccaccacacagcagctgcggcggcgaagacgaagctggcttgccttccaccctctgttctccctccttgtgcattaagttccctccgcgggatgctgcattgttaccccgccctcccctctctcatttttcttggtgtggcttggggtttttaggcttcctgttttatctcgtgtgtgtggtgcaccagctatgaggttgtctgtaacccaagccatcaaagggcctgtacatacctaggagccatgagttgtcccggccagcttcatacttgagtgtgcacatcttgagaaataaacaagtgacttaacacacattgaaaa

SEQ ID NO: 356660 - DNA, 3022 bp, Homo sapiens
aatcagctcggtcctttcacagcggagatgctggaggacatgaccacaggtacagaatcagaaaccaaggccttcatggctgtgtgcattgagacagccaagcgctacaatctggatgactaccggaccccggtgttcatcttcgagaggctctgcagcatcatttatcctgaggagaatgaagtcactgagttctttgtgaccctggagaaggatccccaacaagaagacttcttacagggcaggatgcctgggaacccgtatagcagcaatgagccaggcatcgggccgctgatgagggatataaagaacaagatttgccaggactgtgacttagtggccctcctggaagatgacagtggcatggagcttctagtgaacaataaaatcattagtttggaccttcctgtggctgaagtttacaagaaagtctggtgtaccacgaatgagggagagcccatgaggattgtttatcgtatgcgggggctgctgggcgatgccacagaggagttcattgagtccctggactctactacagatgaagaagaagatgaagaagaagtgtataaaatggctggtgtgatggcccagtgtgggggcctggaatgcatgcttaacagactcgcagggatcagagatttcaagcagggacgccaccttctaacagtgctactgaaattgttcagttactgcgtgaaggtgaaagtcaaccggcagcaactggtcaaactggaaatgaacaccttgaacgtcatgctggggaccctaaacctggcccttgtagctgaacaagaaagcaaggacagtgggggtgcagctgtggctgagcaggtgcttagcatcatggagatcattctagatgagtccaatgctgagcccctgagtgaggacaagggcaacctcctcctgacaggtgacaaggatcaactggtgatgctcttggaccagatcaacagcacctttgttcgctccaaccccagtgtgctccagggcctgcttcgcatcatcccgtacctttcctttggagaggtggagaaaatgcagatcttggtggagcgattcaaaccatactgcaactttgataaatatgatgaagatcacagtggtgatgataaagtcttcctggactgcttctgtaaaatagctgctggcatcaagaacaacagcaatgggcaccagctgaaggatctgattctccagaaggggatcacccagaatgcacttgactacatgaaaaagcacatccctagcgccaagaatttggatgccgacatctggaaaaagtttttgtctcgcccagccttgccatttatcctaaggctgcttcggggcctggccatccagcaccctggcacccaggttctgattggaactgattccatcccgaacctgcataagctggagcaggtgtccagtgatgagggcattgggaccttggcagagaacctgctggaagccctgcgggaacaccctgacgtaaacaagaagattgacgcagcccgcagggagacccgggcagagaagaaacgcatggccatggcaatgaggcagaaggccctgggcaccctgggcatgacgacaaatgaaaagggccaggtcgtgaccaagacagcactcctgaagcagatggaagagctgatcgaggagcctggcctcacgtgctgcatctgcagggagggatacaagttccagcccacaaaggtcctgggcatttataccttcacgaagcgggtagccttggaggagttggagaataagccccggaaacagcagggctacagcaccgtgtcccacttcaacattgtgcactacgactgccatctggctgccgtcaggttggctcgaggccgggaagagtgggagagtgccgccctgcagaatgccaacaccaagtgcaacgggctccttccggtctggggacctcatgtccctgaatcagcttttgccacttgcttggcaagacacaacacttacctccaggaatgtacaggccagcgggagcccacgtatcagctcaacatccacgacatcaaactgctcttcctgcgcttcgccatggagcagtcgttcagcgcagacactggcgggggcggccgggagagcaacatccacctgatcccgtacatcattcacactgtgctttacgtcctgaacacaacccgagcaacttcccgagaagagaagaacctccaaggctttctggaacagcccaaggagaagtgggtggagagtgcctttgaagtggacgggccctactatttcacagtcttggcccttcacatcctgccccctgagcagtggagagccacacgtgtggaaatcttgcggaggctgttggtgacctcgcaggctcgggcagtggctccaggtggagccaccaggctgacagataaggcagtgaaggactattccgcttaccgttcttcccttctcttttgggccctcgtcgatctcatttacaacatgtttaagaaggtgcctaccagtaacacagagggaggctggtcctgctctctcgctgagtacatccgccacaacgacatgcccatctacgaagctgccgacaaagccctgaaaaccttccaggaggagttcatgccagtggagaccttctcagagttcctcgatgtggccggtcttttatcagaaatcaccgatccagagagcttcctgaaggacctgttgaactcagtcccctgaccaccacacagcagctgcggcggcgaagacgaagctggcttgccttccaccctctgttctccctccttgtgcattaagttccctccgcgggatgctgcattgttaccccgccctcccctctctcatttttcttggtgtggcttggggtttttaggcttcctgttttatctcgtgtgtgtggtgcaccagctatgaggttgtctgtaacccaagccatcaaagggcctgtacatacctaggagccatgagttgtcccggccagcttcatacttgagtgtgcacatcttgagaaataaacaagtgacttaacacacattgaaaa

SEQ ID NO: 356661 - DNA, 2914 bp, Homo sapiens
cccaacaagagtgtaaagctgtttagaaaatacacagaaatgtacagactaaaaaagggaattatttcttaatggagaatctattactgctgtaactggtgtaaagatccccaacaagaagacttcttacagggcaggatgcctgggaacccgtatagcagcaatgagccaggcatcgggccgctgatgagggatataaagaacaagatttgccaggactgtgacttagtggccctcctggaagatgacagtggcatggagcttctagtgaacaataaaatcattagtttggaccttcctgtggctgaagtttacaagaaagtctggtgtaccacgaatgagggagagcccatgaggattgtttatcgtatgcgggggctgctgggcgatgccacagaggagttcattgagtccctggactctactacagatgaagaagaagatgaagaagaagtgtataaaatggctggtgtgatggcccagtgtgggggcctggaatgcatgcttaacagactcgcagggatcagagatttcaagcagggacgccaccttctaacagtgctactgaaattgttcagttactgcgtgaaggtgaaagtcaaccggcagcaactggtcaaactggaaatgaacaccttgaacgtcatgctggggaccctaaacctggcccttgtagctgaacaagaaagcaaggacagtgggggtgcagctgtggctgagcaggtgcttagcatcatggagatcattctagatgagtccaatgctgagcccctgagtgaggacaagggcaacctcctcctgacaggtgacaaggatcaactggtgatgctcttggaccagatcaacagcacctttgttcgctccaaccccagtgtgctccagggcctgcttcgcatcatcccgtacctttcctttggagaggtggagaaaatgcagatcttggtggagcgattcaaaccatactgcaactttgataaatatgatgaagatcacagtggtgatgataaagtcttcctggactgcttctgtaaaatagctgctggcatcaagaacaacagcaatgggcaccagctgaaggatctgattctccagaaggggatcacccagaatgcacttgactacatgaaaaagcacatccctagcgccaagaatttggatgccgacatctggaaaaagtttttgtctcgcccagccttgccatttatcctaaggctgcttcggggcctggccatccagcaccctggcacccaggttctgattggaactgattccatcccgaacctgcataagctggagcaggtgtccagtgatgagggcattgggaccttggcagagaacctgctggaagccctgcgggaacaccctgacgtaaacaagaagattgacgcagcccgcagggagacccgggcagagaagaaacgcatggccatggcaatgaggcagaaggccctgggcaccctgggcatgacgacaaatgaaaagggccaggtcgtgaccaagacagcactcctgaagcagatggaagagctgatcgaggagcctggcctcacgtgctgcatctgcagggagggatacaagttccagcccacaaaggtcctgggcatttataccttcacgaagcgggtagccttggaggagttggagaataagccccggaaacagcagggctacagcaccgtgtcccacttcaacattgtgcactacgactgccatctggctgccgtcaggttggctcgaggccgggaagagtgggagagtgccgccctgcagaatgccaacaccaagtgcaacgggctccttccggtctggggacctcatgtccctgaatcagcttttgccacttgcttggcaagacacaacacttacctccaggaatgtacaggccagcgggagcccacgtatcagctcaacatccacgacatcaaactgctcttcctgcgcttcgccatggagcagtcgttcagcgcagacactggcgggggcggccgggagagcaacatccacctgatcccgtacatcattcacactgtgctttacgtcctgaacacaacccgagcaacttcccgagaagagaagaacctccaaggctttctggaacagcccaaggagaagtgggtggagagtgcctttgaagtggacgggccctactatttcacagtcttggcccttcacatcctgccccctgagcagtggagagccacacgtgtggaaatcttgcggaggctgttggtgacctcgcaggctcgggcagtggctccaggtggagccaccaggctgacagataaggcagtgaaggactattccgcttaccgttcttcccttctcttttgggccctcgtcgatctcatttacaacatgtttaagaaggtgcctaccagtaacacagagggaggctggtcctgctctctcgctgagtacatccgccacaacgacatgcccatctacgaagctgccgacaaagccctgaaaaccttccaggaggagttcatgccagtggagaccttctcagagttcctcgatgtggccggtcttttatcagaaatcaccgatccagagagcttcctgaaggacctgttgaactcagtcccctgaccaccacacagcagctgcggcggcgaagacgaagctggcttgccttccaccctctgttctccctccttgtgcattaagttccctccgcgggatgctgcattgttaccccgccctcccctctctcatttttcttggtgtggcttggggtttttaggcttcctgttttatctcgtgtgtgtggtgcaccagctatgaggttgtctgtaacccaagccatcaaagggcctgtacatacctaggagccatgagttgtcccggccagcttcatacttgagtgtgcacatcttgagaaataaacaagtgacttaacacacattgaaaa

SEQ ID NO: 356662 - DNA, 3402 bp, Homo sapiens
gagcacatatactaaaattggaacgatacagagaagattagcatggcccctgcgcaaggatgacacgcaaattcgtgaagcgttccatattttaggcggtatgagtttggctgggggccgggcaccccggaagaccgctgggaaccggctttctgggcttttggaggcagaggaggaagatgagttctaccagacgacttatgggggtttcacagaggaatccggagatgatgagtatcaaggggaccagtcagacacagaggacgaagtggactctgactttgacattgatgaaggggatgaaccatccagtgatggagaagcagaagagccaagaaggaagcgccgagtagtcaccaaggcctataaggaacctctcaagagcttaaggcctcgaaaggtcaacaccccggctggtagctctcagaaggcgcgagaagagaaggcactactgccattagaactacaagatgacggctctgacagtcggaagtctatgcgtcagtctacagctgagcatacacgacaaacgttccttcgggtacaggagaggcagggccagtcaagacggcgaaaggggccccactgtgagcggccactaacccaggaggaactgctccgggaggccaagatcacagaagagcttaatttacggtcactggagacatatgagcggctcgaggctgataaaaagaagcaggttcataagaagcggaagtgccccgggcccataatcacctatcattcagtgacagtgccacttgttggggagccaggccccaaggaagagaacgttgacatagaaggacttgatcctgctccctcggtgtctgcattgactcctcatgctgggactggacccgtcaacccccctgctcgctgctcacgtaccttcatcacttttagtgatgatgcaactttcgaggaatggttcccccaagggcggcccccaaaagtccctgttcgtgaggtctgtccagtgacccatcgtccagccctataccgggaccctgttacagacataccctatgccactgctcgagccttcaagatcattcgtgaggcttacaagaagtacattactgcccatggactgccgcccactgcctcagccaacaagcgcctggaggcgcttgctggggaccctaaacctggcccttgtagctgaacaagaaagcaaggacagtgggggtgcagctgtggctgagcaggtgcttagcatcatggagatcattctagatgagtccaatgctgagcccctgagtgaggacaagggcaacctcctcctgacaggtgacaaggatcaactggtgatgctcttggaccagatcaacagcacctttgttcgctccaaccccagtgtgctccagggcctgcttcgcatcatcccgtacctttcctttggagaggtggagaaaatgcagatcttggtggagcgattcaaaccatactgcaactttgataaatatgatgaagatcacagtggtgatgataaagtcttcctggactgcttctgtaaaatagctgctggcatcaagaacaacagcaatgggcaccagctgaaggatctgattctccagaaggggatcacccagaatgcacttgactacatgaaaaagcacatccctagcgccaagaatttggatgccgacatctggaaaaagtttttgtctcgcccagccttgccatttatcctaaggctgcttcggggcctggccatccagcaccctggcacccaggttctgattggaactgattccatcccgaacctgcataagctggagcaggtgtccagtgatgagggcattgggaccttggcagagaacctgctggaagccctgcgggaacaccctgacgtaaacaagaagattgacgcagcccgcagggagacccgggcagagaagaaacgcatggccatggcaatgaggcagaaggccctgggcaccctgggcatgacgacaaatgaaaagggccaggtcgtgaccaagacagcactcctgaagcagatggaagagctgatcgaggagcctggcctcacgtgctgcatctgcagggagggatacaagttccagcccacaaaggtcctgggcatttataccttcacgaagcgggtagccttggaggagttggagaataagccccggaaacagcagggctacagcaccgtgtcccacttcaacattgtgcactacgactgccatctggctgccgtcaggttggctcgaggccgggaagagtgggagagtgccgccctgcagaatgccaacaccaagtgcaacgggctccttccggtctggggacctcatgtccctgaatcagcttttgccacttgcttggcaagacacaacacttacctccaggaatgtacaggccagcgggagcccacgtatcagctcaacatccacgacatcaaactgctcttcctgcgcttcgccatggagcagtcgttcagcgcagacactggcgggggcggccgggagagcaacatccacctgatcccgtacatcattcacactgtgctttacgtcctgaacacaacccgagcaacttcccgagaagagaagaacctccaaggctttctggaacagcccaaggagaagtgggtggagagtgcctttgaagtggacgggccctactatttcacagtcttggcccttcacatcctgccccctgagcagtggagagccacacgtgtggaaatcttgcggaggctgttggtgacctcgcaggctcgggcagtggctccaggtggagccaccaggctgacagataaggcagtgaaggactattccgcttaccgttcttcccttctcttttgggccctcgtcgatctcatttacaacatgtttaagaaggtgcctaccagtaacacagagggaggctggtcctgctctctcgctgagtacatccgccacaacgacatgcccatctacgaagctgccgacaaagccctgaaaaccttccaggaggagttcatgccagtggagaccttctcagagttcctcgatgtggccggtcttttatcagaaatcaccgatccagagagcttcctgaaggacctgttgaactcagtcccctgaccaccacacagcagctgcggcggcgaagacgaagctggcttgccttccaccctctgttctccctccttgtgcattaagttccctccgcgggatgctgcattgttaccccgccctcccctctctcatttttcttggtgtggcttggggtttttaggcttcctgttttatctcgtgtgtgtggtgcaccagctatgaggttgtctgtaacccaagccatcaaagggcctgtacatacctaggagccatgagttgtcccggccagcttcatacttgagtgtgcacatcttgagaaataaacaagtgacttaacacacattgaaaa

SEQ ID NO: 356663 - DNA, 3257 bp, Homo sapiens
gagcacatatactaaaattggaacgatacagagaagattagcatggcccctgcgcaaggatgacacgcaaattcgtgaagcgttccatattttaggcggtatgagtttggctgggggccgggcaccccggaagaccgctgggaaccggctttctgggcttttggaggcagaggaggaagatgagttctaccagacgacttatgggggtttcacagaggaatccggagatgatgagtatcaaggggaccagtcagacacagaggacgaagtggactctgactttgacattgatgaaggggatgaaccatccagtgatggagaagcagaagagccaagaaggaagcgccgagtagtcaccaaggcctataaggaacctctcaagagcttaaggcctcgaaaggtcaacaccccggctggtagctctcagaaggcgcgagaagagaaggcactactgccattagaactacaagatgacggctctgacagtcggaagtctatgcgtcagtctacagctgagcatacacgacaaacgttccttcgggtacaggagaggcagggccagtcaagacggcgaaaggggccccactgtgagcggccactaacccaggaggaactgctccgggaggccaagatcacagaagagcttaatttacggtcactggacttgatcctgctccctcggtgtctgcattgactcctcatgctgggactggacccgtcaacccccctgctcgctgctcacgtaccttcatcacttttagtgatgatgcaactttcgaggaatggttcccccaagggcggcccccaaaagtccctgttcgtgaggtctgtccagtgacccatcgtccagccctataccgggaccctgttacagacataccctatgccactgctcgagccttcaagatcattcgtgaggcttacaagaagtacattactgcccatggactgccgcccactgcctcagccaacaagcgcctggaggcgcttgctggggaccctaaacctggcccttgtagctgaacaagaaagcaaggacagtgggggtgcagctgtggctgagcaggtgcttagcatcatggagatcattctagatgagtccaatgctgagcccctgagtgaggacaagggcaacctcctcctgacaggtgacaaggatcaactggtgatgctcttggaccagatcaacagcacctttgttcgctccaaccccagtgtgctccagggcctgcttcgcatcatcccgtacctttcctttggagaggtggagaaaatgcagatcttggtggagcgattcaaaccatactgcaactttgataaatatgatgaagatcacagtggtgatgataaagtcttcctggactgcttctgtaaaatagctgctggcatcaagaacaacagcaatgggcaccagctgaaggatctgattctccagaaggggatcacccagaatgcacttgactacatgaaaaagcacatccctagcgccaagaatttggatgccgacatctggaaaaagtttttgtctcgcccagccttgccatttatcctaaggctgcttcggggcctggccatccagcaccctggcacccaggttctgattggaactgattccatcccgaacctgcataagctggagcaggtgtccagtgatgagggcattgggaccttggcagagaacctgctggaagccctgcgggaacaccctgacgtaaacaagaagattgacgcagcccgcagggagacccgggcagagaagaaacgcatggccatggcaatgaggcagaaggccctgggcaccctgggcatgacgacaaatgaaaagggccaggtcgtgaccaagacagcactcctgaagcagatggaagagctgatcgaggagcctggcctcacgtgctgcatctgcagggagggatacaagttccagcccacaaaggtcctgggcatttataccttcacgaagcgggtagccttggaggagttggagaataagccccggaaacagcagggctacagcaccgtgtcccacttcaacattgtgcactacgactgccatctggctgccgtcaggttggctcgaggccgggaagagtgggagagtgccgccctgcagaatgccaacaccaagtgcaacgggctccttccggtctggggacctcatgtccctgaatcagcttttgccacttgcttggcaagacacaacacttacctccaggaatgtacaggccagcgggagcccacgtatcagctcaacatccacgacatcaaactgctcttcctgcgcttcgccatggagcagtcgttcagcgcagacactggcgggggcggccgggagagcaacatccacctgatcccgtacatcattcacactgtgctttacgtcctgaacacaacccgagcaacttcccgagaagagaagaacctccaaggctttctggaacagcccaaggagaagtgggtggagagtgcctttgaagtggacgggccctactatttcacagtcttggcccttcacatcctgccccctgagcagtggagagccacacgtgtggaaatcttgcggaggctgttggtgacctcgcaggctcgggcagtggctccaggtggagccaccaggctgacagataaggcagtgaaggactattccgcttaccgttcttcccttctcttttgggccctcgtcgatctcatttacaacatgtttaagaaggtgcctaccagtaacacagagggaggctggtcctgctctctcgctgagtacatccgccacaacgacatgcccatctacgaagctgccgacaaagccctgaaaaccttccaggaggagttcatgccagtggagaccttctcagagttcctcgatgtggccggtcttttatcagaaatcaccgatccagagagcttcctgaaggacctgttgaactcagtcccctgaccaccacacagcagctgcggcggcgaagacgaagctggcttgccttccaccctctgttctccctccttgtgcattaagttccctccgcgggatgctgcattgttaccccgccctcccctctctcatttttcttggtgtggcttggggtttttaggcttcctgttttatctcgtgtgtgtggtgcaccagctatgaggttgtctgtaacccaagccatcaaagggcctgtacatacctaggagccatgagttgtcccggccagcttcatacttgagtgtgcacatcttgagaaataaacaagtgacttaacacacattgaaaa

SEQ ID NO: 356664 - DNA, 2635 bp, Homo sapiens
gtgtctagccgatcccttctttggtcaggacatagaaggcacttgatcctgctccctcggtgtctgcattgactcctcatgctgggactggacccgtcaacccccctgctcgctgctcacgtaccttcatcacttttagtgatgatgcaactttcgaggaatggttcccccaagggcggcccccaaaagtccctgttcgtgaggtctgtccagtgacccatcgtccagccctataccgggaccctgttacagacataccctatgccactgctcgagccttcaagatcattcgtgaggcttacaagaagtacattactgcccatggactgccgcccactgcctcagccaacaagcgcctggaggcgcttgctggggaccctaaacctggcccttgtagctgaacaagaaagcaaggacagtgggggtgcagctgtggctgagcaggtgcttagcatcatggagatcattctagatgagtccaatgctgagcccctgagtgaggacaagggcaacctcctcctgacaggtgacaaggatcaactggtgatgctcttggaccagatcaacagcacctttgttcgctccaaccccagtgtgctccagggcctgcttcgcatcatcccgtacctttcctttggagaggtggagaaaatgcagatcttggtggagcgattcaaaccatactgcaactttgataaatatgatgaagatcacagtggtgatgataaagtcttcctggactgcttctgtaaaatagctgctggcatcaagaacaacagcaatgggcaccagctgaaggatctgattctccagaaggggatcacccagaatgcacttgactacatgaaaaagcacatccctagcgccaagaatttggatgccgacatctggaaaaagtttttgtctcgcccagccttgccatttatcctaaggctgcttcggggcctggccatccagcaccctggcacccaggttctgattggaactgattccatcccgaacctgcataagctggagcaggtgtccagtgatgagggcattgggaccttggcagagaacctgctggaagccctgcgggaacaccctgacgtaaacaagaagattgacgcagcccgcagggagacccgggcagagaagaaacgcatggccatggcaatgaggcagaaggccctgggcaccctgggcatgacgacaaatgaaaagggccaggtcgtgaccaagacagcactcctgaagcagatggaagagctgatcgaggagcctggcctcacgtgctgcatctgcagggagggatacaagttccagcccacaaaggtcctgggcatttataccttcacgaagcgggtagccttggaggagttggagaataagccccggaaacagcagggctacagcaccgtgtcccacttcaacattgtgcactacgactgccatctggctgccgtcaggttggctcgaggccgggaagagtgggagagtgccgccctgcagaatgccaacaccaagtgcaacgggctccttccggtctggggacctcatgtccctgaatcagcttttgccacttgcttggcaagacacaacacttacctccaggaatgtacaggccagcgggagcccacgtatcagctcaacatccacgacatcaaactgctcttcctgcgcttcgccatggagcagtcgttcagcgcagacactggcgggggcggccgggagagcaacatccacctgatcccgtacatcattcacactgtgctttacgtcctgaacacaacccgagcaacttcccgagaagagaagaacctccaaggctttctggaacagcccaaggagaagtgggtggagagtgcctttgaagtggacgggccctactatttcacagtcttggcccttcacatcctgccccctgagcagtggagagccacacgtgtggaaatcttgcggaggctgttggtgacctcgcaggctcgggcagtggctccaggtggagccaccaggctgacagataaggcagtgaaggactattccgcttaccgttcttcccttctcttttgggccctcgtcgatctcatttacaacatgtttaagaaggtgcctaccagtaacacagagggaggctggtcctgctctctcgctgagtacatccgccacaacgacatgcccatctacgaagctgccgacaaagccctgaaaaccttccaggaggagttcatgccagtggagaccttctcagagttcctcgatgtggccggtcttttatcagaaatcaccgatccagagagcttcctgaaggacctgttgaactcagtcccctgaccaccacacagcagctgcggcggcgaagacgaagctggcttgccttccaccctctgttctccctccttgtgcattaagttccctccgcgggatgctgcattgttaccccgccctcccctctctcatttttcttggtgtggcttggggtttttaggcttcctgttttatctcgtgtgtgtggtgcaccagctatgaggttgtctgtaacccaagccatcaaagggcctgtacatacctaggagccatgagttgtcccggccagcttcatacttgagtgtgcacatcttgagaaataaacaagtgacttaacacacattgaaaa

SEQ ID NO: 356665 - DNA, 12483 bp, Homo sapiens
gtgacctagaggttccgccacaagcgcgatctcaaaggtccaggtctctttggatgagcatttttctaagatggctgctgagactgatcctcataagtcgtctgagattaccaagaacctacttccagccacgctgcaactcattgacacctatgcatcgttcaccagagcctatttgctgcaaaactttaatgaagagggaacaactgagaaaccttccaaggagaaactgcaaggctttgctgctgttttggctattggctctagcaggtgcaaggcaaatactctgggtccgacactggttcagaatttgccatcgtcagtgcagactgtgtgtgagtcctggaacaacatcaataccaatgaatttcccaatattggatcctggcgcaatgcctttgccaatgacaccatcccttcagagagttatattagtgcagtgcaggctgcacacctggggactctctgtagccaaagtctgcccctggctgcttccctgaagcataccctcctctcactggtcaggttgactggagatcttattgtttggtcagatgagatgaacccaccacaggtaattcggacactgctacctcttcttttggaatcaagcactgagagtgttgccgagatcagtagcaactccctggaacgcatcttgggccctgctgagtctgatgagttcttggctcgtgtttatgagaagctgatcactggttgttacaacattctggccaatcatgcagatcctaacagtggactggatgaatccatcctggaggaatgtctccagtacttggaaaagcagctggaaagtagccaggctcgtaaagctatggaggagtttttctctgacagtggagaacttgtacagatcatgatggcaacagccaatgagaacctctctgctaaattctgtaaccgagttttgaaattcttcaccaaactcttccagctgactgagaagagccctaacccgagcctgttgcatctctgtggctccctggcacaactggcctgtgtggaacctgtgcgcctgcaggcctggctcacccgcatgactacatcgcccccaaaagattctgatcagctggatgtaattcaggagaaccggcagctgctgcagttactgaccacatacattgttcgggaaaacagccaagttggggaaggtgtgtgtgctgttcttctgggcaccctgactcccatggcaacagagatgctggccaacggtgatgggactggcttccctgaacttatggttgtgatggccactctggccagtgcaggtcaaggtgctggtcaccttcagcttcataatgctgctgtggattggctgagcagatgcaagaaatacctgtcacagaagaatgtagttgaaaaactgaatgccaatgtaatgcatggaaagcatgtgatgatcttggagtgcacatgccatatcatgtcttacttggctgatgtcacgaatgccctgagccagagtaatggtcaaggcccaagtcatctctcagtggatggggaagagcgggccattgaagtagactcagactgggtggaggagttggcggtggaagaggaagattcccaggctgaggattcagatgaagattctctttgcaataaactctgcacttttacgatcacacagaaagaattcatgaaccagcattggtaccactgtcacacctgtaaaatggtggatggcgtgggtgtctgcacagtgtgtgctaaggtgtgccacaaggatcatgagatttcctatgccaagtatggatccttcttctgtgactgtggagccaaggaagatggcagctgtttggctctggtgaagagaactcctagcagtggcatgagctctaccatgaaggagtcggcatttcagagtgaacccaggatttcagagagtctagtgcgtcatgccagcacctcctcgccagctgacaaagccaaggttaccatcagtgatggaaaggttgctgacgaagagaagcccaagaagagcagcctctgccgcacagtagagggctgccgggaggaattacagaaccaggccaatttctccttcgctcctctcgtgttagacatgcttaatttccttatggatgccattcagaccaacttccagcaagcttcagccgtcgggagcagcagccgtgctcagcaagccctcagtgagctacacactgtggagaaggcagtggagatgacagaccagctgatggttcccaccttagggtcccaggaaggtgcctttgagaatgtgcggatgaattacagtggagaccagggccagaccatccggcagctgatcagtgctcatgtgctcaggcgggtggctatgtgtgtgctctcctctccccatgggcgccgccaacatttggctgtcagccatgagaagggcaagatcaccgttctgcagctctctgcactcctgaagcaagcagattccagcaaaaggaagttaactctgacccgcttggcttctgccccagttccttttactgtgttgagcctcacaggaaatccctgcaaggaagactacttggcggtttgtgggctaaaggactgtcatgtgctcacctttagtagctcaggctctgtttcggatcacttggttttgcaccctcagttggcaacggggaacttcatcatcaaagccgtgtggttacctggttcacagaccgagttagcaattgtcaccgcagactttgttaagatttatgacctgtgtgttgatgccttgagtccaaccttctattttctcctgccaagctcaaagataagagatgttaccttccttttcaatgaggagggaaagaacatcattgttataatgtcttcggctgggtacatctatactcagcttatggaagaggccagcagtgcccagcagggacccttctatgtcactaatgtgttggaaatcaatcatgaggacctgaaggacagtaacagccaggtggcgggcggtggtgtgtccgtgtactactcccacgtgttgcagatgttgttcttcagctattgtcaaggcaaatcattcgcagccaccatcagcaggacaaccctggaggtgttgcaactcttccccatcaacatcaaaagttccaatggtggcagtaagacttctcctgctctttgccagtggtctgaggtgatgaaccaccctggcttggtgtgctgtgtccagcaaactacaggggtgccgctggtagttatggtgaaaccagacacttttcttatccaggagattaagactcttcctgctaaagcgaagatccaagacatggttgctattaggcacacggcctgcaatgagcagcagcggacaacaatgattctgctgtgtgaggatggcagcctgcgcatttacatggccaacgtggagaacacctcctactggctgcagccatccctgcagcccagcagtgtcatcagcatcatgaagcctgttcgaaagcgcaaaacagctacaatcacaacccgcacgtctagccaggtgactttccccattgacttttttgaacacaaccagcagctgacagatgtggagtttggtggtaacgacctcctacaggtctataatgcacaacagataaaacaccggctgaattccactggcatgtatgtggccaacaccaagcccggaggcttcaccattgagattagtaacaacaatagcactatggtgatgacaggcatgcggatccagattgggactcaagcaatagaacgggccccgtcatatatcgagatcttcggcagaactatgcagctcaacctgagtcgctcacgctggtttgacttccccttcaccagagaagaagccctgcaggctgataagaagctgaacctcttcattggggcctcggtggatccagcaggtgtcaccatgatagatgctgtaaaaatttatggcaagactaaggagcagtttggctggcctgatgagcccccagaagaattcccttctgcctctgtcagcaacatctgcccttcaaatctgaaccagagcaacggcactggagatagcgactcagctgcccccactacgaccagtggaactgtcctggagaggctggttgtgagttctttagaagccctggaaagctgctttgccgttggcccaatcatcgagaaggagagaaacaagaatgctgctcaggagctggccactttgctgttgtccctgccagcacctgccagtgtccagcagcagtccaagagccttctggccagcctgcacaccagccgctcggcctaccacagccacaaggatcaggccttgctgagcaaagctgtgcagtgtctcaacacatctagcaaagagggcaaggatttggaccctgaggtgttccagaggctagtgatcacagctcgctccattgccatcatgcgccccaacaaccttgtccactttacggagtcaaagctgccccagatggaaacagactgtttttttcctagatgtgcctgctggagtctagggatagttggcatattgattggggccccacttgaaactccctccccaggcaagcttccttgacctgagttaaccttaaaacaaattaaattccatctcagatttaccatcgttgataattttctttctcctgcttagaaggaatggatgaagggaaggaaccgcagaagcagttggaaggagattgctgtagtttcatcacccagcttgtgaaccacttctggaaactccatgcatccaaacccaagaatgccttcttggcacctgcctgccttccaggactaactcatattgaagctactgtcaatgctctggtggacatcatccatggctactgtacctgtgagctggattgtattaacacagcatccaagatctacatgcagatgctcttgtgtcctgatcctgctgtgagcttctcttgtaaacaagctctaattcgagtcctaaggcccaggaacaaacggagacatgtgactttaccctcttcccctcgaagcaacactccaatgggagacaaggatgatgatgacgatgatgatgcagatgagaaaatgcagtcatcagggatcccgaatggtggtcacatccgtcaggaaagccaggaacagagtgaggtggaccatggagattttgagatggtgtctgagtcgatggtcctggagacagctgaaaatgtcaacaatggcaacccctctcccctggaggccctgctggcaggcgcagagggcttcccccccatgctggacatcccacctgatgcagatgacgagaccatggttgaactagccattgccctgagcctgcagcaggaccaacaaggcagcagcagcagtgccctgggcctgcagagcctgggactgtccggccaggcacccagctcttcctctctggacgcaggaaccctctctgacaccacagcatcagctccagcctcagacgacgagggcagtacagcagcgacagatggttctacccttcggacctctcctgctgaccacggtggtagtgtgggctcggagagcgggggcagtgcagtggactcagtggctggcgagcacagtgtatctggccggagcagtgcttatggcgatgctacagctgaggggcatccggctggaccaggaagtgtcagctcaagcactggagccatcagcaccaccactgggcaccaggagggagatggctccgagggagaaggagaaggagaaactgaaggagatgtccacactagcaacaggctgcacatggtccgtctaatgctgttggagagattactgcagaccctgcctcaattacgaaacgttggcggtgtccgggccatcccatacatgcaggtcattctaatgctcactacagatctggatggagaagatgagaaagacaagggggccctagacaacctgctctcccagcttattgctgagttgggtatggataaaaaggatgtctccaagaagaatgagcgcagcgccctgaatgaagtccatctggtagtaatgagactcctgagtgtcttcatgtcccgcaccaaatctggatccaagtcttccatatgtgagtcatcttccctcatctccagtgccacagcagcagctctactgagctctggggctgtggactactgcctgcacgtgctcaaatcactgctggaatattggaagagccaacagaatgacgaggagcctgtggctaccagccagttgctgaaaccacatactacctcctccccacctgacatgagcccattctttctccgccagtatgtgaagggtcatgctgctgatgtgtttgaggcctatactcagcttctaacagaaatggtactgaggcttccttaccaaatcaaaaagattactgacaccaattctcgaatcccacctcctgtctttgaccactcgtggttttactttctctccgagtacctcatgatccagcagactccatttgtgcgccgtcaagtccgcaaacttctgctcttcatctgtggatccaaagagaagtaccgccagctccgggatttgcacaccctggactctcacgtgcgtgggatcaagaagctgctagaagagcaggggatattcctccgggcaagtgtggttacagccagctcaggctccgccttgcaatatgacacactcatcagcctgatggagcacctgaaagcctgtgcagagattgccgcccagcgaaccatcaactggcagaaattctgcatcaaagatgactccgtcctgtacttcctcctccaagtcagtttccttgtggatgagggcgtgtccccagtgctgctgcaactgctctcctgtgctctctgcggcagcaaggtgctcgctgcactggcagcctcttcgggatcctccagtgcttcttcctcctcagcccctgtggctgccagttctggacaagccacaacacagtccaagtcttccactaaaaagagcaagaaagaagaaaaagaaaaggagaaagatggtgagacctctggcagccaggaggaccagctgtgcacagctctggtgaaccagctgaacaaatttgccgataaggaaaccctgatccagttcctgcgttgtttcctgttagagtccaattcttcctcggtgcgctggcaggcccactgtctgacactgcacatctacagaaattccagcaaatctcaacaggagctcctgctagatctgatgtggtccatctggccagaactcccagcctatggtcgtaaggctgcccagtttgtggacctactaggatatttctccctgaaaactccacaaacagagaagaagttgaaggagtattcacagaaggctgtggagattctgcggactcaaaaccatattcttaccaaccaccccaactcgaacatttataacactttgtctggcttagtggagtttgatggctattacctggagagcgatccctgcctggtgtgtaataacccggaagtaccgttctgttatatcaagctgtcttccattaaagtggacacgcggtacaccaccacccagcaggttgtgaagctcattggcagtcacaccatcagcaaagtgacagtgaaaatcggggatctgaaacggaccaagatggtgcggaccatcaacctgtattataacaaccgaaccgtgcaggccatcgtggagttgaaaaacaagccagctcgctggcacaaagccaagaaggttcagctgacccctggacagacagaggtgaagattgacctgccgttgcccattgtggcctccaatctgatgattgagtttgcagacttctatgaaaactaccaggcctccacagagaccctgcagtgccctcgctgtagtgcctcggtccctgccaacccaggagtctgtggcaactgtggagagaatgtgtaccagtgtcacaaatgcagatccatcaactacgatgaaaaggatcccttcctctgcaatgcctgtggcttctgtaaatatgcccgcttcgacttcatgctctatgccaagccttgctgtgcagtggatcccattgagaatgaagaagaccggaagaaggctgtatccaacatcaatacacttttggacaaagctgatcgagtgtatcatcagctgatgggacaccggccacagctggagaacctgctctgcaaagtgaatgaggcagctccagaaaagccacaggatgactcaggaacagcagggggcatcagctccacttctgccagtgtgaatcgttacatcctgcagttggctcaggagtattgtggagactgcaagaactcttttgatgaactctccaaaatcatccagaaagtctttgcttcgcgcaaagagttgttggaatatgacctacagcagagggaagcagccactaaatcatcccggacctccgtgcagcccacattcactgccagccagtaccgtgccttatccgtcctgggctgtggccacacatcctccaccaagtgctatggctgcgcctcggctgtcacagaacattgtatcacactacttcgggccctggccaccaacccagccttgaggcacatccttgtctcccagggccttatccgggagctctttgattataatcttcgccgaggggctgcggccatgcgggaggaggtccgccagctcatgtgcctcctaactcgagacaacccagaagccacccaacagatgaatgacctgattattggcaaggtctccacagccctgaagggccactgggccaaccccgatctggcaagtagcctgcagtatgaaatgctgctgctgacggattctatctccaaggaggacagctgctgggagctccggttacgctgtgctctcagccttttcctcatggctgtgaacattaagactcctgtggtggttgaaaacattaccctcatgtgcctgaggatcttgcagaagctgataaaaccacctgctcccactagcaagaagaacaaggatgtccccgtcgaggccctcaccacggtgaagccatactgcaatgagatccatgcccaggctcaactgtggctcaagagagaccccaaggcatcctatgatgcctggaagaagtgtcttcctatcagagggatagatggcaatgggaaagcccccagcaaatcagagctccgccatctctatttgactgagaagtatgtgtggaggtggaaacagttcctgagtcgtcgggggaagaggacctcccccttggatctcaaactggggcataacaactggctgcgacaagtgcttttcactccagcaacgcaggccgcacggcaggcagcctgtaccattgtggaagctctagccaccattcccagccgcaagcagcaggtcctggacctgcttaccagttacctggatgagctgagcatagctggggagtgtgcagctgagtacctggctctctaccagaagctcatcacttctgcgcactggaaagtctacttggcagctcggggagtcctaccctatgtgggcaacctcatcaccaaggaaatagctcgtctgctggccctggaggaggctaccctgagtaccgatctgcagcagggttatgcccttaaaagtctcacaggccttctctcctcctttgttgaggtggaatccatcaaaagacattttaaaagtcgcttggtgggtactgtgctgaatggatacctgtgcttgcggaagctggtggtgcagaggaccaagctgatcgatgagacgcaggacatgctgctggagatgctggaggacatgaccacaggtacagaatcagaaaccaaggccttcatggctgtgtgcattgagacagccaagcgctacaatctggatgactaccggaccccggtgttcatcttcgagaggctctgcagcatcatttatcctgaggagaatgaagtcactgagttctttgtgaccctggagaaggatccccaacaagaagacttcttacagggcaggatgcctgggaacccgtatagcagcaatgagccaggcatcgggccgctgatgagggatataaagaacaagatttgccaggactgtgacttagtggccctcctggaagatgacagtggcatggagcttctagtgaacaataaaatcattagtttggaccttcctgtggctgaagtttacaagaaagtctggtgtaccacgaatgagggagagcccatgaggattgtttatcgtatgcgggggctgctgggcgatgccacagaggagttcattgagtccctggactctactacagatgaagaagaagatgaagaagaagtgtataaaatggctggtgtgatggcccagtgtgggggcctggaatgcatgcttaacagactcgcagggatcagagatttcaagcagggacgccaccttctaacagtgctactgaaattgttcagttactgcgtgaaggtgaaagtcaaccggcagcaactggtcaaactggaaatgaacaccttgaacgtcatgctggggaccctaaacctggcccttgtagctgaacaagaaagcaaggacagtgggggtgcagctgtggctgagcaggtgcttagcatcatggagatcattctagatgagtccaatgctgagcccctgagtgaggacaagggcaacctcctcctgacaggtgacaaggatcaactggtgatgctcttggaccagatcaacagcacctttgttcgctccaaccccagtgtgctccagggcctgcttcgcatcatcccgtacctttcctttggagaggtggagaaaatgcagatcttggtggagcgattcaaaccatactgcaactttgataaatatgatgaagatcacagtggtgatgataaagtcttcctggactgcttctgtaaaatagctgctggcatcaagaacaacagcaatgggcaccagctgaaggatctgattctccagaaggggatcacccagaatgcacttgactacatgaaaaagcacatccctagcgccaagaatttggatgccgacatctggaaaaagtttttgtctcgcccagccttgccatttatcctaaggctgcttcggggcctggccatccagcaccctggcacccaggttctgattggaactgattccatcccgaacctgcataagctggagcaggtgtccagtgatgagggcattgggaccttggcagagaacctgctggaagccctgcgggaacaccctgacgtaaacaagaagattgacgcagcccgcagggagacccgggcagagaagaaacgcatggccatggcaatgaggcagaaggccctgggcaccctgggcatgacgacaaatgaaaagggccaggtcgtgaccaagacagcactcctgaagcagatggaagagctgatcgaggagcctggcctcacgtgctgcataatgccaacaccaagtgcaacgggctccttccggtctggggacctcatgtccctgaatcagcttttgccacttgcttggcaagacacaacacttacctccaggaatgtacaggccagcgggagcccacgtatcagctcaacatccacgacatcaaactgctcttcctgcgcttcgccatggagcagtcgttcagcgcagacactggcgggggcggccgggagagcaacatccacctgatcccgtacatcattcacactgtgctttacgtcctgaacacaacccgagcaacttcccgagaagagaagaacctccaaggctttctggaacagcccaaggagaagtgggtggagagtgcctttgaagtggacgggccctactatttcacagtcttggcccttcacatcctgccccctgagcagtggagagccacacgtgtggaaatcttgcggaggctgttggtgacctcgcaggctcgggcagtggctccaggtggagccaccaggctgacagataaggcagtgaaggactattccgcttaccgttcttcccttctcttttgggccctcgtcgatctcatttacaacatgtttaagaaggtgcctaccagtaacacagagggaggctggtcctgctctctcgctgagtacatccgccacaacgacatgcccatctacgaagctgccgacaaagccctgaaaaccttccaggaggagttcatgccagtggagaccttctcagagttcctcgatgtggccggtcttttatcagaaatcaccgatccagagagcttcctgaaggacctgttgaactcagtcccctgaccaccacacagcagctgcggcggcgaagacgaagctggcttgccttccaccctctgttctccctccttgtgcattaagttccctccgcgggatgctgcattgttaccccgccctcccctctctcatttttcttggtgtggcttggggtttttaggcttcctgttttatctcgtgtgtgtggtgcaccagctatgaggttgtctgtaacccaagccatcaaagggcctgtacatacctaggagccatgagttgtcccggccagcttcatacttgagtgtgcacatcttgagaaataaacaagtgacttaacacacattgaaaa

SEQ ID NO: 356666 - DNA, 12872 bp, Homo sapiens
gtgacctagaggttccgccacaagcgcgatctcaaaggtccaggtctctttggatgagcatttttctaagatggctgctgagactgatcctcataagtcgtctgagattaccaagaacctacttccagccacgctgcaactcattgacacctatgcatcgttcaccagagcctatttgctgcaaaactttaatgaagagggaacaactgagaaaccttccaaggagaaactgcaaggctttgctgctgttttggctattggctctagcaggtgcaaggcaaatactctgggtccgacactggttcagaatttgccatcgtcagtgcagactgtgtgtgagtcctggaacaacatcaataccaatgaatttcccaatattggatcctggcgcaatgcctttgccaatgacaccatcccttcagagagttatattagtgcagtgcaggctgcacacctggggactctctgtagccaaagtctgcccctggctgcttccctgaagcataccctcctctcactggtcaggttgactggagatcttattgtttggtcagatgagatgaacccaccacaggtaattcggacactgctacctcttcttttggaatcaagcactgagagtgttgccgagatcagtagcaactccctggaacgcatcttgggccctgctgagtctgatgagttcttggctcgtgtttatgagaagctgatcactggttgttacaacattctggccaatcatgcagatcctaacagtggactggatgaatccatcctggaggaatgtctccagtacttggaaaagcagctggaaagtagccaggctcgtaaagctatggaggagtttttctctgacagtggagaacttgtacagatcatgatggcaacagccaatgagaacctctctgctaaattctgtaaccgagttttgaaattcttcaccaaactcttccagctgactgagaagagccctaacccgagcctgttgcatctctgtggctccctggcacaactggcctgtgtggaacctgtgcgcctgcaggcctggctcacccgcatgactacatcgcccccaaaagattctgatcagctggatgtaattcaggagaaccggcagctgctgcagttactgaccacatacattgttcgggaaaacagccaagttggggaaggtgtgtgtgctgttcttctgggcaccctgactcccatggcaacagagatgctggccaacggtgatgggactggcttccctgaacttatggttgtgatggccactctggccagtgcaggtcaaggtgctggtcaccttcagcttcataatgctgctgtggattggctgagcagatgcaagaaatacctgtcacagaagaatgtagttgaaaaactgaatgccaatgtaatgcatggaaagcatgtgatgatcttggagtgcacatgccatatcatgtcttacttggctgatgtcacgaatgccctgagccagagtaatggtcaaggcccaagtcatctctcagtggatggggaagagcgggccattgaagtagactcagactgggtggaggagttggcggtggaagaggaagattcccaggctgaggattcagatgaagattctctttgcaataaactctgcacttttacgatcacacagaaagaattcatgaaccagcattggtaccactgtcacacctgtaaaatggtggatggcgtgggtgtctgcacagtgtgtgctaaggtgtgccacaaggatcatgagatttcctatgccaagtatggatccttcttctgtgactgtggagccaaggaagatggcagctgtttggctctggtgaagagaactcctagcagtggcatgagctctaccatgaaggagtcggcatttcagagtgaacccaggatttcagagagtctagtgcgtcatgccagcacctcctcgccagctgacaaagccaaggttaccatcagtgatggaaaggttgctgacgaagagaagcccaagaagagcagcctctgccgcacagtagagggctgccgggaggaattacagaaccaggccaatttctccttcgctcctctcgtgttagacatgcttaatttccttatggatgccattcagaccaacttccagcaagcttcagccgtcgggagcagcagccgtgctcagcaagccctcagtgagctacacactgtggagaaggcagtggagatgacagaccagctgatggttcccaccttagggtcccaggaaggtgcctttgagaatgtgcggatgaattacagtggagaccagggccagaccatccggcagctgatcagtgctcatgtgctcaggcgggtggctatgtgtgtgctctcctctccccatgggcgccgccaacatttggctgtcagccatgagaagggcaagatcaccgttctgcagctctctgcactcctgaagcaagcagattccagcaaaaggaagttaactctgacccgcttggcttctgccccagttccttttactgtgttgagcctcacaggaaatccctgcaaggaagactacttggcggtttgtgggctaaaggactgtcatgtgctcacctttagtagctcaggctctgtttcggatcacttggttttgcaccctcagttggcaacggggaacttcatcatcaaagccgtgtggttacctggttcacagaccgagttagcaattgtcaccgcagactttgttaagatttatgacctgtgtgttgatgccttgagtccaaccttctattttctcctgccaagctcaaagataagagatgttaccttccttttcaatgaggagggaaagaacatcattgttataatgtcttcggctgggtacatctatactcagcttatggaagaggccagcagtgcccagcagggacccttctatgtcactaatgtgttggaaatcaatcatgaggacctgaaggacagtaacagccaggtggcgggcggtggtgtgtccgtgtactactcccacgtgttgcagatgttgttcttcagctattgtcaaggcaaatcattcgcagccaccatcagcaggacaaccctggaggtgttgcaactcttccccatcaacatcaaaagttccaatggtggcagtaagacttctcctgctctttgccagtggtctgaggtgatgaaccaccctggcttggtgtgctgtgtccagcaaactacaggggtgccgctggtagttatggtgaaaccagacacttttcttatccaggagattaagactcttcctgctaaagcgaagatccaagacatggttgctattaggcacacggcctgcaatgagcagcagcggacaacaatgattctgctgtgtgaggatggcagcctgcgcatttacatggccaacgtggagaacacctcctactggctgcagccatccctgcagcccagcagtgtcatcagcatcatgaagcctgttcgaaagcgcaaaacagctacaatcacaacccgcacgtctagccaggtgactttccccattgacttttttgaacacaaccagcagctgacagatgtggagtttggtggtaacgacctcctacaggtctataatgcacaacagataaaacaccggctgaattccactggcatgtatgtggccaacaccaagcccggaggcttcaccattgagattagtaacaacaatagcactatggtgatgacaggcatgcggatccagattgggactcaagcaatagaacgggccccgtcatatatcgagatcttcggcagaactatgcagctcaacctgagtcgctcacgctggtttgacttccccttcaccagagaagaagccctgcaggctgataagaagctgaacctcttcattggggcctcggtggatccagcaggtgtcaccatgatagatgctgtaaaaatttatggcaagactaaggagcagtttggctggcctgatgagcccccagaagaattcccttctgcctctgtcagcaacatctgcccttcaaatctgaaccagagcaacggcactggagatagcgactcagctgcccccactacgaccagtggaactgtcctggagaggctggttgtgagttctttagaagccctggaaagctgctttgccgttggcccaatcatcgagaaggagagaaacaagaatgctgctcaggagctggccactttgctgttgtccctgccagcacctgccagtgtccagcagcagtccaagagccttctggccagcctgcacaccagccgctcggcctaccacagccacaaggatcaggccttgctgagcaaagctgtgcagtgtctcaacacatctagcaaagagggcaaggatttggaccctgaggtgttccagaggctagtgatcacagctcgctccattgccatcatgcgccccaacaaccttgtccactttacggagtcaaagctgccccagatggaaacagactgtttttttcctagatgtgcctgctggagtctagggatagttggcatattgattggggccccacttgaaactccctccccaggcaagcttccttgacctgagttaaccttaaaacaaattaaattccatctcagatttaccatcgttgataattttctttctcctgcttagaaggaatggatgaagggaaggaaccgcagaagcagttggaaggagattgctgtagtttcatcacccagcttgtgaaccacttctggaaactccatgcatccaaacccaagaatgccttcttggcacctgcctgccttccaggactaactcatattgaagctactgtcaatgctctggtggacatcatccatggctactgtacctgtgagctggattgtattaacacagcatccaagatctacatgcagatgctcttgtgtcctgatcctgctgtgagcttctcttgtaaacaagctctaattcgagtcctaaggcccaggaacaaacggagacatgtgactttaccctcttcccctcgaagcaacactccaatgggagacaaggatgatgatgacgatgatgatgcagatgagaaaatgcagtcatcagggatcccgaatggtggtcacatccgtcaggaaagccaggaacagagtgaggtggaccatggagattttgagatggtgtctgagtcgatggtcctggagacagctgaaaatgtcaacaatggcaacccctctcccctggaggccctgctggcaggcgcagagggcttcccccccatgctggacatcccacctgatgcagatgacgagaccatggttgaactagccattgccctgagcctgcagcaggaccaacaaggcagcagcagcagtgccctgggcctgcagagcctgggactgtccggccaggcacccagctcttcctctctggacgcaggaaccctctctgacaccacagcatcagctccagcctcagacgacgagggcagtacagcagcgacagatggttctacccttcggacctctcctgctgaccacggtggtagtgtgggctcggagagcgggggcagtgcagtggactcagtggctggcgagcacagtgtatctggccggagcagtgcttatggcgatgctacagctgaggggcatccggctggaccaggaagtgtcagctcaagcactggagccatcagcaccaccactgggcaccaggagggagatggctccgagggagaaggagaaggagaaactgaaggagatgtccacactagcaacaggctgcacatggtccgtctaatgctgttggagagattactgcagaccctgcctcaattacgaaacgttggcggtgtccgggccatcccatacatgcaggtcattctaatgctcactacagatctggatggagaagatgagaaagacaagggggccctagacaacctgctctcccagcttattgctgagttgggtatggataaaaaggatgtctccaagaagaatgagcgcagcgccctgaatgaagtccatctggtagtaatgagactcctgagtgtcttcatgtcccgcaccaaatctggatccaagtcttccatatgtgagtcatcttccctcatctccagtgccacagcagcagctctactgagctctggggctgtggactactgcctgcacgtgctcaaatcactgctggaatattggaagagccaacagaatgacgaggagcctgtggctaccagccagttgctgaaaccacatactacctcctccccacctgacatgagcccattctttctccgccagtatgtgaagggtcatgctgctgatgtgtttgaggcctatactcagcttctaacagaaatggtactgaggcttccttaccaaatcaaaaagattactgacaccaattctcgaatcccacctcctgtctttgaccactcgtggttttactttctctccgagtacctcatgatccagcagactccatttgtgcgccgtcaagtccgcaaacttctgctcttcatctgtggatccaaagagaagtaccgccagctccgggatttgcacaccctggactctcacgtgcgtgggatcaagaagctgctagaagagcaggggatattcctccgggcaagtgtggttacagccagctcaggctccgccttgcaatatgacacactcatcagcctgatggagcacctgaaagcctgtgcagagattgccgcccagcgaaccatcaactggcagaaattctgcatcaaagatgactccgtcctgtacttcctcctccaagtcagtttccttgtggatgagggcgtgtccccagtgctgctgcaactgctctcctgtgctctctgcggcagcaaggtgctcgctgcactggcagcctcttcgggatcctccagtgcttcttcctcctcagcccctgtggctgccagttctggacaagccacaacacagtccaagtcttccactaaaaagagcaagaaagaagaaaaagaaaaggagaaagatggtgagacctctggcagccaggaggaccagctgtgcacagctctggtgaaccagctgaacaaatttgccgataaggaaaccctgatccagttcctgcgttgtttcctgttagagtccaattcttcctcggtgcgctggcaggcccactgtctgacactgcacatctacagaaattccagcaaatctcaacaggagctcctgctagatctgatgtggtccatctggccagaactcccagcctatggtcgtaaggctgcccagtttgtggacctactaggatatttctccctgaaaactccacaaacagagaagaagttgaaggagtattcacagaaggctgtggagattctgcggactcaaaaccatattcttaccaaccaccccaactcgaacatttataacactttgtctggcttagtggagtttgatggctattacctggagagcgatccctgcctggtgtgtaataacccggaagtaccgttctgttatatcaagctgtcttccattaaagtggacacgcggtacaccaccacccagcaggttgtgaagctcattggcagtcacaccatcagcaaagtgacagtgaaaatcggggatctgaaacggaccaagatggtgcggaccatcaacctgtattataacaaccgaaccgtgcaggccatcgtggagttgaaaaacaagccagctcgctggcacaaagccaagaaggttcagctgacccctggacagacagaggtgaagattgacctgccgttgcccattgtggcctccaatctgatgattgagtttgcagacttctatgaaaactaccaggcctccacagagaccctgcagtgccctcgctgtagtgcctcggtccctgccaacccaggagtctgtggcaactgtggagagaatgtgtaccagtgtcacaaatgcagatccatcaactacgatgaaaaggatcccttcctctgcaatgcctgtggcttctgtaaatatgcccgcttcgacttcatgctctatgccaagccttgctgtgcagtggatcccattgagaatgaagaagaccggaagaaggctgtatccaacatcaatacacttttggacaaagctgatcgagtgtatcatcagctgatgggacaccggccacagctggagaacctgctctgcaaagtgaatgaggcagctccagaaaagccacaggatgactcaggaacagcagggggcatcagctccacttctgccagtgtgaatcgttacatcctgcagttggctcaggagtattgtggagactgcaagaactcttttgatgaactctccaaaatcatccagaaagtctttgcttcgcgcaaagagttgttggaatatgacctacagcagagggaagcagccactaaatcatcccggacctccgtgcagcccacattcactgccagccagtaccgtgccttatccgtcctgggctgtggccacacatcctccaccaagtgctatggctgcgcctcggctgtcacagaacattgtatcacactacttcgggccctggccaccaacccagccttgaggcacatccttgtctcccagggccttatccgggagctctttgattataatcttcgccgaggggctgcggccatgcgggaggaggtccgccagctcatgtgcctcctaactcgagacaacccagaagccacccaacagatgaatgacctgattattggcaaggtctccacagccctgaagggccactgggccaaccccgatctggcaagtagcctgcagtatgaaatgctgctgctgacggattctatctccaaggaggacagctgctgggagctccggttacgctgtgctctcagccttttcctcatggctgtgaacattaagactcctgtggtggttgaaaacattaccctcatgtgcctgaggatcttgcagaagctgataaaaccacctgctcccactagcaagaagaacaaggatgtccccgtcgaggccctcaccacggtgaagccatactgcaatgagatccatgcccaggctcaactgtggctcaagagagaccccaaggcatcctatgatgcctggaagaagtgtcttcctatcagagggatagatggcaatgggaaagcccccagcaaatcagagctccgccatctctatttgactgagaagtatgtgtggaggtggaaacagttcctgagtcgtcgggggaagaggacctcccccttggatctcaaactggggcataacaactggctgcgacaagtgcttttcactccagcaacgcaggccgcacggcaggcagcctgtaccattgtggaagctctagccaccattcccagccgcaagcagcaggtcctggacctgcttaccagttacctggatgagctgagcatagctggggagtgtgcagctgagtacctggctctctaccagaagctcatcacttctgcgcactggaaagtctacttggcagctcggggagtcctaccctatgtgggcaacctcatcaccaaggaaatagctcgtctgctggccctggaggaggctaccctgagtaccgatctgcagcagggttatgcccttaaaagtctcacaggccttctctcctcctttgttgaggtggaatccatcaaaagacattttaaaagtcgcttggtgggtactgtgctgaatggatacctgtgcttgcggaagctggtggtgcagaggaccaagctgatcgatgagacgcaggacatgctgctggagatgctggaggacatgaccacaggtacagaatcagaaaccaaggccttcatggctgtgtgcattgagacagccaagcgctacaatctggatgactaccggaccccggtgttcatcttcgagaggctctgcagcatcatttatcctgaggagaatgaagtcactgagttctttgtgaccctggagaaggatccccaacaagaagacttcttacagggcaggatgcctgggaacccgtatagcagcaatgagccaggcatcgggccgctgatgagggatataaagaacaagatttgccaggactgtgacttagtggccctcctggaagatgacagtggcatggagcttctagtgaacaataaaatcattagtttggaccttcctgtggctgaagtttacaagaaagtctggtgtaccacgaatgagggagagcccatgaggattgtttatcgtatgcgggggctgctgggcgatgccacagaggagttcattgagtccctggactctactacagatgaagaagaagatgaagaagaagtgtataaaatggctggtgtgatggcccagtgtgggggcctggaatgcatgcttaacagactcgcagggatcagagatttcaagcagggacgccaccttctaacagtgctactgaaattgttcagttactgcgtgaaggtgaaagtcaaccggcagcaactggtcaaactggaaatgaacaccttgaacgtcatgctggggaccctaaacctggcccttgtagctgaacaagaaagcaaggacagtgggggtgcagctgtggctgagcaggtgcttagcatcatggagatcattctagatgagtccaatgctgagcccctgagtgaggacaagggcaacctcctcctgacaggtgacaaggatcaactggtgatgctcttggaccagatcaacagcacctttgttcgctccaaccccagtgtgctccagggcctgcttcgcatcatcccgtacctttcctttggagaggtggagaaaatgcagatcttggtggagcgattcaaaccatactgcaactttgataaatatgatgaagatcacagtggtgatgataaagtcttcctggactgcttctgtaaaatagctgctggcatcaagaacaacagcaatgggcaccagctgaaggatctgattctccagaaggggatcacccagaatgcacttgactacatgaaaaagcacatccctagcgccaagaatttggatgccgacatctggaaaaagtttttgtctcgcccagccttgccatttatcctaaggctgcttcggggcctggccatccagcaccctggcacccaggttctgattggaactgattccatcccgaacctgcataagctggagcaggtgtccagtgatgagggcattgggaccttggcagagaacctgctggaagccctgcgggaacaccctgacgtaaacaagaagattgacgcagcccgcagggagacccgggcagagaagaaacgcatggccatggcaatgaggcagaaggccctgggcaccctgggcatgacgacaaatgaaaagggccaggtcgtgaccaagacagcactcctgaagcagatggaagagctgatcgaggagcctggcctcacgtgctgcatctgcagggagggatacaagttccagcccacaaaggtcctgggcatttataccttcacgaagcgggtagccttggaggagttggagaataagccccggaaacagcagggctacagcaccgtgtcccacttcaacattgtgcactacgactgccatctggctgccgtcaggttggctcgaggccgggaagagtgggagagtgccgccctgcagaatgccaacaccaagtgcaacgggctccttccggtctggggacctcatgtccctgaatcagcttttgccacttgcttggcaagacacaacacttacctccaggaatgtacaggccagcgggagcccacgtatcagctcaacatccacgacatcaaactgctcttcctgcgcttcgccatggagcagtcgttcagcgcagacactggcgggggcggccgggagagcaacatccacctgatcccgtacatcattcacactgtgctttacgtcctgaacacaacccgagcaacttcccgagaagagaagaacctccaaggctttctggaacagcccaaggagaagtgggtggagagtgcctttgaagtggacgggccctactatttcacagtcttggcccttcacatcctgccccctgagcagtggagagccacacgtgtggaaatcttgcggaggctgttggtgacctcgcaggctcgggcagtggctccaggtggagccaccaggctgacagataaggcagtgaaggactattccgcttaccgttcttcccttctcttttgggccctcgtcgatctcatttacaacatgtttaagaaggtgcctaccagtaacacagagggaggctggtcctgctctctcgctgagtacatccgccacaacgacatgcccatctacgaagctgccgacaaagccctgaaaaccttccaggaggagttcatgccagtggagaccttctcagagttcctcgatgtggccggtcttttatcagaaatcaccgatccagagagcttcctgaaggacctgttgaactcagtcccctgaccaccacacagcagctgcggcggcgaagacgaagctggcttgccttccaccctctgttctccctccttgtgcattaagttccctccgcgggatgctgcattgttaccccgccctcccctctctcatttttcttggtgtggcttggggtttttaggcttcctgttttatctcgtgtgtgtggtgcaccagctatgaggttgtctgtaacccaagccatcaaagggcctgtacatacctaggagccatgagttgtcccggccagcttcatacttgagtgtgcacatcttgagaaataaacaagtgacttaacacacattgaaaaaaaaaaaaaaaagggggggttaaaaaatccggaggggccagttagggtaccggttttgtaaagggccaaagggcgttaagaaggaggcgggtaaagggaggggaagggggtctgggagaccttgggggtatggaaccacgaaagcgaaaaagtaggagttgggtgttgtaataaaggg

SEQ ID NO: 356667 - DNA, 12858 bp, Homo sapiens
gtgacctagaggttccgccacaagcgcgatctcaaaggtccaggtctctttggatgagcatttttctaagatggctgctgagactgatcctcataagtcgtctgagattaccaagaacctacttccagccacgctgcaactcattgacacctatgcatcgttcaccagagcctatttgctgcaaaactttaatgaagagggaacaactgagaaaccttccaaggagaaactgcaaggctttgctgctgttttggctattggctctagcaggtgcaaggcaaatactctgggtccgacactggttcagaatttgccatcgtcagtgcagactgtgtgtgagtcctggaacaacatcaataccaatgaatttcccaatattggatcctggcgcaatgcctttgccaatgacaccatcccttcagagagttatattagtgcagtgcaggctgcacacctggggactctctgtagccaaagtctgcccctggctgcttccctgaagcataccctcctctcactggtcaggttgactggagatcttattgtttggtcagatgagatgaacccaccacaggtaattcggacactgctacctcttcttttggaatcaagcactgagagtgttgccgagatcagtagcaactccctggaacgcatcttgggccctgctgagtctgatgagttcttggctcgtgtttatgagaagctgatcactggttgttacaacattctggccaatcatgcagatcctaacagtggactggatgaatccatcctggaggaatgtctccagtacttggaaaagcagctggaaagtagccaggctcgtaaagctatggaggagtttttctctgacagtggagaacttgtacagatcatgatggcaacagccaatgagaacctctctgctaaattctgtaaccgagttttgaaattcttcaccaaactcttccagctgactgagaagagccctaacccgagcctgttgcatctctgtggctccctggcacaactggcctgtgtggaacctgtgcgcctgcaggcctggctcacccgcatgactacatcgcccccaaaagattctgatcagctggatgtaattcaggagaaccggcagctgctgcagttactgaccacatacattgttcgggaaaacagccaagttggggaaggtgtgtgtgctgttcttctgggcaccctgactcccatggcaacagagatgctggccaacggtgatgggactggcttccctgaacttatggttgtgatggccactctggccagtgcaggtcaaggtgctggtcaccttcagcttcataatgctgctgtggattggctgagcagatgcaagaaatacctgtcacagaagaatgtagttgaaaaactgaatgccaatgtaatgcatggaaagcatgtgatgatcttggagtgcacatgccatatcatgtcttacttggctgatgtcacgaatgccctgagccagagtaatggtcaaggcccaagtcatctctcagtggatggggaagagcgggccattgaagtagactcagactgggtggaggagttggcggtggaagaggaagattcccaggctgaggattcagatgaagattctctttgcaataaactctgcacttttacgatcacacagaaagaattcatgaaccagcattggtaccactgtcacacctgtaaaatggtggatggcgtgggtgtctgcacagtgtgtgctaaggtgtgccacaaggatcatgagatttcctatgccaagtatggatccttcttctgtgactgtggagccaaggaagatggcagctgtttggctctggtgaagagaactcctagcagtggcatgagctctaccatgaaggagtcggcatttcagagtgaacccaggatttcagagagtctagtgcgtcatgccagcacctcctcgccagctgacaaagccaaggttaccatcagtgatggaaaggttgctgacgaagagaagcccaagaagagcagcctctgccgcacagtagagggctgccgggaggaattacagaaccaggccaatttctccttcgctcctctcgtgttagacatgcttaatttccttatggatgccattcagaccaacttccagcaagcttcagccgtcgggagcagcagccgtgctcagcaagccctcagtgagctacacactgtggagaaggcagtggagatgacagaccagctgatggttcccaccttagggtcccaggaaggtgcctttgagaatgtgcggatgaattacagtggagaccagggccagaccatccggcagctgatcagtgctcatgtgctcaggcgggtggctatgtgtgtgctctcctctccccatgggcgccgccaacatttggctgtcagccatgagaagggcaagatcaccgttctgcagctctctgcactcctgaagcaagcagattccagcaaaaggaagttaactctgacccgcttggcttctgccccagttccttttactgtgttgagcctcacaggaaatccctgcaaggaagactacttggcggtttgtgggctaaaggactgtcatgtgctcacctttagtagctcaggctctgtttcggatcacttggttttgcaccctcagttggcaacggggaacttcatcatcaaagccgtgtggttacctggttcacagaccgagttagcaattgtcaccgcagactttgttaagatttatgacctgtgtgttgatgccttgagtccaaccttctattttctcctgccaagctcaaagataagagatgttaccttccttttcaatgaggagggaaagaacatcattgttataatgtcttcggctgggtacatctatactcagcttatggaagaggccagcagtgcccagcagggacccttctatgtcactaatgtgttggaaatcaatcatgaggacctgaaggacagtaacagccaggtggcgggcggtggtgtgtccgtgtactactcccacgtgttgcagatgttgttcttcagctattgtcaaggcaaatcattcgcagccaccatcagcaggacaaccctggaggtgttgcaactcttccccatcaacatcaaaagttccaatggtggcagtaagacttctcctgctctttgccagtggtctgaggtgatgaaccaccctggcttggtgtgctgtgtccagcaaactacaggggtgccgctggtagttatggtgaaaccagacacttttcttatccaggagattaagactcttcctgctaaagcgaagatccaagacatggttgctattaggcacacggcctgcaatgagcagcagcggacaacaatgattctgctgtgtgaggatggcagcctgcgcatttacatggccaacgtggagaacacctcctactggctgcagccatccctgcagcccagcagtgtcatcagcatcatgaagcctgttcgaaagcgcaaaacagctacaatcacaacccgcacgtctagccaggtgactttccccattgacttttttgaacacaaccagcagctgacagatgtggagtttggtggtaacgacctcctacaggtctataatgcacaacagataaaacaccggctgaattccactggcatgtatgtggccaacaccaagcccggaggcttcaccattgagattagtaacaacaatagcactatggtgatgacaggcatgcggatccagattgggactcaagcaatagaacgggccccgtcatatatcgagatcttcggcagaactatgcagctcaacctgagtcgctcacgctggtttgacttccccttcaccagagaagaagccctgcaggctgataagaagctgaacctcttcattggggcctcggtggatccagcaggtgtcaccatgatagatgctgtaaaaatttatggcaagactaaggagcagtttggctggcctgatgagcccccagaagaattcccttctgcctctgtcagcaacatctgcccttcaaatctgaaccagagcaacggcactggagatagcgactcagctgcccccactacgaccagtggaactgtcctggagaggctggttgtgagttctttagaagccctggaaagctgctttgccgttggcccaatcatcgagaaggagagaaacaagaatgctgctcaggagctggccactttgctgttgtccctgccagcacctgccagtgtccagcagcagtccaagagccttctggccagcctgcacaccagccgctcggcctaccacagccacaaggatcaggccttgctgagcaaagctgtgcagtgtctcaacacatctagcaaagagggcaaggatttggaccctgaggtgttccagaggctagtgatcacagctcgctccattgccatcatgcgccccaacaaccttgtccactttacggagtcaaagctgccccagatggaaacagactgtttttttcctagatgtgcctgctggagtctagggatagttggcatattgattggggccccacttgaaactccctccccaggcaagcttccttgacctgagttaaccttaaaacaaattaaattccatctcagatttaccatcgttgataattttctttctcctgcttagaaggaatggatgaagggaaggaaccgcagaagcagttggaaggagattgctgtagtttcatcacccagcttgtgaaccacttctggaaactccatgcatccaaacccaagaatgccttcttggcacctgcctgccttccaggactaactcatattgaagctactgtcaatgctctggtggacatcatccatggctactgtacctgtgagctggattgtattaacacagcatccaagatctacatgcagatgctcttgtgtcctgatcctgctgtgagcttctcttgtaaacaagctctaattcgagtcctaaggcccaggaacaaacggagacatgtgactttaccctcttcccctcgaagcaacactccaatgggagacaaggatgatgatgacgatgatgatgcagatgagaaaatgcagtcatcagggatcccgaatggtggtcacatccgtcaggaaagccaggaacagagtgaggtggaccatggagattttgagatggtgtctgagtcgatggtcctggagacagctgaaaatgtcaacaatggcaacccctctcccctggaggccctgctggcaggcgcagagggcttcccccccatgctggacatcccacctgatgcagatgacgagaccatggttgaactagccattgccctgagcctgcagcaggaccaacaaggcagcagcagcagtgccctgggcctgcagagcctgggactgtccggccaggcacccagctcttcctctctggacgcaggaaccctctctgacaccacagcatcagctccagcctcagacgacgagggcagtacagcagcgacagatggttctacccttcggacctctcctgctgaccacggtggtagtgtgggctcggagagcgggggcagtgcagtggactcagtggctggcgagcacagtgtatctggccggagcagtgcttatggcgatgctacagctgaggggcatccggctggaccaggaagtgtcagctcaagcactggagccatcagcaccaccactgggcaccaggagggagatggctccgagggagaaggagaaggagaaactgaaggagatgtccacactagcaacaggctgcacatggtccgtctaatgctgttggagagattactgcagaccctgcctcaattacgaaacgttggcggtgtccgggccatcccatacatgcaggtcattctaatgctcactacagatctggatggagaagatgagaaagacaagggggccctagacaacctgctctcccagcttattgctgagttgggtatggataaaaaggatgtctccaagaagaatgagcgcagcgccctgaatgaagtccatctggtagtaatgagactcctgagtgtcttcatgtcccgcaccaaatctggatccaagtcttccatatgtgagtcatcttccctcatctccagtgccacagcagcagctctactgagctctggggctgtggactactgcctgcacgtgctcaaatcactgctggaatattggaagagccaacagaatgacgaggagcctgtggctaccagccagttgctgaaaccacatactacctcctccccacctgacatgagcccattctttctccgccagtatgtgaagggtcatgctgctgatgtgtttgaggcctatactcagcttctaacagaaatggtactgaggcttccttaccaaatcaaaaagattactgacaccaattctcgaatcccacctcctgtctttgaccactcgtggttttactttctctccgagtacctcatgatccagcagactccatttgtgcgccgtcaagtccgcaaacttctgctcttcatctgtggatccaaagagaagtaccgccagctccgggatttgcacaccctggactctcacgtgcgtgggatcaagaagctgctagaagagcaggggatattcctccgggcaagtgtggttacagccagctcaggctccgccttgcaatatgacacactcatcagcctgatggagcacctgaaagcctgtgcagagattgccgcccagcgaaccatcaactggcagaaattctgcatcaaagatgactccgtcctgtacttcctcctccaagtcagtttccttgtggatgagggcgtgtccccagtgctgctgcaactgctctcctgtgctctctgcggcagcaaggtgctcgctgcactggcagcctcttcgggatcctccagtgcttcttcctcctcagcccctgtggctgccagttctggacaagccacaacacagtccaagtcttccactaaaaagagcaagaaagaagaaaaagaaaaggagaaagatggtgagacctctggcagccaggaggaccagctgtgcacagctctggtgaaccagctgaacaaatttgccgataaggaaaccctgatccagttcctgcgttgtttcctgttagagtccaattcttcctcggtgcgctggcaggcccactgtctgacactgcacatctacagaaattccagcaaatctcaacaggagctcctgctagatctgatgtggtccatctggccagaactcccagcctatggtcgtaaggctgcccagtttgtggacctactaggatatttctccctgaaaactccacaaacagagaagaagttgaaggagtattcacagaaggctgtggagattctgcggactcaaaaccatattcttaccaaccaccccaactcgaacatttataacactttgtctggcttagtggagtttgatggctattacctggagagcgatccctgcctggtgtgtaataacccggaagtaccgttctgttatatcaagctgtcttccattaaagtggacacgcggtacaccaccacccagcaggttgtgaagctcattggcagtcacaccatcagcaaagtgacagtgaaaatcggggatctgaaacggaccaagatggtgcggaccatcaacctgtattataacaaccgaaccgtgcaggccatcgtggagttgaaaaacaagccagctcgctggcacaaagccaagaaggttcagctgacccctggacagacagaggtgaagattgacctgccgttgcccattgtggcctccaatctgatgattgagtttgcagacttctatgaaaactaccaggcctccacagagaccctgcagtgccctcgctgtagtgcctcggtccctgccaacccaggagtctgtggcaactgtggagagaatgtgtaccagtgtcacaaatgcagatccatcaactacgatgaaaaggatcccttcctctgcaatgcctgtggcttctgtaaatatgcccgcttcgacttcatgctctatgccaagccttgctgtgcagtggatcccattgagaatgaagaagaccggaagaaggctgtatccaacatcaatacacttttggacaaagctgatcgagtgtatcatcagctgatgggacaccggccacagctggagaacctgctctgcaaagtgaatgaggcagctccagaaaagccacaggatgactcaggaacagcagggggcatcagctccacttctgccagtgtgaatcgttacatcctgcagttggctcaggagtattgtggagactgcaagaactcttttgatgaactctccaaaatcatccagaaagtctttgcttcgcgcaaagagttgttggaatatgacctacagcagagggaagcagccactaaatcatcccggacctccgtgcagcccacattcactgccagccagtaccgtgccttatccgtcctgggctgtggccacacatcctccaccaagtgctatggctgcgcctcggctgtcacagaacattgtatcacactacttcgggccctggccaccaacccagccttgaggcacatccttgtctcccagggccttatccgggagctctttgattataatcttcgccgaggggctgcggccatgcgggaggaggtccgccagctcatgtgcctcctaactcgagacaacccagaagccacccaacagatgaatgacctgattattggcaaggtctccacagccctgaagggccactgggccaaccccgatctggcaagtagcctgcagtatgaaatgctgctgctgacggattctatctccaaggaggacagctgctgggagctccggttacgctgtgctctcagccttttcctcatggctgtgaacattaagactcctgtggtggttgaaaacattaccctcatgtgcctgaggatcttgcagaagctgataaaaccacctgctcccactagcaagaagaacaaggatgtccccgtcgaggccctcaccacggtgaagccatactgcaatgagatccatgcccaggctcaactgtggctcaagagagaccccaaggcatcctatgatgcctggaagaagtgtcttcctatcagagggatagatggcaatgggaaagcccccagcaaatcagagctccgccatctctatttgactgagaagtatgtgtggaggtggaaacagttcctgagtcgtcgggggaagaggacctcccccttggatctcaaactggggcataacaactggctgcgacaagtgcttttcactccagcaacgcaggccgcacggcaggcagcctgtaccattgtggaagctctagccaccattcccagccgcaagcagcaggtcctggacctgcttaccagttacctggatgagctgagcatagctggggagtgtgcagctgagtacctggctctctaccagaagctcatcacttctgcgcactggaaagtctacttggcagctcggggagtcctaccctatgtgggcaacctcatcaccaaggaaatagctcgtctgctggccctggaggaggctaccctgagtaccgatctgcagcagggttatgcccttaaaagtctcacaggccttctctcctcctttgttgaggtggaatccatcaaaagacattttaaaagtcgcttggtgggtactgtgctgaatggatacctgtgcttgcggaagctggtggtgcagaggaccaagctgatcgatgagacgcaggacatgctgctggagatgctggaggacatgaccacaggtacagaatcagaaaccaaggccttcatggctgtgtgcattgagacagccaagcgctacaatctggatgactaccggaccccggtgttcatcttcgagaggctctgcagcatcatttatcctgaggagaatgaagtcactgagttctttgtgaccctggagaaggatccccaacaagaagacttcttacagggcaggatgcctgggaacccgtatagcagcaatgagccaggcatcgggccgctgatgagggatataaagaacaagatttgccaggactgtgacttagtggccctcctggaagatgacagtggcatggagcttctagtgaacaataaaatcattagtttggaccttcctgtggctgaagtttacaagaaagtctggtgtaccacgaatgagggagagcccatgaggattgtttatcgtatgcgggggctgctgggcgatgccacagaggagttcattgagtccctggactctactacagatgaagaagaagatgaagaagaagtgtataaaatggctggtgtgatggcccagtgtgggggcctggaatgcatgcttaacagactcgcagggatcagagatttcaagcagggacgccaccttctaacagtgctactgaaattgttcagttactgcgtgaaggtgaaagtcaaccggcagcaactggtcaaactggaaatgaacaccttgaacgtcatgctggggaccctaaacctggcccttgtagctgaacaagaaagcaaggacagtgggggtgcagctgtggctgagcaggtgcttagcatcatggagatcattctagatgagtccaatgctgagcccctgagtgaggacaagggcaacctcctcctgacaggtgacaaggatcaactggtgatgctcttggaccagatcaacagcacctttgttcgctccaaccccagtgtgctccagggcctgcttcgcatcatcccgtacctttcctttggagaggtggagaaaatgcagatcttggtggagcgattcaaaccatactgcaactttgataaatatgatgaagatcacagtggtgatgataaagtcttcctggactgcttctgtaaaatagctgctggcatcaagaacaacagcaatgggcaccagctgaaggatctgattctccagaaggggatcacccagaatgcacttgactacatgaaaaagcacatccctagcgccaagaatttggatgccgacatctggaaaaagtttttgtctcgcccagccttgccatttatcctaaggctgcttcggggcctggccatccagcaccctggcacccaggttctgattggaactgattccatcccgaacctgcataagctggagcaggtgtccagtgatgagggcattgggaccttggcagagaacctgctggaagccctgcgggaacaccctgacgtaaacaagaagattgacgcagcccgcagggagacccgggcagagaagaaacgcatggccatggcaatgaggcagaaggccctgggcaccctgggcatgacgacaaatgaaaagggccaggtcgtgaccaagacagcactcctgaagcagatggaagagctgatcgaggagcctggcctcacgtgctgcatctgcagggagggatacaagttccagcccacaaaggtcctgggcatttataccttcacgaagcgggtagccttggaggagttggagaataagccccggaaacagcagggctacagcaccgtgtcccacttcaacattgtgcactacgactgccatctggctgccgtcaggttggctcgaggccgggaagagtgggagagtgccgccctgcagaatgccaacaccaagtgcaacgggctccttccggtctggggacctcatgtccctgaatcagcttttgccacttgcttggcaagacacaacacttacctccaggaatgtacaggccagcgggagcccacgtatcagctcaacatccacgacatcaaactgctcttcctgcgcttcgccatggagcagtcgttcagcgcagacactggcgggggcggccgggagagcaacatccacctgatcccgtacatcattcacactgtgctttacgtcctgaacacaacccgagcaacttcccgagaagagaagaacctccaaggctttctggaacagcccaaggagaagtgggtggagagtgcctttgaagtggacgggccctactatttcacagtcttggcccttcacatcctgccccctgagcagtggagagccacacgtgtggaaatcttgcggaggctgttggtgacctcgcaggctcgggcagtggctccaggtggagccaccaggctgacagataaggcagtgaaggactattccgcttaccgttcttcccttctcttttgggccctcgtcgatctcatttacaacatgtttaagaaggtgcctaccagtaacacagagggaggctggtcctgctctctcgctgagtacatccgccacaacgacatgcccatctacgaagctgccgacaaagccctgaaaaccttccaggaggagttcatgccagtggagaccttctcagagttcctcgatgtggccggtcttttatcagaaatcaccgatccagagagcttcctgaaggacctgttgaactcagtcccctgaccaccacacagcagctgcggcggcgaagacgaagctggcttgccttccaccctctgttctccctccttgtgcattaagttccctccgcgggatgctgcattgttaccccgccctcccctctctcatttttcttggtgtggcttggggtttttaggcttcctgttttatctcgtgtgtgtggtgcaccagctatgaggttgtctgtaacccaagccatcaaagggcctgtacatacctaggagccatgagttgtcccggccagcttcatacttgagtgtgcacatcttgagaaataaacaagtgacttaacacacattgaaaaaaaaaaaagtgcattatactaccggtagatgctccgtagcgacggttgtcttcagcctgtctttcgcgcggtcgtttgtttcctcgcccgttcctttaagagggataataaacttccccccccagccgcatgcctgattttcgagtagaagaggcatatttcca

SEQ ID NO: 356668 - DNA, 13040 bp, Homo sapiens
  misc_feature (12697)..(12697): n is a, c, g, or t
  misc_feature (12699)..(12699): n is a, c, g, or t
  misc_feature (12703)..(12703): n is a, c, g, or t
  misc_feature (12811)..(12811): n is a, c, g, or t
gtgacctagaggttccgccacaagcgcgatctcaaaggtccaggtctctttggatgagcatttttctaagatggctgctgagactgatcctcataagtcgtctgagattaccaagaacctacttccagccacgctgcaactcattgacacctatgcatcgttcaccagagcctatttgctgcaaaactttaatgaagagggaacaactgagaaaccttccaaggagaaactgcaaggctttgctgctgttttggctattggctctagcaggtgcaaggcaaatactctgggtccgacactggttcagaatttgccatcgtcagtgcagactgtgtgtgagtcctggaacaacatcaataccaatgaatttcccaatattggatcctggcgcaatgcctttgccaatgacaccatcccttcagagagttatattagtgcagtgcaggctgcacacctggggactctctgtagccaaagtctgcccctggctgcttccctgaagcataccctcctctcactggtcaggttgactggagatcttattgtttggtcagatgagatgaacccaccacaggtaattcggacactgctacctcttcttttggaatcaagcactgagagtgttgccgagatcagtagcaactccctggaacgcatcttgggccctgctgagtctgatgagttcttggctcgtgtttatgagaagctgatcactggttgttacaacattctggccaatcatgcagatcctaacagtggactggatgaatccatcctggaggaatgtctccagtacttggaaaagcagctggaaagtagccaggctcgtaaagctatggaggagtttttctctgacagtggagaacttgtacagatcatgatggcaacagccaatgagaacctctctgctaaattctgtaaccgagttttgaaattcttcaccaaactcttccagctgactgagaagagccctaacccgagcctgttgcatctctgtggctccctggcacaactggcctgtgtggaacctgtgcgcctgcaggcctggctcacccgcatgactacatcgcccccaaaagattctgatcagctggatgtaattcaggagaaccggcagctgctgcagttactgaccacatacattgttcgggaaaacagccaagttggggaaggtgtgtgtgctgttcttctgggcaccctgactcccatggcaacagagatgctggccaacggtgatgggactggcttccctgaacttatggttgtgatggccactctggccagtgcaggtcaaggtgctggtcaccttcagcttcataatgctgctgtggattggctgagcagatgcaagaaatacctgtcacagaagaatgtagttgaaaaactgaatgccaatgtaatgcatggaaagcatgtgatgatcttggagtgcacatgccatatcatgtcttacttggctgatgtcacgaatgccctgagccagagtaatggtcaaggcccaagtcatctctcagtggatggggaagagcgggccattgaagtagactcagactgggtggaggagttggcggtggaagaggaagattcccaggctgaggattcagatgaagattctctttgcaataaactctgcacttttacgatcacacagaaagaattcatgaaccagcattggtaccactgtcacacctgtaaaatggtggatggcgtgggtgtctgcacagtgtgtgctaaggtgtgccacaaggatcatgagatttcctatgccaagtatggatccttcttctgtgactgtggagccaaggaagatggcagctgtttggctctggtgaagagaactcctagcagtggcatgagctctaccatgaaggagtcggcatttcagagtgaacccaggatttcagagagtctagtgcgtcatgccagcacctcctcgccagctgacaaagccaaggttaccatcagtgatggaaaggttgctgacgaagagaagcccaagaagagcagcctctgccgcacagtagagggctgccgggaggaattacagaaccaggccaatttctccttcgctcctctcgtgttagacatgcttaatttccttatggatgccattcagaccaacttccagcaagcttcagccgtcgggagcagcagccgtgctcagcaagccctcagtgagctacacactgtggagaaggcagtggagatgacagaccagctgatggttcccaccttagggtcccaggaaggtgcctttgagaatgtgcggatgaattacagtggagaccagggccagaccatccggcagctgatcagtgctcatgtgctcaggcgggtggctatgtgtgtgctctcctctccccatgggcgccgccaacatttggctgtcagccatgagaagggcaagatcaccgttctgcagctctctgcactcctgaagcaagcagattccagcaaaaggaagttaactctgacccgcttggcttctgccccagttccttttactgtgttgagcctcacaggaaatccctgcaaggaagactacttggcggtttgtgggctaaaggactgtcatgtgctcacctttagtagctcaggctctgtttcggatcacttggttttgcaccctcagttggcaacggggaacttcatcatcaaagccgtgtggttacctggttcacagaccgagttagcaattgtcaccgcagactttgttaagatttatgacctgtgtgttgatgccttgagtccaaccttctattttctcctgccaagctcaaagataagagatgttaccttccttttcaatgaggagggaaagaacatcattgttataatgtcttcggctgggtacatctatactcagcttatggaagaggccagcagtgcccagcagggacccttctatgtcactaatgtgttggaaatcaatcatgaggacctgaaggacagtaacagccaggtggcgggcggtggtgtgtccgtgtactactcccacgtgttgcagatgttgttcttcagctattgtcaaggcaaatcattcgcagccaccatcagcaggacaaccctggaggtgttgcaactcttccccatcaacatcaaaagttccaatggtggcagtaagacttctcctgctctttgccagtggtctgaggtgatgaaccaccctggcttggtgtgctgtgtccagcaaactacaggggtgccgctggtagttatggtgaaaccagacacttttcttatccaggagattaagactcttcctgctaaagcgaagatccaagacatggttgctattaggcacacggcctgcaatgagcagcagcggacaacaatgattctgctgtgtgaggatggcagcctgcgcatttacatggccaacgtggagaacacctcctactggctgcagccatccctgcagcccagcagtgtcatcagcatcatgaagcctgttcgaaagcgcaaaacagctacaatcacaacccgcacgtctagccaggtgactttccccattgacttttttgaacacaaccagcagctgacagatgtggagtttggtggtaacgacctcctacaggtctataatgcacaacagataaaacaccggctgaattccactggcatgtatgtggccaacaccaagcccggaggcttcaccattgagattagtaacaacaatagcactatggtgatgacaggcatgcggatccagattgggactcaagcaatagaacgggccccgtcatatatcgagatcttcggcagaactatgcagctcaacctgagtcgctcacgctggtttgacttccccttcaccagagaagaagccctgcaggctgataagaagctgaacctcttcattggggcctcggtggatccagcaggtgtcaccatgatagatgctgtaaaaatttatggcaagactaaggagcagtttggctggcctgatgagcccccagaagaattcccttctgcctctgtcagcaacatctgcccttcaaatctgaaccagagcaacggcactggagatagcgactcagctgcccccactacgaccagtggaactgtcctggagaggctggttgtgagttctttagaagccctggaaagctgctttgccgttggcccaatcatcgagaaggagagaaacaagaatgctgctcaggagctggccactttgctgttgtccctgccagcacctgccagtgtccagcagcagtccaagagccttctggccagcctgcacaccagccgctcggcctaccacagccacaaggatcaggccttgctgagcaaagctgtgcagtgtctcaacacatctagcaaagagggcaaggatttggaccctgaggtgttccagaggctagtgatcacagctcgctccattgccatcatgcgccccaacaaccttgtccactttacggagtcaaagctgccccagatggaaacagactgtttttttcctagatgtgcctgctggagtctagggatagttggcatattgattggggccccacttgaaactccctccccaggcaagcttccttgacctgagttaaccttaaaacaaattaaattccatctcagatttaccatcgttgataattttctttctcctgcttagaaggaatggatgaagggaaggaaccgcagaagcagttggaaggagattgctgtagtttcatcacccagcttgtgaaccacttctggaaactccatgcatccaaacccaagaatgccttcttggcacctgcctgccttccaggactaactcatattgaagctactgtcaatgctctggtggacatcatccatggctactgtacctgtgagctggattgtattaacacagcatccaagatctacatgcagatgctcttgtgtcctgatcctgctgtgagcttctcttgtaaacaagctctaattcgagtcctaaggcccaggaacaaacggagacatgtgactttaccctcttcccctcgaagcaacactccaatgggagacaaggatgatgatgacgatgatgatgcagatgagaaaatgcagtcatcagggatcccgaatggtggtcacatccgtcaggaaagccaggaacagagtgaggtggaccatggagattttgagatggtgtctgagtcgatggtcctggagacagctgaaaatgtcaacaatggcaacccctctcccctggaggccctgctggcaggcgcagagggcttcccccccatgctggacatcccacctgatgcagatgacgagaccatggttgaactagccattgccctgagcctgcagcaggaccaacaaggcagcagcagcagtgccctgggcctgcagagcctgggactgtccggccaggcacccagctcttcctctctggacgcaggaaccctctctgacaccacagcatcagctccagcctcagacgacgagggcagtacagcagcgacagatggttctacccttcggacctctcctgctgaccacggtggtagtgtgggctcggagagcgggggcagtgcagtggactcagtggctggcgagcacagtgtatctggccggagcagtgcttatggcgatgctacagctgaggggcatccggctggaccaggaagtgtcagctcaagcactggagccatcagcaccaccactgggcaccaggagggagatggctccgagggagaaggagaaggagaaactgaaggagatgtccacactagcaacaggctgcacatggtccgtctaatgctgttggagagattactgcagaccctgcctcaattacgaaacgttggcggtgtccgggccatcccatacatgcaggtcattctaatgctcactacagatctggatggagaagatgagaaagacaagggggccctagacaacctgctctcccagcttattgctgagttgggtatggataaaaaggatgtctccaagaagaatgagcgcagcgccctgaatgaagtccatctggtagtaatgagactcctgagtgtcttcatgtcccgcaccaaatctggatccaagtcttccatatgtgagtcatcttccctcatctccagtgccacagcagcagctctactgagctctggggctgtggactactgcctgcacgtgctcaaatcactgctggaatattggaagagccaacagaatgacgaggagcctgtggctaccagccagttgctgaaaccacatactacctcctccccacctgacatgagcccattctttctccgccagtatgtgaagggtcatgctgctgatgtgtttgaggcctatactcagcttctaacagaaatggtactgaggcttccttaccaaatcaaaaagattactgacaccaattctcgaatcccacctcctgtctttgaccactcgtggttttactttctctccgagtacctcatgatccagcagactccatttgtgcgccgtcaagtccgcaaacttctgctcttcatctgtggatccaaagagaagtaccgccagctccgggatttgcacaccctggactctcacgtgcgtgggatcaagaagctgctagaagagcaggggatattcctccgggcaagtgtggttacagccagctcaggctccgccttgcaatatgacacactcatcagcctgatggagcacctgaaagcctgtgcagagattgccgcccagcgaaccatcaactggcagaaattctgcatcaaagatgactccgtcctgtacttcctcctccaagtcagtttccttgtggatgagggcgtgtccccagtgctgctgcaactgctctcctgtgctctctgcggcagcaaggtgctcgctgcactggcagcctcttcgggatcctccagtgcttcttcctcctcagcccctgtggctgccagttctggacaagccacaacacagtccaagtcttccactaaaaagagcaagaaagaagaaaaagaaaaggagaaagatggtgagacctctggcagccaggaggaccagctgtgcacagctctggtgaaccagctgaacaaatttgccgataaggaaaccctgatccagttcctgcgttgtttcctgttagagtccaattcttcctcggtgcgctggcaggcccactgtctgacactgcacatctacagaaattccagcaaatctcaacaggagctcctgctagatctgatgtggtccatctggccagaactcccagcctatggtcgtaaggctgcccagtttgtggacctactaggatatttctccctgaaaactccacaaacagagaagaagttgaaggagtattcacagaaggctgtggagattctgcggactcaaaaccatattcttaccaaccaccccaactcgaacatttataacactttgtctggcttagtggagtttgatggctattacctggagagcgatccctgcctggtgtgtaataacccggaagtaccgttctgttatatcaagctgtcttccattaaagtggacacgcggtacaccaccacccagcaggttgtgaagctcattggcagtcacaccatcagcaaagtgacagtgaaaatcggggatctgaaacggaccaagatggtgcggaccatcaacctgtattataacaaccgaaccgtgcaggccatcgtggagttgaaaaacaagccagctcgctggcacaaagccaagaaggttcagctgacccctggacagacagaggtgaagattgacctgccgttgcccattgtggcctccaatctgatgattgagtttgcagacttctatgaaaactaccaggcctccacagagaccctgcagtgccctcgctgtagtgcctcggtccctgccaacccaggagtctgtggcaactgtggagagaatgtgtaccagtgtcacaaatgcagatccatcaactacgatgaaaaggatcccttcctctgcaatgcctgtggcttctgtaaatatgcccgcttcgacttcatgctctatgccaagccttgctgtgcagtggatcccattgagaatgaagaagaccggaagaaggctgtatccaacatcaatacacttttggacaaagctgatcgagtgtatcatcagctgatgggacaccggccacagctggagaacctgctctgcaaagtgaatgaggcagctccagaaaagccacaggatgactcaggaacagcagggggcatcagctccacttctgccagtgtgaatcgttacatcctgcagttggctcaggagtattgtggagactgcaagaactcttttgatgaactctccaaaatcatccagaaagtctttgcttcgcgcaaagagttgttggaatatgacctacagcagagggaagcagccactaaatcatcccggacctccgtgcagcccacattcactgccagccagtaccgtgccttatccgtcctgggctgtggccacacatcctccaccaagtgctatggctgcgcctcggctgtcacagaacattgtatcacactacttcgggccctggccaccaacccagccttgaggcacatccttgtctcccagggccttatccgggagctctttgattataatcttcgccgaggggctgcggccatgcgggaggaggtccgccagctcatgtgcctcctaactcgagacaacccagaagccacccaacagatgaatgacctgattattggcaaggtctccacagccctgaagggccactgggccaaccccgatctggcaagtagcctgcagtatgaaatgctgctgctgacggattctatctccaaggaggacagctgctgggagctccggttacgctgtgctctcagccttttcctcatggctgtgaacattaagactcctgtggtggttgaaaacattaccctcatgtgcctgaggatcttgcagaagctgataaaaccacctgctcccactagcaagaagaacaaggatgtccccgtcgaggccctcaccacggtgaagccatactgcaatgagatccatgcccaggctcaactgtggctcaagagagaccccaaggcatcctatgatgcctggaagaagtgtcttcctatcagagggatagatggcaatgggaaagcccccagcaaatcagagctccgccatctctatttgactgagaagtatgtgtggaggtggaaacagttcctgagtcgtcgggggaagaggacctcccccttggatctcaaactggggcataacaactggctgcgacaagtgcttttcactccagcaacgcaggccgcacggcaggcagcctgtaccattgtggaagctctagccaccattcccagccgcaagcagcaggtcctggacctgcttaccagttacctggatgagctgagcatagctggggagtgtgcagctgagtacctggctctctaccagaagctcatcacttctgcgcactggaaagtctacttggcagctcggggagtcctaccctatgtgggcaacctcatcaccaaggaaatagctcgtctgctggccctggaggaggctaccctgagtaccgatctgcagcagggttatgcccttaaaagtctcacaggccttctctcctcctttgttgaggtggaatccatcaaaagacattttaaaagtcgcttggtgggtactgtgctgaatggatacctgtgcttgcggaagctggtggtgcagaggaccaagctgatcgatgagacgcaggacatgctgctggagatgctggaggacatgaccacaggtacagaatcagaaaccaaggccttcatggctgtgtgcattgagacagccaagcgctacaatctggatgactaccggaccccggtgttcatcttcgagaggctctgcagcatcatttatcctgaggagaatgaagtcactgagttctttgtgaccctggagaaggatccccaacaagaagacttcttacagggcaggatgcctgggaacccgtatagcagcaatgagccaggcatcgggccgctgatgagggatataaagaacaagatttgccaggactgtgacttagtggccctcctggaagatgacagtggcatggagcttctagtgaacaataaaatcattagtttggaccttcctgtggctgaagtttacaagaaagtctggtgtaccacgaatgagggagagcccatgaggattgtttatcgtatgcgggggctgctgggcgatgccacagaggagttcattgagtccctggactctactacagatgaagaagaagatgaagaagaagtgtataaaatggctggtgtgatggcccagtgtgggggcctggaatgcatgcttaacagactcgcagggatcagagatttcaagcagggacgccaccttctaacagtgctactgaaattgttcagttactgcgtgaaggtgaaagtcaaccggcagcaactggtcaaactggaaatgaacaccttgaacgtcatgctggggaccctaaacctggcccttgtagctgaacaagaaagcaaggacagtgggggtgcagctgtggctgagcaggtgcttagcatcatggagatcattctagatgagtccaatgctgagcccctgagtgaggacaagggcaacctcctcctgacaggtgacaaggatcaactggtgatgctcttggaccagatcaacagcacctttgttcgctccaaccccagtgtgctccagggcctgcttcgcatcatcccgtacctttcctttggagaggtggagaaaatgcagatcttggtggagcgattcaaaccatactgcaactttgataaatatgatgaagatcacagtggtgatgataaagtcttcctggactgcttctgtaaaatagctgctggcatcaagaacaacagcaatgggcaccagctgaaggatctgattctccagaaggggatcacccagaatgcacttgactacatgaaaaagcacatccctagcgccaagaatttggatgccgacatctggaaaaagtttttgtctcgcccagccttgccatttatcctaaggctgcttcggggcctggccatccagcaccctggcacccaggttctgattggaactgattccatcccgaacctgcataagctggagcaggtgtccagtgatgagggcattgggaccttggcagagaacctgctggaagccctgcgggaacaccctgacgtaaacaagaagattgacgcagcccgcagggagacccgggcagagaagaaacgcatggccatggcaatgaggcagaaggccctgggcaccctgggcatgacgacaaatgaaaagggccaggtcgtgaccaagacagcactcctgaagcagatggaagagctgatcgaggagcctggcctcacgtgctgcatctgcagggagggatacaagttccagcccacaaaggtcctgggcatttataccttcacgaagcgggtagccttggaggagttggagaataagccccggaaacagcagggctacagcaccgtgtcccacttcaacattgtgcactacgactgccatctggctgccgtcaggttggctcgaggccgggaagagtgggagagtgccgccctgcagaatgccaacaccaagtgcaacgggctccttccggtctggggacctcatgtccctgaatcagcttttgccacttgcttggcaagacacaacacttacctccaggaatgtacaggccagcgggagcccacgtatcagctcaacatccacgacatcaaactgctcttcctgcgcttcgccatggagcagtcgttcagcgcagacactggcgggggcggccgggagagcaacatccacctgatcccgtacatcattcacactgtgctttacgtcctgaacacaacccgagcaacttcccgagaagagaagaacctccaaggctttctggaacagcccaaggagaagtgggtggagagtgcctttgaagtggacgggccctactatttcacagtcttggcccttcacatcctgccccctgagcagtggagagccacacgtgtggaaatcttgcggaggctgttggtgacctcgcaggctcgggcagtggctccaggtggagccaccaggctgacagataaggcagtgaaggactattccgcttaccgttcttcccttctcttttgggccctcgtcgatctcatttacaacatgtttaagaaggtgcctaccagtaacacagagggaggctggtcctgctctctcgctgagtacatccgccacaacgacatgcccatctacgaagctgccgacaaagccctgaaaaccttccaggaggagttcatgccagtggagaccttctcagagttcctcgatgtggccggtcttttatcagaaatcaccgatccagagagcttcctgaaggacctgttgaactcagtcccctgaccaccacacagcagctgcggcggcgaagacgaagctggcttgccttccaccctctgttctccctccttgtgcattaagttccctccgcgggatgctgcattgttaccccgccctcccctctctcatttttcttggtgtggcttggggtttttaggcttcctgttttatctcgtgtgtgtggtgcaccagctatgaggttgtctgtaacccaagccatcaaagggcctgtacatacctaggagccatgagttgtcccggccagcttcatacttgagtgtgcacatcttgagaaataaacaagtgacttaacacacattgaaaaaananaaanaaaaaaagaaaaaaaaaaacaaaaaaaaaaaaaaaaaaaaaaggggggggggcccccaaaaaatccccacgcggggggggccccaagatgatgccgcccccccgcagntattttgggtagatgacagaggaggggccccccccaatagagagggggcacccctatttattaataaaagcgcacagcgacgcgggccgccccgctatttacacaaacgcgcggcggacggaggtgagaaaacaacgtgccgacgcgggaggacaccttttgggaagggaccccccactgaccgcgggggggggggaacacacaagtggggccaccaacactccccgga

SEQ ID NO: 356669 - DNA, 12511 bp, Homo sapiens
gtgacctagaggttccgccacaagcgcgatctcaaaggtccaggtctctttggatgagcatttttctaagatggctgctgagactgatcctcataagtcgtctgagattaccaagaacctacttccagccacgctgcaactcattgacacctatgcatcgttcaccagagcctatttgctgcaaaactttaatgaagagggaacaactgagaaaccttccaaggagaaactgcaaggctttgctgctgttttggctattggctctagcaggtgcaaggcaaatactctgggtccgacactggttcagaatttgccatcgtcagtgcagactgtgtgtgagtcctggaacaacatcaataccaatgaatttcccaatattggatcctggcgcaatgcctttgccaatgacaccatcccttcagagagttatattagtgcagtgcaggctgcacacctggggactctctgtagccaaagtctgcccctggctgcttccctgaagcataccctcctctcactggtcaggttgactggagatcttattgtttggtcagatgagatgaacccaccacaggtaattcggacactgctacctcttcttttggaatcaagcactgagagtgttgccgagatcagtagcaactccctggaacgcatcttgggccctgctgagtctgatgagttcttggctcgtgtttatgagaagctgatcactggttgttacaacattctggccaatcatgcagatcctaacagtggactggatgaatccatcctggaggaatgtctccagtacttggaaaagcagctggaaagtagccaggctcgtaaagctatggaggagtttttctctgacagtggagaacttgtacagatcatgatggcaacagccaatgagaacctctctgctaaattctgtaaccgagttttgaaattcttcaccaaactcttccagctgactgagaagagccctaacccgagcctgttgcatctctgtggctccctggcacaactggcctgtgtggaacctgtgcgcctgcaggcctggctcacccgcatgactacatcgcccccaaaagattctgatcagctggatgtaattcaggagaaccggcagctgctgcagttactgaccacatacattgttcgggaaaacagccaagttggggaaggtgtgtgtgctgttcttctgggcaccctgactcccatggcaacagagatgctggccaacggtgatgggactggcttccctgaacttatggttgtgatggccactctggccagtgcaggtcaaggtgctggtcaccttcagcttcataatgctgctgtggattggctgagcagatgcaagaaatacctgtcacagaagaatgtagttgaaaaactgaatgccaatgtaatgcatggaaagcatgtgatgatcttggagtgcacatgccatatcatgtcttacttggctgatgtcacgaatgccctgagccagagtaatggtcaaggcccaagtcatctctcagtggatggggaagagcgggccattgaagtagactcagactgggtggaggagttggcggtggaagaggaagattcccaggctgaggattcagatgaagattctctttgcaataaactctgcacttttacgatcacacagaaagaattcatgaaccagcattggtaccactgtcacacctgtaaaatggtggatggcgtgggtgtctgcacagtgtgtgctaaggtgtgccacaaggatcatgagatttcctatgccaagtatggatccttcttctgtgactgtggagccaaggaagatggcagctgtttggctctggtgaagagaactcctagcagtggcatgagctctaccatgaaggagtcggcatttcagagtgaacccaggatttcagagagtctagtgcgtcatgccagcacctcctcgccagctgacaaagccaaggttaccatcagtgatggaaaggttgctgacgaagagaagcccaagaagagcagcctctgccgcacagtagagggctgccgggaggaattacagaaccaggccaatttctccttcgctcctctcgtgttagacatgcttaatttccttatggatgccattcagaccaacttccagcaagcttcagccgtcgggagcagcagccgtgctcagcaagccctcagtgagctacacactgtggagaaggcagtggagatgacagaccagctgatggttcccaccttagggtcccaggaaggtgcctttgagaatgtgcggatgaattacagtggagaccagggccagaccatccggcagctgatcagtgctcatgtgctcaggcgggtggctatgtgtgtgctctcctctccccatgggcgccgccaacatttggctgtcagccatgagaagggcaagatcaccgttctgcagctctctgcactcctgaagcaagcagattccagcaaaaggaagttaactctgacccgcttggcttctgccccagttccttttactgtgttgagcctcacaggaaatccctgcaaggaagactacttggcggtttgtgggctaaaggactgtcatgtgctcacctttagtagctcaggctctgtttcggatcacttggttttgcaccctcagttggcaacggggaacttcatcatcaaagccgtgtggttacctggttcacagaccgagttagcaattgtcaccgcagactttgttaagatttatgacctgtgtgttgatgccttgagtccaaccttctattttctcctgccaagctcaaagataagagatgttaccttccttttcaatgaggagggaaagaacatcattgttataatgtcttcggctgggtacatctatactcagcttatggaagaggccagcagtgcccagcagggacccttctatgtcactaatgtgttggaaatcaatcatgaggacctgaaggacagtaacagccaggtggcgggcggtggtgtgtccgtgtactactcccacgtgttgcagatgttgttcttcagctattgtcaaggcaaatcattcgcagccaccatcagcaggacaaccctggaggtgttgcaactcttccccatcaacatcaaaagttccaatggtggcagtaagacttctcctgctctttgccagtggtctgaggtgatgaaccaccctggcttggtgtgctgtgtccagcaaactacaggggtgccgctggtagttatggtgaaaccagacacttttcttatccaggagattaagactcttcctgctaaagcgaagatccaagacatggttgctattaggcacacggcctgcaatgagcagcagcggacaacaatgattctgctgtgtgaggatggcagcctgcgcatttacatggccaacgtggagaacacctcctactggctgcagccatccctgcagcccagcagtgtcatcagcatcatgaagcctgttcgaaagcgcaaaacagctacaatcacaacccgcacgtctagccaggtgactttccccattgacttttttgaacacaaccagcagctgacagatgtggagtttggtggtaacgacctcctacaggtctataatgcacaacagataaaacaccggctgaattccactggcatgtatgtggccaacaccaagcccggaggcttcaccattgagattagtaacaacaatagcactatggtgatgacaggcatgcggatccagattgggactcaagcaatagaacgggccccgtcatatatcgagatcttcggcagaactatgcagctcaacctgagtcgctcacgctggtttgacttccccttcaccagagaagaagccctgcaggctgataagaagctgaacctcttcattggggcctcggtggatccagcaggtgtcaccatgatagatgctgtaaaaatttatggcaagactaaggagcagtttggctggcctgatgagcccccagaagaattcccttctgcctctgtcagcaacatctgcccttcaaatctgaaccagagcaacggcactggagatagcgactcagctgcccccactacgaccagtggaactgtcctggagaggctggttgtgagttctttagaagccctggaaagctgctttgccgttggcccaatcatcgagaaggagagaaacaagaatgctgctcaggagctggccactttgctgttgtccctgccagcacctgccagtgtccagcagcagtccaagagccttctggccagcctgcacaccagccgctcggcctaccacagccacaaggatcaggccttgctgagcaaagctgtgcagtgtctcaacacatctagcaaagagggcaaggatttggaccctgaggtgttccagaggctagtgatcacagctcgctccattgccatcatgcgccccaacaaccttgtccactttacggagtcaaagctgccccagatggaaacagactgtttttttcctagatgtgcctgctggagtctagggatagttggcatattgattggggccccacttgaaactccctccccaggcaagcttccttgacctgagttaaccttaaaacaaattaaattccatctcagatttaccatcgttgataattttctttctcctgcttagaaggaatggatgaagggaaggaaccgcagaagcagttggaaggagattgctgtagtttcatcacccagcttgtgaaccacttctggaaactccatgcatccaaacccaagaatgccttcttggcacctgcctgccttccaggactaactcatattgaagctactgtcaatgctctggtggacatcatccatggctactgtacctgtgagctggattgtattaacacagcatccaagatctacatgcagatgctcttgtgtcctgatcctgctgtgagcttctcttgtaaacaagctctaattcgagtcctaaggcccaggaacaaacggagacatgtgactttaccctcttcccctcgaagcaacactccaatgggagacaaggatgatgatgacgatgatgatgcagatgagaaaatgcagtcatcagggatcccgaatggtggtcacatccgtcaggaaagccaggaacagagtgaggtggaccatggagattttgagatggtgtctgagtcgatggtcctggagacagctgaaaatgtcaacaatggcaacccctctcccctggaggccctgctggcaggcgcagagggcttcccccccatgctggacatcccacctgatgcagatgacgagaccatggttgaactagccattgccctgagcctgcagcaggaccaacaaggcagcagcagcagtgccctgggcctgcagagcctgggactgtccggccaggcacccagctcttcctctctggacgcaggaaccctctctgacaccacagcatcagctccagcctcagacgacgagggcagtacagcagcgacagatggttctacccttcggacctctcctgctgaccacggtggtagtgtgggctcggagagcgggggcagtgcagtggactcagtggctggcgagcacagtgtatctggccggagcagtgcttatggcgatgctacagctgaggggcatccggctggaccaggaagtgtcagctcaagcactggagccatcagcaccaccactgggcaccaggagggagatggctccgagggagaaggagaaggagaaactgaaggagatgtccacactagcaacaggctgcacatggtccgtctaatgctgttggagagattactgcagaccctgcctcaattacgaaacgttggcggtgtccgggccatcccatacatgcaggtcattctaatgctcactacagatctggatggagaagatgagaaagacaagggggccctagacaacctgctctcccagcttattgctgagttgggtatggataaaaaggatgtctccaagaagaatgagcgcagcgccctgaatgaagtccatctggtagtaatgagactcctgagtgtcttcatgtcccgcaccaaatctggatccaagtcttccatatgtgagtcatcttccctcatctccagtgccacagcagcagctctactgagctctggggctgtggactactgcctgcacgtgctcaaatcactgctggaatattggaagagccaacagaatgacgaggagcctgtggctaccagccagttgctgaaaccacatactacctcctccccacctgacatgagcccattctttctccgccagtatgtgaagggtcatgctgctgatgtgtttgaggcctatactcagcttctaacagaaatggtactgaggcttccttaccaaatcaaaaagattactgacaccaattctcgaatcccacctcctgtctttgaccactcgtggttttactttctctccgagtacctcatgatccagcagactccatttgtgcgccgtcaagtccgcaaacttctgctcttcatctgtggatccaaagagaagtaccgccagctccgggatttgcacaccctggactctcacgtgcgtgggatcaagaagctgctagaagagcaggggatattcctccgggcaagtgtggttacagccagctcaggctccgccttgcaatatgacacactcatcagcctgatggagcacctgaaagcctgtgcagagattgccgcccagcgaaccatcaactggcagaaattctgcatcaaagatgactccgtcctgtacttcctcctccaagtcagtttccttgtggatgagggcgtgtccccagtgctgctgcaactgctctcctgtgctctctgcggcagcaaggtgctcgctgcactggcagcctcttcgggatcctccagtgcttcttcctcctcagcccctgtggctgccagttctggacaagccacaacacagtccaagtcttccactaaaaagagcaagaaagaagaaaaagaaaaggagaaagatggtgagacctctggcagccaggaggaccagctgtgcacagctctggtgaaccagctgaacaaatttgccgataaggaaaccctgatccagttcctgcgttgtttcctgttagagtccaattcttcctcggtgcgctggcaggcccactgtctgacactgcacatctacagaaattccagcaaatctcaacaggagctcctgctagatctgatgtggtccatctggccagaactcccagcctatggtcgtaaggctgcccagtttgtggacctactaggatatttctccctgaaaactccacaaacagagaagaagttgaaggagtattcacagaaggctgtggagattctgcggactcaaaaccatattcttaccaaccaccccaactcgaacatttataacactttgtctggcttagtggagtttgatggctattacctggagagcgatccctgcctggtgtgtaataacccggaagtaccgttctgttatatcaagctgtcttccattaaagtggacacgcggtacaccaccacccagcaggttgtgaagctcattggcagtcacaccatcagcaaagtgacagtgaaaatcggggatctgaaacggaccaagatggtgcggaccatcaacctgtattataacaaccgaaccgtgcaggccatcgtggagttgaaaaacaagccagctcgctggcacaaagccaagaaggttcagctgacccctggacagacagaggtgaagattgacctgccgttgcccattgtggcctccaatctgatgattgagtttgcagacttctatgaaaactaccaggcctccacagagaccctgcagtgccctcgctgtagtgcctcggtccctgccaacccaggagtctgtggcaactgtggagagaatgtgtaccagtgtcacaaatgcagatccatcaactacgatgaaaaggatcccttcctctgcaatgcctgtggcttctgtaaatatgcccgcttcgacttcatgctctatgccaagccttgctgtgcagtggatcccattgagaatgaagaagaccggaagaaggctgtatccaacatcaatacacttttggacaaagctgatcgagtgtatcatcagctgatgggacaccggccacagctggagaacctgctctgcaaagtgaatgaggcagctccagaaaagccacaggatgactcaggaacagcagggggcatcagctccacttctgccagtgtgaatcgttacatcctgcagttggctcaggagtattgtggagactgcaagaactcttttgatgaactctccaaaatcatccagaaagtctttgcttcgcgcaaagagttgttggaatatgacctacagcagagggaagcagccactaaatcatcccggacctccgtgcagcccacattcactgccagccagtaccgtgccttatccgtcctgggctgtggccacacatcctccaccaagtgctatggctgcgcctcggctgtcacagaacattgtatcacactacttcgggccctggccaccaacccagccttgaggcacatccttgtctcccagggccttatccgggagctctttgattataatcttcgccgaggggctgcggccatgcgggaggaggtccgccagctcatgtgcctcctaactcgagacaacccagaagccacccaacagatgaatgacctgattattggcaaggtctccacagccctgaagggccactgggccaaccccgatctggcaagtagcctgcagtatgaaatgctgctgctgacggattctatctccaaggaggacagctgctgggagctccggttacgctgtgctctcagccttttcctcatggctgtgaacattaagactcctgtggtggttgaaaacattaccctcatgtgcctgaggatcttgcagaagctgataaaaccacctgctcccactagcaagaagaacaaggatgtccccgtcgaggccctcaccacggtgaagccatactgcaatgagatccatgcccaggctcaactgtggctcaagagagaccccaaggcatcctatgatgcctggaagaagtgtcttcctatcagagggatagatggcaatgggaaagcccccagcaaatcagagctccgccatctctatttgactgagaagtatgtgtggaggtggaaacagttcctgagtcgtcgggggaagaggacctcccccttggatctcaaactggggcataacaactggctgcgacaagtgcttttcactccagcaacgcaggccgcacggcaggcagcctgtaccattgtggaagctctagccaccattcccagccgcaagcagcaggtcctggacctgcttaccagttacctggatgagctgagcatagctggggagtgtgcagctgagtacctggctctctaccagaagctcatcacttctgcgcactggaaagtctacttggcagctcggggagtcctaccctatgtgggcaacctcatcaccaaggaaatagctcgtctgctggccctggaggaggctaccctgagtaccgatctgcagcagggttatgcccttaaaagtctcacaggccttctctcctcctttgttgaggtggaatccatcaaaagacattttaaaagtcgcttggtgggtactgtgctgaatggatacctgtgcttgcggaagctggtggtgcagaggaccaagctgatcgatgagacgcaggacatgctgctggagatgctggaggacatgaccacaggtacagaatcagaaaccaaggccttcatggctgtgtgcattgagacagccaagcgctacaatctggatgactaccggaccccggtgttcatcttcgagaggctctgcagcatcatttatcctgaggagaatgaagtcactgagttctttgtgaccctggagaaggatccccaacaagaagacttcttacagggcaggatgcctgggaacccgtatagcagcaatgagccaggcatcgggccgctgatgagggatataaagaacaagatttgccaggactgtgacttagtggccctcctggaagatgacagtggcatggagcttctagtgaacaataaaatcattagtttggaccttcctgtggctgaagtttacaagaaagtctggtgtaccacgaatgagggagagcccatgaggattgtttatcgtatgcgggggctgctgggcgatgccacagaggagttcattgagtccctggactctactacagatgaagaagaagatgaagaagaagtgtataaaatggctggtgtgatggcccagtgtgggggcctggaatgcatgcttaacagactcgcagggatcagagatttcaagcagggacgccaccttctaacagtgctactgaaattgttcagttactgcgtgaaggtgaaagtcaaccggcagcaactggtcaaactggaaatgaacaccttgaacgtcatgctggggaccctaaacctggcccttgtagctgaacaagaaagcaaggacagtgggggtgcagctgtggctgagcaggtgcttagcatcatggagatcattctagatgagtccaatgctgagcccctgagtgaggacaagggcaacctcctcctgacaggtgacaaggatcaactggtgatgctcttggaccagatcaacagcacctttgttcgctccaaccccagtgtgctccagggcctgcttcgcatcatcccgtacctttcctttggagaggtggagaaaatgcagatcttggtggagcgattcaaaccatactgcaactttgataaatatgatgaagatcacagtggtgatgataaagtcttcctggactgcttctgtaaaatagctgctggcatcaagaacaacagcaatgggcaccagctgaaggatctgattctccagaaggggatcacccagaatgcacttgactacatgaaaaagcacatccctagcgccaagaatttggatgccgacatctggaaaaagtttttgtctcgcccagccttgccatttatcctaaggctgcttcggggcctggccatccagcaccctggcacccaggttctgattggaactgattccatcccgaacctgcataagctggagcaggtgtccagtgatgagggcattgggaccttggcagagaacctgctggaagccctgcgggaacaccctgacgtaaacaagaagattgacgcagcccgcagggagacccgggcagagaagaaacgcatggccatggcaatgaggcagaaggccctgggcaccctgggcatgacgacaaatgaaaagggccaggtcgtgaccaagacagcactcctgaagcagatggaagagctgatcgaggagcctggcctcacgtgctgcatctgcagggagggatacaagttccagcccacaaaggtcctgggcatttataccttcacgaagcgggtagccttggaggagttggagaataagccccggaaacagcagggctacagcaccgtgtcccacttcaacattgtgcactacgactgccatctggctgccgtcaggttggctcgaggccgggaagagtgggagagtgccgccctgcagaatgccaacaccaagtgcaacgggctccttccggtctggggacctcatgtccctgaatcagcttttgccacttgcttggcaagacacaacacttacctccaggaatgtacaggccagcgggagcccacgtatcagctcaacatccacgacatcaaactgctcttcctgcgcttcgccatggagcagtcgttcagcgcagacactggcgggggcggccgggagagcaacatccacctgatcccgtacatcattcacactgtgctttacgtcctgaacacaacccgagcaacttcccgagaagagaagaacctccaaggctttctggaacagcccaaggagaagtgggtggagagtgcctttgaagtggacgggccctactatttcacagtcttggcccttcacatcctgccccctgagcagtggagagccacacgtgtggaaatcttgcggaggctgttggtgacctcgcaggctcgggcagtggctccaggtggagccaccaggctgacagataaggcagtgaaggactattccgcttaccgttcttcccttctcttttgggccctcgtcgatctcatttacaacatgtttaagaaggtgcctaccagtaacacagagggaggctggtcctgctctctcgctgagtacatccgccacaacgacatgcccatctacgaagctgccgacaaagccctgaaaaccttccaggaggagttcatgccagtggagaccttctcagagttcctcgatgtggccggttagtgtcaaggttttctcttttaaagatcctccgcagcaaagccccatgtcttcctccgtgggtcatccgtagctttatcttcacgaccagaggaaacgcagtatgaaccagcctgtcagctgccactgaaagccctgggaaagatgcgtaaatagcaagtcaccgataacgagaacagcagctctaacatgtactgagcac

SEQ ID NO: 356670 - DNA, 12111 bp, Homo sapiens
gtgacctagaggttccgccacaagcgcgatctcaaaggtccaggtctctttggatgagcatttttctaagatggctgctgagactgatcctcataagtcgtctgagattaccaagaacctacttccagccacgctgcaactcattgacacctatgcatcgttcaccagagcctatttgctgcaaaactttaatgaagagggaacaactgagaaaccttccaaggagaaactgcaaggctttgctgctgttttggctattggctctagcaggtgcaaggcaaatactctgggtccgacactggttcagaatttgccatcgtcagtgcagactgtgtgtgagtcctggaacaacatcaataccaatgaatttcccaatattggatcctggcgcaatgcctttgccaatgacaccatcccttcagagagttatattagtgcagtgcaggctgcacacctggggactctctgtagccaaagtctgcccctggctgcttccctgaagcataccctcctctcactggtcaggttgactggagatcttattgtttggtcagatgagatgaacccaccacaggtaattcggacactgctacctcttcttttggaatcaagcactgagagtgttgccgagatcagtagcaactccctggaacgcatcttgggccctgctgagtctgatgagttcttggctcgtgtttatgagaagctgatcactggttgttacaacattctggccaatcatgcagatcctaacagtggactggatgaatccatcctggaggaatgtctccagtacttggaaaagcagctggaaagtagccaggctcgtaaagctatggaggagtttttctctgacagtggagaacttgtacagatcatgatggcaacagccaatgagaacctctctgctaaattctgtaaccgagttttgaaattcttcaccaaactcttccagctgactgagaagagccctaacccgagcctgttgcatctctgtggctccctggcacaactggcctgtgtggaacctgtgcgcctgcaggcctggctcacccgcatgactacatcgcccccaaaagattctgatcagctggatgtaattcaggagaaccggcagctgctgcagttactgaccacatacattgttcgggaaaacagccaagttggggaaggtgtgtgtgctgttcttctgggcaccctgactcccatggcaacagagatgctggccaacggtgatgggactggcttccctgaacttatggttgtgatggccactctggccagtgcaggtcaaggtgctggtcaccttcagcttcataatgctgctgtggattggctgagcagatgcaagaaatacctgtcacagaagaatgtagttgaaaaactgaatgccaatgtaatgcatggaaagcatgtgatgatcttggagtgcacatgccatatcatgtcttacttggctgatgtcacgaatgccctgagccagagtaatggtcaaggcccaagtcatctctcagtggatggggaagagcgggccattgaagtagactcagactgggtggaggagttggcggtggaagaggaagattcccaggctgaggattcagatgaagattctctttgcaataaactctgcacttttacgatcacacagaaagaattcatgaaccagcattggtaccactgtcacacctgtaaaatggtggatggcgtgggtgtctgcacagtgtgtgctaaggtgtgccacaaggatcatgagatttcctatgccaagtatggatccttcttctgtgactgtggagccaaggaagatggcagctgtttggctctggtgaagagaactcctagcagtggcatgagctctaccatgaaggagtcggcatttcagagtgaacccaggatttcagagagtctagtgcgtcatgccagcacctcctcgccagctgacaaagccaaggttaccatcagtgatggaaaggttgctgacgaagagaagcccaagaagagcagcctctgccgcacagtagagggctgccgggaggaattacagaaccaggccaatttctccttcgctcctctcgtgttagacatgcttaatttccttatggatgccattcagaccaacttccagcaagcttcagccgtcgggagcagcagccgtgctcagcaagccctcagtgagctacacactgtggagaaggcagtggagatgacagaccagctgatggttcccaccttagggtcccaggaaggtgcctttgagaatgtgcggatgaattacagtggagaccagggccagaccatccggcagctgatcagtgctcatgtgctcaggcgggtggctatgtgtgtgctctcctctccccatgggcgccgccaacatttggctgtcagccatgagaagggcaagatcaccgttctgcagctctctgcactcctgaagcaagcagattccagcaaaaggaagttaactctgacccgcttggcttctgccccagttccttttactgtgttgagcctcacaggaaatccctgcaaggaagactacttggcggtttgtgggctaaaggactgtcatgtgctcacctttagtagctcaggctctgtttcggatcacttggttttgcaccctcagttggcaacggggaacttcatcatcaaagccgtgtggttacctggttcacagaccgagttagcaattgtcaccgcagactttgttaagatttatgacctgtgtgttgatgccttgagtccaaccttctattttctcctgccaagctcaaagataagagatgttaccttccttttcaatgaggagggaaagaacatcattgttataatgtcttcggctgggtacatctatactcagcttatggaagaggccagcagtgcccagcagggacccttctatgtcactaatgtgttggaaatcaatcatgaggacctgaaggacagtaacagccaggtggcgggcggtggtgtgtccgtgtactactcccacgtgttgcagatgttgttcttcagctattgtcaaggcaaatcattcgcagccaccatcagcaggacaaccctggaggtgttgcaactcttccccatcaacatcaaaagttccaatggtggcagtaagacttctcctgctctttgccagtggtctgaggtgatgaaccaccctggcttggtgtgctgtgtccagcaaactacaggggtgccgctggtagttatggtgaaaccagacacttttcttatccaggagattaagactcttcctgctaaagcgaagatccaagacatggttgctattaggcacacggcctgcaatgagcagcagcggacaacaatgattctgctgtgtgaggatggcagcctgcgcatttacatggccaacgtggagaacacctcctactggctgcagccatccctgcagcccagcagtgtcatcagcatcatgaagcctgttcgaaagcgcaaaacagctacaatcacaacccgcacgtctagccaggtgactttccccattgacttttttgaacacaaccagcagctgacagatgtggagtttggtggtaacgacctcctacaggtctataatgcacaacagataaaacaccggctgaattccactggcatgtatgtggccaacaccaagcccggaggcttcaccattgagattagtaacaacaatagcactatggtgatgacaggcatgcggatccagattgggactcaagcaatagaacgggccccgtcatatatcgagatcttcggcagaactatgcagctcaacctgagtcgctcacgctggtttgacttccccttcaccagagaagaagccctgcaggctgataagaagctgaacctcttcattggggcctcggtggatccagcaggtgtcaccatgatagatgctgtaaaaatttatggcaagactaaggagcagtttggctggcctgatgagcccccagaagaattcccttctgcctctgtcagcaacatctgcccttcaaatctgaaccagagcaacggcactggagatagcgactcagctgcccccactacgaccagtggaactgtcctggagaggctggttgtgagttctttagaagccctggaaagctgctttgccgttggcccaatcatcgagaaggagagaaacaagaatgctgctcaggagctggccactttgctgttgtccctgccagcacctgccagtgtccagcagcagtccaagagccttctggccagcctgcacaccagccgctcggcctaccacagccacaaggatcaggccttgctgagcaaagctgtgcagtgtctcaacacatctagcaaagagggcaaggatttggaccctgaggtgttccagaggctagtgatcacagctcgctccattgccatcatgcgccccaacaaccttgtccactttacggagtcaaagctgccccagatggaaacagactgtttttttcctagatgtgcctgctggagtctagggatagttggcatattgattggggccccacttgaaactccctccccaggcaagcttccttgacctgagttaaccttaaaacaaattaaattccatctcagatttaccatcgttgataattttctttctcctgcttagaaggaatggatgaagggaaggaaccgcagaagcagttggaaggagattgctgtagtttcatcacccagcttgtgaaccacttctggaaactccatgcatccaaacccaagaatgccttcttggcacctgcctgccttccaggactaactcatattgaagctactgtcaatgctctggtggacatcatccatggctactgtacctgtgagctggattgtattaacacagcatccaagatctacatgcagatgctcttgtgtcctgatcctgctgtgagcttctcttgtaaacaagctctaattcgagtcctaaggcccaggaacaaacggagacatgtgactttaccctcttcccctcgaagcaacactccaatgggagacaaggatgatgatgacgatgatgatgcagatgagaaaatgcagtcatcagggatcccgaatggtggtcacatccgtcaggaaagccaggaacagagtgaggtggaccatggagattttgagatggtgtctgagtcgatggtcctggagacagctgaaaatgtcaacaatggcaacccctctcccctggaggccctgctggcaggcgcagagggcttcccccccatgctggacatcccacctgatgcagatgacgagaccatggttgaactagccattgccctgagcctgcagcaggaccaacaaggcagcagcagcagtgccctgggcctgcagagcctgggactgtccggccaggcacccagctcttcctctctggacgcaggaaccctctctgacaccacagcatcagctccagcctcagacgacgagggcagtacagcagcgacagatggttctacccttcggacctctcctgctgaccacggtggtagtgtgggctcggagagcgggggcagtgcagtggactcagtggctggcgagcacagtgtatctggccggagcagtgcttatggcgatgctacagctgaggggcatccggctggaccaggaagtgtcagctcaagcactggagccatcagcaccaccactgggcaccaggagggagatggctccgagggagaaggagaaggagaaactgaaggagatgtccacactagcaacaggctgcacatggtccgtctaatgctgttggagagattactgcagaccctgcctcaattacgaaacgttggcggtgtccgggccatcccatacatgcaggtcattctaatgctcactacagatctggatggagaagatgagaaagacaagggggccctagacaacctgctctcccagcttattgctgagttgggtatggataaaaaggatgtctccaagaagaatgagcgcagcgccctgaatgaagtccatctggtagtaatgagactcctgagtgtcttcatgtcccgcaccaaatctggatccaagtcttccatatgtgagtcatcttccctcatctccagtgccacagcagcagctctactgagctctggggctgtggactactgcctgcacgtgctcaaatcactgctggaatattggaagagccaacagaatgacgaggagcctgtggctaccagccagttgctgaaaccacatactacctcctccccacctgacatgagcccattctttctccgccagtatgtgaagggtcatgctgctgatgtgtttgaggcctatactcagcttctaacagaaatggtactgaggcttccttaccaaatcaaaaagattactgacaccaattctcgaatcccacctcctgtctttgaccactcgtggttttactttctctccgagtacctcatgatccagcagactccatttgtgcgccgtcaagtccgcaaacttctgctcttcatctgtggatccaaagagaagtaccgccagctccgggatttgcacaccctggactctcacgtgcgtgggatcaagaagctgctagaagagcaggggatattcctccgggcaagtgtggttacagccagctcaggctccgccttgcaatatgacacactcatcagcctgatggagcacctgaaagcctgtgcagagattgccgcccagcgaaccatcaactggcagaaattctgcatcaaagatgactccgtcctgtacttcctcctccaagtcagtttccttgtggatgagggcgtgtccccagtgctgctgcaactgctctcctgtgctctctgcggcagcaaggtgctcgctgcactggcagcctcttcgggatcctccagtgcttcttcctcctcagcccctgtggctgccagttctggacaagccacaacacagtccaagtcttccactaaaaagagcaagaaagaagaaaaagaaaaggagaaagatggtgagacctctggcagccaggaggaccagctgtgcacagctctggtgaaccagctgaacaaatttgccgataaggaaaccctgatccagttcctgcgttgtttcctgttagagtccaattcttcctcggtgcgctggcaggcccactgtctgacactgcacatctacagaaattccagcaaatctcaacaggagctcctgctagatctgatgtggtccatctggccagaactcccagcctatggtcgtaaggctgcccagtttgtggacctactaggatatttctccctgaaaactccacaaacagagaagaagttgaaggagtattcacagaaggctgtggagattctgcggactcaaaaccatattcttaccaaccaccccaactcgaacatttataacactttgtctggcttagtggagtttgatggctattacctggagagcgatccctgcctggtgtgtaataacccggaagtaccgttctgttatatcaagctgtcttccattaaagtggacacgcggtacaccaccacccagcaggttgtgaagctcattggcagtcacaccatcagcaaagtgacagtgaaaatcggggatctgaaacggaccaagatggtgcggaccatcaacctgtattataacaaccgaaccgtgcaggccatcgtggagttgaaaaacaagccagctcgctggcacaaagccaagaaggttcagctgacccctggacagacagaggtgaagattgacctgccgttgcccattgtggcctccaatctgatgattgagtttgcagacttctatgaaaactaccaggcctccacagagaccctgcagtgccctcgctgtagtgcctcggtccctgccaacccaggagtctgtggcaactgtggagagaatgtgtaccagtgtcacaaatgcagatccatcaactacgatgaaaaggatcccttcctctgcaatgcctgtggcttctgtaaatatgcccgcttcgacttcatgctctatgccaagccttgctgtgcagtggatcccattgagaatgaagaagaccggaagaaggctgtatccaacatcaatacacttttggacaaagctgatcgagtgtatcatcagctgatgggacaccggccacagctggagaacctgctctgcaaagtgaatgaggcagctccagaaaagccacaggatgactcaggaacagcagggggcatcagctccacttctgccagtgtgaatcgttacatcctgcagttggctcaggagtattgtggagactgcaagaactcttttgatgaactctccaaaatcatccagaaagtctttgcttcgcgcaaagagttgttggaatatgacctacagcagagggaagcagccactaaatcatcccggacctccgtgcagcccacattcactgccagccagtaccgtgccttatccgtcctgggctgtggccacacatcctccaccaagtgctatggctgcgcctcggctgtcacagaacattgtatcacactacttcgggccctggccaccaacccagccttgaggcacatccttgtctcccagggccttatccgggagctctttgattataatcttcgccgaggggctgcggccatgcgggaggaggtccgccagctcatgtgcctcctaactcgagacaacccagaagccacccaacagatgaatgacctgattattggcaaggtctccacagccctgaagggccactgggccaaccccgatctggcaagtagcctgcagtatgaaatgctgctgctgacggattctatctccaaggaggacagctgctgggagctccggttacgctgtgctctcagccttttcctcatggctgtgaacattaagactcctgtggtggttgaaaacattaccctcatgtgcctgaggatcttgcagaagctgataaaaccacctgctcccactagcaagaagaacaaggatgtccccgtcgaggccctcaccacggtgaagccatactgcaatgagatccatgcccaggctcaactgtggctcaagagagaccccaaggcatcctatgatgcctggaagaagtgtcttcctatcagagggatagatggcaatgggaaagcccccagcaaatcagagctccgccatctctatttgactgagaagtatgtgtggaggtggaaacagttcctgagtcgtcgggggaagaggacctcccccttggatctcaaactggggcataacaactggctgcgacaagtgcttttcactccagcaacgcaggccgcacggcaggcagcctgtaccattgtggaagctctagccaccattcccagccgcaagcagcaggtcctggacctgcttaccagttacctggatgagctgagcatagctggggagtgtgcagctgagtacctggctctctaccagaagctcatcacttctgcgcactggaaagtctacttggcagctcggggagtcctaccctatgtgggcaacctcatcaccaaggaaatagctcgtctgctggccctggaggaggctaccctgagtaccgatctgcagcagggttatgcccttaaaagtctcacaggccttctctcctcctttgttgaggtggaatccatcaaaagacattttaaaagtcgcttggtgggtactgtgctgaatggatacctgtgcttgcggaagctggtggtgcagaggaccaagctgatcgatgagacgcaggacatgctgctggagatgctggaggacatgaccacaggtacagaatcagaaaccaaggccttcatggctgtgtgcattgagacagccaagcgctacaatctggatgactaccggaccccggtgttcatcttcgagaggctctgcagcatcatttatcctgaggagaatgaagtcactgagttctttgtgaccctggagaaggatccccaacaagaagacttcttacagggcaggatgcctgggaacccgtatagcagcaatgagccaggcatcgggccgctgatgagggatataaagaacaagatttgccaggactgtgacttagtggccctcctggaagatgacagtggcatggagcttctagtgaacaataaaatcattagtttggaccttcctgtggctgaagtttacaagaaagtctggtgtaccacgaatgagggagagcccatgaggattgtttatcgtatgcgggggctgctgggcgatgccacagaggagttcattgagtccctggactctactacagatgaagaagaagatgaagaagaagtgtataaaatggctggtgtgatggcccagtgtgggggcctggaatgcatgcttaacagactcgcagggatcagagatttcaagcagggacgccaccttctaacagtgctactgaaattgttcagttactgcgtgaaggtgaaagtcaaccggcagcaactggtcaaactggaaatgaacaccttgaacgtcatgctggggaccctaaacctggcccttgtagctgaacaagaaagcaaggacagtgggggtgcagctgtggctgagcaggtgcttagcatcatggagatcattctagatgagtccaatgctgagcccctgagtgaggacaagggcaacctcctcctgacaggtgacaaggatcaactggtgatgctcttggaccagatcaacagcacctttgttcgctccaaccccagtgtgctccagggcctgcttcgcatcatcccgtacctttcctttggagaggtggagaaaatgcagatcttggtggagcgattcaaaccatactgcaactttgataaatatgatgaagatcacagtggtgatgataaagtcttcctggactgcttctgtaaaatagctgctggcatcaagaacaacagcaatgggcaccagctgaaggatctgattctccagaaggggatcacccagaatgcacttgactacatgaaaaagcacatccctagcgccaagaatttggatgccgacatctggaaaaagtttttgtctcgcccagccttgccatttatcctaaggctgcttcggggcctggccatccagcaccctggcacccaggttctgattggaactgattccatcccgaacctgcataagctggagcaggtgtccagtgatgagggcattgggaccttggcagagaacctgctggaagccctgcgggaacaccctgacgtaaacaagaagattgacgcagcccgcagggagacccgggcagagaagaaacgcatggccatggcaatgaggcagaaggccctgggcaccctgggcatgacgacaaatgaaaagggccaggtcgtgaccaagacagcactcctgaagcagatggaagagctgatcgaggagcctggcctcacgtgctgcatctgcagggagggatacaagttccagcccacaaaggtcctgggcatttataccttcacgaagcgggtagccttggaggagttggagaataagccccggaaacagcagggctacagcaccgtgtcccacttcaacattgtgcactacgactgccatctggctgccgtcaggttggctcgaggccgggaagagtgggagagtgccgccctgcagaatgccaacaccaagtgcaacgggctccttccggtctggggacctcatgtccctgaatcagcttttgccacttgcttggcaagacacaacacttacctccaggaatgtacaggccagcgggagcccacgtatcagctcaacatccacgacatcaaactgctcttcctgcgcttcgccatggagcagtcgttcagcgcagacactggcgggggcggccgggagagcaacatccacctgatcccgtacatcattcacactgtgctttacgtcctgaacacaacccgagcaacttcccgagaagagaagaacctccaaggctttctggaacagcccaaggagaagtgggtggagagtgcctttgaagtggacgggccctactatttcacagtcttggcccttcacatcctgccccctgagcagtggagagccacacgtgtggaaatcttgcggaggctgttggtgacctcgcaggctcgggcagtggctccaggtggagccaccaggtcagtacctgcttccggaagctgctgctcactatttcccatcatcagttttgaaaag

SEQ ID NO: 356671 - DNA, 11733 bp, Homo sapiens
gtgacctagaggttccgccacaagcgcgatctcaaaggtccaggtctctttggatgagcatttttctaagatggctgctgagactgatcctcataagtcgtctgagattaccaagaacctacttccagccacgctgcaactcattgacacctatgcatcgttcaccagagcctatttgctgcaaaactttaatgaagagggaacaactgagaaaccttccaaggagaaactgcaaggctttgctgctgttttggctattggctctagcaggtgcaaggcaaatactctgggtccgacactggttcagaatttgccatcgtcagtgcagactgtgtgtgagtcctggaacaacatcaataccaatgaatttcccaatattggatcctggcgcaatgcctttgccaatgacaccatcccttcagagagttatattagtgcagtgcaggctgcacacctggggactctctgtagccaaagtctgcccctggctgcttccctgaagcataccctcctctcactggtcaggttgactggagatcttattgtttggtcagatgagatgaacccaccacaggtaattcggacactgctacctcttcttttggaatcaagcactgagagtgttgccgagatcagtagcaactccctggaacgcatcttgggccctgctgagtctgatgagttcttggctcgtgtttatgagaagctgatcactggttgttacaacattctggccaatcatgcagatcctaacagtggactggatgaatccatcctggaggaatgtctccagtacttggaaaagcagctggaaagtagccaggctcgtaaagctatggaggagtttttctctgacagtggagaacttgtacagatcatgatggcaacagccaatgagaacctctctgctaaattctgtaaccgagttttgaaattcttcaccaaactcttccagctgactgagaagagccctaacccgagcctgttgcatctctgtggctccctggcacaactggcctgtgtggaacctgtgcgcctgcaggcctggctcacccgcatgactacatcgcccccaaaagattctgatcagctggatgtaattcaggagaaccggcagctgctgcagttactgaccacatacattgttcgggaaaacagccaagttggggaaggtgtgtgtgctgttcttctgggcaccctgactcccatggcaacagagatgctggccaacggtgatgggactggcttccctgaacttatggttgtgatggccactctggccagtgcaggtcaaggtgctggtcaccttcagcttcataatgctgctgtggattggctgagcagatgcaagaaatacctgtcacagaagaatgtagttgaaaaactgaatgccaatgtaatgcatggaaagcatgtgatgatcttggagtgcacatgccatatcatgtcttacttggctgatgtcacgaatgccctgagccagagtaatggtcaaggcccaagtcatctctcagtggatggggaagagcgggccattgaagtagactcagactgggtggaggagttggcggtggaagaggaagattcccaggctgaggattcagatgaagattctctttgcaataaactctgcacttttacgatcacacagaaagaattcatgaaccagcattggtaccactgtcacacctgtaaaatggtggatggcgtgggtgtctgcacagtgtgtgctaaggtgtgccacaaggatcatgagatttcctatgccaagtatggatccttcttctgtgactgtggagccaaggaagatggcagctgtttggctctggtgaagagaactcctagcagtggcatgagctctaccatgaaggagtcggcatttcagagtgaacccaggatttcagagagtctagtgcgtcatgccagcacctcctcgccagctgacaaagccaaggttaccatcagtgatggaaaggttgctgacgaagagaagcccaagaagagcagcctctgccgcacagtagagggctgccgggaggaattacagaaccaggccaatttctccttcgctcctctcgtgttagacatgcttaatttccttatggatgccattcagaccaacttccagcaagcttcagccgtcgggagcagcagccgtgctcagcaagccctcagtgagctacacactgtggagaaggcagtggagatgacagaccagctgatggttcccaccttagggtcccaggaaggtgcctttgagaatgtgcggatgaattacagtggagaccagggccagaccatccggcagctgatcagtgctcatgtgctcaggcgggtggctatgtgtgtgctctcctctccccatgggcgccgccaacatttggctgtcagccatgagaagggcaagatcaccgttctgcagctctctgcactcctgaagcaagcagattccagcaaaaggaagttaactctgacccgcttggcttctgccccagttccttttactgtgttgagcctcacaggaaatccctgcaaggaagactacttggcggtttgtgggctaaaggactgtcatgtgctcacctttagtagctcaggctctgtttcggatcacttggttttgcaccctcagttggcaacggggaacttcatcatcaaagccgtgtggttacctggttcacagaccgagttagcaattgtcaccgcagactttgttaagatttatgacctgtgtgttgatgccttgagtccaaccttctattttctcctgccaagctcaaagataagagatgttaccttccttttcaatgaggagggaaagaacatcattgttataatgtcttcggctgggtacatctatactcagcttatggaagaggccagcagtgcccagcagggacccttctatgtcactaatgtgttggaaatcaatcatgaggacctgaaggacagtaacagccaggtggcgggcggtggtgtgtccgtgtactactcccacgtgttgcagatgttgttcttcagctattgtcaaggcaaatcattcgcagccaccatcagcaggacaaccctggaggtgttgcaactcttccccatcaacatcaaaagttccaatggtggcagtaagacttctcctgctctttgccagtggtctgaggtgatgaaccaccctggcttggtgtgctgtgtccagcaaactacaggggtgccgctggtagttatggtgaaaccagacacttttcttatccaggagattaagactcttcctgctaaagcgaagatccaagacatggttgctattaggcacacggcctgcaatgagcagcagcggacaacaatgattctgctgtgtgaggatggcagcctgcgcatttacatggccaacgtggagaacacctcctactggctgcagccatccctgcagcccagcagtgtcatcagcatcatgaagcctgttcgaaagcgcaaaacagctacaatcacaacccgcacgtctagccaggtgactttccccattgacttttttgaacacaaccagcagctgacagatgtggagtttggtggtaacgacctcctacaggtctataatgcacaacagataaaacaccggctgaattccactggcatgtatgtggccaacaccaagcccggaggcttcaccattgagattagtaacaacaatagcactatggtgatgacaggcatgcggatccagattgggactcaagcaatagaacgggccccgtcatatatcgagatcttcggcagaactatgcagctcaacctgagtcgctcacgctggtttgacttccccttcaccagagaagaagccctgcaggctgataagaagctgaacctcttcattggggcctcggtggatccagcaggtgtcaccatgatagatgctgtaaaaatttatggcaagactaaggagcagtttggctggcctgatgagcccccagaagaattcccttctgcctctgtcagcaacatctgcccttcaaatctgaaccagagcaacggcactggagatagcgactcagctgcccccactacgaccagtggaactgtcctggagaggctggttgtgagttctttagaagccctggaaagctgctttgccgttggcccaatcatcgagaaggagagaaacaagaatgctgctcaggagctggccactttgctgttgtccctgccagcacctgccagtgtccagcagcagtccaagagccttctggccagcctgcacaccagccgctcggcctaccacagccacaaggatcaggccttgctgagcaaagctgtgcagtgtctcaacacatctagcaaagagggcaaggatttggaccctgaggtgttccagaggctagtgatcacagctcgctccattgccatcatgcgccccaacaaccttgtccactttacggagtcaaagctgccccagatggaaacagactgtttttttcctagatgtgcctgctggagtctagggatagttggcatattgattggggccccacttgaaactccctccccaggcaagcttccttgacctgagttaaccttaaaacaaattaaattccatctcagatttaccatcgttgataattttctttctcctgcttagaaggaatggatgaagggaaggaaccgcagaagcagttggaaggagattgctgtagtttcatcacccagcttgtgaaccacttctggaaactccatgcatccaaacccaagaatgccttcttggcacctgcctgccttccaggactaactcatattgaagctactgtcaatgctctggtggacatcatccatggctactgtacctgtgagctggattgtattaacacagcatccaagatctacatgcagatgctcttgtgtcctgatcctgctgtgagcttctcttgtaaacaagctctaattcgagtcctaaggcccaggaacaaacggagacatgtgactttaccctcttcccctcgaagcaacactccaatgggagacaaggatgatgatgacgatgatgatgcagatgagaaaatgcagtcatcagggatcccgaatggtggtcacatccgtcaggaaagccaggaacagagtgaggtggaccatggagattttgagatggtgtctgagtcgatggtcctggagacagctgaaaatgtcaacaatggcaacccctctcccctggaggccctgctggcaggcgcagagggcttcccccccatgctggacatcccacctgatgcagatgacgagaccatggttgaactagccattgccctgagcctgcagcaggaccaacaaggcagcagcagcagtgccctgggcctgcagagcctgggactgtccggccaggcacccagctcttcctctctggacgcaggaaccctctctgacaccacagcatcagctccagcctcagacgacgagggcagtacagcagcgacagatggttctacccttcggacctctcctgctgaccacggtggtagtgtgggctcggagagcgggggcagtgcagtggactcagtggctggcgagcacagtgtatctggccggagcagtgcttatggcgatgctacagctgaggggcatccggctggaccaggaagtgtcagctcaagcactggagccatcagcaccaccactgggcaccaggagggagatggctccgagggagaaggagaaggagaaactgaaggagatgtccacactagcaacaggctgcacatggtccgtctaatgctgttggagagattactgcagaccctgcctcaattacgaaacgttggcggtgtccgggccatcccatacatgcaggtcattctaatgctcactacagatctggatggagaagatgagaaagacaagggggccctagacaacctgctctcccagcttattgctgagttgggtatggataaaaaggatgtctccaagaagaatgagcgcagcgccctgaatgaagtccatctggtagtaatgagactcctgagtgtcttcatgtcccgcaccaaatctggatccaagtcttccatatgtgagtcatcttccctcatctccagtgccacagcagcagctctactgagctctggggctgtggactactgcctgcacgtgctcaaatcactgctggaatattggaagagccaacagaatgacgaggagcctgtggctaccagccagttgctgaaaccacatactacctcctccccacctgacatgagcccattctttctccgccagtatgtgaagggtcatgctgctgatgtgtttgaggcctatactcagcttctaacagaaatggtactgaggcttccttaccaaatcaaaaagattactgacaccaattctcgaatcccacctcctgtctttgaccactcgtggttttactttctctccgagtacctcatgatccagcagactccatttgtgcgccgtcaagtccgcaaacttctgctcttcatctgtggatccaaagagaagtaccgccagctccgggatttgcacaccctggactctcacgtgcgtgggatcaagaagctgctagaagagcaggggatattcctccgggcaagtgtggttacagccagctcaggctccgccttgcaatatgacacactcatcagcctgatggagcacctgaaagcctgtgcagagattgccgcccagcgaaccatcaactggcagaaattctgcatcaaagatgactccgtcctgtacttcctcctccaagtcagtttccttgtggatgagggcgtgtccccagtgctgctgcaactgctctcctgtgctctctgcggcagcaaggtgctcgctgcactggcagcctcttcgggatcctccagtgcttcttcctcctcagcccctgtggctgccagttctggacaagccacaacacagtccaagtcttccactaaaaagagcaagaaagaagaaaaagaaaaggagaaagatggtgagacctctggcagccaggaggaccagctgtgcacagctctggtgaaccagctgaacaaatttgccgataaggaaaccctgatccagttcctgcgttgtttcctgttagagtccaattcttcctcggtgcgctggcaggcccactgtctgacactgcacatctacagaaattccagcaaatctcaacaggagctcctgctagatctgatgtggtccatctggccagaactcccagcctatggtcgtaaggctgcccagtttgtggacctactaggatatttctccctgaaaactccacaaacagagaagaagttgaaggagtattcacagaaggctgtggagattctgcggactcaaaaccatattcttaccaaccaccccaactcgaacatttataacactttgtctggcttagtggagtttgatggctattacctggagagcgatccctgcctggtgtgtaataacccggaagtaccgttctgttatatcaagctgtcttccattaaagtggacacgcggtacaccaccacccagcaggttgtgaagctcattggcagtcacaccatcagcaaagtgacagtgaaaatcggggatctgaaacggaccaagatggtgcggaccatcaacctgtattataacaaccgaaccgtgcaggccatcgtggagttgaaaaacaagccagctcgctggcacaaagccaagaaggttcagctgacccctggacagacagaggtgaagattgacctgccgttgcccattgtggcctccaatctgatgattgagtttgcagacttctatgaaaactaccaggcctccacagagaccctgcagtgccctcgctgtagtgcctcggtccctgccaacccaggagtctgtggcaactgtggagagaatgtgtaccagtgtcacaaatgcagatccatcaactacgatgaaaaggatcccttcctctgcaatgcctgtggcttctgtaaatatgcccgcttcgacttcatgctctatgccaagccttgctgtgcagtggatcccattgagaatgaagaagaccggaagaaggctgtatccaacatcaatacacttttggacaaagctgatcgagtgtatcatcagctgatgggacaccggccacagctggagaacctgctctgcaaagtgaatgaggcagctccagaaaagccacaggatgactcaggaacagcagggggcatcagctccacttctgccagtgtgaatcgttacatcctgcagttggctcaggagtattgtggagactgcaagaactcttttgatgaactctccaaaatcatccagaaagtctttgcttcgcgcaaagagttgttggaatatgacctacagcagagggaagcagccactaaatcatcccggacctccgtgcagcccacattcactgccagccagtaccgtgccttatccgtcctgggctgtggccacacatcctccaccaagtgctatggctgcgcctcggctgtcacagaacattgtatcacactacttcgggccctggccaccaacccagccttgaggcacatccttgtctcccagggccttatccgggagctctttgattataatcttcgccgaggggctgcggccatgcgggaggaggtccgccagctcatgtgcctcctaactcgagacaacccagaagccacccaacagatgaatgacctgattattggcaaggtctccacagccctgaagggccactgggccaaccccgatctggcaagtagcctgcagtatgaaatgctgctgctgacggattctatctccaaggaggacagctgctgggagctccggttacgctgtgctctcagccttttcctcatggctgtgaacattaagactcctgtggtggttgaaaacattaccctcatgtgcctgaggatcttgcagaagctgataaaaccacctgctcccactagcaagaagaacaaggatgtccccgtcgaggccctcaccacggtgaagccatactgcaatgagatccatgcccaggctcaactgtggctcaagagagaccccaaggcatcctatgatgcctggaagaagtgtcttcctatcagagggatagatggcaatgggaaagcccccagcaaatcagagctccgccatctctatttgactgagaagtatgtgtggaggtggaaacagttcctgagtcgtcgggggaagaggacctcccccttggatctcaaactggggcataacaactggctgcgacaagtgcttttcactccagcaacgcaggccgcacggcaggcagcctgtaccattgtggaagctctagccaccattcccagccgcaagcagcaggtcctggacctgcttaccagttacctggatgagctgagcatagctggggagtgtgcagctgagtacctggctctctaccagaagctcatcacttctgcgcactggaaagtctacttggcagctcggggagtcctaccctatgtgggcaacctcatcaccaaggaaatagctcgtctgctggccctggaggaggctaccctgagtaccgatctgcagcagggttatgcccttaaaagtctcacaggccttctctcctcctttgttgaggtggaatccatcaaaagacattttaaaagtcgcttggtgggtactgtgctgaatggatacctgtgcttgcggaagctggtggtgcagaggaccaagctgatcgatgagacgcaggacatgctgctggagatgctggaggacatgaccacaggtacagaatcagaaaccaaggccttcatggctgtgtgcattgagacagccaagcgctacaatctggatgactaccggaccccggtgttcatcttcgagaggctctgcagcatcatttatcctgaggagaatgaagtcactgagttctttgtgaccctggagaaggatccccaacaagaagacttcttacagggcaggatgcctgggaacccgtatagcagcaatgagccaggcatcgggccgctgatgagggatataaagaacaagatttgccaggactgtgacttagtggccctcctggaagatgacagtggcatggagcttctagtgaacaataaaatcattagtttggaccttcctgtggctgaagtttacaagaaagtctggtgtaccacgaatgagggagagcccatgaggattgtttatcgtatgcgggggctgctgggcgatgccacagaggagttcattgagtccctggactctactacagatgaagaagaagatgaagaagaagtgtataaaatggctggtgtgatggcccagtgtgggggcctggaatgcatgcttaacagactcgcagggatcagagatttcaagcagggacgccaccttctaacagtgctactgaaattgttcagttactgcgtgaaggtgaaagtcaaccggcagcaactggtcaaactggaaatgaacaccttgaacgtcatgctggggaccctaaacctggcccttgtagctgaacaagaaagcaaggacagtgggggtgcagctgtggctgagcaggtgcttagcatcatggagatcattctagatgagtccaatgctgagcccctgagtgaggacaagggcaacctcctcctgacaggtgacaaggatcaactggtgatgctcttggaccagatcaacagcacctttgttcgctccaaccccagtgtgctccagggcctgcttcgcatcatcccgtacctttcctttggagaggtggagaaaatgcagatcttggtggagcgattcaaaccatactgcaactttgataaatatgatgaagatcacagtggtgatgataaagtcttcctggactgcttctgtaaaatagctgctggcatcaagaacaacagcaatgggcaccagctgaaggatctgattctccagaaggggatcacccagaatgcacttgactacatgaaaaagcacatccctagcgccaagaatttggatgccgacatctggaaaaagtttttgtctcgcccagccttgccatttatcctaaggctgcttcggggcctggccatccagcaccctggcacccaggttctgattggaactgattccatcccgaacctgcataagctggagcaggtgtccagtgatgagggcattgggaccttggcagagaacctgctggaagccctgcgggaacaccctgacgtaaacaagaagattgacgcagcccgcagggagacccgggcagagaagaaacgcatggccatggcaatgaggcagaaggccctgggcaccctgggcatgacgacaaatgaaaagggccaggtcgtgaccaagacagcactcctgaagcagatggaagagctgatcgaggagcctggcctcacgtgctgcatctgcagggagggatacaagttccagcccacaaaggtcctgggcatttataccttcacgaagcgggtagccttggaggagttggagaataagccccggaaacagcagggctacagcaccgtgtcccacttcaacattgtgcactacgactgccatctggctgccgtcaggttggctcgaggccgggaagagtgggagagtgccgccctgcagaatgccaacaccaagtgcaacgggctccttccggtctggggacctcatgtccctgaatcagcttttgccacttgcttggcaagggcctgtacatacctaggagccatgagttgtcccggccagcttcatacttgagtgtgcacatcttgagaaataaacaagtgacttaacacacattgaaaa

SEQ ID NO: 356672 - DNA, 1380 bp, Homo sapiens
gagcacatatactaaaattggaacgatacagagaagattagcatggcccctgcgcaaggatgacacgcaaattcgtgaagcgttccatattttaggcggtatgagtttggctgggggccgggcaccccggaagaccgctgggaaccggctttctgggcttttggaggcagaggaggaagatgagttctaccagacgacttatgggggtttcacagaggaatccggagatgatgagtatcaaggggaccagtcagacacagaggacgaagtggactctgactttgacattgatgaaggggatgaaccatccagtgatggagaagcagaagagccaagaaggaagcgccgagtagtcaccaaggcctataaggaacctctcaagagcttaaggcctcgaaaggtcaacaccccggctggtagctctcagaaggcgcgagaagagaaggcactactgccattagaactacaagatgacggctctgacagtcggaagtctatgcgtcagtctacagctgagcatacacgacaaacgttccttcgggtacaggagaggcagggccagtcaagacggcgaaaggggccccactgtgagcggccactaacccaggaggaactgctccgggaggccaagatcacagaagagcttaatttacggtcactggagacatatgagcggctcgaggctgataaaaagaagcaggttcataagaagcggaagtgccccgggcccataatcacctatcattcagtgacagtgccacttgttggggagccaggccccaaggaagagaacgttgacatagaaggacttgatcctgctccctcggtgtctgcattgactcctcatgctgggactggacccgtcaacccccctgctcgctgctcacgtaccttcatcacttttagtgatgatgcaactttcgaggaatggttcccccaagggcggcccccaaaagtccctgttcgtgaggtctgtccagtgacccatcgtccagccctataccgggaccctgttacagacataccctatgccactgctcgagccttcaagatcattcgtgaggcttacaagaagtacattactgcccatggactgccgcccactgcctcagccctgggccccggcccgccacctcctgagcccctccctggctctgggccccgagccttgcgccagaaaattgtcattaaatgaagagatgtctagtcctcagaaacttctttcctgccctgattggggctcttgctgttccgtttcttctccctgcttctcccctttgtcatctctgatctttgcctaatctgtttctttttccttttcccctagttcttacaggtttcgttgtgttttttaatctaataaaatagaaagatcccttt

SEQ ID NO: 356673 - DNA, 644 bp, Homo sapiens
gtgagatcgtttcgccccagacctctaatattccgcttaccgttcttcccttctcttttgggccctcgtcgatctcatttacaacatgtttaagaaggtgcctaccagtaacacagagggaggctggtcctgctctctcgctgagtacatccgccacaacgacatgcccatctacgaagctgccgacaaagccctgaaaaccttccaggaggagttcatgccagtggagaccttctcagagttcctcgatgtggccggtcttttatcagaaatcaccgatccagagagcttcctgaaggacctgttgaactcagtcccctgaccaccacacagcagctgcggcggcgaagacgaagctggcttgccttccaccctctgttctccctccttgtgcattaagttccctccgcgggatgctgcattgttaccccgccctcccctctctcatttttcttggtgtggcttggggtttttaggcttcctgttttatctcgtgtgtgtggtgcaccagctatgaggttgtctgtaacccaagccatcaaagggcctgtacatacctaggagccatgagttgtcccggccagcttcatacttgagtgtgcacatcttgagaaataaacaagtgacttaacacacattgaaaa

SEQ ID NO: 356674 - DNA, 9973 bp, Homo sapiens
gtgacctagaggttccgccacaagcgcgatctcaaaggtccaggtctctttggatgagcatttttctaagatggctgctgagactgatcctcataagtcgtctgagattaccaagaacctacttccagccacgctgcaactcattgacacctatgcatcgttcaccagagcctatttgctgcaaaactttaatgaagagggaacaactgagaaaccttccaaggagaaactgcaaggctttgctgctgttttggctattggctctagcaggtgcaaggcaaatactctgggtccgacactggttcagaatttgccatcgtcagtgcagactgtgtgtgagtcctggaacaacatcaataccaatgaatttcccaatattggatcctggcgcaatgcctttgccaatgacaccatcccttcagagagttatattagtgcagtgcaggctgcacacctggggactctctgtagccaaagtctgcccctggctgcttccctgaagcataccctcctctcactggtcaggttgactggagatcttattgtttggtcagatgagatgaacccaccacaggtaattcggacactgctacctcttcttttggaatcaagcactgagagtgttgccgagatcagtagcaactccctggaacgcatcttgggccctgctgagtctgatgagttcttggctcgtgtttatgagaagctgatcactggttgttacaacattctggccaatcatgcagatcctaacagtggactggatgaatccatcctggaggaatgtctccagtacttggaaaagcagctggaaagtagccaggctcgtaaagctatggaggagtttttctctgacagtggagaacttgtacagatcatgatggcaacagccaatgagaacctctctgctaaattctgtaaccgagttttgaaattcttcaccaaactcttccagctgactgagaagagccctaacccgagcctgttgcatctctgtggctccctggcacaactggcctgtgtggaacctgtgcgcctgcaggcctggctcacccgcatgactacatcgcccccaaaagattctgatcagctggatgtaattcaggagaaccggcagctgctgcagttactgaccacatacattgttcgggaaaacagccaagttggggaaggtgtgtgtgctgttcttctgggcaccctgactcccatggcaacagagatgctggccaacggtgatgggactggcttccctgaacttatggttgtgatggccactctggccagtgcaggtcaaggtgctggtcaccttcagcttcataatgctgctgtggattggctgagcagatgcaagaaatacctgtcacagaagaatgtagttgaaaaactgaatgccaatgtaatgcatggaaagcatgtgatgatcttggagtgcacatgccatatcatgtcttacttggctgatgtcacgaatgccctgagccagagtaatggtcaaggcccaagtcatctctcagtggatggggaagagcgggccattgaagtagactcagactgggtggaggagttggcggtggaagaggaagattcccaggctgaggattcagatgaagattctctttgcaataaactctgcacttttacgatcacacagaaagaattcatgaaccagcattggtaccactgtcacacctgtaaaatggtggatggcgtgggtgtctgcacagtgtgtgctaaggtgtgccacaaggatcatgagatttcctatgccaagtatggatccttcttctgtgactgtggagccaaggaagatggcagctgtttggctctggtgaagagaactcctagcagtggcatgagctctaccatgaaggagtcggcatttcagagtgaacccaggatttcagagagtctagtgcgtcatgccagcacctcctcgccagctgacaaagccaaggttaccatcagtgatggaaaggttgctgacgaagagaagcccaagaagagcagcctctgccgcacagtagagggctgccgggaggaattacagaaccaggccaatttctccttcgctcctctcgtgttagacatgcttaatttccttatggatgccattcagaccaacttccagcaagcttcagccgtcgggagcagcagccgtgctcagcaagccctcagtgagctacacactgtggagaaggcagtggagatgacagaccagctgatggttcccaccttagggtcccaggaaggtgcctttgagaatgtgcggatgaattacagtggagaccagggccagaccatccggcagctgatcagtgctcatgtgctcaggcgggtggctatgtgtgtgctctcctctccccatgggcgccgccaacatttggctgtcagccatgagaagggcaagatcaccgttctgcagctctctgcactcctgaagcaagcagattccagcaaaaggaagttaactctgacccgcttggcttctgccccagttccttttactgtgttgagcctcacaggaaatccctgcaaggaagactacttggcggtttgtgggctaaaggactgtcatgtgctcacctttagtagctcaggctctgtttcggatcacttggttttgcaccctcagttggcaacggggaacttcatcatcaaagccgtgtggttacctggttcacagaccgagttagcaattgtcaccgcagactttgttaagatttatgacctgtgtgttgatgccttgagtccaaccttctattttctcctgccaagctcaaagataagagatgttaccttccttttcaatgaggagggaaagaacatcattgttataatgtcttcggctgggtacatctatactcagcttatggaagaggccagcagtgcccagcagggacccttctatgtcactaatgtgttggaaatcaatcatgaggacctgaaggacagtaacagccaggtggcgggcggtggtgtgtccgtgtactactcccacgtgttgcagatgttgttcttcagctattgtcaaggcaaatcattcgcagccaccatcagcaggacaaccctggaggtgttgcaactcttccccatcaacatcaaaagttccaatggtggcagtaagacttctcctgctctttgccagtggtctgaggtgatgaaccaccctggcttggtgtgctgtgtccagcaaactacaggggtgccgctggtagttatggtgaaaccagacacttttcttatccaggagattaagactcttcctgctaaagcgaagatccaagacatggttgctattaggcacacggcctgcaatgagcagcagcggacaacaatgattctgctgtgtgaggatggcagcctgcgcatttacatggccaacgtggagaacacctcctactggctgcagccatccctgcagcccagcagtgtcatcagcatcatgaagcctgttcgaaagcgcaaaacagctacaatcacaacccgcacgtctagccaggtgactttccccattgacttttttgaacacaaccagcagctgacagatgtggagtttggtggtaacgacctcctacaggtctataatgcacaacagataaaacaccggctgaattccactggcatgtatgtggccaacaccaagcccggaggcttcaccattgagattagtaacaacaatagcactatggtgatgacaggcatgcggatccagattgggactcaagcaatagaacgggccccgtcatatatcgagatcttcggcagaactatgcagctcaacctgagtcgctcacgctggtttgacttccccttcaccagagaagaagccctgcaggctgataagaagctgaacctcttcattggggcctcggtggatccagcaggtgtcaccatgatagatgctgtaaaaatttatggcaagactaaggagcagtttggctggcctgatgagcccccagaagaattcccttctgcctctgtcagcaacatctgcccttcaaatctgaaccagagcaacggcactggagatagcgactcagctgcccccactacgaccagtggaactgtcctggagaggctggttgtgagttctttagaagccctggaaagctgctttgccgttggcccaatcatcgagaaggagagaaacaagaatgctgctcaggagctggccactttgctgttgtccctgccagcacctgccagtgtccagcagcagtccaagagccttctggccagcctgcacaccagccgctcggcctaccacagccacaaggatcaggccttgctgagcaaagctgtgcagtgtctcaacacatctagcaaagagggcaaggatttggaccctgaggtgttccagaggctagtgatcacagctcgctccattgccatcatgcgccccaacaaccttgtccactttacggagtcaaagctgccccagatggaaacagactgtttttttcctagatgtgcctgctggagtctagggatagttggcatattgattggggccccacttgaaactccctccccaggcaagcttccttgacctgagttaaccttaaaacaaattaaattccatctcagatttaccatcgttgataattttctttctcctgcttagaaggaatggatgaagggaaggaaccgcagaagcagttggaaggagattgctgtagtttcatcacccagcttgtgaaccacttctggaaactccatgcatccaaacccaagaatgccttcttggcacctgcctgccttccaggactaactcatattgaagctactgtcaatgctctggtggacatcatccatggctactgtacctgtgagctggattgtattaacacagcatccaagatctacatgcagatgctcttgtgtcctgatcctgctgtgagcttctcttgtaaacaagctctaattcgagtcctaaggcccaggaacaaacggagacatgtgactttaccctcttcccctcgaagcaacactccaatgggagacaaggatgatgatgacgatgatgatgcagatgagaaaatgcagtcatcagggatcccgaatggtggtcacatccgtcaggaaagccaggaacagagtgaggtggaccatggagattttgagatggtgtctgagtcgatggtcctggagacagctgaaaatgtcaacaatggcaacccctctcccctggaggccctgctggcaggcgcagagggcttcccccccatgctggacatcccacctgatgcagatgacgagaccatggttgaactagccattgccctgagcctgcagcaggaccaacaaggcagcagcagcagtgccctgggcctgcagagcctgggactgtccggccaggcacccagctcttcctctctggacgcaggaaccctctctgacaccacagcatcagctccagcctcagacgacgagggcagtacagcagcgacagatggttctacccttcggacctctcctgctgaccacggtggtagtgtgggctcggagagcgggggcagtgcagtggactcagtggctggcgagcacagtgtatctggccggagcagtgcttatggcgatgctacagctgaggggcatccggctggaccaggaagtgtcagctcaagcactggagccatcagcaccaccactgggcaccaggagggagatggctccgagggagaaggagaaggagaaactgaaggagatgtccacactagcaacaggctgcacatggtccgtctaatgctgttggagagattactgcagaccctgcctcaattacgaaacgttggcggtgtccgggccatcccatacatgcaggtcattctaatgctcactacagatctggatggagaagatgagaaagacaagggggccctagacaacctgctctcccagcttattgctgagttgggtatggataaaaaggatgtctccaagaagaatgagcgcagcgccctgaatgaagtccatctggtagtaatgagactcctgagtgtcttcatgtcccgcaccaaatctggatccaagtcttccatatgtgagtcatcttccctcatctccagtgccacagcagcagctctactgagctctggggctgtggactactgcctgcacgtgctcaaatcactgctggaatattggaagagccaacagaatgacgaggagcctgtggctaccagccagttgctgaaaccacatactacctcctccccacctgacatgagcccattctttctccgccagtatgtgaagggtcatgctgctgatgtgtttgaggcctatactcagcttctaacagaaatggtactgaggcttccttaccaaatcaaaaagattactgacaccaattctcgaatcccacctcctgtctttgaccactcgtggttttactttctctccgagtacctcatgatccagcagactccatttgtgcgccgtcaagtccgcaaacttctgctcttcatctgtggatccaaagagaagtaccgccagctccgggatttgcacaccctggactctcacgtgcgtgggatcaagaagctgctagaagagcaggggatattcctccgggcaagtgtggttacagccagctcaggctccgccttgcaatatgacacactcatcagcctgatggagcacctgaaagcctgtgcagagattgccgcccagcgaaccatcaactggcagaaattctgcatcaaagatgactccgtcctgtacttcctcctccaagtcagtttccttgtggatgagggcgtgtccccagtgctgctgcaactgctctcctgtgctctctgcggcagcaaggtgctcgctgcactggcagcctcttcgggatcctccagtgcttcttcctcctcagcccctgtggctgccagttctggacaagccacaacacagtccaagtcttccactaaaaagagcaagaaagaagaaaaagaaaaggagaaagatggtgagacctctggcagccaggaggaccagctgtgcacagctctggtgaaccagctgaacaaatttgccgataaggaaaccctgatccagttcctgcgttgtttcctgttagagtccaattcttcctcggtgcgctggcaggcccactgtctgacactgcacatctacagaaattccagcaaatctcaacaggagctcctgctagatctgatgtggtccatctggccagaactcccagcctatggtcgtaaggctgcccagtttgtggacctactaggatatttctccctgaaaactccacaaacagagaagaagttgaaggagtattcacagaaggctgtggagattctgcggactcaaaaccatattcttaccaaccaccccaactcgaacatttataacactttgtctggcttagtggagtttgatggctattacctggagagcgatccctgcctggtgtgtaataacccggaagtaccgttctgttatatcaagctgtcttccattaaagtggacacgcggtacaccaccacccagcaggttgtgaagctcattggcagtcacaccatcagcaaagtgacagtgaaaatcggggatctgaaacggaccaagatggtgcggaccatcaacctgtattataacaaccgaaccgtgcaggccatcgtggagttgaaaaacaagccagctcgctggcacaaagccaagaaggttcagctgacccctggacagacagaggtgaagattgacctgccgttgcccattgtggcctccaatctgatgattgagtttgcagacttctatgaaaactaccaggcctccacagagaccctgcagtgccctcgctgtagtgcctcggtccctgccaacccaggagtctgtggcaactgtggagagaatgtgtaccagtgtcacaaatgcagatccatcaactacgatgaaaaggatcccttcctctgcaatgcctgtggcttctgtaaatatgcccgcttcgacttcatgctctatgccaagccttgctgtgcagtggatcccattgagaatgaagaagaccggaagaaggctgtatccaacatcaatacacttttggacaaagctgatcgagtgtatcatcagctgatgggacaccggccacagctggagaacctgctctgcaaagtgaatgaggcagctccagaaaagccacaggatgactcaggaacagcagggggcatcagctccacttctgccagtgtgaatcgttacatcctgcagttggctcaggagtattgtggagactgcaagaactcttttgatgaactctccaaaatcatccagaaagtctttgcttcgcgcaaagagttgttggaatatgacctacagcagagggaagcagccactaaatcatcccggacctccgtgcagcccacattcactgccagccagtaccgtgccttatccgtcctgggctgtggccacacatcctccaccaagtgctatggctgcgcctcggctgtcacagaacattgtatcacactacttcgggccctggccaccaacccagccttgaggcacatccttgtctcccagggccttatccgggagctctttgattataatcttcgccgaggggctgcggccatgcgggaggaggtccgccagctcatgtgcctcctaactcgagacaacccagaagccacccaacagatgaatgacctgattattggcaaggtctccacagccctgaagggccactgggccaaccccgatctggcaagtagcctgcagtatgaaatgctgctgctgacggattctatctccaaggaggacagctgctgggagctccggttacgctgtgctctcagccttttcctcatggctgtgaacattaagactcctgtggtggttgaaaacattaccctcatgtgcctgaggatcttgcagaagctgataaaaccacctgctcccactagcaagaagaacaaggatgtccccgtcgaggccctcaccacggtgaagccatactgcaatgagatccatgcccaggctcaactgtggctcaagagagaccccaaggcatcctatgatgcctggaagaagtgtcttcctatcagagggatagatggcaatgggaaagcccccagcaaatcagagctccgccatctctatttgactgagaagtatgtgtggaggtggaaacagttcctgagtcgtcgggggaagaggacctcccccttggatctcaaactggggcataacaactggctgcgacaagtgcttttcactccagcaacgcaggccgcacggcaggcagcctgtaccattgtggaagctctagccaccattcccagccgcaagcagcaggtcctggacctgcttaccagttacctggatgagctgagcatagctggggagtgtgcagctgagtacctggctctctaccagaagctcatcacttctgcgcactggaaagtctacttggcagctcggggagtcctaccctatgtgggcaacctcatcaccaaggaaatagctcgtctgctggccctggaggaggctaccctgagtaccgatctgcagcagggttatgcccttaaaagtctcacaggccttctctcctcctttgttgaggtggaatccatcaaaagacattttaaaagtcgcttggtgggtactgtgctgaatggatacctgtgcttgcggaagctggtggtgcagaggaccaagctgatcgatgagacgcaggacatgctgctggagatgctggaggacatgaccacaggtacagaatcagaaaccaaggccttcatggctgtgtgcattgagacagccaagcgctacaatctggatgactaccggaccccggtgttcatcttcgagaggctctgcagcatcatttatcctgaggagaatgaagtcactgagttctttgtgaccctggagaaggatccccaacaagaagacttcttacagggcaggatgcctgggaacccgtatagcagcatctcgctttgaaaggtccgagctcgatttc

SEQ ID NO: 356675 - DNA, 1540 bp, Homo sapiens
gagcacatatactaaaattggaacgatacagagaagattagcatggcccctgcgcaaggatgacacgcaaattcgtgaagcgttccatattttaggcggtatgagtttggctgggggccgggcaccccggaagaccgctgggaaccggctttctgggcttttggaggcagaggaggaagatgagttctaccagacgacttatgggggtttcacagaggaatccggagatgatgagtatcaaggggaccagtcagacacagaggacgaagtggactctgactttgacattgatgaaggggatgaaccatccagtgatggagaagcagaagagccaagaaggaagcgccgagtagtcaccaaggcctataaggaacctctcaagagcttaaggcctcgaaaggtcaacaccccggctggtagctctcagaaggcgcgagaagagaaggcactactgccattagaactacaagatgacggctctgacagtcggaagtctatgcgtcagtctacagctgagcatacacgacaaacgttccttcgggtacaggagaggcagggccagtcaagacggcgaaaggggccccactgtgagcggccactaacccaggaggaactgctccgggaggccaagatcacagaagagcttaatttacggtcactggagacatatgagcggctcgaggctgataaaaagaagcaggttcataagaagcggaagtgccccgggcccataatcacctatcattcagtgacagtgccacttgttggggagccaggccccaaggaagagaacgttgacatagaaggacttgatcctgctccctcggtgtctgcattgactcctcatgctgggactggacccgtcaacccccctgctcgctgctcacgtaccttcatcacttttagtgatgatgcaactttcgaggaatggttcccccaagggcggcccccaaaagtccctgttcgtgaggtctgtccagtgacccatcgtccagccctataccgggaccctgttacagacataccctatgccactgctcgagccttcaagatcattcgtgaggcttacaagaagtacattactgcccatggactgccgcccactgcctcagccctgggccccggcccgccacctcctgagcccctccctggctctgggccccgagccttgcgccagaaaattgtcattaaatgaagagatgtctagtcctcagaaacttctttcctgccctgattggggctcttgctgttccgtttcttctccctgcttctcccctttgtcatctctgatctttgcctaatctgtttctttttccttttcccctagttcttacaggtttcgttgtgttttttaatctaataaaatagaaagatcccttttgtctggtgtccagtctagggttgggagcaagaagtatttgaatacctgcatatatttgggtctttattcgatagcatttattatgagctgtcctttctaaattgtattcattcctccaactaaattataaacatctgaaaattgcacaccaaaacacat

SEQ ID NO: 356676 - DNA, 1726 bp, Homo sapiens
  misc_feature (1383)..(1383): n is a, c, g, or t
  misc_feature (1385)..(1385): n is a, c, g, or t
  misc_feature (1389)..(1389): n is a, c, g, or t
  misc_feature (1497)..(1497): n is a, c, g, or t
gagcacatatactaaaattggaacgatacagagaagattagcatggcccctgcgcaaggatgacacgcaaattcgtgaagcgttccatattttaggcggtatgagtttggctgggggccgggcaccccggaagaccgctgggaaccggctttctgggcttttggaggcagaggaggaagatgagttctaccagacgacttatgggggtttcacagaggaatccggagatgatgagtatcaaggggaccagtcagacacagaggacgaagtggactctgactttgacattgatgaaggggatgaaccatccagtgatggagaagcagaagagccaagaaggaagcgccgagtagtcaccaaggcctataaggaacctctcaagagcttaaggcctcgaaaggtcaacaccccggctggtagctctcagaaggcgcgagaagagaaggcactactgccattagaactacaagatgacggctctgacagtcggaagtctatgcgtcagtctacagctgagcatacacgacaaacgttccttcgggtacaggagaggcagggccagtcaagacggcgaaaggggccccactgtgagcggccactaacccaggaggaactgctccgggaggccaagatcacagaagagcttaatttacggtcactggagacatatgagcggctcgaggctgataaaaagaagcaggttcataagaagcggaagtgccccgggcccataatcacctatcattcagtgacagtgccacttgttggggagccaggccccaaggaagagaacgttgacatagaaggacttgatcctgctccctcggtgtctgcattgactcctcatgctgggactggacccgtcaacccccctgctcgctgctcacgtaccttcatcacttttagtgatgatgcaactttcgaggaatggttcccccaagggcggcccccaaaagtccctgttcgtgaggtctgtccagtgacccatcgtccagccctataccgggaccctgttacagacataccctatgccactgctcgagccttcaagatcattcgtgaggcttacaagaagtacattactgcccatggactgccgcccactgcctcagccctgggccccggcccgccacctcctgagcccctccctggctctgggccccgagccttgcgccagaaaattgtcattaaatgaagagatgtctagtcctcagaaacttctttcctgccctgattggggctcttgctgttccgtttcttctccctgcttctcccctttgtcatctctgatctttgcctaatctgtttctttttccttttcccctagttcttacaggtttcgttgtgttttttaatctaataaaatagaaagatccctttaananaaanaaaaaaagaaaaaaaaaaacaaaaaaaaaaaaaaaaaaaaaaggggggggggcccccaaaaaatccccacgcggggggggccccaagatgatgccgcccccccgcagntattttgggtagatgacagaggaggggccccccccaatagagagggggcacccctatttattaataaaagcgcacagcgacgcgggccgccccgctatttacacaaacgcgcggcggacggaggtgagaaaacaacgtgccgacgcgggaggacaccttttgggaagggaccccccactgaccgcgggggggggggaacacacaagtggggccaccaacactccccgga

SEQ ID NO: 356677 - DNA, 6827 bp, Homo sapiens
gtgacctagaggttccgccacaagcgcgatctcaaaggtccaggtctctttggatgagcatttttctaagatggctgctgagactgatcctcataagtcgtctgagattaccaagaacctacttccagccacgctgcaactcattgacacctatgcatcgttcaccagagcctatttgctgcaaaactttaatgaagagggaacaactgagaaaccttccaaggagaaactgcaaggctttgctgctgttttggctattggctctagcaggtgcaaggcaaatactctgggtccgacactggttcagaatttgccatcgtcagtgcagactgtgtgtgagtcctggaacaacatcaataccaatgaatttcccaatattggatcctggcgcaatgcctttgccaatgacaccatcccttcagagagttatattagtgcagtgcaggctgcacacctggggactctctgtagccaaagtctgcccctggctgcttccctgaagcataccctcctctcactggtcaggttgactggagatcttattgtttggtcagatgagatgaacccaccacaggtaattcggacactgctacctcttcttttggaatcaagcactgagagtgttgccgagatcagtagcaactccctggaacgcatcttgggccctgctgagtctgatgagttcttggctcgtgtttatgagaagctgatcactggttgttacaacattctggccaatcatgcagatcctaacagtggactggatgaatccatcctggaggaatgtctccagtacttggaaaagcagctggaaagtagccaggctcgtaaagctatggaggagtttttctctgacagtggagaacttgtacagatcatgatggcaacagccaatgagaacctctctgctaaattctgtaaccgagttttgaaattcttcaccaaactcttccagctgactgagaagagccctaacccgagcctgttgcatctctgtggctccctggcacaactggcctgtgtggaacctgtgcgcctgcaggcctggctcacccgcatgactacatcgcccccaaaagattctgatcagctggatgtaattcaggagaaccggcagctgctgcagttactgaccacatacattgttcgggaaaacagccaagttggggaaggtgtgtgtgctgttcttctgggcaccctgactcccatggcaacagagatgctggccaacggtgatgggactggcttccctgaacttatggttgtgatggccactctggccagtgcaggtcaaggtgctggtcaccttcagcttcataatgctgctgtggattggctgagcagatgcaagaaatacctgtcacagaagaatgtagttgaaaaactgaatgccaatgtaatgcatggaaagcatgtgatgatcttggagtgcacatgccatatcatgtcttacttggctgatgtcacgaatgccctgagccagagtaatggtcaaggcccaagtcatctctcagtggatggggaagagcgggccattgaagtagactcagactgggtggaggagttggcggtggaagaggaagattcccaggctgaggattcagatgaagattctctttgcaataaactctgcacttttacgatcacacagaaagaattcatgaaccagcattggtaccactgtcacacctgtaaaatggtggatggcgtgggtgtctgcacagtgtgtgctaaggtgtgccacaaggatcatgagatttcctatgccaagtatggatccttcttctgtgactgtggagccaaggaagatggcagctgtttggctctggtgaagagaactcctagcagtggcatgagctctaccatgaaggagtcggcatttcagagtgaacccaggatttcagagagtctagtgcgtcatgccagcacctcctcgccagctgacaaagccaaggttaccatcagtgatggaaaggttgctgacgaagagaagcccaagaagagcagcctctgccgcacagtagagggctgccgggaggaattacagaaccaggccaatttctccttcgctcctctcgtgttagacatgcttaatttccttatggatgccattcagaccaacttccagcaagcttcagccgtcgggagcagcagccgtgctcagcaagccctcagtgagctacacactgtggagaaggcagtggagatgacagaccagctgatggttcccaccttagggtcccaggaaggtgcctttgagaatgtgcggatgaattacagtggagaccagggccagaccatccggcagctgatcagtgctcatgtgctcaggcgggtggctatgtgtgtgctctcctctccccatgggcgccgccaacatttggctgtcagccatgagaagggcaagatcaccgttctgcagctctctgcactcctgaagcaagcagattccagcaaaaggaagttaactctgacccgcttggcttctgccccagttccttttactgtgttgagcctcacaggaaatccctgcaaggaagactacttggcggtttgtgggctaaaggactgtcatgtgctcacctttagtagctcaggctctgtttcggatcacttggttttgcaccctcagttggcaacggggaacttcatcatcaaagccgtgtggttacctggttcacagaccgagttagcaattgtcaccgcagactttgttaagatttatgacctgtgtgttgatgccttgagtccaaccttctattttctcctgccaagctcaaagataagagatgttaccttccttttcaatgaggagggaaagaacatcattgttataatgtcttcggctgggtacatctatactcagcttatggaagaggccagcagtgcccagcagggacccttctatgtcactaatgtgttggaaatcaatcatgaggacctgaaggacagtaacagccaggtggcgggcggtggtgtgtccgtgtactactcccacgtgttgcagatgttgttcttcagctattgtcaaggcaaatcattcgcagccaccatcagcaggacaaccctggaggtgttgcaactcttccccatcaacatcaaaagttccaatggtggcagtaagacttctcctgctctttgccagtggtctgaggtgatgaaccaccctggcttggtgtgctgtgtccagcaaactacaggggtgccgctggtagttatggtgaaaccagacacttttcttatccaggagattaagactcttcctgctaaagcgaagatccaagacatggttgctattaggcacacggcctgcaatgagcagcagcggacaacaatgattctgctgtgtgaggatggcagcctgcgcatttacatggccaacgtggagaacacctcctactggctgcagccatccctgcagcccagcagtgtcatcagcatcatgaagcctgttcgaaagcgcaaaacagctacaatcacaacccgcacgtctagccaggtgactttccccattgacttttttgaacacaaccagcagctgacagatgtggagtttggtggtaacgacctcctacaggtctataatgcacaacagataaaacaccggctgaattccactggcatgtatgtggccaacaccaagcccggaggcttcaccattgagattagtaacaacaatagcactatggtgatgacaggcatgcggatccagattgggactcaagcaatagaacgggccccgtcatatatcgagatcttcggcagaactatgcagctcaacctgagtcgctcacgctggtttgacttccccttcaccagagaagaagccctgcaggctgataagaagctgaacctcttcattggggcctcggtggatccagcaggtgtcaccatgatagatgctgtaaaaatttatggcaagactaaggagcagtttggctggcctgatgagcccccagaagaattcccttctgcctctgtcagcaacatctgcccttcaaatctgaaccagagcaacggcactggagatagcgactcagctgcccccactacgaccagtggaactgtcctggagaggctggttgtgagttctttagaagccctggaaagctgctttgccgttggcccaatcatcgagaaggagagaaacaagaatgctgctcaggagctggccactttgctgttgtccctgccagcacctgccagtgtccagcagcagtccaagagccttctggccagcctgcacaccagccgctcggcctaccacagccacaaggatcaggccttgctgagcaaagctgtgcagtgtctcaacacatctagcaaagagggcaaggatttggaccctgaggtgttccagaggctagtgatcacagctcgctccattgccatcatgcgccccaacaaccttgtccactttacggagtcaaagctgccccagatggaaacagactgtttttttcctagatgtgcctgctggagtctagggatagttggcatattgattggggccccacttgaaactccctccccaggcaagcttccttgacctgagttaaccttaaaacaaattaaattccatctcagatttaccatcgttgataattttctttctcctgcttagaaggaatggatgaagggaaggaaccgcagaagcagttggaaggagattgctgtagtttcatcacccagcttgtgaaccacttctggaaactccatgcatccaaacccaagaatgccttcttggcacctgcctgccttccaggactaactcatattgaagctactgtcaatgctctggtggacatcatccatggctactgtacctgtgagctggattgtattaacacagcatccaagatctacatgcagatgctcttgtgtcctgatcctgctgtgagcttctcttgtaaacaagctctaattcgagtcctaaggcccaggaacaaacggagacatgtgactttaccctcttcccctcgaagcaacactccaatgggagacaaggatgatgatgacgatgatgatgcagatgagaaaatgcagtcatcagggatcccgaatggtggtcacatccgtcaggaaagccaggaacagagtgaggtggaccatggagattttgagatggtgtctgagtcgatggtcctggagacagctgaaaatgtcaacaatggcaacccctctcccctggaggccctgctggcaggcgcagagggcttcccccccatgctggacatcccacctgatgcagatgacgagaccatggttgaactagccattgccctgagcctgcagcaggaccaacaaggcagcagcagcagtgccctgggcctgcagagcctgggactgtccggccaggcacccagctcttcctctctggacgcaggaaccctctctgacaccacagcatcagctccagcctcagacgacgagggcagtacagcagcgacagatggttctacccttcggacctctcctgctgaccacggtggtagtgtgggctcggagagcgggggcagtgcagtggactcagtggctggcgagcacagtgtatctggccggagcagtgcttatggcgatgctacagctgaggggcatccggctggaccaggaagtgtcagctcaagcactggagccatcagcaccaccactgggcaccaggagggagatggctccgagggagaaggagaaggagaaactgaaggagatgtccacactagcaacaggctgcacatggtccgtctaatgctgttggagagattactgcagaccctgcctcaattacgaaacgttggcggtgtccgggccatcccatacatgcaggtcattctaatgctcactacagatctggatggagaagatgagaaagacaagggggccctagacaacctgctctcccagcttattgctgagttgggtatggataaaaaggatgtctccaagaagaatgagcgcagcgccctgaatgaagtccatctggtagtaatgagactcctgagtgtcttcatgtcccgcaccaaatctggatccaagtcttccatatgtgagtcatcttccctcatctccagtgccacagcagcagctctactgagctctggggctgtggactactgcctgcacgtgctcaaatcactgctggaatattggaagagccaacagaatgacgaggagcctgtggctaccagccagttgctgaaaccacatactacctcctccccacctgacatgagcccattctttctccgccagtatgtgaagggtcatgctgctgatgtgtttgaggcctatactcagcttctaacagaaatggtactgaggcttccttaccaaatcaaaaagattactgacaccaattctcgaatcccacctcctgtctttgaccactcgtggttttactttctctccgagtacctcatgatccagcagactccatttgtgcgccgtcaagtccgcaaacttctgctcttcatctgtggatccaaagagaagtaccgccagctccgggatttgcacaccctggactctcacgtgcgtgggatcaagaagctgctagaagagcaggggatattcctccgggcaagtgtggttacagccagctcaggctccgccttgcaatatgacacactcatcagcctgatggagcacctgaaagcctgtgcagagattgccgcccagcgaaccatcaactggcagaaattctgcatcaaagatgactccgtcctgtacttcctcctcccaagggaaagtgtttttgtatataatgtattttttcacttttggaggattctttttgtataacttcaataaagattgtaagcaaaggttga

SEQ ID NO: 356678 - DNA, 6442 bp, Homo sapiens
gtgacctagaggttccgccacaagcgcgatctcaaaggtccaggtctctttggatgagcatttttctaagatggctgctgagactgatcctcataagtcgtctgagattaccaagaacctacttccagccacgctgcaactcattgacacctatgcatcgttcaccagagcctatttgctgcaaaactttaatgaagagggaacaactgagaaaccttccaaggagaaactgcaaggctttgctgctgttttggctattggctctagcaggtgcaaggcaaatactctgggtccgacactggttcagaatttgccatcgtcagtgcagactgtgtgtgagtcctggaacaacatcaataccaatgaatttcccaatattggatcctggcgcaatgcctttgccaatgacaccatcccttcagagagttatattagtgcagtgcaggctgcacacctggggactctctgtagccaaagtctgcccctggctgcttccctgaagcataccctcctctcactggtcaggttgactggagatcttattgtttggtcagatgagatgaacccaccacaggtaattcggacactgctacctcttcttttggaatcaagcactgagagtgttgccgagatcagtagcaactccctggaacgcatcttgggccctgctgagtctgatgagttcttggctcgtgtttatgagaagctgatcactggttgttacaacattctggccaatcatgcagatcctaacagtggactggatgaatccatcctggaggaatgtctccagtacttggaaaagcagctggaaagtagccaggctcgtaaagctatggaggagtttttctctgacagtggagaacttgtacagatcatgatggcaacagccaatgagaacctctctgctaaattctgtaaccgagttttgaaattcttcaccaaactcttccagctgactgagaagagccctaacccgagcctgttgcatctctgtggctccctggcacaactggcctgtgtggaacctgtgcgcctgcaggcctggctcacccgcatgactacatcgcccccaaaagattctgatcagctggatgtaattcaggagaaccggcagctgctgcagttactgaccacatacattgttcgggaaaacagccaagttggggaaggtgtgtgtgctgttcttctgggcaccctgactcccatggcaacagagatgctggccaacggtgatgggactggcttccctgaacttatggttgtgatggccactctggccagtgcaggtcaaggtgctggtcaccttcagcttcataatgctgctgtggattggctgagcagatgcaagaaatacctgtcacagaagaatgtagttgaaaaactgaatgccaatgtaatgcatggaaagcatgtgatgatcttggagtgcacatgccatatcatgtcttacttggctgatgtcacgaatgccctgagccagagtaatggtcaaggcccaagtcatctctcagtggatggggaagagcgggccattgaagtagactcagactgggtggaggagttggcggtggaagaggaagattcccaggctgaggattcagatgaagattctctttgcaataaactctgcacttttacgatcacacagaaagaattcatgaaccagcattggtaccactgtcacacctgtaaaatggtggatggcgtgggtgtctgcacagtgtgtgctaaggtgtgccacaaggatcatgagatttcctatgccaagtatggatccttcttctgtgactgtggagccaaggaagatggcagctgtttggctctggtgaagagaactcctagcagtggcatgagctctaccatgaaggagtcggcatttcagagtgaacccaggatttcagagagtctagtgcgtcatgccagcacctcctcgccagctgacaaagccaaggttaccatcagtgatggaaaggttgctgacgaagagaagcccaagaagagcagcctctgccgcacagtagagggctgccgggaggaattacagaaccaggccaatttctccttcgctcctctcgtgttagacatgcttaatttccttatggatgccattcagaccaacttccagcaagcttcagccgtcgggagcagcagccgtgctcagcaagccctcagtgagctacacactgtggagaaggcagtggagatgacagaccagctgatggttcccaccttagggtcccaggaaggtgcctttgagaatgtgcggatgaattacagtggagaccagggccagaccatccggcagctgatcagtgctcatgtgctcaggcgggtggctatgtgtgtgctctcctctccccatgggcgccgccaacatttggctgtcagccatgagaagggcaagatcaccgttctgcagctctctgcactcctgaagcaagcagattccagcaaaaggaagttaactctgacccgcttggcttctgccccagttccttttactgtgttgagcctcacaggaaatccctgcaaggaagactacttggcggtttgtgggctaaaggactgtcatgtgctcacctttagtagctcaggctctgtttcggatcacttggttttgcaccctcagttggcaacggggaacttcatcatcaaagccgtgtggttacctggttcacagaccgagttagcaattgtcaccgcagactttgttaagatttatgacctgtgtgttgatgccttgagtccaaccttctattttctcctgccaagctcaaagataagagatgttaccttccttttcaatgaggagggaaagaacatcattgttataatgtcttcggctgggtacatctatactcagcttatggaagaggccagcagtgcccagcagggacccttctatgtcactaatgtgttggaaatcaatcatgaggacctgaaggacagtaacagccaggtggcgggcggtggtgtgtccgtgtactactcccacgtgttgcagatgttgttcttcagctattgtcaaggcaaatcattcgcagccaccatcagcaggacaaccctggaggtgttgcaactcttccccatcaacatcaaaagttccaatggtggcagtaagacttctcctgctctttgccagtggtctgaggtgatgaaccaccctggcttggtgtgctgtgtccagcaaactacaggggtgccgctggtagttatggtgaaaccagacacttttcttatccaggagattaagactcttcctgctaaagcgaagatccaagacatggttgctattaggcacacggcctgcaatgagcagcagcggacaacaatgattctgctgtgtgaggatggcagcctgcgcatttacatggccaacgtggagaacacctcctactggctgcagccatccctgcagcccagcagtgtcatcagcatcatgaagcctgttcgaaagcgcaaaacagctacaatcacaacccgcacgtctagccaggtgactttccccattgacttttttgaacacaaccagcagctgacagatgtggagtttggtggtaacgacctcctacaggtctataatgcacaacagataaaacaccggctgaattccactggcatgtatgtggccaacaccaagcccggaggcttcaccattgagattagtaacaacaatagcactatggtgatgacaggcatgcggatccagattgggactcaagcaatagaacgggccccgtcatatatcgagatcttcggcagaactatgcagctcaacctgagtcgctcacgctggtttgacttccccttcaccagagaagaagccctgcaggctgataagaagctgaacctcttcattggggcctcggtggatccagcaggtgtcaccatgatagatgctgtaaaaatttatggcaagactaaggagcagtttggctggcctgatgagcccccagaagaattcccttctgcctctgtcagcaacatctgcccttcaaatctgaaccagagcaacggcactggagatagcgactcagctgcccccactacgaccagtggaactgtcctggagaggctggttgtgagttctttagaagccctggaaagctgctttgccgttggcccaatcatcgagaaggagagaaacaagaatgctgctcaggagctggccactttgctgttgtccctgccagcacctgccagtgtccagcagcagtccaagagccttctggccagcctgcacaccagccgctcggcctaccacagccacaaggatcaggccttgctgagcaaagctgtgcagtgtctcaacacatctagcaaagagggcaaggatttggaccctgaggtgttccagaggctagtgatcacagctcgctccattgccatcatgcgccccaacaaccttgtccactttacggagtcaaagctgccccagatggaaacagactgtttttttcctagatgtgcctgctggagtctagggatagttggcatattgattggggccccacttgaaactccctccccaggcaagcttccttgacctgagttaaccttaaaacaaattaaattccatctcagatttaccatcgttgataattttctttctcctgcttagaaggaatggatgaagggaaggaaccgcagaagcagttggaaggagattgctgtagtttcatcacccagcttgtgaaccacttctggaaactccatgcatccaaacccaagaatgccttcttggcacctgcctgccttccaggactaactcatattgaagctactgtcaatgctctggtggacatcatccatggctactgtacctgtgagctggattgtattaacacagcatccaagatctacatgcagatgctcttgtgtcctgatcctgctgtgagcttctcttgtaaacaagctctaattcgagtcctaaggcccaggaacaaacggagacatgtgactttaccctcttcccctcgaagcaacactccaatgggagacaaggatgatgatgacgatgatgatgcagatgagaaaatgcagtcatcagggatcccgaatggtggtcacatccgtcaggaaagccaggaacagagtgaggtggaccatggagattttgagatggtgtctgagtcgatggtcctggagacagctgaaaatgtcaacaatggcaacccctctcccctggaggccctgctggcaggcgcagagggcttcccccccatgctggacatcccacctgatgcagatgacgagaccatggttgaactagccattgccctgagcctgcagcaggaccaacaaggcagcagcagcagtgccctgggcctgcagagcctgggactgtccggccaggcacccagctcttcctctctggacgcaggaaccctctctgacaccacagcatcagctccagcctcagacgacgagggcagtacagcagcgacagatggttctacccttcggacctctcctgctgaccacggtggtagtgtgggctcggagagcgggggcagtgcagtggactcagtggctggcgagcacagtgtatctggccggagcagtgcttatggcgatgctacagctgaggggcatccggctggaccaggaagtgtcagctcaagcactggagccatcagcaccaccactgggcaccaggagggagatggctccgagggagaaggagaaggagaaactgaaggagatgtccacactagcaacaggctgcacatggtccgtctaatgctgttggagagattactgcagaccctgcctcaattacgaaacgttggcggtgtccgggccatcccatacatgcaggtcattctaatgctcactacagatctggatggagaagatgagaaagacaagggggccctagacaacctgctctcccagcttattgctgagttgggtatggataaaaaggatgtctccaagaagaatgagcgcagcgccctgaatgaagtccatctggtagtaatgagactcctgagtgtcttcatgtcccgcaccaaatctggatccaagtcttccatatgtgagtcatcttccctcatctccagtgccacagcagcagctctactgagctctggggctgtggactactgcctgcacgtgctcaaatcactgctggaatattggaagagccaacagaatgacgaggagcctgtggctaccagccagttgctgaaaccacatactacctcctccccacctgacatgagcccattctttctccgccagtatgtgaagggtcatgctgctgatgtgtttgaggcctatactcagcttctaacagaaatggtactgaggcttccttaccaaatcaaaaagattactgacaccaattctcgaatcccacctcctgtctttgaccactcgtggttttactttctctccgagtacctcatgtcaaacattgggccgagctcgatga

SEQ ID NO: 356679 - DNA, 5467 bp, Homo sapiens
gtgacctagaggttccgccacaagcgcgatctcaaaggtccaggtctctttggatgagcatttttctaagatggctgctgagactgatcctcataagtcgtctgagattaccaagaacctacttccagccacgctgcaactcattgacacctatgcatcgttcaccagagcctatttgctgcaaaactttaatgaagagggaacaactgagaaaccttccaaggagaaactgcaaggctttgctgctgttttggctattggctctagcaggtgcaaggcaaatactctgggtccgacactggttcagaatttgccatcgtcagtgcagactgtgtgtgagtcctggaacaacatcaataccaatgaatttcccaatattggatcctggcgcaatgcctttgccaatgacaccatcccttcagagagttatattagtgcagtgcaggctgcacacctggggactctctgtagccaaagtctgcccctggctgcttccctgaagcataccctcctctcactggtcaggttgactggagatcttattgtttggtcagatgagatgaacccaccacaggtaattcggacactgctacctcttcttttggaatcaagcactgagagtgttgccgagatcagtagcaactccctggaacgcatcttgggccctgctgagtctgatgagttcttggctcgtgtttatgagaagctgatcactggttgttacaacattctggccaatcatgcagatcctaacagtggactggatgaatccatcctggaggaatgtctccagtacttggaaaagcagctggaaagtagccaggctcgtaaagctatggaggagtttttctctgacagtggagaacttgtacagatcatgatggcaacagccaatgagaacctctctgctaaattctgtaaccgagttttgaaattcttcaccaaactcttccagctgactgagaagagccctaacccgagcctgttgcatctctgtggctccctggcacaactggcctgtgtggaacctgtgcgcctgcaggcctggctcacccgcatgactacatcgcccccaaaagattctgatcagctggatgtaattcaggagaaccggcagctgctgcagttactgaccacatacattgttcgggaaaacagccaagttggggaaggtgtgtgtgctgttcttctgggcaccctgactcccatggcaacagagatgctggccaacggtgatgggactggcttccctgaacttatggttgtgatggccactctggccagtgcaggtcaaggtgctggtcaccttcagcttcataatgctgctgtggattggctgagcagatgcaagaaatacctgtcacagaagaatgtagttgaaaaactgaatgccaatgtaatgcatggaaagcatgtgatgatcttggagtgcacatgccatatcatgtcttacttggctgatgtcacgaatgccctgagccagagtaatggtcaaggcccaagtcatctctcagtggatggggaagagcgggccattgaagtagactcagactgggtggaggagttggcggtggaagaggaagattcccaggctgaggattcagatgaagattctctttgcaataaactctgcacttttacgatcacacagaaagaattcatgaaccagcattggtaccactgtcacacctgtaaaatggtggatggcgtgggtgtctgcacagtgtgtgctaaggtgtgccacaaggatcatgagatttcctatgccaagtatggatccttcttctgtgactgtggagccaaggaagatggcagctgtttggctctggtgaagagaactcctagcagtggcatgagctctaccatgaaggagtcggcatttcagagtgaacccaggatttcagagagtctagtgcgtcatgccagcacctcctcgccagctgacaaagccaaggttaccatcagtgatggaaaggttgctgacgaagagaagcccaagaagagcagcctctgccgcacagtagagggctgccgggaggaattacagaaccaggccaatttctccttcgctcctctcgtgttagacatgcttaatttccttatggatgccattcagaccaacttccagcaagcttcagccgtcgggagcagcagccgtgctcagcaagccctcagtgagctacacactgtggagaaggcagtggagatgacagaccagctgatggttcccaccttagggtcccaggaaggtgcctttgagaatgtgcggatgaattacagtggagaccagggccagaccatccggcagctgatcagtgctcatgtgctcaggcgggtggctatgtgtgtgctctcctctccccatgggcgccgccaacatttggctgtcagccatgagaagggcaagatcaccgttctgcagctctctgcactcctgaagcaagcagattccagcaaaaggaagttaactctgacccgcttggcttctgccccagttccttttactgtgttgagcctcacaggaaatccctgcaaggaagactacttggcggtttgtgggctaaaggactgtcatgtgctcacctttagtagctcaggctctgtttcggatcacttggttttgcaccctcagttggcaacggggaacttcatcatcaaagccgtgtggttacctggttcacagaccgagttagcaattgtcaccgcagactttgttaagatttatgacctgtgtgttgatgccttgagtccaaccttctattttctcctgccaagctcaaagataagagatgttaccttccttttcaatgaggagggaaagaacatcattgttataatgtcttcggctgggtacatctatactcagcttatggaagaggccagcagtgcccagcagggacccttctatgtcactaatgtgttggaaatcaatcatgaggacctgaaggacagtaacagccaggtggcgggcggtggtgtgtccgtgtactactcccacgtgttgcagatgttgttcttcagctattgtcaaggcaaatcattcgcagccaccatcagcaggacaaccctggaggtgttgcaactcttccccatcaacatcaaaagttccaatggtggcagtaagacttctcctgctctttgccagtggtctgaggtgatgaaccaccctggcttggtgtgctgtgtccagcaaactacaggggtgccgctggtagttatggtgaaaccagacacttttcttatccaggagattaagactcttcctgctaaagcgaagatccaagacatggttgctattaggcacacggcctgcaatgagcagcagcggacaacaatgattctgctgtgtgaggatggcagcctgcgcatttacatggccaacgtggagaacacctcctactggctgcagccatccctgcagcccagcagtgtcatcagcatcatgaagcctgttcgaaagcgcaaaacagctacaatcacaacccgcacgtctagccaggtgactttccccattgacttttttgaacacaaccagcagctgacagatgtggagtttggtggtaacgacctcctacaggtctataatgcacaacagataaaacaccggctgaattccactggcatgtatgtggccaacaccaagcccggaggcttcaccattgagattagtaacaacaatagcactatggtgatgacaggcatgcggatccagattgggactcaagcaatagaacgggccccgtcatatatcgagatcttcggcagaactatgcagctcaacctgagtcgctcacgctggtttgacttccccttcaccagagaagaagccctgcaggctgataagaagctgaacctcttcattggggcctcggtggatccagcaggtgtcaccatgatagatgctgtaaaaatttatggcaagactaaggagcagtttggctggcctgatgagcccccagaagaattcccttctgcctctgtcagcaacatctgcccttcaaatctgaaccagagcaacggcactggagatagcgactcagctgcccccactacgaccagtggaactgtcctggagaggctggttgtgagttctttagaagccctggaaagctgctttgccgttggcccaatcatcgagaaggagagaaacaagaatgctgctcaggagctggccactttgctgttgtccctgccagcacctgccagtgtccagcagcagtccaagagccttctggccagcctgcacaccagccgctcggcctaccacagccacaaggatcaggccttgctgagcaaagctgtgcagtgtctcaacacatctagcaaagagggcaaggatttggaccctgaggtgttccagaggctagtgatcacagctcgctccattgccatcatgcgccccaacaaccttgtccactttacggagtcaaagctgccccagatggaaacagactgtttttttcctagatgtgcctgctggagtctagggatagttggcatattgattggggccccacttgaaactccctccccaggcaagcttccttgacctgagttaaccttaaaacaaattaaattccatctcagatttaccatcgttgataattttctttctcctgcttagaaggaatggatgaagggaaggaaccgcagaagcagttggaaggagattgctgtagtttcatcacccagcttgtgaaccacttctggaaactccatgcatccaaacccaagaatgccttcttggcacctgcctgccttccaggactaactcatattgaagctactgtcaatgctctggtggacatcatccatggctactgtacctgtgagctggattgtattaacacagcatccaagatctacatgcagatgctcttgtgtcctgatcctgctgtgagcttctcttgtaaacaagctctaattcgagtcctaaggcccaggaacaaacggagacatgtgactttaccctcttcccctcgaagcaacactccaatgggagacaaggatgatgatgacgatgatgatgcagatgagaaaatgcagtcatcagggatcccgaatggtggtcacatccgtcaggaaagccaggaacagagtgaggtggaccatggagattttgagatggtgtctgagtcgatggtcctggagacagctgaaaatgtcaacaatggcaacccctctcccctggaggccctgctggcaggcgcagagggcttcccccccatgctggacatcccacctgatgcagatgacgagaccatggttgaactagccattgccctgagcctgcagcaggaccaacaaggtagaaggccatgccaagaacaaagcggcccattggccttgcacaggaaaagagggtttggcagttactgatatccagctgacttagtttgtccccagatatggggagaggttgatctgggtgagagctgttcagagatacaggtggagagtgagaggg

SEQ ID NO: 356680 - DNA, 924 bp, Homo sapiens
gagcacatatactaaaattggaacgatacagagaagattagcatggcccctgcgcaaggatgacacgcaaattcgtgaagcgttccatattttaggcggtatgagtttggctgggggccgggcaccccggaagaccgctgggaaccggctttctgggcttttggaggcagaggaggaagatgagttctaccagacgacttatgggggtttcacagaggaatccggagatgatgagtatcaaggggaccagtcagacacagaggacgaagtggactctgactttgacattgatgaaggggatgaaccatccagtgatggagaagcagaagagccaagaaggaagcgccgagtagtcaccaaggcctataaggaacctctcaagagcttaaggcctcgaaaggtcaacaccccggctggtagctctcagaaggcgcgagaagagaaggcactactgccattagaactacaagatgacggctctgacagtcggaagtctatgcgtcagtctacagctgagcatacacgacaaacgttccttcgggtacaggagaggcagggccagtcaagacggcgaaaggggccccactgtgagcggccactaacccaggaggaactgctccgggaggccaagatcacagaagagcttaatttacggtcactggagacatatgagcggctcgaggctgataaaaagaagcaggttcataagaagcggaagtgccccgggcccataatcacctatcattcagtgacagtgccacttgttggggagccaggccccaaggaagagaacgttgacatagaagggtcgccagcaaaagaagagataacactgcatttccctttaccaactagcgctgggagcactggacacttaaatcctcatctgtcctcctttcctgtaaataaaagcccttctatcca

SEQ ID NO: 356681 - DNA, 295 bp, Homo sapiens
tgacatgatacgagtcgagctcggtaccgaattcgacaagtgtgcattaagttccctccgcgggatgctgcattgttaccccgccctcccctctctcatttttcttggtgtggcttggggtttttaggcttcctgttttatctcgtgtgtgtggtgcaccagctatgaggttgtctgtaacccaagccatcaaagggcctgtacatacctaggagccatgagttgtcccggccagcttcatacttgagtgtgcacatcttgagaaataaacaagtgacttaacacacattgaaaa

SEQ ID NO: 356682 - DNA, 1117 bp, Homo sapiens
gagcacatatactaaaattggaacgatacagagaagattagcatggcccctgcgcaaggatgacacgcaaattcgtgaagcgttccatattttaggcggtatgagtttggctgggggccgggcaccccggaagaccgctgggaaccggctttctgggcttttggaggcagaggaggaagatgagttctaccagacgacttatgggggtttcacagaggaatccggagatgatgagtatcaaggggaccagtcagacacagaggacgaagtggactctgactttgacattgatgaaggggatgaaccatccagtgatggagaagcagaagagccaagaaggaagcgccgagtagtcaccaaggcctataaggaacctctcaagagcttaaggcctcgaaaggtcaacaccccggctggtagctctcagaaggcgcgagaagagaaggcactactgccattagaactacaagatgacggctctgacagtcggaagtctatgcgtcagtctacagctgagcatacacgacaaacgttccttcgggtacaggagaggcagggccagtcaagacggcgaaaggggccccactgtgagcggccactaacccaggaggaactgctccgggaggccaagatcacagaagagcttaatttacggtcactggacttgatcctgctccctcggtgtctgcattgactcctcatgctgggactggacccgtcaacccccctgctcgctgctcacgtaccttcatcacttttagtgatgatgcaactttcgaggaatggttcccccaagggcggcccccaaaagtccctgttcgtgaggtctgtccagtgacccatcgtccagcctgggccccggcccgccacctcctgagcccctccctggctctgggccccgagccttgcgccagaaaattgtcattaaatgaagagatgtctagtcctcagaaacttctttcctgccctgattggggctcttgctgttccgtttcttctccctgcttctcccctttgtcatctctgatctttgcctaatctgtttctttttccttttcccctagttcttacaggtttcgttgtgttttttaatctaataaaatagaaagatcccttt

SEQ ID NO: 356683 - DNA, 809 bp, Homo sapiens
gagcacatatactaaaattggaacgatacagagaagattagcatggcccctgcgcaaggatgacacgcaaattcgtgaagcgttccatattttaggcggtatgagtttggctgggggccgggcaccccggaagaccgctgggaaccggctttctgggcttttggaggcagaggaggaagatgagttctaccagacgacttatgggggtttcacagaggaatccggagatgatgagtatcaaggggaccagtcagacacagaggacgaagtggactctgactttgacattgatgaaggggatgaaccatccagtgatggagaagcagaagagccaagaaggaagcgccgagtagtcaccaaggcctataaggaacctctcaagagcttaaggcctcgaaaggtcaacaccccggctggtagctctcagaaggcgcgagaagagaaggcactactgccattagaactacaagatgacggctctgacagtcggaagtctatgcgtcagtctacagctgagcatacacgacaaacgttccttcgggtacaggagaggcagggccagtcaagacggcgaaaggggccccactgtgagcggccactaacccaggaggaactgctccgggaggccaagatcacagaagagcttaatttacggtcactgggtaagtctgtggtttcagaaaaagtgagtagaggggctgaggggcatgagaaaaaccatgagacctggaggaccaaagaactggagagatggaaatttgggatgatggaatcagaaggaagaaatggcggagcagttccacttagct

SEQ ID NO: 356684 - DNA, 537 bp, Homo sapiens
gagcacatatactaaaattggaacgatacagagaagattagcatggcccctgcgcaaggatgacacgcaaattcgtgaagcgttccatattttaggcggtatgagtttggctgggggccgggcaccccggaagaccgctgggaaccggctttctgggcttttggaggcagaggaggaagatgagttctaccagacgacttatgggggtttcacagaggaatccggagatgatgagtatcaaggggaccagtcagacacagaggacgaagtggactctgactttgacattgatgaaggggatgaaccatccagtgatggagaagcagaagagcagaaaattgtcattaaatgaagagatgtctagtcctcagaaacttctttcctgccctgattggggctcttgctgttccgtttcttctccctgcttctcccctttgtcatctctgatctttgcctaatctgtttctttttccttttcccctagttcttacaggtttcgttgtgttttttaatctaataaaatagaaagatcccttt

SEQ ID NO: 356685 - DNA, 410 bp, Homo sapiens
caaaatggtttaacaggaacacatatttgggcataagagatacacgtgttgatcctcctgatcttcttgcctttgcacatcaccccctggggcaccagtgccatgctgttggggctatggctcaggtgtgcccttgagcgccctcaccttgctccacttgcctcctccaggatgtccccgtcgaggccctcaccacggtgaagccatactgcaatgagatccatgcccaggctcaactgtggctcaagagagaccccaaggcatcctatgatgcctggaagaagtgtcttcctatcagaggtatatctttctcttcaagacgccgggaagtcctgcctgcgctctgacagccctgccttctgtcactctcatttacttacctactacccctgcaacccttggccttgcag

SEQ ID NO: 356686 - DNA, 348 bp, Homo sapiens
gcaggccatcgtggagttgaaaaacaagtacgggctttttaggcctcgggaggggcagcaggttgtaaggctgaagctcagttgctgccttcggttcctggaatggagtaaggcagcacatccctagaggcctaatacatcctcttggcccctccattcatgaccaaaggacaaaagtgaaacaacagttctaagcatgttgacaaagattatttctaaattagcccagtggagccataggggtctgtggaagttcctcaacagcctgcctagggaggggaagctgagtgaggggacctccaggcttctcatgcccattttaactattcttacacaaaggtctagact

SEQ ID NO: 356687 - DNA, 377 bp, Homo sapiens
gaaagcctgtgcagagattgccgcccagcgaaccatcaactggcagaaattctgcatcaaagatgactgtaagcaatgctgctccttttgattgctgttattcattcattcaggaactgttaaggcctactatatgccaagcactgaactggatgctggagatatagctgtgaacaagatagactagacagaactctgtctagcaaagaagacaagtaaaaatctaaaagagtggtgagggctggtcgtcaaagtttggggagctgtagaagcacaaagtaggagtctctgacctccaggtagtggcagtaaagtcaaagaggagtaggtggagtctagagaaccccttattcaaaggagcagggggctctggtcgg

SEQ ID NO: 356688 - DNA, 547 bp, Homo sapiens
agcaagcaccttcaggtgactggggtttctttgactcaggagacaaggatgatgatgacgatgatgatgcagatgagaaaatgcagtcatcagggatcccgaatggtggtcacatccgtcaggaaagccaggaacagagtgaggtggaccatggagattttgagatggtggtgagtctctggcagcaggagaaggggaggaggagcttcacaactctcctctagctcttattcagtggacttccaaaagttaccacttaccatgggacactgacagagctttctctctgcagtctgagtcgatggtcctggagacagctgaaaatgtcaacaatggcaacccctctcccctggaggccctgctggcaggcgcagagggcttcccccccatgctggacatcccacctgatgcagatgacgagaccatggttgaactagccattgccctgagcctgcagcaggaccaacaaggtagaaggccatgccaagaacaaagcggcccattggccttgcacaggaaaagagggtttggcagttactgatatcca

SEQ ID NO: 356689 - DNA, 578 bp, Homo sapiens
tgcagtccatggagcataacctagccctggtggcctagaaggaaggaagggcaggcagagtgtagatagttcattctgccttgagttggtggggttagtgataaccctgctgtcttttgccttaggagagaaacaagaatgctgctcaggagctggccactttgctgttgtccctgccagcacctgccagtgtccagcagcagtccaagagccttctggccagcctgcacaccagccgctcggcctaccacagccacaaggtaactgttctctcagggaaaggaaattgcagtgctgacagggaatcaaataagttagcttttcattgtaaagcaacagcacagcaaagtaaggtagagggaggatagcattcagattagacctacattttacagagtttctcctgagaaattctcaagtgccactcaaaaccgagggtaagccagtgactgggcccctggtttgtacttatttttctgtcactctaacaggatcaacaagacttaagaaagagaaggagggatattgagcgtgggtagccttctcgctggaaaagggtgaggtgagggagtccctca

SEQ ID NO: 356690 - DNA, 310 bp, Homo sapiens
gtgacaaggatcaactggtgatgctcttggaccagatcaacagcacctttgttcgctccaaccccagtgtgctccagggcctgcttcgcatcatcccgtacctttcctttggagaggtggagaaaatgcagatcttggtggagcgattcaaaccatactgcaactttgataagtatgttactttgatttcatatagtgaaatgagagtctccactaaaacgccgaactaggtctgtgagatgaggaagaatcctctgaatacctattagatttttgtgtcctcgttctggcttttaaggagctcagtcta

SEQ ID NO: 356691 - DNA, 359 bp, Homo sapiens
gtactttgggaggctaagatgggaggatcccctgagcccaggggttttagaccagcctgggcaagatggtgagaccccatctctacaaaatattttttaaaaaattaaatagaaacttcatcttgtggatgaagagtgggttacactgatgaatttttaaaaaggcagtacgagtcttgaactaataccatgttttgtgaactcttgtatttagtatatcaagctgtcttccattaaagtggacacgcggtacaccaccacccagcaggttgtgaagctcattggcagtcacaccatcagcaaagtgacagtgaaaatcggggatctgaaacggaccaagatggtgcggaccatcaacc

SEQ ID NO: 356692 - DNA, 787 bp, Homo sapiens
tgagcctggccccaattatgtggaccaagcggaatagcccttcacatcctgccccctgagcagtggagagccacacgtgtggaaatcttgcggaggctgttggtgacctcgcaggctcgggcagtggctccaggtggagccaccaggctgacagataaggcagtgaaggactattccgcttaccgttcttcccttctcttttgggccctcgtcgatctcatttacaacatgtttaagaaggtgcctaccagtaacacagagggaggctggtcctgctctctcgctgagtacatccgccacaacgacatgcccatctacgaagctgccgacaaagccctgaaaaccttccaggaggagttcatgccagtggagaccttctcagagttcctcgatgtggccggtcttttatcagaaatcaccgatccagagagcttcctgaaggacctgttgaactcagtcccctgaccaccacacagcagctgcggcggcgaagacgaagctggcttgccttccaccctctgttctccctccttgtgcattaagttccctccgcgggatgctgcattgttaccccgccctcccctctctcatttttcttggtgtggcttggggtttttaggcttcctgttttatctcgtgtgtgtggtgcaccagctatgaggttgtctgtaacccaagccatcaaagggcctgtacatacctaggagccatgagttgtcccggccagcttcatacttgagtgtgcacatcttgagaaataaacaagtgacttaacacacattgaaaa

SEQ ID NO: 356693 - DNA, 427 bp, Homo sapiens
aatcagctcggtcctttcacagcggagatgctggaggacatgaccacaggtacagaatcagaaaccaaggccttcatggctgtgtgcattgagacagccaagcgctacaatctggatgactaccggaccccggtgttcatcttcgagaggctctgcagcatcatttatcctgaggagaatgaagtcactgagttctttgtgaccctggagaaggatccccaacaagaagacttcttacagggcaggatgcctgggaacccgtatagcagcatctccgctttggaaatttccaaacgcggagatgctgcccagaagacagatacatcccaccatgatcaggatcacccaaccttcaacaagatcacccccaacctggctgagttccttcagcctataccgccagctgcacaccagtccacagcatcgg

SEQ ID NO: 356694 - DNA, 12694 bp, Homo sapiens
gtgacctagaggttccgccacaagcgcgatctcaaaggtccaggtctctttggatgagcatttttctaagatggctgctgagactgatcctcataagtcgtctgagattaccaagaacctacttccagccacgctgcaactcattgacacctatgcatcgttcaccagagcctatttgctgcaaaactttaatgaagagggaacaactgagaaaccttccaaggagaaactgcaaggctttgctgctgttttggctattggctctagcaggtgcaaggcaaatactctgggtccgacactggttcagaatttgccatcgtcagtgcagactgtgtgtgagtcctggaacaacatcaataccaatgaatttcccaatattggatcctggcgcaatgcctttgccaatgacaccatcccttcagagagttatattagtgcagtgcaggctgcacacctggggactctctgtagccaaagtctgcccctggctgcttccctgaagcataccctcctctcactggtcaggttgactggagatcttattgtttggtcagatgagatgaacccaccacaggtaattcggacactgctacctcttcttttggaatcaagcactgagagtgttgccgagatcagtagcaactccctggaacgcatcttgggccctgctgagtctgatgagttcttggctcgtgtttatgagaagctgatcactggttgttacaacattctggccaatcatgcagatcctaacagtggactggatgaatccatcctggaggaatgtctccagtacttggaaaagcagctggaaagtagccaggctcgtaaagctatggaggagtttttctctgacagtggagaacttgtacagatcatgatggcaacagccaatgagaacctctctgctaaattctgtaaccgagttttgaaattcttcaccaaactcttccagctgactgagaagagccctaacccgagcctgttgcatctctgtggctccctggcacaactggcctgtgtggaacctgtgcgcctgcaggcctggctcacccgcatgactacatcgcccccaaaagattctgatcagctggatgtaattcaggagaaccggcagctgctgcagttactgaccacatacattgttcgggaaaacagccaagttggggaaggtgtgtgtgctgttcttctgggcaccctgactcccatggcaacagagatgctggccaacggtgatgggactggcttccctgaacttatggttgtgatggccactctggccagtgcaggtcaaggtgctggtcaccttcagcttcataatgctgctgtggattggctgagcagatgcaagaaatacctgtcacagaagaatgtagttgaaaaactgaatgccaatgtaatgcatggaaagcatgtgatgatcttggagtgcacatgccatatcatgtcttacttggctgatgtcacgaatgccctgagccagagtaatggtcaaggcccaagtcatctctcagtggatggggaagagcgggccattgaagtagactcagactgggtggaggagttggcggtggaagaggaagattcccaggctgaggattcagatgaagattctctttgcaataaactctgcacttttacgatcacacagaaagaattcatgaaccagcattggtaccactgtcacacctgtaaaatggtggatggcgtgggtgtctgcacagtgtgtgctaaggtgtgccacaaggatcatgagatttcctatgccaagtatggatccttcttctgtgactgtggagccaaggaagatggcagctgtttggctctggtgaagagaactcctagcagtggcatgagctctaccatgaaggagtcggcatttcagagtgaacccaggatttcagagagtctagtgcgtcatgccagcacctcctcgccagctgacaaagccaaggttaccatcagtgatggaaaggttgctgacgaagagaagcccaagaagagcagcctctgccgcacagtagagggctgccgggaggaattacagaaccaggccaatttctccttcgctcctctcgtgttagacatgcttaatttccttatggatgccattcagaccaacttccagcaagcttcagccgtcgggagcagcagccgtgctcagcaagccctcagtgagctacacactgtggagaaggcagtggagatgacagaccagctgatggttcccaccttagggtcccaggaaggtgcctttgagaatgtgcggatgaattacagtggagaccagggccagaccatccggcagctgatcagtgctcatgtgctcaggcgggtggctatgtgtgtgctctcctctccccatgggcgccgccaacatttggctgtcagccatgagaagggcaagatcaccgttctgcagctctctgcactcctgaagcaagcagattccagcaaaaggaagttaactctgacccgcttggcttctgccccagttccttttactgtgttgagcctcacaggaaatccctgcaaggaagactacttggcggtttgtgggctaaaggactgtcatgtgctcacctttagtagctcaggctctgtttcggatcacttggttttgcaccctcagttggcaacggggaacttcatcatcaaagccgtgtggttacctggttcacagaccgagttagcaattgtcaccgcagactttgttaagatttatgacctgtgtgttgatgccttgagtccaaccttctattttctcctgccaagctcaaagataagagatgttaccttccttttcaatgaggagggaaagaacatcattgttataatgtcttcggctgggtacatctatactcagcttatggaagaggccagcagtgcccagcagggacccttctatgtcactaatgtgttggaaatcaatcatgaggacctgaaggacagtaacagccaggtggcgggcggtggtgtgtccgtgtactactcccacgtgttgcagatgttgttcttcagctattgtcaaggcaaatcattcgcagccaccatcagcaggacaaccctggaggtgttgcaactcttccccatcaacatcaaaagttccaatggtggcagtaagacttctcctgctctttgccagtggtctgaggtgatgaaccaccctggcttggtgtgctgtgtccagcaaactacaggggtgccgctggtagttatggtgaaaccagacacttttcttatccaggagattaagactcttcctgctaaagcgaagatccaagacatggttgctattaggcacacggcctgcaatgagcagcagcggacaacaatgattctgctgtgtgaggatggcagcctgcgcatttacatggccaacgtggagaacacctcctactggctgcagccatccctgcagcccagcagtgtcatcagcatcatgaagcctgttcgaaagcgcaaaacagctacaatcacaacccgcacgtctagccaggtgactttccccattgacttttttgaacacaaccagcagctgacagatgtggagtttggtggtaacgacctcctacaggtctataatgcacaacagataaaacaccggctgaattccactggcatgtatgtggccaacaccaagcccggaggcttcaccattgagattagtaacaacaatagcactatggtgatgacaggcatgcggatccagattgggactcaagcaatagaacgggccccgtcatatatcgagatcttcggcagaactatgcagctcaacctgagtcgctcacgctggtttgacttccccttcaccagagaagaagccctgcaggctgataagaagctgaacctcttcattggggcctcggtggatccagcaggtgtcaccatgatagatgctgtaaaaatttatggcaagactaaggagcagtttggctggcctgatgagcccccagaagaattcccttctgcctctgtcagcaacatctgcccttcaaatctgaaccagagcaacggcactggagatagcgactcagctgcccccactacgaccagtggaactgtcctggagaggctggttgtgagttctttagaagccctggaaagctgctttgccgttggcccaatcatcgagaaggagagaaacaagaatgctgctcaggagctggccactttgctgttgtccctgccagcacctgccagtgtccagcagcagtccaagagccttctggccagcctgcacaccagccgctcggcctaccacagccacaaggatcaggccttgctgagcaaagctgtgcagtgtctcaacacatctagcaaagagggcaaggatttggaccctgaggtgttccagaggctagtgatcacagctcgctccattgccatcatgcgccccaacaaccttgtccactttacggagtcaaagctgccccagatggaaacagactgtttttttcctagatgtgcctgctggagtctagggatagttggcatattgattggggccccacttgaaactccctccccaggcaagcttccttgacctgagttaaccttaaaacaaattaaattccatctcagatttaccatcgttgataattttctttctcctgcttagaaggaatggatgaagggaaggaaccgcagaagcagttggaaggagattgctgtagtttcatcacccagcttgtgaaccacttctggaaactccatgcatccaaacccaagaatgccttcttggcacctgcctgccttccaggactaactcatattgaagctactgtcaatgctctggtggacatcatccatggctactgtacctgtgagctggattgtattaacacagcatccaagatctacatgcagatgctcttgtgtcctgatcctgctgtgagcttctcttgtaaacaagctctaattcgagtcctaaggcccaggaacaaacggagacatgtgactttaccctcttcccctcgaagcaacactccaatgggagacaaggatgatgatgacgatgatgatgcagatgagaaaatgcagtcatcagggatcccgaatggtggtcacatccgtcaggaaagccaggaacagagtgaggtggaccatggagattttgagatggtgtctgagtcgatggtcctggagacagctgaaaatgtcaacaatggcaacccctctcccctggaggccctgctggcaggcgcagagggcttcccccccatgctggacatcccacctgatgcagatgacgagaccatggttgaactagccattgccctgagcctgcagcaggaccaacaaggcagcagcagcagtgccctgggcctgcagagcctgggactgtccggccaggcacccagctcttcctctctggacgcaggaaccctctctgacaccacagcatcagctccagcctcagacgacgagggcagtacagcagcgacagatggttctacccttcggacctctcctgctgaccacggtggtagtgtgggctcggagagcgggggcagtgcagtggactcagtggctggcgagcacagtgtatctggccggagcagtgcttatggcgatgctacagctgaggggcatccggctggaccaggaagtgtcagctcaagcactggagccatcagcaccaccactgggcaccaggagggagatggctccgagggagaaggagaaggagaaactgaaggagatgtccacactagcaacaggctgcacatggtccgtctaatgctgttggagagattactgcagaccctgcctcaattacgaaacgttggcggtgtccgggccatcccatacatgcaggtcattctaatgctcactacagatctggatggagaagatgagaaagacaagggggccctagacaacctgctctcccagcttattgctgagttgggtatggataaaaaggatgtctccaagaagaatgagcgcagcgccctgaatgaagtccatctggtagtaatgagactcctgagtgtcttcatgtcccgcaccaaatctggatccaagtcttccatatgtgagtcatcttccctcatctccagtgccacagcagcagctctactgagctctggggctgtggactactgcctgcacgtgctcaaatcactgctggaatattggaagagccaacagaatgacgaggagcctgtggctaccagccagttgctgaaaccacatactacctcctccccacctgacatgagcccattctttctccgccagtatgtgaagggtcatgctgctgatgtgtttgaggcctatactcagcttctaacagaaatggtactgaggcttccttaccaaatcaaaaagattactgacaccaattctcgaatcccacctcctgtctttgaccactcgtggttttactttctctccgagtacctcatgatccagcagactccatttgtgcgccgtcaagtccgcaaacttctgctcttcatctgtggatccaaagagaagtaccgccagctccgggatttgcacaccctggactctcacgtgcgtgggatcaagaagctgctagaagagcaggggatattcctccgggcaagtgtggttacagccagctcaggctccgccttgcaatatgacacactcatcagcctgatggagcacctgaaagcctgtgcagagattgccgcccagcgaaccatcaactggcagaaattctgcatcaaagatgactccgtcctgtacttcctcctccaagtcagtttccttgtggatgagggcgtgtccccagtgctgctgcaactgctctcctgtgctctctgcggcagcaaggtgctcgctgcactggcagcctcttcgggatcctccagtgcttcttcctcctcagcccctgtggctgccagttctggacaagccacaacacagtccaagtcttccactaaaaagagcaagaaagaagaaaaagaaaaggagaaagatggtgagacctctggcagccaggaggaccagctgtgcacagctctggtgaaccagctgaacaaatttgccgataaggaaaccctgatccagttcctgcgttgtttcctgttagagtccaattcttcctcggtgcgctggcaggcccactgtctgacactgcacatctacagaaattccagcaaatctcaacaggagctcctgctagatctgatgtggtccatctggccagaactcccagcctatggtcgtaaggctgcccagtttgtggacctactaggatatttctccctgaaaactccacaaacagagaagaagttgaaggagtattcacagaaggctgtggagattctgcggactcaaaaccatattcttaccaaccaccccaactcgaacatttataacactttgtctggcttagtggagtttgatggctattacctggagagcgatccctgcctggtgtgtaataacccggaagtaccgttctgttatatcaagctgtcttccattaaagtggacacgcggtacaccaccacccagcaggttgtgaagctcattggcagtcacaccatcagcaaagtgacagtgaaaatcggggatctgaaacggaccaagatggtgcggaccatcaacctgtattataacaaccgaaccgtgcaggccatcgtggagttgaaaaacaagccagctcgctggcacaaagccaagaaggttcagctgacccctggacagacagaggtgaagattgacctgccgttgcccattgtggcctccaatctgatgattgagtttgcagacttctatgaaaactaccaggcctccacagagaccctgcagtgccctcgctgtagtgcctcggtccctgccaacccaggagtctgtggcaactgtggagagaatgtgtaccagtgtcacaaatgcagatccatcaactacgatgaaaaggatcccttcctctgcaatgcctgtggcttctgtaaatatgcccgcttcgacttcatgctctatgccaagccttgctgtgcagtggatcccattgagaatgaagaagaccggaagaaggctgtatccaacatcaatacacttttggacaaagctgatcgagtgtatcatcagctgatgggacaccggccacagctggagaacctgctctgcaaagtgaatgaggcagctccagaaaagccacaggatgactcaggaacagcagggggcatcagctccacttctgccagtgtgaatcgttacatcctgcagttggctcaggagtattgtggagactgcaagaactcttttgatgaactctccaaaatcatccagaaagtctttgcttcgcgcaaagagttgttggaatatgacctacagcagagggaagcagccactaaatcatcccggacctccgtgcagcccacattcactgccagccagtaccgtgccttatccgtcctgggctgtggccacacatcctccaccaagtgctatggctgcgcctcggctgtcacagaacattgtatcacactacttcgggccctggccaccaacccagccttgaggcacatccttgtctcccagggccttatccgggagctctttgattataatcttcgccgaggggctgcggccatgcgggaggaggtccgccagctcatgtgcctcctaactcgagacaacccagaagccacccaacagatgaatgacctgattattggcaaggtctccacagccctgaagggccactgggccaaccccgatctggcaagtagcctgcagtatgaaatgctgctgctgacggattctatctccaaggaggacagctgctgggagctccggttacgctgtgctctcagccttttcctcatggctgtgaacattaagactcctgtggtggttgaaaacattaccctcatgtgcctgaggatcttgcagaagctgataaaaccacctgctcccactagcaagaagaacaaggatgtccccgtcgaggccctcaccacggtgaagccatactgcaatgagatccatgcccaggctcaactgtggctcaagagagaccccaaggcatcctatgatgcctggaagaagtgtcttcctatcagagggatagatggcaatgggaaagcccccagcaaatcagagctccgccatctctatttgactgagaagtatgtgtggaggtggaaacagttcctgagtcgtcgggggaagaggacctcccccttggatctcaaactggggcataacaactggctgcgacaagtgcttttcactccagcaacgcaggccgcacggcaggcagcctgtaccattgtggaagctctagccaccattcccagccgcaagcagcaggtcctggacctgcttaccagttacctggatgagctgagcatagctggggagtgtgcagctgagtacctggctctctaccagaagctcatcacttctgcgcactggaaagtctacttggcagctcggggagtcctaccctatgtgggcaacctcatcaccaaggaaatagctcgtctgctggccctggaggaggctaccctgagtaccgatctgcagcagggttatgcccttaaaagtctcacaggccttctctcctcctttgttgaggtggaatccatcaaaagacattttaaaagtcgcttggtgggtactgtgctgaatggatacctgtgcttgcggaagctggtggtgcagaggaccaagctgatcgatgagacgcaggacatgctgctggagatgctggaggacatgaccacaggtacagaatcagaaaccaaggccttcatggctgtgtgcattgagacagccaagcgctacaatctggatgactaccggaccccggtgttcatcttcgagaggctctgcagcatcatttatcctgaggagaatgaagtcactgagttctttgtgaccctggagaaggatccccaacaagaagacttcttacagggcaggatgcctgggaacccgtatagcagcaatgagccaggcatcgggccgctgatgagggatataaagaacaagatttgccaggactgtgacttagtggccctcctggaagatgacagtggcatggagcttctagtgaacaataaaatcattagtttggaccttcctgtggctgaagtttacaagaaagtctggtgtaccacgaatgagggagagcccatgaggattgtttatcgtatgcgggggctgctgggcgatgccacagaggagttcattgagtccctggactctactacagatgaagaagaagatgaagaagaagtgtataaaatggctggtgtgatggcccagtgtgggggcctggaatgcatgcttaacagactcgcagggatcagagatttcaagcagggacgccaccttctaacagtgctactgaaattgttcagttactgcgtgaaggtgaaagtcaaccggcagcaactggtcaaactggaaatgaacaccttgaacgtcatgctggggaccctaaacctggcccttgtagctgaacaagaaagcaaggacagtgggggtgcagctgtggctgagcaggtgcttagcatcatggagatcattctagatgagtccaatgctgagcccctgagtgaggacaagggcaacctcctcctgacaggtgacaaggatcaactggtgatgctcttggaccagatcaacagcacctttgttcgctccaaccccagtgtgctccagggcctgcttcgcatcatcccgtacctttcctttggagaggtggagaaaatgcagatcttggtggagcgattcaaaccatactgcaactttgataaatatgatgaagatcacagtggtgatgataaagtcttcctggactgcttctgtaaaatagctgctggcatcaagaacaacagcaatgggcaccagctgaaggatctgattctccagaaggggatcacccagaatgcacttgactacatgaaaaagcacatccctagcgccaagaatttggatgccgacatctggaaaaagtttttgtctcgcccagccttgccatttatcctaaggctgcttcggggcctggccatccagcaccctggcacccaggttctgattggaactgattccatcccgaacctgcataagctggagcaggtgtccagtgatgagggcattgggaccttggcagagaacctgctggaagccctgcgggaacaccctgacgtaaacaagaagattgacgcagcccgcagggagacccgggcagagaagaaacgcatggccatggcaatgaggcagaaggccctgggcaccctgggcatgacgacaaatgaaaagggccaggtcgtgaccaagacagcactcctgaagcagatggaagagctgatcgaggagcctggcctcacgtgctgcatctgcagggagggatacaagttccagcccacaaaggtcctgggcatttataccttcacgaagcgggtagccttggaggagttggagaataagccccggaaacagcagggctacagcaccgtgtcccacttcaacattgtgcactacgactgccatctggctgccgtcaggttggctcgaggccgggaagagtgggagagtgccgccctgcagaatgccaacaccaagtgcaacgggctccttccggtctggggacctcatgtccctgaatcagcttttgccacttgcttggcaagacacaacacttacctccaggaatgtacaggccagcgggagcccacgtatcagctcaacatccacgacatcaaactgctcttcctgcgcttcgccatggagcagtcgttcagcgcagacactggcgggggcggccgggagagcaacatccacctgatcccgtacatcattcacactgtgctttacgtcctgaacacaacccgagcaacttcccgagaagagaagaacctccaaggctttctggaacagcccaaggagaagtgggtggagagtgcctttgaagtggacgggccctactatttcacagtcttggcccttcacatcctgccccctgagcagtggagagccacacgtgtggaaatcttgcggaggctgttggtgacctcgcaggctcgggcagtggctccaggtggagccaccaggctgacagataaggcagtgaaggactattccgcttaccgttcttcccttctcttttgggccctcgtcgatctcatttacaacatgtttaagaaggtgcctaccagtaacacagagggaggctggtcctgctctctcgctgagtacatccgccacaacgacatgcccatctacgaagctgccgacaaagccctgaaaaccttccaggaggagttcatgccagtggagaccttctcagagttcctcgatgtggccggtcttttatcagaaatcaccgatccagagagcttcctgaaggacctgttgaactcagtcccctgaccaccacacagcagctgcggcggcgaagacgaagctggcttgccttccaccctctgttctccctccttgtgcattaagttccctccgcgggatgctgcattgttaccccgccctcccctctctcatttttcttggtgtggcttggggtttttaggcttcctgttttatctcgtgtgtgtggtgcaccagctatgaggttgtctgtaacccaagccatcaaagggcctgtacatacctaggagccatgagttgtcccggccagcttcatacttgagtgtgcacatcttgagaaataaacaagtgacttaacacacattgaaaa

SEQ ID NO: 356695 - DNA, 13642 bp, Homo sapiens
  misc_feature (8480)..(8480): n is a, c, g, or t
gtgacctagaggttccgccacaagcgcgatctcaaaggtccaggtctctttggatgagcatttttctaagatggctgctgagactgatcctcataagtcgtctgagattaccaagaacctacttccagccacgctgcaactcattgacacctatgcatcgttcaccagagcctatttgctgcaaaactttaatgaagagggaacaactgagaaaccttccaaggagaaactgcaaggctttgctgctgttttggctattggctctagcaggtgcaaggcaaatactctgggtccgacactggttcagaatttgccatcgtcagtgcagactgtgtgtgagtcctggaacaacatcaataccaatgaatttcccaatattggatcctggcgcaatgcctttgccaatgacaccatcccttcagagagttatattagtgcagtgcaggctgcacacctggggactctctgtagccaaagtctgcccctggctgcttccctgaagcataccctcctctcactggtcaggttgactggagatcttattgtttggtcagatgagatgaacccaccacaggtaattcggacactgctacctcttcttttggaatcaagcactgagagtgttgccgagatcagtagcaactccctggaacgcatcttgggccctgctgagtctgatgagttcttggctcgtgtttatgagaagctgatcactggttgttacaacattctggccaatcatgcagatcctaacagtggactggatgaatccatcctggaggaatgtctccagtacttggaaaagcagctggaaagtagccaggctcgtaaagctatggaggagtttttctctgacagtggagaacttgtacagatcatgatggcaacagccaatgagaacctctctgctaaattctgtaaccgagttttgaaattcttcaccaaactcttccagctgactgagaagagccctaacccgagcctgttgcatctctgtggctccctggcacaactggcctgtgtggaacctgtgcgcctgcaggcctggctcacccgcatgactacatcgcccccaaaagattctgatcagctggatgtaattcaggagaaccggcagctgctgcagttactgaccacatacattgttcgggaaaacagccaagttggggaaggtgtgtgtgctgttcttctgggcaccctgactcccatggcaacagagatgctggccaacggtgatgggactggcttccctgaacttatggttgtgatggccactctggccagtgcaggtcaaggtgctggtcaccttcagcttcataatgctgctgtggattggctgagcagatgcaagaaatacctgtcacagaagaatgtagttgaaaaactgaatgccaatgtaatgcatggaaagcatgtgatgatcttggagtgcacatgccatatcatgtcttacttggctgatgtcacgaatgccctgagccagagtaatggtcaaggcccaagtcatctctcagtggatggggaagagcgggccattgaagtagactcagactgggtggaggagttggcggtggaagaggaagattcccaggctgaggattcagatgaagattctctttgcaataaactctgcacttttacgatcacacagaaagaattcatgaaccagcattggtaccactgtcacacctgtaaaatggtggatggcgtgggtgtctgcacagtgtgtgctaaggtgtgccacaaggatcatgagatttcctatgccaagtatggatccttcttctgtgactgtggagccaaggaagatggcagctgtttggctctggtgaagagaactcctagcagtggcatgagctctaccatgaaggagtcggcatttcagagtgaacccaggatttcagagagtctagtgcgtcatgccagcacctcctcgccagctgacaaagccaaggttaccatcagtgatggaaaggttgctgacgaagagaagcccaagaagagcagcctctgccgcacagtagagggctgccgggaggaattacagaaccaggccaatttctccttcgctcctctcgtgttagacatgcttaatttccttatggatgccattcagaccaacttccagcaagcttcagccgtcgggagcagcagccgtgctcagcaagccctcagtgagctacacactgtggagaaggcagtggagatgacagaccagctgatggttcccaccttagggtcccaggaaggtgcctttgagaatgtgcggatgaattacagtggagaccagggccagaccatccggcagctgatcagtgctcatgtgctcaggcgggtggctatgtgtgtgctctcctctccccatgggcgccgccaacatttggctgtcagccatgagaagggcaagatcaccgttctgcagctctctgcactcctgaagcaagcagattccagcaaaaggaagttaactctgacccgcttggcttctgccccagttccttttactgtgttgagcctcacaggaaatccctgcaaggaagactacttggcggtttgtgggctaaaggactgtcatgtgctcacctttagtagctcaggctctgtttcggatcacttggttttgcaccctcagttggcaacggggaacttcatcatcaaagccgtgtggttacctggttcacagaccgagttagcaattgtcaccgcagactttgttaagatttatgacctgtgtgttgatgccttgagtccaaccttctattttctcctgccaagctcaaagataagagatgttaccttccttttcaatgaggagggaaagaacatcattgttataatgtcttcggctgggtacatctatactcagcttatggaagaggccagcagtgcccagcagggacccttctatgtcactaatgtgttggaaatcaatcatgaggacctgaaggacagtaacagccaggtggcgggcggtggtgtgtccgtgtactactcccacgtgttgcagatgttgttcttcagctattgtcaaggcaaatcattcgcagccaccatcagcaggacaaccctggaggtgttgcaactcttccccatcaacatcaaaagttccaatggtggcagtaagacttctcctgctctttgccagtggtctgaggtgatgaaccaccctggcttggtgtgctgtgtccagcaaactacaggggtgccgctggtagttatggtgaaaccagacacttttcttatccaggagattaagactcttcctgctaaagcgaagatccaagacatggttgctattaggcacacggcctgcaatgagcagcagcggacaacaatgattctgctgtgtgaggatggcagcctgcgcatttacatggccaacgtggagaacacctcctactggctgcagccatccctgcagcccagcagtgtcatcagcatcatgaagcctgttcgaaagcgcaaaacagctacaatcacaacccgcacgtctagccaggtgactttccccattgacttttttgaacacaaccagcagctgacagatgtggagtttggtggtaacgacctcctacaggtctataatgcacaacagataaaacaccggctgaattccactggcatgtatgtggccaacaccaagcccggaggcttcaccattgagattagtaacaacaatagcactatggtgatgacaggcatgcggatccagattgggactcaagcaatagaacgggccccgtcatatatcgagatcttcggcagaactatgcagctcaacctgagtcgctcacgctggtttgacttccccttcaccagagaagaagccctgcaggctgataagaagctgaacctcttcattggggcctcggtggatccagcaggtgtcaccatgatagatgctgtaaaaatttatggcaagactaaggagcagtttggctggcctgatgagcccccagaagaattcccttctgcctctgtcagcaacatctgcccttcaaatctgaaccagagcaacggcactggagatagcgactcagctgcccccactacgaccagtggaactgtcctggagaggctggttgtgagttctttagaagccctggaaagctgctttgccgttggcccaatcatcgagaaggagagaaacaagaatgctgctcaggagctggccactttgctgttgtccctgccagcacctgccagtgtccagcagcagtccaagagccttctggccagcctgcacaccagccgctcggcctaccacagccacaaggatcaggccttgctgagcaaagctgtgcagtgtctcaacacatctagcaaagagggcaaggatttggaccctgaggtgttccagaggctagtgatcacagctcgctccattgccatcatgcgccccaacaaccttgtccactttacggagtcaaagctgccccagatggaaacagactgtttttttcctagatgtgcctgctggagtctagggatagttggcatattgattggggccccacttgaaactccctccccaggcaagcttccttgacctgagttaaccttaaaacaaattaaattccatctcagatttaccatcgttgataattttctttctcctgcttagaaggaatggatgaagggaaggaaccgcagaagcagttggaaggagattgctgtagtttcatcacccagcttgtgaaccacttctggaaactccatgcatccaaacccaagaatgccttcttggcacctgcctgccttccaggactaactcatattgaagctactgtcaatgctctggtggacatcatccatggctactgtacctgtgagctggattgtattaacacagcatccaagatctacatgcagatgctcttgtgtcctgatcctgctgtgagcttctcttgtaaacaagctctaattcgagtcctaaggcccaggaacaaacggagacatgtgactttaccctcttcccctcgaagcaacactccaatgggagacaaggatgatgatgacgatgatgatgcagatgagaaaatgcagtcatcagggatcccgaatggtggtcacatccgtcaggaaagccaggaacagagtgaggtggaccatggagattttgagatggtgtctgagtcgatggtcctggagacagctgaaaatgtcaacaatggcaacccctctcccctggaggccctgctggcaggcgcagagggcttcccccccatgctggacatcccacctgatgcagatgacgagaccatggttgaactagccattgccctgagcctgcagcaggaccaacaaggcagcagcagcagtgccctgggcctgcagagcctgggactgtccggccaggcacccagctcttcctctctggacgcaggaaccctctctgacaccacagcatcagctccagcctcagacgacgagggcagtacagcagcgacagatggttctacccttcggacctctcctgctgaccacggtggtagtgtgggctcggagagcgggggcagtgcagtggactcagtggctggcgagcacagtgtatctggccggagcagtgcttatggcgatgctacagctgaggggcatccggctggaccaggaagtgtcagctcaagcactggagccatcagcaccaccactgggcaccaggagggagatggctccgagggagaaggagaaggagaaactgaaggagatgtccacactagcaacaggctgcacatggtccgtctaatgctgttggagagattactgcagaccctgcctcaattacgaaacgttggcggtgtccgggccatcccatacatgcaggtcattctaatgctcactacagatctggatggagaagatgagaaagacaagggggccctagacaacctgctctcccagcttattgctgagttgggtatggataaaaaggatgtctccaagaagaatgagcgcagcgccctgaatgaagtccatctggtagtaatgagactcctgagtgtcttcatgtcccgcaccaaatctggatccaagtcttccatatgtgagtcatcttccctcatctccagtgccacagcagcagctctactgagctctggggctgtggactactgcctgcacgtgctcaaatcactgctggaatattggaagagccaacagaatgacgaggagcctgtggctaccagccagttgctgaaaccacatactacctcctccccacctgacatgagcccattctttctccgccagtatgtgaagggtcatgctgctgatgtgtttgaggcctatactcagcttctaacagaaatggtactgaggcttccttaccaaatcaaaaagattactgacaccaattctcgaatcccacctcctgtctttgaccactcgtggttttactttctctccgagtacctcatgatccagcagactccatttgtgcgccgtcaagtccgcaaacttctgctcttcatctgtggatccaaagagaagtaccgccagctccgggatttgcacaccctggactctcacgtgcgtgggatcaagaagctgctagaagagcaggggatattcctccgggcaagtgtggttacagccagctcaggctccgccttgcaatatgacacactcatcagcctgatggagcacctgaaagcctgtgcagagattgccgcccagcgaaccatcaactggcagaaattctgcatcaaagatgactccgtcctgtacttcctcctccaagtcagtttccttgtggatgagggcgtgtccccagtgctgctgcaactgctctcctgtgctctctgcggcagcaaggtgctcgctgcactggcagcctcttcgggatcctccagtgcttcttcctcctcagcccctgtggctgccagttctggacaagccacaacacagtccaagtcttccactaaaaagagcaagaaagaagaaaaagaaaaggagaaagatggtgagacctctggcagccaggaggaccagctgtgcacagctctggtgaaccagctgaacaaatttgccgataaggaaaccctgatccagttcctgcgttgtttcctgttagagtccaattcttcctcggtgcgctggcaggcccactgtctgacactgcacatctacagaaattccagcaaatctcaacaggagctcctgctagatctgatgtggtccatctggccagaactcccagcctatggtcgtaaggctgcccagtttgtggacctactaggatatttctccctgaaaactccacaaacagagaagaagttgaaggagtattcacagaaggctgtggagattctgcggactcaaaaccatattcttaccaaccaccccaactcgaacatttataacactttgtctggcttagtggagtttgatggctattacctggagagcgatccctgcctggtgtgtaataacccggaagtaccgttctgttatatcaagctgtcttccattaaagtggacacgcggtacaccaccacccagcaggttgtgaagctcattggcagtcacaccatcagcaaagtgacagtgaaaatcggggatctgaaacggaccaagatggtgcggaccatcaacctgtattataacaaccgaaccgtgcaggccatcgtggagttgaaaaacaagccagctcgctggcacaaagccaagaaggttcagctgacccctggacagacagaggtgaagattgacctgccgttgcccattgtggcctccaatctgatgattgagtttgcagacttctatgaaaactaccaggcctccacagagaccctgcagtgccctcgctgtagtgcctcggtccctgccaacccaggagtctgtggcaactgtggagagaatgtgtaccagtgtcacaaatgcagatccatcaactacgatgaaaaggatcccttcctctgcaatgcctgtggcttctgtaaatatgcccgcttcgacttcatgctctatgccaagccttgctgtgcagtggatcccattgagaatgaagaagaccggaagaaggctgtatccaacatcaatacacttttggacaaagctgatcgagtgtatcatcagctgatgggacaccggccacagctggagaacctgctctgcaaagtgaatgaggcagctccagaaaagccacaggtagtcccacgctgcaaagggcatttggataagggcttgggtcttgatcagaagactgcctcctaggtgagatcaccttaggtggggagcctgacagcttacctcttggggttgcaggatgactcaggaacagcagggggcatcagctccacttctgccagtgtgaatcgttacatcctgcagttggctcaggagtattgtggagactgcaagaactcttttgatgaactctccaaaatcatccaggtagagagcggggagcagcttttgggtgtgttttgtccaagtgttactggtgttgttttcacagcagtcctgctgctctctcatcnagcagtccaggtcttggtgttgtccctgcccaatctagctgaaaaggcaggcagatggctgcaccaaacggcatctcccccaccgtgatttatggcgctggtcagaatgctgagttcatgctagataactgaacatactggtgatgggaaggtaacacagataagggttttttttagccattaacaacccatctcttagtagaggggttactggtcttaaaaaatttgatgccaagattctgttccctcttctgataacgccgtgtttgcaggctgtagggtaagggcataccaactgcaatcaaccagggtgggccttgtgtcagttgcaatgtcacagacctaatctccatgagatgggaggctggccatagacagaggtacctcatataaggagagcatccagtttaccttccccctcaaccccaaattgctggagtgccatctttgctacacgtgtattagcttctgacctttgtctttgttacatgggagttaagagcataagcctgccatctgagtctgagttctgactctgccacttatcttggtcaagccactttctccaagcttcagtttccttctctgtaaaatggagataaagcatctaaccagttgggttattgagaagattaagttatataatgcatgtaaagttttttctaaagcaaaactaattttctaattaacatcctcttcttattttaattgctaattcccattattgttgcctttttgttcttagaaagtctttgcttcgcgcaaagagttgttggaatatgacctacagcagagggaagcagccactaaatcatcccggacctccgtgcagcccacattcactgccagccagtaccgtgccttatccgtcctgggctgtggccacacatcctccaccaagtgctatggctgcgcctcggctgtcacagaacattgtatcacactacttcgggccctggccaccaacccagccttgaggcacatccttgtctcccagggccttatccgggagctctttgattataatcttcgccgaggggctgcggccatgcgggaggaggtccgccagctcatgtgcctcctaactcgagacaacccagaagccacccaacagatgaatgacctgattattggcaaggtctccacagccctgaagggccactgggccaaccccgatctggcaagtagcctgcagtatgaaatgctgctgctgacggattctatctccaaggaggacagctgctgggagctccggttacgctgtgctctcagccttttcctcatggctgtgaacattaagactcctgtggtggttgaaaacattaccctcatgtgcctgaggatcttgcagaagctgataaaaccacctgctcccactagcaagaagaacaaggatgtccccgtcgaggccctcaccacggtgaagccatactgcaatgagatccatgcccaggctcaactgtggctcaagagagaccccaaggcatcctatgatgcctggaagaagtgtcttcctatcagagggatagatggcaatgggaaagcccccagcaaatcagagctccgccatctctatttgactgagaagtatgtgtggaggtggaaacagttcctgagtcgtcgggggaagaggacctcccccttggatctcaaactggggcataacaactggctgcgacaagtgcttttcactccagcaacgcaggccgcacggcaggcagcctgtaccattgtggaagctctagccaccattcccagccgcaagcagcaggtcctggacctgcttaccagttacctggatgagctgagcatagctggggagtgtgcagctgagtacctggctctctaccagaagctcatcacttctgcgcactggaaagtctacttggcagctcggggagtcctaccctatgtgggcaacctcatcaccaaggaaatagctcgtctgctggccctggaggaggctaccctgagtaccgatctgcagcagggttatgcccttaaaagtctcacaggccttctctcctcctttgttgaggtggaatccatcaaaagacattttaaaagtcgcttggtgggtactgtgctgaatggatacctgtgcttgcggaagctggtggtgcagaggaccaagctgatcgatgagacgcaggacatgctgctggagatgctggaggacatgaccacaggtacagaatcagaaaccaaggccttcatggctgtgtgcattgagacagccaagcgctacaatctggatgactaccggaccccggtgttcatcttcgagaggctctgcagcatcatttatcctgaggagaatgaagtcactgagttctttgtgaccctggagaaggatccccaacaagaagacttcttacagggcaggatgcctgggaacccgtatagcagcaatgagccaggcatcgggccgctgatgagggatataaagaacaagatttgccaggactgtgacttagtggccctcctggaagatgacagtggcatggagcttctagtgaacaataaaatcattagtttggaccttcctgtggctgaagtttacaagaaagtctggtgtaccacgaatgagggagagcccatgaggattgtttatcgtatgcgggggctgctgggcgatgccacagaggagttcattgagtccctggactctactacagatgaagaagaagatgaagaagaagtgtataaaatggctggtgtgatggcccagtgtgggggcctggaatgcatgcttaacagactcgcagggatcagagatttcaagcagggacgccaccttctaacagtgctactgaaattgttcagttactgcgtgaaggtgaaagtcaaccggcagcaactggtcaaactggaaatgaacaccttgaacgtcatgctggggaccctaaacctggcccttgtagctgaacaagaaagcaaggacagtgggggtgcagctgtggctgagcaggtgcttagcatcatggagatcattctagatgagtccaatgctgagcccctgagtgaggacaagggcaacctcctcctgacaggtgacaaggatcaactggtgatgctcttggaccagatcaacagcacctttgttcgctccaaccccagtgtgctccagggcctgcttcgcatcatcccgtacctttcctttggagaggtggagaaaatgcagatcttggtggagcgattcaaaccatactgcaactttgataaatatgatgaagatcacagtggtgatgataaagtcttcctggactgcttctgtaaaatagctgctggcatcaagaacaacagcaatgggcaccagctgaaggatctgattctccagaaggggatcacccagaatgcacttgactacatgaaaaagcacatccctagcgccaagaatttggatgccgacatctggaaaaagtttttgtctcgcccagccttgccatttatcctaaggctgcttcggggcctggccatccagcaccctggcacccaggttctgattggaactgattccatcccgaacctgcataagctggagcaggtgtccagtgatgagggcattgggaccttggcagagaacctgctggaagccctgcgggaacaccctgacgtaaacaagaagattgacgcagcccgcagggagacccgggcagagaagaaacgcatggccatggcaatgaggcagaaggccctgggcaccctgggcatgacgacaaatgaaaagggccaggtcgtgaccaagacagcactcctgaagcagatggaagagctgatcgaggagcctggcctcacgtgctgcatctgcagggagggatacaagttccagcccacaaaggtcctgggcatttataccttcacgaagcgggtagccttggaggagttggagaataagccccggaaacagcagggctacagcaccgtgtcccacttcaacattgtgcactacgactgccatctggctgccgtcaggttggctcgaggccgggaagagtgggagagtgccgccctgcagaatgccaacaccaagtgcaacgggctccttccggtctggggacctcatgtccctgaatcagcttttgccacttgcttggcaagacacaacacttacctccaggaatgtacaggccagcgggagcccacgtatcagctcaacatccacgacatcaaactgctcttcctgcgcttcgccatggagcagtcgttcagcgcagacactggcgggggcggccgggagagcaacatccacctgatcccgtacatcattcacactgtgctttacgtcctgaacacaacccgagcaacttcccgagaagagaagaacctccaaggctttctggaacagcccaaggagaagtgggtggagagtgcctttgaagtggacgggccctactatttcacagtcttggcccttcacatcctgccccctgagcagtggagagccacacgtgtggaaatcttgcggaggctgttggtgacctcgcaggctcgggcagtggctccaggtggagccaccaggctgacagataaggcagtgaaggactattccgcttaccgttcttcccttctcttttgggccctcgtcgatctcatttacaacatgtttaagaaggtgcctaccagtaacacagagggaggctggtcctgctctctcgctgagtacatccgccacaacgacatgcccatctacgaagctgccgacaaagccctgaaaaccttccaggaggagttcatgccagtggagaccttctcagagttcctcgatgtggccggtcttttatcagaaatcaccgatccagagagcttcctgaaggacctgttgaactcagtcccctgaccaccacacagcagctgcggcggcgaagacgaagctggcttgccttccaccctctgttctccctccttgtgcattaagttccctccgcgggatgctgcattgttaccccgccctcccctctctcatttttcttggtgtggcttggggtttttaggcttcctgttttatctcgtgtgtgtggtgcaccagctatgaggttgtctgtaacccaagccatcaaagggcctgtacatacctaggagccatgagttgtcccggccagcttcatacttgagtgtgcacatcttgagaaataaacaagtgacttaacacacattgaaaa

SEQ ID NO: 356696 - DNA, 12003 bp, Homo sapiens
gtgacctagaggttccgccacaagcgcgatctcaaaggtccaggtctctttggatgagcatttttctaagatggctgctgagactgatcctcataagtcgtctgagattaccaagaacctacttccagccacgctgcaactcattgacacctatgcatcgttcaccagagcctatttgctgcaaaactttaatgaagagggaacaactgagaaaccttccaaggagaaactgcaaggctttgctgctgttttggctattggctctagcaggtgcaaggcaaatactctgggtccgacactggttcagaatttgccatcgtcagtgcagactgtgtgtgagtcctggaacaacatcaataccaatgaatttcccaatattggatcctggcgcaatgcctttgccaatgacaccatcccttcagagagttatattagtgcagtgcaggctgcacacctggggactctctgtagccaaagtctgcccctggctgcttccctgaagcataccctcctctcactggtcaggttgactggagatcttattgtttggtcagatgagatgaacccaccacaggtaattcggacactgctacctcttcttttggaatcaagcactgagagtgttgccgagatcagtagcaactccctggaacgcatcttgggccctgctgagtctgatgagttcttggctcgtgtttatgagaagctgatcactggttgttacaacattctggccaatcatgcagatcctaacagtggactggatgaatccatcctggaggaatgtctccagtacttggaaaagcagctggaaagtagccaggctcgtaaagctatggaggagtttttctctgacagtggagaacttgtacagatcatgatggcaacagccaatgagaacctctctgctaaattctgtaaccgagttttgaaattcttcaccaaactcttccagctgactgagaagagccctaacccgagcctgttgcatctctgtggctccctggcacaactggcctgtgtggaacctgtgcgcctgcaggcctggctcacccgcatgactacatcgcccccaaaagattctgatcagctggatgtaattcaggagaaccggcagctgctgcagttactgaccacatacattgttcgggaaaacagccaagttggggaaggtgtgtgtgctgttcttctgggcaccctgactcccatggcaacagagatgctggccaacggtgatgggactggcttccctgaacttatggttgtgatggccactctggccagtgcaggtcaaggtgctggtcaccttcagcttcataatgctgctgtggattggctgagcagatgcaagaaatacctgtcacagaagaatgtagttgaaaaactgaatgccaatgtaatgcatggaaagcatgtgatgatcttggagtgcacatgccatatcatgtcttacttggctgatgtcacgaatgccctgagccagagtaatggtcaaggcccaagtcatctctcagtggatggggaagagcgggccattgaagtagactcagactgggtggaggagttggcggtggaagaggaagattcccaggctgaggattcagatgaagattctctttgcaataaactctgcacttttacgatcacacagaaagaattcatgaaccagcattggtaccactgtcacacctgtaaaatggtggatggcgtgggtgtctgcacagtgtgtgctaaggtgtgccacaaggatcatgagatttcctatgccaagtatggatccttcttctgtgactgtggagccaaggaagatggcagctgtttggctctggtgaagagaactcctagcagtggcatgagctctaccatgaaggagtcggcatttcagagtgaacccaggatttcagagagtctagtgcgtcatgccagcacctcctcgccagctgacaaagccaaggttaccatcagtgatggaaaggttgctgacgaagagaagcccaagaagagcagcctctgccgcacagtagagggctgccgggaggaattacagaaccaggccaatttctccttcgctcctctcgtgttagacatgcttaatttccttatggatgccattcagaccaacttccagcaagcttcagccgtcgggagcagcagccgtgctcagcaagccctcagtgagctacacactgtggagaaggcagtggagatgacagaccagctgatggttcccaccttagggtcccaggaaggtgcctttgagaatgtgcggatgaattacagtggagaccagggccagaccatccggcagctgatcagtgctcatgtgctcaggcgggtggctatgtgtgtgctctcctctccccatgggcgccgccaacatttggctgtcagccatgagaagggcaagatcaccgttctgcagctctctgcactcctgaagcaagcagattccagcaaaaggaagttaactctgacccgcttggcttctgccccagttccttttactgtgttgagcctcacaggaaatccctgcaaggaagactacttggcggtttgtgggctaaaggactgtcatgtgctcacctttagtagctcaggctctgtttcggatcacttggttttgcaccctcagttggcaacggggaacttcatcatcaaagccgtgtggttacctggttcacagaccgagttagcaattgtcaccgcagactttgttaagatttatgacctgtgtgttgatgccttgagtccaaccttctattttctcctgccaagctcaaagataagagatgttaccttccttttcaatgaggagggaaagaacatcattgttataatgtcttcggctgggtacatctatactcagcttatggaagaggccagcagtgcccagcagggacccttctatgtcactaatgtgttggaaatcaatcatgaggacctgaaggacagtaacagccaggtggcgggcggtggtgtgtccgtgtactactcccacgtgttgcagatgttgttcttcagctattgtcaaggcaaatcattcgcagccaccatcagcaggacaaccctggaggtgttgcaactcttccccatcaacatcaaaagttccaatggtggcagtaagacttctcctgctctttgccagtggtctgaggtgatgaaccaccctggcttggtgtgctgtgtccagcaaactacaggggtgccgctggtagttatggtgaaaccagacacttttcttatccaggagattaagactcttcctgctaaagcgaagatccaagacatggttgctattaggcacacggcctgcaatgagcagcagcggacaacaatgattctgctgtgtgaggatggcagcctgcgcatttacatggccaacgtggagaacacctcctactggctgcagccatccctgcagcccagcagtgtcatcagcatcatgaagcctgttcgaaagcgcaaaacagctacaatcacaacccgcacgtctagccaggtgactttccccattgacttttttgaacacaaccagcagctgacagatgtggagtttggtggtaacgacctcctacaggtctataatgcacaacagataaaacaccggctgaattccactggcatgtatgtggccaacaccaagcccggaggcttcaccattgagattagtaacaacaatagcactatggtgatgacaggcatgcggatccagattgggactcaagcaatagaacgggccccgtcatatatcgagatcttcggcagaactatgcagctcaacctgagtcgctcacgctggtttgacttccccttcaccagagaagaagccctgcaggctgataagaagctgaacctcttcattggggcctcggtggatccagcaggtgtcaccatgatagatgctgtaaaaatttatggcaagactaaggagcagtttggctggcctgatgagcccccagaagaattcccttctgcctctgtcagcaacatctgcccttcaaatctgaaccagagcaacggcactggagatagcgactcagctgcccccactacgaccagtggaactgtcctggagaggctggttgtgagttctttagaagccctggaaagctgctttgccgttggcccaatcatcgagaaggagagaaacaagaatgctgctcaggagctggccactttgctgttgtccctgccagcacctgccagtgtccagcagcagtccaagagccttctggccagcctgcacaccagccgctcggcctaccacagccacaaggatcaggccttgctgagcaaagctgtgcagtgtctcaacacatctagcaaagagggcaaggatttggaccctgaggtgttccagaggctagtgatcacagctcgctccattgccatcatgcgccccaacaaccttgtccactttacggagtcaaagctgccccagatggaaacagactgtttttttcctagatgtgcctgctggagtctagggatagttggcatattgattggggccccacttgaaactccctccccaggcaagcttccttgacctgagttaaccttaaaacaaattaaattccatctcagatttaccatcgttgataattttctttctcctgcttagaaggaatggatgaagggaaggaaccgcagaagcagttggaaggagattgctgtagtttcatcacccagcttgtgaaccacttctggaaactccatgcatccaaacccaagaatgccttcttggcacctgcctgccttccaggactaactcatattgaagctactgtcaatgctctggtggacatcatccatggctactgtacctgtgagctggattgtattaacacagcatccaagatctacatgcagatgctcttgtgtcctgatcctgctgtgagcttctcttgtaaacaagctctaattcgagtcctaaggcccaggaacaaacggagacatgtgactttaccctcttcccctcgaagcaacactccaatgggagacaaggatgatgatgacgatgatgatgcagatgagaaaatgcagtcatcagggatcccgaatggtggtcacatccgtcaggaaagccaggaacagagtgaggtggaccatggagattttgagatggtgtctgagtcgatggtcctggagacagctgaaaatgtcaacaatggcaacccctctcccctggaggccctgctggcaggcgcagagggcttcccccccatgctggacatcccacctgatgcagatgacgagaccatggttgaactagccattgccctgagcctgcagcaggaccaacaaggcagcagcagcagtgccctgggcctgcagagcctgggactgtccggccaggcacccagctcttcctctctggacgcaggaaccctctctgacaccacagcatcagctccagcctcagacgacgagggcagtacagcagcgacagatggttctacccttcggacctctcctgctgaccacggtggtagtgtgggctcggagagcgggggcagtgcagtggactcagtggctggcgagcacagtgtatctggccggagcagtgcttatggcgatgctacagctgaggggcatccggctggaccaggaagtgtcagctcaagcactggagccatcagcaccaccactgggcaccaggagggagatggctccgagggagaaggagaaggagaaactgaaggagatgtccacactagcaacaggctgcacatggtccgtctaatgctgttggagagattactgcagaccctgcctcaattacgaaacgttggcggtgtccgggccatcccatacatgcaggtcattctaatgctcactacagatctggatggagaagatgagaaagacaagggggccctagacaacctgctctcccagcttattgctgagttgggtatggataaaaaggatgtctccaagaagaatgagcgcagcgccctgaatgaagtccatctggtagtaatgagactcctgagtgtcttcatgtcccgcaccaaatctggatccaagtcttccatatgtgagtcatcttccctcatctccagtgccacagcagcagctctactgagctctggggctgtggactactgcctgcacgtgctcaaatcactgctggaatattggaagagccaacagaatgacgaggagcctgtggctaccagccagttgctgaaaccacatactacctcctccccacctgacatgagcccattctttctccgccagtatgtgaagggtcatgctgctgatgtgtttgaggcctatactcagcttctaacagaaatggtactgaggcttccttaccaaatcaaaaagattactgacaccaattctcgaatcccacctcctgtctttgaccactcgtggttttactttctctccgagtacctcatgatccagcagactccatttgtgcgccgtcaagtccgcaaacttctgctcttcatctgtggatccaaagagaagtaccgccagctccgggatttgcacaccctggactctcacgtgcgtgggatcaagaagctgctagaagagcaggggatattcctccgggcaagtgtggttacagccagctcaggctccgccttgcaatatgacacactcatcagcctgatggagcacctgaaagcctgtgcagagattgccgcccagcgaaccatcaactggcagaaattctgcatcaaagatgactccgtcctgtacttcctcctccaagtcagtttccttgtggatgagggcgtgtccccagtgctgctgcaactgctctcctgtgctctctgcggcagcaaggtgctcgctgcactggcagcctcttcgggatcctccagtgcttcttcctcctcagcccctgtggctgccagttctggacaagccacaacacagtccaagtcttccactaaaaagagcaagaaagaagaaaaagaaaaggagaaagatggtgagacctctggcagccaggaggaccagctgtgcacagctctggtgaaccagctgaacaaatttgccgataaggaaaccctgatccagttcctgcgttgtttcctgttagagtccaattcttcctcggtgcgctggcaggcccactgtctgacactgcacatctacagaaattccagcaaatctcaacaggagctcctgctagatctgatgtggtccatctggccagaactcccagcctatggtcgtaaggctgcccagtttgtggacctactaggatatttctccctgaaaactccacaaacagagaagaagttgaaggagtattcacagaaggctgtggagattctgcggactcaaaaccatattcttaccaaccaccccaactcgaacatttataacactttgtctggcttagtggagtttgatggctattacctggagagcgatccctgcctggtgtgtaataacccggaagtaccgttctgttatatcaagctgtcttccattaaagtggacacgcggtacaccaccacccagcaggttgtgaagctcattggcagtcacaccatcagcaaagtgacagtgaaaatcggggatctgaaacggaccaagatggtgcggaccatcaacctgtattataacaaccgaaccgtgcaggccatcgtggagttgaaaaacaagccagctcgctggcacaaagccaagaaggttcagctgacccctggacagacagaggtgaagattgacctgccgttgcccattgtggcctccaatctgatgattgagtttgcagacttctatgaaaactaccaggcctccacagagaccctgcagtgccctcgctgtagtgcctcggtccctgccaacccaggagtctgtggcaactgtggagagaatgtgtaccagtgtcacaaatgcagatccatcaactacgatgaaaaggatcccttcctctgcaatgcctgtggcttctgtaaatatgcccgcttcgacttcatgctctatgccaagccttgctgtgcagtggatcccattgagaatgaagaagaccggaagaaggctgtatccaacatcaatacacttttggacaaagctgatcgagtgtatcatcagctgatgggacaccggccacagctggagaacctgctctgcaaagtgaatgaggcagctccagaaaagccacaggatgactcaggaacagcagggggcatcagctccacttctgccagtgtgaatcgttacatcctgcagttggctcaggagtattgtggagactgcaagaactcttttgatgaactctccaaaatcatccagaaagtctttgcttcgcgcaaagagttgttggaatatgacctacagcagagggaagcagccactaaatcatcccggacctccgtgcagcccacattcactgccagccagtaccgtgccttatccgtcctgggctgtggccacacatcctccaccaagtgctatggctgcgcctcggctgtcacagaacattgtatcacactacttcgggccctggccaccaacccagccttgaggcacatccttgtctcccagggccttatccgggagctctttgattataatcttcgccgaggggctgcggccatgcgggaggaggtccgccagctcatgtgcctcctaactcgagacaacccagaagccacccaacagatgaatgacctgattattggcaaggtctccacagccctgaagggccactgggccaaccccgatctggtgagccggcctagcaggcccagctgtcctctctgacttcccctcacatgccttgtgtttctcagcttcccctcccaggtcctgcggtgactgaggagggaaggagcagaacattaccccagaatggttttcccagggaagagcctggagcacaagggtctccgtctgtcctttgtctctgttggagccacctaggaccagaaattgtattaatagttaagagtcgctggaccggagggaagctggtggtgcagaggaccaagctgatcgatgagacgcaggacatgctgctggagatgctggaggacatgaccacaggtacagaatcagaaaccaaggccttcatggctgtgtgcattgagacagccaagcgctacaatctggatgactaccggaccccggtgttcatcttcgagaggctctgcagcatcatttatcctgaggagaatgaagtcactgagttctttgtgaccctggagaaggatccccaacaagaagacttcttacagggcaggatgcctgggaacccgtatagcagcaatgagccaggcatcgggccgctgatgagggatataaagaacaagatttgccaggactgtgacttagtggccctcctggaagatgacagtggcatggagcttctagtgaacaataaaatcattagtttggaccttcctgtggctgaagtttacaagaaagtctggtgtaccacgaatgagggagagcccatgaggattgtttatcgtatgcgggggctgctgggcgatgccacagaggagttcattgagtccctggactctactacagatgaagaagaagatgaagaagaagtgtataaaatggctggtgtgatggcccagtgtgggggcctggaatgcatgcttaacagactcgcagggatcagagatttcaagcagggacgccaccttctaacagtgctactgaaattgttcagttactgcgtgaaggtgaaagtcaaccggcagcaactggtcaaactggaaatgaacaccttgaacgtcatgctggggaccctaaacctggcccttgtagctgaacaagaaagcaaggacagtgggggtgcagctgtggctgagcaggtgcttagcatcatggagatcattctagatgagtccaatgctgagcccctgagtgaggacaagggcaacctcctcctgacaggtgacaaggatcaactggtgatgctcttggaccagatcaacagcacctttgttcgctccaaccccagtgtgctccagggcctgcttcgcatcatcccgtacctttcctttggagaggtggagaaaatgcagatcttggtggagcgattcaaaccatactgcaactttgataaatatgatgaagatcacagtggtgatgataaagtcttcctggactgcttctgtaaaatagctgctggcatcaagaacaacagcaatgggcaccagctgaaggatctgattctccagaaggggatcacccagaatgcacttgactacatgaaaaagcacatccctagcgccaagaatttggatgccgacatctggaaaaagtttttgtctcgcccagccttgccatttatcctaaggctgcttcggggcctggccatccagcaccctggcacccaggttctgattggaactgattccatcccgaacctgcataagctggagcaggtgtccagtgatgagggcattgggaccttggcagagaacctgctggaagccctgcgggaacaccctgacgtaaacaagaagattgacgcagcccgcagggagacccgggcagagaagaaacgcatggccatggcaatgaggcagaaggccctgggcaccctgggcatgacgacaaatgaaaagggccaggtcgtgaccaagacagcactcctgaagcagatggaagagctgatcgaggagcctggcctcacgtgctgcatctgcagggagggatacaagttccagcccacaaaggtcctgggcatttataccttcacgaagcgggtagccttggaggagttggagaataagccccggaaacagcagggctacagcaccgtgtcccacttcaacattgtgcactacgactgccatctggctgccgtcaggttggctcgaggccgggaagagtgggagagtgccgccctgcagaatgccaacaccaagtgcaacgggctccttccggtctggggacctcatgtccctgaatcagcttttgccacttgcttggcaagacacaacacttacctccaggaatgtacaggccagcgggagcccacgtatcagctcaacatccacgacatcaaactgctcttcctgcgcttcgccatggagcagtcgttcagcgcagacactggcgggggcggccgggagagcaacatccacctgatcccgtacatcattcacactgtgctttacgtcctgaacacaacccgagcaacttcccgagaagagaagaacctccaaggctttctggaacagcccaaggagaagtgggtggagagtgcctttgaagtggacgggccctactatttcacagtcttggcccttcacatcctgccccctgagcagtggagagccacacgtgtggaaatcttgcggaggctgttggtgacctcgcaggctcgggcagtggctccaggtggagccaccaggctgacagataaggcagtgaaggactattccgcttaccgttcttcccttctcttttgggccctcgtcgatctcatttacaacatgtttaagaaggtgcctaccagtaacacagagggaggctggtcctgctctctcgctgagtacatccgccacaacgacatgcccatctacgaagctgccgacaaagccctgaaaaccttccaggaggagttcatgccagtggagaccttctcagagttcctcgatgtggccggtcttttatcagaaatcaccgatccagagagcttcctgaaggacctgttgaactcagtcccctgaccaccacacagcagctgcggcggcgaagacgaagctggcttgccttccaccctctgttctccctccttgtgcattaagttccctccgcgggatgctgcattgttaccccgccctcccctctctcatttttcttggtgtggcttggggtttttaggcttcctgttttatctcgtgtgtgtggtgcaccagctatgaggttgtctgtaacccaagccatcaaagggcctgtacatacctaggagccatgagttgtcccggccagcttcatacttgagtgtgcacatcttgagaaataaacaagtgacttaacacacattgaaaa

SEQ ID NO: 356697 - DNA, 12439 bp, Homo sapiens
gtgacctagaggttccgccacaagcgcgatctcaaaggtccaggtctctttggatgagcatttttctaagatggctgctgagactgatcctcataagtcgtctgagattaccaagaacctacttccagccacgctgcaactcattgacacctatgcatcgttcaccagagcctatttgctgcaaaactttaatgaagagggaacaactgagaaaccttccaaggagaaactgcaaggctttgctgctgttttggctattggctctagcaggtgcaaggcaaatactctgggtccgacactggttcagaatttgccatcgtcagtgcagactgtgtgtgagtcctggaacaacatcaataccaatgaatttcccaatattggatcctggcgcaatgcctttgccaatgacaccatcccttcagagagttatattagtgcagtgcaggctgcacacctggggactctctgtagccaaagtctgcccctggctgcttccctgaagcataccctcctctcactggtcaggttgactggagatcttattgtttggtcagatgagatgaacccaccacaggtaattcggacactgctacctcttcttttggaatcaagcactgagagtgttgccgagatcagtagcaactccctggaacgcatcttgggccctgctgagtctgatgagttcttggctcgtgtttatgagaagctgatcactggttgttacaacattctggccaatcatgcagatcctaacagtggactggatgaatccatcctggaggaatgtctccagtacttggaaaagcagctggaaagtagccaggctcgtaaagctatggaggagtttttctctgacagtggagaacttgtacagatcatgatggcaacagccaatgagaacctctctgctaaattctgtaaccgagttttgaaattcttcaccaaactcttccagctgactgagaagagccctaacccgagcctgttgcatctctgtggctccctggcacaactggcctgtgtggaacctgtgcgcctgcaggcctggctcacccgcatgactacatcgcccccaaaagattctgatcagctggatgtaattcaggagaaccggcagctgctgcagttactgaccacatacattgttcgggaaaacagccaagttggggaaggtgtgtgtgctgttcttctgggcaccctgactcccatggcaacagagatgctggccaacggtgatgggactggcttccctgaacttatggttgtgatggccactctggccagtgcaggtcaaggtgctggtcaccttcagcttcataatgctgctgtggattggctgagcagatgcaagaaatacctgtcacagaagaatgtagttgaaaaactgaatgccaatgtaatgcatggaaagcatgtgatgatcttggagtgcacatgccatatcatgtcttacttggctgatgtcacgaatgccctgagccagagtaatggtcaaggcccaagtcatctctcagtggatggggaagagcgggccattgaagtagactcagactgggtggaggagttggcggtggaagaggaagattcccaggctgaggattcagatgaagattctctttgcaataaactctgcacttttacgatcacacagaaagaattcatgaaccagcattggtaccactgtcacacctgtaaaatggtggatggcgtgggtgtctgcacagtgtgtgctaaggtgtgccacaaggatcatgagatttcctatgccaagtatggatccttcttctgtgactgtggagccaaggaagatggcagctgtttggctctggtgaagagaactcctagcagtggcatgagctctaccatgaaggagtcggcatttcagagtgaacccaggatttcagagagtctagtgcgtcatgccagcacctcctcgccagctgacaaagccaaggttaccatcagtgatggaaaggttgctgacgaagagaagcccaagaagagcagcctctgccgcacagtagagggctgccgggaggaattacagaaccaggccaatttctccttcgctcctctcgtgttagacatgcttaatttccttatggatgccattcagaccaacttccagcaagcttcagccgtcgggagcagcagccgtgctcagcaagccctcagtgagctacacactgtggagaaggcagtggagatgacagaccagctgatggttcccaccttagggtcccaggaaggtgcctttgagaatgtgcggatgaattacagtggagaccagggccagaccatccggcagctgatcagtgctcatgtgctcaggcgggtggctatgtgtgtgctctcctctccccatgggcgccgccaacatttggctgtcagccatgagaagggcaagatcaccgttctgcagctctctgcactcctgaagcaagcagattccagcaaaaggaagttaactctgacccgcttggcttctgccccagttccttttactgtgttgagcctcacaggaaatccctgcaaggaagactacttggcggtttgtgggctaaaggactgtcatgtgctcacctttagtagctcaggctctgtttcggatcacttggttttgcaccctcagttggcaacggggaacttcatcatcaaagccgtgtggttacctggttcacagaccgagttagcaattgtcaccgcagactttgttaagatttatgacctgtgtgttgatgccttgagtccaaccttctattttctcctgccaagctcaaagataagagatgttaccttccttttcaatgaggagggaaagaacatcattgttataatgtcttcggctgggtacatctatactcagcttatggaagaggccagcagtgcccagcagggacccttctatgtcactaatgtgttggaaatcaatcatgaggacctgaaggacagtaacagccaggtggcgggcggtggtgtgtccgtgtactactcccacgtgttgcagatgttgttcttcagctattgtcaaggcaaatcattcgcagccaccatcagcaggacaaccctggaggtgttgcaactcttccccatcaacatcaaaagttccaatggtggcagtaagacttctcctgctctttgccagtggtctgaggtgatgaaccaccctggcttggtgtgctgtgtccagcaaactacaggggtgccgctggtagttatggtgaaaccagacacttttcttatccaggagattaagactcttcctgctaaagcgaagatccaagacatggttgctattaggcacacggcctgcaatgagcagcagcggacaacaatgattctgctgtgtgaggatggcagcctgcgcatttacatggccaacgtggagaacacctcctactggctgcagccatccctgcagcccagcagtgtcatcagcatcatgaagcctgttcgaaagcgcaaaacagctacaatcacaacccgcacgtctagccaggtgactttccccattgacttttttgaacacaaccagcagctgacagatgtggagtttggtggtaacgacctcctacaggtctataatgcacaacagataaaacaccggctgaattccactggcatgtatgtggccaacaccaagcccggaggcttcaccattgagattagtaacaacaatagcactatggtgatgacaggcatgcggatccagattgggactcaagcaatagaacgggccccgtcatatatcgagatcttcggcagaactatgcagctcaacctgagtcgctcacgctggtttgacttccccttcaccagagaagaagccctgcaggctgataagaagctgaacctcttcattggggcctcggtggatccagcaggtgtcaccatgatagatgctgtaaaaatttatggcaagactaaggagcagtttggctggcctgatgagcccccagaagaattcccttctgcctctgtcagcaacatctgcccttcaaatctgaaccagagcaacggcactggagatagcgactcagctgcccccactacgaccagtggaactgtcctggagaggctggttgtgagttctttagaagccctggaaagctgctttgccgttggcccaatcatcgagaaggagagaaacaagaatgctgctcaggagctggccactttgctgttgtccctgccagcacctgccagtgtccagcagcagtccaagagccttctggccagcctgcacaccagccgctcggcctaccacagccacaaggatcaggccttgctgagcaaagctgtgcagtgtctcaacacatctagcaaagagggcaaggatttggaccctgaggtgttccagaggctagtgatcacagctcgctccattgccatcatgcgccccaacaaccttgtccactttacggagtcaaagctgccccagatggaaacagactgtttttttcctagatgtgcctgctggagtctagggatagttggcatattgattggggccccacttgaaactccctccccaggcaagcttccttgacctgagttaaccttaaaacaaattaaattccatctcagatttaccatcgttgataattttctttctcctgcttagaaggaatggatgaagggaaggaaccgcagaagcagttggaaggagattgctgtagtttcatcacccagcttgtgaaccacttctggaaactccatgcatccaaacccaagaatgccttcttggcacctgcctgccttccaggactaactcatattgaagctactgtcaatgctctggtggacatcatccatggctactgtacctgtgagctggattgtattaacacagcatccaagatctacatgcagatgctcttgtgtcctgatcctgctgtgagcttctcttgtaaacaagctctaattcgagtcctaaggcccaggaacaaacggagacatgtgactttaccctcttcccctcgaagcaacactccaatgggagacaaggatgatgatgacgatgatgatgcagatgagaaaatgcagtcatcagggatcccgaatggtggtcacatccgtcaggaaagccaggaacagagtgaggtggaccatggagattttgagatggtgtctgagtcgatggtcctggagacagctgaaaatgtcaacaatggcaacccctctcccctggaggccctgctggcaggcgcagagggcttcccccccatgctggacatcccacctgatgcagatgacgagaccatggttgaactagccattgccctgagcctgcagcaggaccaacaaggcagcagcagcagtgccctgggcctgcagagcctgggactgtccggccaggcacccagctcttcctctctggacgcaggaaccctctctgacaccacagcatcagctccagcctcagacgacgagggcagtacagcagcgacagatggttctacccttcggacctctcctgctgaccacggtggtagtgtgggctcggagagcgggggcagtgcagtggactcagtggctggcgagcacagtgtatctggccggagcagtgcttatggcgatgctacagctgaggggcatccggctggaccaggaagtgtcagctcaagcactggagccatcagcaccaccactgggcaccaggagggagatggctccgagggagaaggagaaggagaaactgaaggagatgtccacactagcaacaggctgcacatggtccgtctaatgctgttggagagattactgcagaccctgcctcaattacgaaacgttggcggtgtccgggccatcccatacatgcaggtcattctaatgctcactacagatctggatggagaagatgagaaagacaagggggccctagacaacctgctctcccagcttattgctgagttgggtatggataaaaaggatgtctccaagaagaatgagcgcagcgccctgaatgaagtccatctggtagtaatgagactcctgagtgtcttcatgtcccgcaccaaatctggatccaagtcttccatatgtgagtcatcttccctcatctccagtgccacagcagcagctctactgagctctggggctgtggactactgcctgcacgtgctcaaatcactgctggaatattggaagagccaacagaatgacgaggagcctgtggctaccagccagttgctgaaaccacatactacctcctccccacctgacatgagcccattctttctccgccagtatgtgaagggtcatgctgctgatgtgtttgaggcctatactcagcttctaacagaaatggtactgaggcttccttaccaaatcaaaaagattactgacaccaattctcgaatcccacctcctgtctttgaccactcgtggttttactttctctccgagtacctcatgatccagcagactccatttgtgcgccgtcaagtccgcaaacttctgctcttcatctgtggatccaaagagaagtaccgccagctccgggatttgcacaccctggactctcacgtgcgtgggatcaagaagctgctagaagagcaggggatattcctccgggcaagtgtggttacagccagctcaggctccgccttgcaatatgacacactcatcagcctgatggagcacctgaaagcctgtgcagagattgccgcccagcgaaccatcaactggcagaaattctgcatcaaagatgactccgtcctgtacttcctcctccaagtcagtttccttgtggatgagggcgtgtccccagtgctgctgcaactgctctcctgtgctctctgcggcagcaaggtgctcgctgcactggcagcctcttcgggatcctccagtgcttcttcctcctcagcccctgtggctgccagttctggacaagccacaacacagtccaagtcttccactaaaaagagcaagaaagaagaaaaagaaaaggagaaagatggtgagacctctggcagccaggaggaccagctgtgcacagctctggtgaaccagctgaacaaatttgccgataaggaaaccctgatccagttcctgcgttgtttcctgttagagtccaattcttcctcggtgcgctggcaggcccactgtctgacactgcacatctacagaaattccagcaaatctcaacaggagctcctgctagatctgatgtggtccatctggccagaactcccagcctatggtcgtaaggctgcccagtttgtggacctactaggatatttctccctgaaaactccacaaacagagaagaagttgaaggagtattcacagaaggctgtggagattctgcggactcaaaaccatattcttaccaaccaccccaactcgaacatttataacactttgtctggcttagtggagtttgatggctattacctggagagcgatccctgcctggtgtgtaataacccggaagtaccgttctgttatatcaagctgtcttccattaaagtggacacgcggtacaccaccacccagcaggttgtgaagctcattggcagtcacaccatcagcaaagtgacagtgaaaatcggggatctgaaacggaccaagatggtgcggaccatcaacctgtattataacaaccgaaccgtgcaggccatcgtggagttgaaaaacaagccagctcgctggcacaaagccaagaaggttcagctgacccctggacagacagaggtgaagattgacctgccgttgcccattgtggcctccaatctgatgattgagtttgcagacttctatgaaaactaccaggcctccacagagaccctgcagtgccctcgctgtagtgcctcggtccctgccaacccaggagtctgtggcaactgtggagagaatgtgtaccagtgtcacaaatgcagatccatcaactacgatgaaaaggatcccttcctctgcaatgcctgtggcttctgtaaatatgcccgcttcgacttcatgctctatgccaagccttgctgtgcagtggatcccattgagaatgaagaagaccggaagaaggctgtatccaacatcaatacacttttggacaaagctgatcgagtgtatcatcagctgatgggacaccggccacagctggagaacctgctctgcaaagtgaatgaggcagctccagaaaagccacaggatgactcaggaacagcagggggcatcagctccacttctgccagtgtgaatcgttacatcctgcagttggctcaggagtattgtggagactgcaagaactcttttgatgaactctccaaaatcatccagaaagtctttgcttcgcgcaaagagttgttggaatatgacctacagcagagggaagcagccactaaatcatcccggacctccgtgcagcccacattcactgccagccagtaccgtgccttatccgtcctgggctgtggccacacatcctccaccaagtgctatggctgcgcctcggctgtcacagaacattgtatcacactacttcgggccctggccaccaacccagccttgaggcacatccttgtctcccagggccttatccgggagctctttgattataatcttcgccgaggggctgcggccatgcgggaggaggtccgccagctcatgtgcctcctaactcgagacaacccagaagccacccaacagatgaatgacctgattattggcaaggtctccacagccctgaagggccactgggccaaccccgatctggcaagtagcctgcagtatgaaatgctgctgctgacggattctatctccaaggaggacagctgctgggagctccggttacgctgtgctctcagccttttcctcatggctgtgaacattaagactcctgtggtggttgaaaacattaccctcatgtgcctgaggatcttgcagaagctgataaaaccacctgctcccactagcaagaagaacaaggatgtccccgtcgaggccctcaccacggtgaagccatactgcaatgagatccatgcccaggctcaactgtggctcaagagagaccccaaggcatcctatgatgcctggaagaagtgtcttcctatcagagggatagatggcaatgggaaagcccccagcaaatcagagctccgccatctctatttgactgagaagtatgtgtggaggtggaaacagttcctgagtcgtcgggggaagaggacctcccccttggatctcaaactggggcataacaactggctgcgacaagtgcttttcactccagcaacgcaggccgcacggcaggcagcctgtaccattgtggaagctctagccaccattcccagccgcaagcagcaggtcctggacctgcttaccagttacctggatgagctgagcatagctggggagtgtgcagctgagtacctggctctctaccagaagctcatcacttctgcgcactggaaagtctacttggcagctcggggagtcctaccctatgtgggcaacctcatcaccaaggaaatagctcgtctgctggccctggaggaggctaccctgagtaccgatctgcagcagggttatgcccttaaaagtctcacaggccttctctcctcctttgttgaggtggaatccatcaaaagacattttaaaagtcgcttggtgggtactgtgctgaatggatacctgtgcttgcggaagctggtggtgcagaggaccaagctgatcgatgagacgcaggacatgctgctggagatgctggaggacatgaccacaggtacagaatcagaaaccaaggccttcatggctgtgtgcattgagacagccaagcgctacaatctggatgactaccggaccccggtgttcatcttcgagaggctctgcagcatcatttatcctgaggagaatgaagtcactgagttctttgtgaccctggagaaggatccccaacaagaagacttcttacagggcaggatgcctgggaacccgtatagcagcaatgagccaggcatcgggccgctgatgagggatataaagaacaagatttgccaggactgtgacttagtggccctcctggaagatgacagtggcatggagcttctagtgaacaataaaatcattagtttggaccttcctgtggctgaagtttacaagaaagtctggtgtaccacgaatgagggagagcccatgaggattgtttatcgtatgcgggggctgctgggcgatgccacagaggagttcattgagtccctggactctactacagatgaagaagaagatgaagaagaagtgtataaaatggctggtgtgatggcccagtgtgggggcctggaatgcatgcttaacagactcgcagggatcagagatttcaagcagggacgccaccttctaacagtgctactgaaattgttcagttactgcgtgaaggtgaaagtcaaccggcagcaactggtcaaactggaaatgaacaccttgaacgtcatgctggggaccctaaacctgggcaacctcctcctgacaggtgacaaggatcaactggtgatgctcttggaccagatcaacagcacctttgttcgctccaaccccagtgtgctccagggctgcttctgtaaaatagctgctggcatcaagaacaacagcaatgggcaccagctgaaggatctgattctccagaaggggatcacccagaatgcacttgactacatgaaaaagcacatccctagcgccaagaatttggatgccgacatctggaaaaagtttttgtctcgcccagccttgccatttatcctaaggctgcttcggggcctggccatccagcaccctggcacccaggttctgattggaactgattccatcccgaacctgcataagctggagcaggtgtccagtgatgagggcattgggaccttggcagagaacctgctggaagccctgcgggaacaccctgacgtaaacaagaagattgacgcagcccgcagggagacccgggcagagaagaaacgcatggccatggcaatgaggcagaaggccctgggcaccctgggcatgacgacaaatgaaaagggccaggtcgtgaccaagacagcactcctgaagcagatggaagagctgatcgaggagcctggcctcacgtgctgcatctgcagggagggatacaagttccagcccacaaaggtcctgggcatttataccttcacgaagcgggtagccttggaggagttggagaataagccccggaaacagcagggctacagcaccgtgtcccacttcaacattgtgcactacgactgccatctggctgccgtcaggttggctcgaggccgggaagagtgggagagtgccgccctgcagaatgccaacaccaagtgcaacgggctccttccggtctggggacctcatgtccctgaatcagcttttgccacttgcttggcaagacacaacacttacctccaggaatgtacaggccagcgggagcccacgtatcagctcaacatccacgacatcaaactgctcttcctgcgcttcgccatggagcagtcgttcagcgcagacactggcgggggcggccgggagagcaacatccacctgatcccgtacatcattcacactgtgctttacgtcctgaacacaacccgagcaacttcccgagaagagaagaacctccaaggctttctggaacagcccaaggagaagtgggtggagagtgcctttgaagtggacgggccctactatttcacagtcttggcccttcacatcctgccccctgagcagtggagagccacacgtgtggaaatcttgcggaggctgttggtgacctcgcaggctcgggcagtggctccaggtggagccaccaggctgacagataaggcagtgaaggactattccgcttaccgttcttcccttctcttttgggccctcgtcgatctcatttacaacatgtttaagaaggtgcctaccagtaacacagagggaggctggtcctgctctctcgctgagtacatccgccacaacgacatgcccatctacgaagctgccgacaaagccctgaaaaccttccaggaggagttcatgccagtggagaccttctcagagttcctcgatgtggccggtcttttatcagaaatcaccgatccagagagcttcctgaaggacctgttgaactcagtcccctgaccaccacacagcagctgcggcggcgaagacgaagctggcttgccttccaccctctgttctccctccttgtgcattaagttccctccgcgggatgctgcattgttaccccgccctcccctctctcatttttcttggtgtggcttggggtttttaggcttcctgttttatctcgtgtgtgtggtgcaccagctatgaggttgtctgtaacccaagccatcaaagggcctgtacatacctaggagccatgagttgtcccggccagcttcatacttgagtgtgcacatcttgagaaataaacaagtgacttaacacacattgaaaa

SEQ ID NO: 356698 - DNA, 12636 bp, Homo sapiens
gtgacctagaggttccgccacaagcgcgatctcaaaggtccaggtctctttggatgagcatttttctaagatggctgctgagactgatcctcataagtcgtctgagattaccaagaacctacttccagccacgctgcaactcattgacacctatgcatcgttcaccagagcctatttgctgcaaaactttaatgaagagggaacaactgagaaaccttccaaggagaaactgcaaggctttgctgctgttttggctattggctctagcaggtgcaaggcaaatactctgggtccgacactggttcagaatttgccatcgtcagtgcagactgtgtgtgagtcctggaacaacatcaataccaatgaatttcccaatattggatcctggcgcaatgcctttgccaatgacaccatcccttcagagagttatattagtgcagtgcaggctgcacacctggggactctctgtagccaaagtctgcccctggctgcttccctgaagcataccctcctctcactggtcaggttgactggagatcttattgtttggtcagatgagatgaacccaccacaggtaattcggacactgctacctcttcttttggaatcaagcactgagagtgttgccgagatcagtagcaactccctggaacgcatcttgggccctgctgagtctgatgagttcttggctcgtgtttatgagaagctgatcactggttgttacaacattctggccaatcatgcagatcctaacagtggactggatgaatccatcctggaggaatgtctccagtacttggaaaagcagctggaaagtagccaggctcgtaaagctatggaggagtttttctctgacagtggagaacttgtacagatcatgatggcaacagccaatgagaacctctctgctaaattctgtaaccgagttttgaaattcttcaccaaactcttccagctgactgagaagagccctaacccgagcctgttgcatctctgtggctccctggcacaactggcctgtgtggaacctgtgcgcctgcaggcctggctcacccgcatgactacatcgcccccaaaagattctgatcagctggatgtaattcaggagaaccggcagctgctgcagttactgaccacatacattgttcgggaaaacagccaagttggggaaggtgtgtgtgctgttcttctgggcaccctgactcccatggcaacagagatgctggccaacggtgatgggactggcttccctgaacttatggttgtgatggccactctggccagtgcaggtcaaggtgctggtcaccttcagcttcataatgctgctgtggattggctgagcagatgcaagaaatacctgtcacagaagaatgtagttgaaaaactgaatgccaatgtaatgcatggaaagcatgtgatgatcttggagtgcacatgccatatcatgtcttacttggctgatgtcacgaatgccctgagccagagtaatggtcaaggcccaagtcatctctcagtggatggggaagagcgggccattgaagtagactcagactgggtggaggagttggcggtggaagaggaagattcccaggctgaggattcagatgaagattctctttgcaataaactctgcacttttacgatcacacagaaagaattcatgaaccagcattggtaccactgtcacacctgtaaaatggtggatggcgtgggtgtctgcacagtgtgtgctaaggtgtgccacaaggatcatgagatttcctatgccaagtatggatccttcttctgtgactgtggagccaaggaagatggcagctgtttggctctggtgaagagaactcctagcagtggcatgagctctaccatgaaggagtcggcatttcagagtgaacccaggatttcagagagtctagtgcgtcatgccagcacctcctcgccagctgacaaagccaaggttaccatcagtgatggaaaggttgctgacgaagagaagcccaagaagagcagcctctgccgcacagtagagggctgccgggaggaattacagaaccaggccaatttctccttcgctcctctcgtgttagacatgcttaatttccttatggatgccattcagaccaacttccagcaagcttcagccgtcgggagcagcagccgtgctcagcaagccctcagtgagctacacactgtggagaaggcagtggagatgacagaccagctgatggttcccaccttagggtcccaggaaggtgcctttgagaatgtgcggatgaattacagtggagaccagggccagaccatccggcagctgatcagtgctcatgtgctcaggcgggtggctatgtgtgtgctctcctctccccatgggcgccgccaacatttggctgtcagccatgagaagggcaagatcaccgttctgcagctctctgcactcctgaagcaagcagattccagcaaaaggaagttaactctgacccgcttggcttctgccccagttccttttactgtgttgagcctcacaggaaatccctgcaaggaagactacttggcggtttgtgggctaaaggactgtcatgtgctcacctttagtagctcaggctctgtttcggatcacttggttttgcaccctcagttggcaacggggaacttcatcatcaaagccgtgtggttacctggttcacagaccgagttagcaattgtcaccgcagactttgttaagatttatgacctgtgtgttgatgccttgagtccaaccttctattttctcctgccaagctcaaagataagagatgttaccttccttttcaatgaggagggaaagaacatcattgttataatgtcttcggctgggtacatctatactcagcttatggaagaggccagcagtgcccagcagggacccttctatgtcactaatgtgttggaaatcaatcatgaggacctgaaggacagtaacagccaggtggcgggcggtggtgtgtccgtgtactactcccacgtgttgcagatgttgttcttcagctattgtcaaggcaaatcattcgcagccaccatcagcaggacaaccctggaggtgttgcaactcttccccatcaacatcaaaagttccaatggtggcagtaagacttctcctgctctttgccagtggtctgaggtgatgaaccaccctggcttggtgtgctgtgtccagcaaactacaggggtgccgctggtagttatggtgaaaccagacacttttcttatccaggagattaagactcttcctgctaaagcgaagatccaagacatggttgctattaggcacacggcctgcaatgagcagcagcggacaacaatgattctgctgtgtgaggatggcagcctgcgcatttacatggccaacgtggagaacacctcctactggctgcagccatccctgcagcccagcagtgtcatcagcatcatgaagcctgttcgaaagcgcaaaacagctacaatcacaacccgcacgtctagccaggtgactttccccattgacttttttgaacacaaccagcagctgacagatgtggagtttggtggtaacgacctcctacaggtctataatgcacaacagataaaacaccggctgaattccactggcatgtatgtggccaacaccaagcccggaggcttcaccattgagattagtaacaacaatagcactatggtgatgacaggcatgcggatccagattgggactcaagcaatagaacgggccccgtcatatatcgagatcttcggcagaactatgcagctcaacctgagtcgctcacgctggtttgacttccccttcaccagagaagaagccctgcaggctgataagaagctgaacctcttcattggggcctcggtggatccagcaggtgtcaccatgatagatgctgtaaaaatttatggcaagactaaggagcagtttggctggcctgatgagcccccagaagaattcccttctgcctctgtcagcaacatctgcccttcaaatctgaaccagagcaacggcactggagatagcgactcagctgcccccactacgaccagtggaactgtcctggagaggctggttgtgagttctttagaagccctggaaagctgctttgccgttggcccaatcatcgagaaggagagaaacaagaatgctgctcaggagctggccactttgctgttgtccctgccagcacctgccagtgtccagcagcagtccaagagccttctggccagcctgcacaccagccgctcggcctaccacagccacaaggatcaggccttgctgagcaaagctgtgcagtgtctcaacacatctagcaaagagggcaaggatttggaccctgaggtgttccagaggctagtgatcacagctcgctccattgccatcatgcgccccaacaaccttgtccactttacggagtcaaagctgccccagatggaaacagactgtttttttcctagatgtgcctgctggagtctagggatagttggcatattgattggggccccacttgaaactccctccccaggcaagcttccttgacctgagttaaccttaaaacaaattaaattccatctcagatttaccatcgttgataattttctttctcctgcttagaaggaatggatgaagggaaggaaccgcagaagcagttggaaggagattgctgtagtttcatcacccagcttgtgaaccacttctggaaactccatgcatccaaacccaagaatgccttcttggcacctgcctgccttccaggactaactcatattgaagctactgtcaatgctctggtggacatcatccatggctactgtacctgtgagctggattgtattaacacagcatccaagatctacatgcagatgctcttgtgtcctgatcctgctgtgagcttctcttgtaaacaagctctaattcgagtcctaaggcccaggaacaaacggagacatgtgactttaccctcttcccctcgaagcaacactccaatgggagacaaggatgatgatgacgatgatgatgcagatgagaaaatgcagtcatcagggatcccgaatggtggtcacatccgtcaggaaagccaggaacagagtgaggtggaccatggagattttgagatggtgtctgagtcgatggtcctggagacagctgaaaatgtcaacaatggcaacccctctcccctggaggccctgctggcaggcgcagagggcttcccccccatgctggacatcccacctgatgcagatgacgagaccatggttgaactagccattgccctgagcctgcagcaggaccaacaaggcagcagcagcagtgccctgggcctgcagagcctgggactgtccggccaggcacccagctcttcctctctggacgcaggaaccctctctgacaccacagcatcagctccagcctcagacgacgagggcagtacagcagcgacagatggttctacccttcggacctctcctgctgaccacggtggtagtgtgggctcggagagcgggggcagtgcagtggactcagtggctggcgagcacagtgtatctggccggagcagtgcttatggcgatgctacagctgaggggcatccggctggaccaggaagtgtcagctcaagcactggagccatcagcaccaccactgggcaccaggagggagatggctccgagggagaaggagaaggagaaactgaaggagatgtccacactagcaacaggctgcacatggtccgtctaatgctgttggagagattactgcagaccctgcctcaattacgaaacgttggcggtgtccgggccatcccatacatgcaggtcattctaatgctcactacagatctggatggagaagatgagaaagacaagggggccctagacaacctgctctcccagcttattgctgagttgggtatggataaaaaggatgtctccaagaagaatgagcgcagcgccctgaatgaagtccatctggtagtaatgagactcctgagtgtcttcatgtcccgcaccaaatctggatccaagtcttccatatgtgagtcatcttccctcatctccagtgccacagcagcagctctactgagctctggggctgtggactactgcctgcacgtgctcaaatcactgctggaatattggaagagccaacagaatgacgaggagcctgtggctaccagccagttgctgaaaccacatactacctcctccccacctgacatgagcccattctttctccgccagtatgtgaagggtcatgctgctgatgtgtttgaggcctatactcagcttctaacagaaatggtactgaggcttccttaccaaatcaaaaagattactgacaccaattctcgaatcccacctcctgtctttgaccactcgtggttttactttctctccgagtacctcatgatccagcagactccatttgtgcgccgtcaagtccgcaaacttctgctcttcatctgtggatccaaagagaagtaccgccagctccgggatttgcacaccctggactctcacgtgcgtgggatcaagaagctgctagaagagcaggggatattcctccgggcaagtgtggttacagccagctcaggctccgccttgcaatatgacacactcatcagcctgatggagcacctgaaagcctgtgcagagattgccgcccagcgaaccatcaactggcagaaattctgcatcaaagatgactccgtcctgtacttcctcctccaagtcagtttccttgtggatgagggcgtgtccccagtgctgctgcaactgctctcctgtgctctctgcggcagcaaggtgctcgctgcactggcagcctcttcgggatcctccagtgcttcttcctcctcagcccctgtggctgccagttctggacaagccacaacacagtccaagtcttccactaaaaagagcaagaaagaagaaaaagaaaaggagaaagatggtgagacctctggcagccaggaggaccagctgtgcacagctctggtgaaccagctgaacaaatttgccgataaggaaaccctgatccagttcctgcgttgtttcctgttagagtccaattcttcctcggtgcgctggcaggcccactgtctgacactgcacatctacagaaattccagcaaatctcaacaggagctcctgctagatctgatgtggtccatctggccagaactcccagcctatggtcgtaaggctgcccagtttgtggacctactaggatatttctccctgaaaactccacaaacagagaagaagttgaaggagtattcacagaaggctgtggagattctgcggactcaaaaccatattcttaccaaccaccccaactcgaacatttataacactttgtctggcttagtggagtttgatggctattacctggagagcgatccctgcctggtgtgtaataacccggaagtaccgttctgttatatcaagctgtcttccattaaagtggacacgcggtacaccaccacccagcaggttgtgaagctcattggcagtcacaccatcagcaaagtgacagtgaaaatcggggatctgaaacggaccaagatggtgcggaccatcaacctgtattataacaaccgaaccgtgcaggccatcgtggagttgaaaaacaagccagctcgctggcacaaagccaagaaggttcagctgacccctggacagacagaggtgaagattgacctgccgttgcccattgtggcctccaatctgatgattgagtttgcagacttctatgaaaactaccaggcctccacagagaccctgcagtgccctcgctgtagtgcctcggtccctgccaacccaggagtctgtggcaactgtggagagaatgtgtaccagtgtcacaaatgcagatccatcaactacgatgaaaaggatcccttcctctgcaatgcctgtggcttctgtaaatatgcccgcttcgacttcatgctctatgccaagccttgctgtgcagtggatcccattgagaatgaagaagaccggaagaaggctgtatccaacatcaatacacttttggacaaagctgatcgagtgtatcatcagctgatgggacaccggccacagctggagaacctgctctgcaaagtgaatgaggcagctccagaaaagccacaggatgactcaggaacagcagggggcatcagctccacttctgccagtgtgaatcgttacatcctgcagttggctcaggagtattgtggagactgcaagaactcttttgatgaactctccaaaatcatccagaaagtctttgcttcgcgcaaagagttgttggaatatgacctacagcagagggaagcagccactaaatcatcccggacctccgtgcagcccacattcactgccagccagtaccgtgccttatccgtcctgggctgtggccacacatcctccaccaagtgctatggctgcgcctcggctgtcacagaacattgtatcacactacttcgggccctggccaccaacccagccttgaggcacatccttgtctcccagggccttatccgggagctctttgattataatcttcgccgaggggctgcggccatgcgggaggaggtccgccagctcatgtgcctcctaactcgagacaacccagaagccacccaacagatgaatgacctgattattggcaaggtctccacagccctgaagggccactgggccaaccccgatctggcaagtagcctgcagtatgaaatgctgctgctgacggattctatctccaaggaggacagctgctgggagctccggttacgctgtgctctcagccttttcctcatggctgtgaacattaagactcctgtggtggttgaaaacattaccctcatgtgcctgaggatcttgcagaagctgataaaaccacctgctcccactagcaagaagaacaaggatgtccccgtcgaggccctcaccacggtgaagccatactgcaatgagatccatgcccaggctcaactgtggctcaagagagaccccaaggcatcctatgatgcctggaagaagtgtcttcctatcagagggatagatggcaatgggaaagcccccagcaaatcagagctccgccatctctatttgactgagaagtatgtgtggaggtggaaacagttcctgagtcgtcgggggaagaggacctcccccttggatctcaaactggggcataacaactggctgcgacaagtgcttttcactccagcaacgcaggccgcacggcaggcagcctgtaccattgtggaagctctagccaccattcccagccgcaagcagcaggtcctggacctgcttaccagttacctggatgagctgagcatagctggggagtgtgcagctgagtacctggctctctaccagaagctcatcacttctgcgcactggaaagtctacttggcagctcggggagtcctaccctatgtgggcaacctcatcaccaaggaaatagctcgtctgctggccctggaggaggctaccctgagtaccgatctgcagcagggttatgcccttaaaagtctcacaggccttctctcctcctttgttgaggtggaatccatcaaaagacattttaaaagtcgcttggtgggtactgtgctgaatggatacctgtgcttgcggaagctggtggtgcagaggaccaagctgatcgatgagacgcaggacatgctgctggagatgctggaggacatgaccacaggtacagaatcagaaaccaaggccttcatggctgtgtgcattgagacagccaagcgctacaatctggatgactaccggaccccggtgttcatcttcgagaggctctgcagcatcatttatcctgaggagaatgaagtcactgagttctttgtgaccctggagaaggatccccaacaagaagacttcttacagggcaggatgcctgggaacccgtatagcagcaatgagccaggcatcgggccgctgatgagggatataaagaacaagatttgccaggactgtgacttagtggccctcctggaagatgacagtggcatggagcttctagtgaacaataaaatcattagtttggaccttcctgtggctgaagtttacaagaaagtctggtgtaccacgaatgagggagagcccatgaggattgtttatcgtatgcgggggctgctgggcgatgccacagaggagttcattgagtccctggactctactacagatgaagaagaagatgaagaagaagtgtataaaatggctggtgtgatggcccagtgtgggggcctggaatgcatgcttaacagactcgcagggatcagagatttcaagcagggacgccaccttctaacagtgctactgaaattgttcagttactgcgtgaaggtgaaagtcaaccggcagcaactggtcaaactggaaatgaacaccttgaacgtcatgctggggaccctaaacctggcccttgtagctgaacaagaaagcaaggacagtgggggtgcagctgtggctgagcaggtgcttagcatcatggagatcattctagatgagtccaatgctgagcccctgagtgaggacaagggcaacctcctcctgacaggtgacaaggatcaactggtgatgctcttggaccagatcaacagcacctttgttcgctccaaccccagtgtgctccagggcctgcttcgcatcatcccgtacctttcctttggagaggtggagaaaatgcagatcttggtggagcgattcaaaccatactgcaactttgataaatatgatgaagatcacagtggtgatgataaagtcttcctggactgcttctgtaaaatagctgctggcatcaagaacaacagcaatgggcaccagctgaaggatctgattctccagaaggggatcacccagaatgcacttgactacatgaaaaagcacatccctagcgccaagaatttggatgccgacatctggaaaaagtttttgtctcgcccagccttgccatttatcctaaggctgcttcggggcctggccatccagcaccctggcacccaggttctgattggaactgattccatcccgaacctgcataagctggagcaggtgtccagtgatgagggcattgggaccttggcagagaacctgctggaagccctgcgggaacaccctgacgtaaacaagaagattgacgcagcccgcagggagacccgggcagagaagaaacgcatggccatggcaatgaggcagaaggccctgggcaccctgggcatgacgtgatcgaggagcctggcctcacgtgctgcatctgcagggagggatacaagttccagcccacaaaggtcctgggcatttataccttcacgaagcgggtagccttggaggagttggagaataagccccggaaacagcagggctacagcaccgtgtcccacttcaacattgtgcactacgactgccatctggctgccgtcaggttggctcgaggccgggaagagtgggagagtgccgccctgcagaatgccaacaccaagtgcaacgggctccttccggtctggggacctcatgtccctgaatcagcttttgccacttgcttggcaagacacaacacttacctccaggaatgtacaggccagcgggagcccacgtatcagctcaacatccacgacatcaaactgctcttcctgcgcttcgccatggagcagtcgttcagcgcagacactggcgggggcggccgggagagcaacatccacctgatcccgtacatcattcacactgtgctttacgtcctgaacacaacccgagcaacttcccgagaagagaagaacctccaaggctttctggaacagcccaaggagaagtgggtggagagtgcctttgaagtggacgggccctactatttcacagtcttggcccttcacatcctgccccctgagcagtggagagccacacgtgtggaaatcttgcggaggctgttggtgacctcgcaggctcgggcagtggctccaggtggagccaccaggctgacagataaggcagtgaaggactattccgcttaccgttcttcccttctcttttgggccctcgtcgatctcatttacaacatgtttaagaaggtgcctaccagtaacacagagggaggctggtcctgctctctcgctgagtacatccgccacaacgacatgcccatctacgaagctgccgacaaagccctgaaaaccttccaggaggagttcatgccagtggagaccttctcagagttcctcgatgtggccggtcttttatcagaaatcaccgatccagagagcttcctgaaggacctgttgaactcagtcccctgaccaccacacagcagctgcggcggcgaagacgaagctggcttgccttccaccctctgttctccctccttgtgcattaagttccctccgcgggatgctgcattgttaccccgccctcccctctctcatttttcttggtgtggcttggggtttttaggcttcctgttttatctcgtgtgtgtggtgcaccagctatgaggttgtctgtaacccaagccatcaaagggcctgtacatacctaggagccatgagttgtcccggccagcttcatacttgagtgtgcacatcttgagaaataaacaagtgacttaacacacattgaaaa

SEQ ID NO: 356699 - DNA, 2668 bp, Homo sapiens
cgccgacttctccgcaacaagttccctcaatcaaggccatgttgtccatcgatgtagccgaatgaagggcgctggtggcctcccgtacaaacatcggacaacacggagcagggagagctcaccatggaatcaacccccctgctcgctgctcacgtaccttcatcacttttagtgatgatgcaactttcgaggaatggttcccccaagggcggcccccaaaagtccctgttcgtgaggtctgtccagtgacccatcgtccagccctataccgggaccctgttacagacataccctatgccactgctcgagccttcaagatcattcgtgaggcttacaagaagtacattactgcccatggactgccgcccactgcctcagccaacaagcgcctggaggcgcttgctggggaccctaaacctggcccttgtagctgaacaagaaagcaaggacagtgggggtgcagctgtggctgagcaggtgcttagcatcatggagatcattctagatgagtccaatgctgagcccctgagtgaggacaagggcaacctcctcctgacaggtgacaaggatcaactggtgatgctcttggaccagatcaacagcacctttgttcgctccaaccccagtgtgctccagggcctgcttcgcatcatcccgtacctttcctttggagaggtggagaaaatgcagatcttggtggagcgattcaaaccatactgcaactttgataaatatgatgaagatcacagtggtgatgataaagtcttcctggactgcttctgtaaaatagctgctggcatcaagaacaacagcaatgggcaccagctgaaggatctgattctccagaaggggatcacccagaatgcacttgactacatgaaaaagcacatccctagcgccaagaatttggatgccgacatctggaaaaagtttttgtctcgcccagccttgccatttatcctaaggctgcttcggggcctggccatccagcaccctggcacccaggttctgattggaactgattccatcccgaacctgcataagctggagcaggtgtccagtgatgagggcattgggaccttggcagagaacctgctggaagccctgcgggaacaccctgacgtaaacaagaagattgacgcagcccgcagggagacccgggcagagaagaaacgcatggccatggcaatgaggcagaaggccctgggcaccctgggcatgacgacaaatgaaaagggccaggtcgtgaccaagacagcactcctgaagcagatggaagagctgatcgaggagcctggcctcacgtgctgcatctgcagggagggatacaagttccagcccacaaaggtcctgggcatttataccttcacgaagcgggtagccttggaggagttggagaataagccccggaaacagcagggctacagcaccgtgtcccacttcaacattgtgcactacgactgccatctggctgccgtcaggttggctcgaggccgggaagagtgggagagtgccgccctgcagaatgccaacaccaagtgcaacgggctccttccggtctggggacctcatgtccctgaatcagcttttgccacttgcttggcaagacacaacacttacctccaggaatgtacaggccagcgggagcccacgtatcagctcaacatccacgacatcaaactgctcttcctgcgcttcgccatggagcagtcgttcagcgcagacactggcgggggcggccgggagagcaacatccacctgatcccgtacatcattcacactgtgctttacgtcctgaacacaacccgagcaacttcccgagaagagaagaacctccaaggctttctggaacagcccaaggagaagtgggtggagagtgcctttgaagtggacgggccctactatttcacagtcttggcccttcacatcctgccccctgagcagtggagagccacacgtgtggaaatcttgcggaggctgttggtgacctcgcaggctcgggcagtggctccaggtggagccaccaggctgacagataaggcagtgaaggactattccgcttaccgttcttcccttctcttttgggccctcgtcgatctcatttacaacatgtttaagaaggtgcctaccagtaacacagagggaggctggtcctgctctctcgctgagtacatccgccacaacgacatgcccatctacgaagctgccgacaaagccctgaaaaccttccaggaggagttcatgccagtggagaccttctcagagttcctcgatgtggccggtcttttatcagaaatcaccgatccagagagcttcctgaaggacctgttgaactcagtcccctgaccaccacacagcagctgcggcggcgaagacgaagctggcttgccttccaccctctgttctccctccttgtgcattaagttccctccgcgggatgctgcattgttaccccgccctcccctctctcatttttcttggtgtggcttggggtttttaggcttcctgttttatctcgtgtgtgtggtgcaccagctatgaggttgtctgtaacccaagccatcaaagggcctgtacatacctaggagccatgagttgtcccggccagcttcatacttgagtgtgcacatcttgagaaataaacaagtgacttaacacacattgaaaa

SEQ ID NO: 356700 - DNA, 12731 bp, Homo sapiens
gtgacctagaggttccgccacaagcgcgatctcaaaggtccaggtctctttggatgagcatttttctaagatggctgctgagactgatcctcataagtcgtctgagattaccaagaacctacttccagccacgctgcaactcattgacacctatgcatcgttcaccagagcctatttgctgcaaaactttaatgaagagggaacaactgagaaaccttccaaggagaaactgcaaggctttgctgctgttttggctattggctctagcaggtgcaaggcaaatactctgggtccgacactggttcagaatttgccatcgtcagtgcagactgtgtgtgagtcctggaacaacatcaataccaatgaatttcccaatattggatcctggcgcaatgcctttgccaatgacaccatcccttcagagagttatattagtgcagtgcaggctgcacacctggggactctctgtagccaaagtctgcccctggctgcttccctgaagcataccctcctctcactggtcaggttgactggagatcttattgtttggtcagatgagatgaacccaccacaggtaattcggacactgctacctcttcttttggaatcaagcactgagagtgttgccgagatcagtagcaactccctggaacgcatcttgggccctgctgagtctgatgagttcttggctcgtgtttatgagaagctgatcactggttgttacaacattctggccaatcatgcagatcctaacagtggactggatgaatccatcctggaggaatgtctccagtacttggaaaagcagctggaaagtagccaggctcgtaaagctatggaggagtttttctctgacagtggagaacttgtacagatcatgatggcaacagccaatgagaacctctctgctaaattctgtaaccgagttttgaaattcttcaccaaactcttccagctgactgagaagagccctaacccgagcctgttgcatctctgtggctccctggcacaactggcctgtgtggaacctgtgcgcctgcaggcctggctcacccgcatgactacatcgcccccaaaagattctgatcagctggatgtaattcaggagaaccggcagctgctgcagttactgaccacatacattgttcgggaaaacagccaagttggggaaggtgtgtgtgctgttcttctgggcaccctgactcccatggcaacagagatgctggccaacggtgatgggactggcttccctgaacttatggttgtgatggccactctggccagtgcaggtcaaggtgctggtcaccttcagcttcataatgctgctgtggattggctgagcagatgcaagaaatacctgtcacagaagaatgtagttgaaaaactgaatgccaatgtaatgcatggaaagcatgtgatgatcttggagtgcacatgccatatcatgtcttacttggctgatgtcacgaatgccctgagccagagtaatggtcaaggcccaagtcatctctcagtggatggggaagagcgggccattgaagtagactcagactgggtggaggagttggcggtggaagaggaagattcccaggctgaggattcagatgaagattctctttgcaataaactctgcacttttacgatcacacagaaagaattcatgaaccagcattggtaccactgtcacacctgtaaaatggtggatggcgtgggtgtctgcacagtgtgtgctaaggtgtgccacaaggatcatgagatttcctatgccaagtatggatccttcttctgtgactgtggagccaaggaagatggcagctgtttggctctggtgaagagaactcctagcagtggcatgagctctaccatgaaggagtcggcatttcagagtgaacccaggatttcagagagtctagtgcgtcatgccagcacctcctcgccagctgacaaagccaaggttaccatcagtgatggaaaggttgctgacgaagagaagcccaagaagagcagcctctgccgcacagtagagggctgccgggaggaattacagaaccaggccaatttctccttcgctcctctcgtgttagacatgcttaatttccttatggatgccattcagaccaacttccagcaagcttcagccgtcgggagcagcagccgtgctcagcaagccctcagtgagctacacactgtggagaaggcagtggagatgacagaccagctgatggttcccaccttagggtcccaggaaggtgcctttgagaatgtgcggatgaattacagtggagaccagggccagaccatccggcagctgatcagtgctcatgtgctcaggcgggtggctatgtgtgtgctctcctctccccatgggcgccgccaacatttggctgtcagccatgagaagggcaagatcaccgttctgcagctctctgcactcctgaagcaagcagattccagcaaaaggaagttaactctgacccgcttggcttctgccccagttccttttactgtgttgagcctcacaggaaatccctgcaaggaagactacttggcggtttgtgggctaaaggactgtcatgtgctcacctttagtagctcaggctctgtttcggatcacttggttttgcaccctcagttggcaacggggaacttcatcatcaaagccgtgtggttacctggttcacagaccgagttagcaattgtcaccgcagactttgttaagatttatgacctgtgtgttgatgccttgagtccaaccttctattttctcctgccaagctcaaagataagagatgttaccttccttttcaatgaggagggaaagaacatcattgttataatgtcttcggctgggtacatctatactcagcttatggaagaggccagcagtgcccagcagggacccttctatgtcactaatgtgttggaaatcaatcatgaggacctgaaggacagtaacagccaggtggcgggcggtggtgtgtccgtgtactactcccacgtgttgcagatgttgttcttcagctattgtcaaggcaaatcattcgcagccaccatcagcaggacaaccctggaggtgttgcaactcttccccatcaacatcaaaagttccaatggtggcagtaagacttctcctgctctttgccagtggtctgaggtgatgaaccaccctggcttggtgtgctgtgtccagcaaactacaggggtgccgctggtagttatggtgaaaccagacacttttcttatccaggagattaagactcttcctgctaaagcgaagatccaagacatggttgctattaggcacacggcctgcaatgagcagcagcggacaacaatgattctgctgtgtgaggatggcagcctgcgcatttacatggccaacgtggagaacacctcctactggctgcagccatccctgcagcccagcagtgtcatcagcatcatgaagcctgttcgaaagcgcaaaacagctacaatcacaacccgcacgtctagccaggtgactttccccattgacttttttgaacacaaccagcagctgacagatgtggagtttggtggtaacgacctcctacaggtctataatgcacaacagataaaacaccggctgaattccactggcatgtatgtggccaacaccaagcccggaggcttcaccattgagattagtaacaacaatagcactatggtgatgacaggcatgcggatccagattgggactcaagcaatagaacgggccccgtcatatatcgagatcttcggcagaactatgcagctcaacctgagtcgctcacgctggtttgacttccccttcaccagagaagaagccctgcaggctgataagaagctgaacctcttcattggggcctcggtggatccagcaggtgtcaccatgatagatgctgtaaaaatttatggcaagactaaggagcagtttggctggcctgatgagcccccagaagaattcccttctgcctctgtcagcaacatctgcccttcaaatctgaaccagagcaacggcactggagatagcgactcagctgcccccactacgaccagtggaactgtcctggagaggctggttgtgagttctttagaagccctggaaagctgctttgccgttggcccaatcatcgagaaggagagaaacaagaatgctgctcaggagctggccactttgctgttgtccctgccagcacctgccagtgtccagcagcagtccaagagccttctggccagcctgcacaccagccgctcggcctaccacagccacaaggatcaggccttgctgagcaaagctgtgcagtgtctcaacacatctagcaaagagggcaaggatttggaccctgaggtgttccagaggctagtgatcacagctcgctccattgccatcatgcgccccaacaaccttgtccactttacggagtcaaagctgccccagatggaaacagactgtttttttcctagatgtgcctgctggagtctagggatagttggcatattgattggggccccacttgaaactccctccccaggcaagcttccttgacctgagttaaccttaaaacaaattaaattccatctcagatttaccatcgttgataattttctttctcctgcttagaaggaatggatgaagggaaggaaccgcagaagcagttggaaggagattgctgtagtttcatcacccagcttgtgaaccacttctggaaactccatgcatccaaacccaagaatgccttcttggcacctgcctgccttccaggactaactcatattgaagctactgtcaatgctctggtggacatcatccatggctactgtacctgtgagctggattgtattaacacagcatccaagatctacatgcagatgctcttgtgtcctgatcctgctgtgagcttctcttgtaaacaagctctaattcgagtcctaaggcccaggaacaaacggagacatgtgactttaccctcttcccctcgaagcaacactccaatgggagacaaggatgatgatgacgatgatgatgcagatgagaaaatgcagtcatcagggatcccgaatggtggtcacatccgtcaggaaagccaggaacagagtgaggtggaccatggagattttgagatggtgtctgagtcgatggtcctggagacagctgaaaatgtcaacaatggcaacccctctcccctggaggccctgctggcaggcgcagagggcttcccccccatgctggacatcccacctgatgcagatgacgagaccatggttgaactagccattgccctgagcctgcagcaggaccaacaaggcagcagcagcagtgccctgggcctgcagagcctgggactgtccggccaggcacccagctcttcctctctggacgcaggaaccctctctgacaccacagcatcagctccagcctcagacgacgagggcagtacagcagcgacagatggttctacccttcggacctctcctgctgaccacggtggtagtgtgggctcggagagcgggggcagtgcagtggactcagtggctggcgagcacagtgtatctggccggagcagtgcttatggcgatgctacagctgaggggcatccggctggaccaggaagtgtcagctcaagcactggagccatcagcaccaccactgggcaccaggagggagatggctccgagggagaaggagaaggagaaactgaaggagatgtccacactagcaacaggctgcacatggtccgtctaatgctgttggagagattactgcagaccctgcctcaattacgaaacgttggcggtgtccgggccatcccatacatgcaggtcattctaatgctcactacagatctggatggagaagatgagaaagacaagggggccctagacaacctgctctcccagcttattgctgagttgggtatggataaaaaggatgtctccaagaagaatgagcgcagcgccctgaatgaagtccatctggtagtaatgagactcctgagtgtcttcatgtcccgcaccaaatctggatccaagtcttccatatgtgagtcatcttccctcatctccagtgccacagcagcagctctactgagctctggggctgtggactactgcctgcacgtgctcaaatcactgctggaatattggaagagccaacagaatgacgaggagcctgtggctaccagccagttgctgaaaccacatactacctcctccccacctgacatgagcccattctttctccgccagtatgtgaagggtcatgctgctgatgtgtttgaggcctatactcagcttctaacagaaatggtactgaggcttccttaccaaatcaaaaagattactgacaccaattctcgaatcccacctcctgtctttgaccactcgtggttttactttctctccgagtacctcatgatccagcagactccatttgtgcgccgtcaagtccgcaaacttctgctcttcatctgtggatccaaagagaagtaccgccagctccgggatttgcacaccctggactctcacgtgcgtgggatcaagaagctgctagaagagcaggggatattcctccgggcaagtgtggttacagccagctcaggctccgccttgcaatatgacacactcatcagcctgatggagcacctgaaagcctgtgcagagattgccgcccagcgaaccatcaactggcagaaattctgcatcaaagatgactccgtcctgtacttcctcctccaagtcagtttccttgtggatgagggcgtgtccccagtgctgctgcaactgctctcctgtgctctctgcggcagcaaggtgctcgctgcactggcagcctcttcgggatcctccagtgcttcttcctcctcagcccctgtggctgccagttctggacaagccacaacacagtccaagtcttccactaaaaagagcaagaaagaagaaaaagaaaaggagaaagatggtgagacctctggcagccaggaggaccagctgtgcacagctctggtgaaccagctgaacaaatttgccgataaggaaaccctgatccagttcctgcgttgtttcctgttagagtccaattcttcctcggtgcgctggcaggcccactgtctgacactgcacatctacagaaattccagcaaatctcaacaggagctcctgctagatctgatgtggtccatctggccagaactcccagcctatggtcgtaaggctgcccagtttgtggacctactaggatatttctccctgaaaactccacaaacagagaagaagttgaaggagtattcacagaaggctgtggagattctgcggactcaaaaccatattcttaccaaccaccccaactcgaacatttataacactttgtctggcttagtggagtttgatggctattacctggagagcgatccctgcctggtgtgtaataacccggaagtaccgttctgttatatcaagctgtcttccattaaagtggacacgcggtacaccaccacccagcaggttgtgaagctcattggcagtcacaccatcagcaaagtgacagtgaaaatcggggatctgaaacggaccaagatggtgcggaccatcaacctgtattataacaaccgaaccgtgcaggccatcgtggagttgaaaaacaagccagctcgctggcacaaagccaagaaggttcagctgacccctggacagacagaggtgaagattgacctgccgttgcccattgtggcctccaatctgatgattgagtttgcagacttctatgaaaactaccaggcctccacagagaccctgcagtgccctcgctgtagtgcctcggtccctgccaacccaggagtctgtggcaactgtggagagaatgtgtaccagtgtcacaaatgcagatccatcaactacgatgaaaaggatcccttcctctgcaatgcctgtggcttctgtaaatatgcccgcttcgacttcatgctctatgccaagccttgctgtgcagtggatcccattgagaatgaagaagaccggaagaaggctgtatccaacatcaatacacttttggacaaagctgatcgagtgtatcatcagctgatgggacaccggccacagctggagaacctgctctgcaaagtgaatgaggcagctccagaaaagccacaggatgactcaggaacagcagggggcatcagctccacttctgccagtgtgaatcgttacatcctgcagttggctcaggagtattgtggagactgcaagaactcttttgatgaactctccaaaatcatccagaaagtctttgcttcgcgcaaagagttgttggaatatgacctacagcagagggaagcagccactaaatcatcccggacctccgtgcagcccacattcactgccagccagtaccgtgccttatccgtcctgggctgtggccacacatcctccaccaagtgctatggctgcgcctcggctgtcacagaacattgtatcacactacttcgggccctggccaccaacccagccttgaggcacatccttgtctcccagggccttatccgggagctctttgattataatcttcgccgaggggctgcggccatgcgggaggaggtccgccagctcatgtgcctcctaactcgagacaacccagaagccacccaacagatgaatgacctgattattggcaaggtctccacagccctgaagggccactgggccaaccccgatctggcaagtagcctgcagtatgaaatgctgctgctgacggattctatctccaaggaggacagctgctgggagctccggttacgctgtgctctcagccttttcctcatggctgtgaacattaagactcctgtggtggttgaaaacattaccctcatgtgcctgaggatcttgcagaagctgataaaaccacctgctcccactagcaagaagaacaaggatgtccccgtcgaggccctcaccacggtgaagccatactgcaatgagatccatgcccaggctcaactgtggctcaagagagaccccaaggcatcctatgatgcctggaagaagtgtcttcctatcagagggatagatggcaatgggaaagcccccagcaaatcagagctccgccatctctatttgactgagaagtatgtgtggaggtggaaacagttcctgagtcgtcgggggaagaggacctcccccttggatctcaaactggggcataacaactggctgcgacaagtgcttttcactccagcaacgcaggccgcacggcaggcagcctgtaccattgtggaagctctagccaccattcccagccgcaagcagcaggtcctggacctgcttaccagttacctggatgagctgagcatagctggggagtgtgcagctgagtacctggctctctaccagaagctcatcacttctgcgcactggaaagtctacttggcagctcggggagtcctaccctatgtgggcaacctcatcaccaaggaaatagctcgtctgctggccctggaggaggctaccctgagtaccgatctgcagcagggttatgcccttaaaagtctcacaggccttctctcctcctttgttgaggtggaatccatcaaaagacattttaaaagtcgcttggtgggtactgtgctgaatggatacctgtgcttgcggaagctggtggtgcagaggaccaagctgatcgatgagacgcaggacatgctgctggagatgctggaggacatgaccacaggtacagaatcagaaaccaaggccttcatggctgtgtgcattgagacagccaagcgctacaatctggatgactaccggaccccggtgttcatcttcgagaggctctgcagcatcatttatcctgaggagaatgaagtcactgagttctttgtgaccctggagaaggatccccaacaagaagacttcttacagggcaggatgcctgggaacccgtatagcagcaatgagccaggcatcgggccgctgatgagggatataaagaacaagatttgccaggactgtgacttagtggccctcctggaagatgacagtggcatggagcttctagtgaacaataaaatcattagtttggaccttcctgtggctgaagtttacaagaaagtctggtgtaccacgaatgagggagagcccatgaggattgtttatcgtatgcgggggctgctgggcgatgccacagaggagttcattgagtccctggactctactacagatgaagaagaagatgaagaagaagtgtataaaatggctggtgtgatggcccagtgtgggggcctggaatgcatgcttaacagactcgcagggatcagagatttcaagcagggacgccaccttctaacagtgctactgaaattgttcagttactgcgtgaaggtgaaagtcaaccggcagcaactggtcaaactggaaatgaacaccttgaacgtcatgctggggaccctaaacctggcccttgtagctgaacaagaaagcaaggacagtgggggtgcagctgtggctgagcaggtgcttagcatcatggagatcattctagatgagtccaatgctgagcccctgagtgaggacaagggcaacctcctcctgacaggtgacaaggatcaactggtgatgctcttggaccagatcaacagcacctttgttcgctccaaccccagtgtgctccagggcctgcttcgcatcatcccgtacctttcctttggagaggtggagaaaatgcagatcttggtggagcgattcaaaccatactgcaactttgataaatatgatgaagatcacagtggtgatgataaagtcttcctggactgcttctgtaaaatagctgctggcatcaagaacaacagcaatgggcaccagctgaaggatctgattctccagaaggggatcacccagaatgcacttgactacatgaaaaagcacatccctagcgccaagaatttggatgccgacatctggaaaaagtttttgtctcgcccagccttgccatttatcctaaggctgcttcggggcctggccatccagcaccctggcacccaggttctgattggaactgattccatcccgaacctgcataagctggagcaggtgtccagtgatgagggcattgggaccttggcagagaacctgctggaagccctgcgggaacaccctgacgtaaacaagaagattgacgcagcccgcagggagacccgggcagagaagaaacgcatggccatggcaatgaggcagaaggccctgggcaccctgggcatgacgacaaatgaaaagggccaggtcgtgaccaagacagcactcctgaagcagatggaagagctgatcgaggagcctggcctcacgtgctgcatctgcagggagggatacaagttccagcccacaaaggtcctgggcatttataccttcacgaagcgggtagccttggaggagttggagaataagccccggaaacagcagggctacagcaccgtgtcccacttcaacattgtgcactacgactgccatctggctgccgtcaggttggctcgaggccgggaagagtgggagagtgccgccctgcagaatgccaacaccaagtgcaacgggctccttccggtctggggacctcatgtccctgaatcagcttttgccacttgcttggcaagacacaacacttacctccaggaatgtacaggccagcgggagcccacgtatcagctcaacatccacgacatcaaactgctcttcctgcgcttcgccatggagcagtcgttcagcgcagacactggcgggggcggccgggagagcaacatccacctgatcccgtacatcattcacactgtgctttacgtcctgaacacaacccgagcaacttcccgagaagagaagaacctccaaggctttctggaacagcccaaggagaagtgggtggagagtgcctttgaagtggacgggccctactatttcacagtcttggcccttcacatcctgccccctgagcagtggagagccacacgtgtggaaatcttgcggaggctgttggtgacctcgcaggctcgggcagtggctccaggtggagccaccaggctgacagataaggcagtgaaggactattccgcttaccgttcttcccttctcttttgggccctcgtcgatctcatttacaacatgtttaagaaggtgcctaccagtaacacagagggaggctggtcctgctctctcgctgagtacatccgccacaacgacatgcccatctacgaagctgccgacaaagccctgaaaaccttccaggaggagttcatgccagtggagaccttctcagagttcctcgatgtggccggtcttttatcagaaatcaccgatccagagagcttcctgaaggacctgttgaactcagtcccctgaccaccacacagcagctgcggcggcgaagacgaagctggcttgccttccaccctctgttctccctccttgtgcattaagttccctccgcgggatgctgcattgttaccccgccctcccctctctcatttttcttggtgtggcttggggtttttaggcttcctgttttatctcgtgtgtgtggtgcaccagctatgaggttgtctgtaacccaagccatcaaagggcctgtacatacctaggagccatgagttgtcccggccagcttcatacttgagtgtgcacatcttgagaaataaacaagtgacttaacacacattgaaaacttaccccccttgcccccttcccctctcacctccacc

SEQ ID NO: 356701 - DNA, 1993 bp, Homo sapiens
cagagtggagaaacccacgctgctgaggctagcgatcccgtatcaccgagcatctaaaggacccctcgaatgctcgtgtgtcgtgggagatgcctgtctcgctggacacaacgtcgtctgcgctcaaccaacaacagcaatgggcaccagctgaaggatctgattctccagaaggggatcacccagaatgcacttgactacatgaaaaagcacatccctagcgccaagaatttggatgccgacatctggaaaaagtttttgtctcgcccagccttgccatttatcctaaggctgcttcggggcctggccatccagcaccctggcacccaggttctgattggaactgattccatcccgaacctgcataagctggagcaggtgtccagtgatgagggcattgggaccttggcagagaacctgctggaagccctgcgggaacaccctgacgtaaacaagaagattgacgcagcccgcagggagacccgggcagagaagaaacgcatggccatggcaatgaggcagaaggccctgggcaccctgggcatgacgacaaatgaaaagggccaggtcgtgaccaagacagcactcctgaagcagatggaagagctgatcgaggagcctggcctcacgtgctgcatctgcagggagggatacaagttccagcccacaaaggtcctgggcatttataccttcacgaagcgggtagccttggaggagttggagaataagccccggaaacagcagggctacagcaccgtgtcccacttcaacattgtgcactacgactgccatctggctgccgtcaggttggctcgaggccgggaagagtgggagagtgccgccctgcagaatgccaacaccaagtgcaacgggctccttccggtctggggacctcatgtccctgaatcagcttttgccacttgcttggcaagacacaacacttacctccaggaatgtacaggccagcgggagcccacgtatcagctcaacatccacgacatcaaactgctcttcctgcgcttcgccatggagcagtcgttcagcgcagacactggcgggggcggccgggagagcaacatccacctgatcccgtacatcattcacactgtgctttacgtcctgaacacaacccgagcaacttcccgagaagagaagaacctccaaggctttctggaacagcccaaggagaagtgggtggagagtgcctttgaagtggacgggccctactatttcacagtcttggcccttcacatcctgccccctgagcagtggagagccacacgtgtggaaatcttgcggaggctgttggtgacctcgcaggctcgggcagtggctccaggtggagccaccaggctgacagataaggcagtgaaggactattccgcttaccgttcttcccttctcttttgggccctcgtcgatctcatttacaacatgtttaagaaggtgcctaccagtaacacagagggaggctggtcctgctctctcgctgagtacatccgccacaacgacatgcccatctacgaagctgccgacaaagccctgaaaaccttccaggaggagttcatgccagtggagaccttctcagagttcctcgatgtggccggtcttttatcagaaatcaccgatccagagagcttcctgaaggacctgttgaactcagtcccctgaccaccacacagcagctgcggcggcgaagacgaagctggcttgccttccaccctctgttctccctccttgtgcattaagttccctccgcgggatgctgcattgttaccccgccctcccctctctcatttttcttggtgtggcttggggtttttaggcttcctgttttatctcgtgtgtgtggtgcaccagctatgaggttgtctgtaacccaagccatcaaagggcctgtacatacctaggagccatgagttgtcccggccagcttcatacttgagtgtgcacatcttgagaaataaacaagtgacttaacacacattgaaaa

SEQ ID NO: 356702 - DNA, 12647 bp, Homo sapiens
gtgacctagaggttccgccacaagcgcgatctcaaaggtccaggtctctttggatgagcatttttctaagatggctgctgagactgatcctcataagtcgtctgagattaccaagaacctacttccagccacgctgcaactcattgacacctatgcatcgttcaccagagcctatttgctgcaaaactttaatgaagagggaacaactgagaaaccttccaaggagaaactgcaaggctttgctgctgttttggctattggctctagcaggtgcaaggcaaatactctgggtccgacactggttcagaatttgccatcgtcagtgcagactgtgtgtgagtcctggaacaacatcaataccaatgaatttcccaatattggatcctggcgcaatgcctttgccaatgacaccatcccttcagagagttatattagtgcagtgcaggctgcacacctggggactctctgtagccaaagtctgcccctggctgcttccctgaagcataccctcctctcactggtcaggttgactggagatcttattgtttggtcagatgagatgaacccaccacaggtaattcggacactgctacctcttcttttggaatcaagcactgagagtgttgccgagatcagtagcaactccctggaacgcatcttgggccctgctgagtctgatgagttcttggctcgtgtttatgagaagctgatcactggttgttacaacattctggccaatcatgcagatcctaacagtggactggatgaatccatcctggaggaatgtctccagtacttggaaaagcagctggaaagtagccaggctcgtaaagctatggaggagtttttctctgacagtggagaacttgtacagatcatgatggcaacagccaatgagaacctctctgctaaattctgtaaccgagttttgaaattcttcaccaaactcttccagctgactgagaagagccctaacccgagcctgttgcatctctgtggctccctggcacaactggcctgtgtggaacctgtgcgcctgcaggcctggctcacccgcatgactacatcgcccccaaaagattctgatcagctggatgtaattcaggagaaccggcagctgctgcagttactgaccacatacattgttcgggaaaacagccaagttggggaaggtgtgtgtgctgttcttctgggcaccctgactcccatggcaacagagatgctggccaacggtgatgggactggcttccctgaacttatggttgtgatggccactctggccagtgcaggtcaaggtgctggtcaccttcagcttcataatgctgctgtggattggctgagcagatgcaagaaatacctgtcacagaagaatgtagttgaaaaactgaatgccaatgtaatgcatggaaagcatgtgatgatcttggagtgcacatgccatatcatgtcttacttggctgatgtcacgaatgccctgagccagagtaatggtcaaggcccaagtcatctctcagtggatggggaagagcgggccattgaagtagactcagactgggtggaggagttggcggtggaagaggaagattcccaggctgaggattcagatgaagattctctttgcaataaactctgcacttttacgatcacacagaaagaattcatgaaccagcattggtaccactgtcacacctgtaaaatggtggatggcgtgggtgtctgcacagtgtgtgctaaggtgtgccacaaggatcatgagatttcctatgccaagtatggatccttcttctgtgactgtggagccaaggaagatggcagctgtttggctctggtgaagagaactcctagcagtggcatgagctctaccatgaaggagtcggcatttcagagtgaacccaggatttcagagagtctagtgcgtcatgccagcacctcctcgccagctgacaaagccaaggttaccatcagtgatggaaaggttgctgacgaagagaagcccaagaagagcagcctctgccgcacagtagagggctgccgggaggaattacagaaccaggccaatttctccttcgctcctctcgtgttagacatgcttaatttccttatggatgccattcagaccaacttccagcaagcttcagccgtcgggagcagcagccgtgctcagcaagccctcagtgagctacacactgtggagaaggcagtggagatgacagaccagctgatggttcccaccttagggtcccaggaaggtgcctttgagaatgtgcggatgaattacagtggagaccagggccagaccatccggcagctgatcagtgctcatgtgctcaggcgggtggctatgtgtgtgctctcctctccccatgggcgccgccaacatttggctgtcagccatgagaagggcaagatcaccgttctgcagctctctgcactcctgaagcaagcagattccagcaaaaggaagttaactctgacccgcttggcttctgccccagttccttttactgtgttgagcctcacaggaaatccctgcaaggaagactacttggcggtttgtgggctaaaggactgtcatgtgctcacctttagtagctcaggctctgtttcggatcacttggttttgcaccctcagttggcaacggggaacttcatcatcaaagccgtgtggttacctggttcacagaccgagttagcaattgtcaccgcagactttgttaagatttatgacctgtgtgttgatgccttgagtccaaccttctattttctcctgccaagctcaaagataagagatgttaccttccttttcaatgaggagggaaagaacatcattgttataatgtcttcggctgggtacatctatactcagcttatggaagaggccagcagtgcccagcagggacccttctatgtcactaatgtgttggaaatcaatcatgaggacctgaaggacagtaacagccaggtggcgggcggtggtgtgtccgtgtactactcccacgtgttgcagatgttgttcttcagctattgtcaaggcaaatcattcgcagccaccatcagcaggacaaccctggaggtgttgcaactcttccccatcaacatcaaaagttccaatggtggcagtaagacttctcctgctctttgccagtggtctgaggtgatgaaccaccctggcttggtgtgctgtgtccagcaaactacaggggtgccgctggtagttatggtgaaaccagacacttttcttatccaggagattaagactcttcctgctaaagcgaagatccaagacatggttgctattaggcacacggcctgcaatgagcagcagcggacaacaatgattctgctgtgtgaggatggcagcctgcgcatttacatggccaacgtggagaacacctcctactggctgcagccatccctgcagcccagcagtgtcatcagcatcatgaagcctgttcgaaagcgcaaaacagctacaatcacaacccgcacgtctagccaggtgactttccccattgacttttttgaacacaaccagcagctgacagatgtggagtttggtggtaacgacctcctacaggtctataatgcacaacagataaaacaccggctgaattccactggcatgtatgtggccaacaccaagcccggaggcttcaccattgagattagtaacaacaatagcactatggtgatgacaggcatgcggatccagattgggactcaagcaatagaacgggccccgtcatatatcgagatcttcggcagaactatgcagctcaacctgagtcgctcacgctggtttgacttccccttcaccagagaagaagccctgcaggctgataagaagctgaacctcttcattggggcctcggtggatccagcaggtgtcaccatgatagatgctgtaaaaatttatggcaagactaaggagcagtttggctggcctgatgagcccccagaagaattcccttctgcctctgtcagcaacatctgcccttcaaatctgaaccagagcaacggcactggagatagcgactcagctgcccccactacgaccagtggaactgtcctggagaggctggttgtgagttctttagaagccctggaaagctgctttgccgttggcccaatcatcgagaaggagagaaacaagaatgctgctcaggagctggccactttgctgttgtccctgccagcacctgccagtgtccagcagcagtccaagagccttctggccagcctgcacaccagccgctcggcctaccacagccacaaggatcaggccttgctgagcaaagctgtgcagtgtctcaacacatctagcaaagagggcaaggatttggaccctgaggtgttccagaggctagtgatcacagctcgctccattgccatcatgcgccccaacaaccttgtccactttacggagtcaaagctgccccagatggaaacagactgtttttttcctagatgtgcctgctggagtctagggatagttggcatattgattggggccccacttgaaactccctccccaggcaagcttccttgacctgagttaaccttaaaacaaattaaattccatctcagatttaccatcgttgataattttctttctcctgcttagaaggaatggatgaagggaaggaaccgcagaagcagttggaaggagattgctgtagtttcatcacccagcttgtgaaccacttctggaaactccatgcatccaaacccaagaatgccttcttggcacctgcctgccttccaggactaactcatattgaagctactgtcaatgctctggtggacatcatccatggctactgtacctgtgagctggattgtattaacacagcatccaagatctacatgcagatgctcttgtgtcctgatcctgctgtgagcttctcttgtaaacaagctctaattcgagtcctaaggcccaggaacaaacggagacatgtgactttaccctcttcccctcgaagcaacactccaatgggagacaaggatgatgatgacgatgatgatgcagatgagaaaatgcagtcatcagggatcccgaatggtggtcacatccgtcaggaaagccaggaacagagtgaggtggaccatggagattttgagatggtgtctgagtcgatggtcctggagacagctgaaaatgtcaacaatggcaacccctctcccctggaggccctgctggcaggcgcagagggcttcccccccatgctggacatcccacctgatgcagatgacgagaccatggttgaactagccattgccctgagcctgcagcaggaccaacaaggcagcagcagcagtgccctgggcctgcagagcctgggactgtccggccaggcacccagctcttcctctctggacgcaggaaccctctctgacaccacagcatcagctccagcctcagacgacgagggcagtacagcagcgacagatggttctacccttcggacctctcctgctgaccacggtggtagtgtgggctcggagagcgggggcagtgcagtggactcagtggctggcgagcacagtgtatctggccggagcagtgcttatggcgatgctacagctgaggggcatccggctggaccaggaagtgtcagctcaagcactggagccatcagcaccaccactgggcaccaggagggagatggctccgagggagaaggagaaggagaaactgaaggagatgtccacactagcaacaggctgcacatggtccgtctaatgctgttggagagattactgcagaccctgcctcaattacgaaacgttggcggtgtccgggccatcccatacatgcaggtcattctaatgctcactacagatctggatggagaagatgagaaagacaagggggccctagacaacctgctctcccagcttattgctgagttgggtatggataaaaaggatgtctccaagaagaatgagcgcagcgccctgaatgaagtccatctggtagtaatgagactcctgagtgtcttcatgtcccgcaccaaatctggatccaagtcttccatatgtgagtcatcttccctcatctccagtgccacagcagcagctctactgagctctggggctgtggactactgcctgcacgtgctcaaatcactgctggaatattggaagagccaacagaatgacgaggagcctgtggctaccagccagttgctgaaaccacatactacctcctccccacctgacatgagcccattctttctccgccagtatgtgaagggtcatgctgctgatgtgtttgaggcctatactcagcttctaacagaaatggtactgaggcttccttaccaaatcaaaaagattactgacaccaattctcgaatcccacctcctgtctttgaccactcgtggttttactttctctccgagtacctcatgatccagcagactccatttgtgcgccgtcaagtccgcaaacttctgctcttcatctgtggatccaaagagaagtaccgccagctccgggatttgcacaccctggactctcacgtgcgtgggatcaagaagctgctagaagagcaggggatattcctccgggcaagtgtggttacagccagctcaggctccgccttgcaatatgacacactcatcagcctgatggagcacctgaaagcctgtgcagagattgccgcccagcgaaccatcaactggcagaaattctgcatcaaagatgactccgtcctgtacttcctcctccaagtcagtttccttgtggatgagggcgtgtccccagtgctgctgcaactgctctcctgtgctctctgcggcagcaaggtgctcgctgcactggcagcctcttcgggatcctccagtgcttcttcctcctcagcccctgtggctgccagttctggacaagccacaacacagtccaagtcttccactaaaaagagcaagaaagaagaaaaagaaaaggagaaagatggtgagacctctggcagccaggaggaccagctgtgcacagctctggtgaaccagctgaacaaatttgccgataaggaaaccctgatccagttcctgcgttgtttcctgttagagtccaattcttcctcggtgcgctggcaggcccactgtctgacactgcacatctacagaaattccagcaaatctcaacaggagctcctgctagatctgatgtggtccatctggccagaactcccagcctatggtcgtaaggctgcccagtttgtggacctactaggatatttctccctgaaaactccacaaacagagaagaagttgaaggagtattcacagaaggctgtggagattctgcggactcaaaaccatattcttaccaaccaccccaactcgaacatttataacactttgtctggcttagtggagtttgatggctattacctggagagcgatccctgcctggtgtgtaataacccggaagtaccgttctgttatatcaagctgtcttccattaaagtggacacgcggtacaccaccacccagcaggttgtgaagctcattggcagtcacaccatcagcaaagtgacagtgaaaatcggggatctgaaacggaccaagatggtgcggaccatcaacctgtattataacaaccgaaccgtgcaggccatcgtggagttgaaaaacaagccagctcgctggcacaaagccaagaaggttcagctgacccctggacagacagaggtgaagattgacctgccgttgcccattgtggcctccaatctgatgattgagtttgcagacttctatgaaaactaccaggcctccacagagaccctgcagtgccctcgctgtagtgcctcggtccctgccaacccaggagtctgtggcaactgtggagagaatgtgtaccagtgtcacaaatgcagatccatcaactacgatgaaaaggatcccttcctctgcaatgcctgtggcttctgtaaatatgcccgcttcgacttcatgctctatgccaagccttgctgtgcagtggatcccattgagaatgaagaagaccggaagaaggctgtatccaacatcaatacacttttggacaaagctgatcgagtgtatcatcagctgatgggacaccggccacagctggagaacctgctctgcaaagtgaatgaggcagctccagaaaagccacaggatgactcaggaacagcagggggcatcagctccacttctgccagtgtgaatcgttacatcctgcagttggctcaggagtattgtggagactgcaagaactcttttgatgaactctccaaaatcatccagaaagtctttgcttcgcgcaaagagttgttggaatatgacctacagcagagggaagcagccactaaatcatcccggacctccgtgcagcccacattcactgccagccagtaccgtgccttatccgtcctgggctgtggccacacatcctccaccaagtgctatggctgcgcctcggctgtcacagaacattgtatcacactacttcgggccctggccaccaacccagccttgaggcacatccttgtctcccagggccttatccgggagctctttgattataatcttcgccgaggggctgcggccatgcgggaggaggtccgccagctcatgtgcctcctaactcgagacaacccagaagccacccaacagatgaatgacctgattattggcaaggtctccacagccctgaagggccactgggccaaccccgatctggcaagtagcctgcagtatgaaatgctgctgctgacggattctatctccaaggaggacagctgctgggagctccggttacgctgtgctctcagccttttcctcatggctgtgaacattaagactcctgtggtggttgaaaacattaccctcatgtgcctgaggatcttgcagaagctgataaaaccacctgctcccactagcaagaagaacaaggatgtccccgtcgaggccctcaccacggtgaagccatactgcaatgagatccatgcccaggctcaactgtggctcaagagagaccccaaggcatcctatgatgcctggaagaagtgtcttcctatcagagggatagatggcaatgggaaagcccccagcaaatcagagctccgccatctctatttgactgagaagtatgtgtggaggtggaaacagttcctgagtcgtcgggggaagaggacctcccccttggatctcaaactggggcataacaactggctgcgacaagtgcttttcactccagcaacgcaggccgcacggcaggcagcctgtaccattgtggaagctctagccaccattcccagccgcaagcagcaggtcctggacctgcttaccagttacctggatgagctgagcatagctggggagtgtgcagctgagtacctggctctctaccagaagctcatcacttctgcgcactggaaagtctacttggcagctcggggagtcctaccctatgtgggcaacctcatcaccaaggaaatagctcgtctgctggccctggaggaggctaccctgagtaccgatctgcagcagggttatgcccttaaaagtctcacaggccttctctcctcctttgttgaggtggaatccatcaaaagacattttaaaagtcgcttggtgggtactgtgctgaatggatacctgtgcttgcggaagctggtggtgcagaggaccaagctgatcgatgagacgcaggacatgctgctggagatgctggaggacatgaccacaggtacagaatcagaaaccaaggccttcatggctgtgtgcattgagacagccaagcgctacaatctggatgactaccggaccccggtgttcatcttcgagaggctctgcagcatcatttatcctgaggagaatgaagtcactgagttctttgtgaccctggagaaggatccccaacaagaagacttcttacagggcaggatgcctgggaacccgtatagcagcaatgagccaggcatcgggccgctgatgagggatataaagaacaagatttgccaggactgtgacttagtggccctcctggaagatgacagtggcatggagcttctagtgaacaataaaatcattagtttggaccttcctgtggctgaagtttacaagaaagtctggtgtaccacgaatgagggagagcccatgaggattgtttatcgtatgcgggggctgctgggcgatgccacagaggagttcattgagtccctggactctactacagatgaagaagaagatgaagaagaagtgtataaaatggctggtgtgatggcccagtgtgggggcctggaatgcatgcttaacagactcgcagggatcagagatttcaagcagggacgccaccttctaacagtgctactgaaattgttcagttactgcgtgaaggtgaaagtcaaccggcagcaactggtcaaactggaaatgaacaccttgaacgtcatgctggggaccctaaacctggcccttgtagctgaacaagaaagcaaggacagtgggggtgcagctgtggctgagcaggtgcttagcatcatggagatcattctagatgagtccaatgctgagcccctgagtgaggacaagggcaacctcctcctgacaggtgacaaggatcaactggtgatgctcttggaccagatcaacagcacctttgttcgctccaaccccagtgtgctccagggcctgcttcgcatcatcccgtacctttcctttggagaggtggagaaaatgcagatcttggtggagcgattcaaaccatactgcaactttgataaatatgatgaagatcacagtggtgatgataaagtcttcctggactgcttctgtaaaatagctgctggcatcaagaacaacagcaatgggcaccagctgaaggatctgattctccagaaggggatcacccagaatgcacttgactacatgaaaaagcacatccctagcgccaagaatttggatgccgacatctggaaaaagtttttgtctcgcccagccttgccatttatcctaaggctgcttcggggcctggccatccagcaccctggcacccaggttctgattggaactgattccatcccgaacctgcataagctggagcaggtgtccagtgatgagggcattgggaccttggcagagaacctgctggaagccctgcgggaacaccctgacgtaaacaagaagattgacgcagcccgcagggagacccgggcagagaagaaacgcatggccatggcaatgaggcagaaggccctgggcaccctgggcatgacgacaaatgaaaagggccaggtcgtgaccaagacagcactcctgaagcagatggaagagctgatcgaggagcctggcctcacgtgctgcatctgcagggagggatacaagttccagcccacaaaggtcctgggcatttataccttcacgaagcgggtagccttggaggagttggagaataagccccggaaacagcagggctacagcaccgtgtcccacttcaacattgtgcactacgactgccatctggctgccgtcaggttggctcgaggccgggaagagtgggagagtgccgccctgcagaatgccaacaccaagtgcaacgggctccttccggtctggggacctcatgtccctgaatcagcttttgccacttgcttggcaagacacaacacttacctccaggaatgtacaggccagcgggagcccacgtatcagctcaacatccacgacatcaaactgctcttcctgcgcttcgccatggagcagtcgttcagcgcagacactggcgggggcggccgggagagcaacatccacctgatcccgtacatcattcacactgtgctttacgtcctgaacacaacccgagcaacttcccgagaagagaagaacctccaaggctttctggaacagcccaaggagaagtgggtggagagtgcctttgaagtggacgggccctactatttcacagtcttggcccttcacatcctgccccctgagcagtggagagccacacgtgtggaaatcttgcggaggctgttggtgacctcgcaggctcgggcagtggctccaggtggagccaccaggctgacagataaggcagtgaaggactattccgcttaccgttcttcccttctcttttgggccctcgtcgatctcatttacaacatgtttaagaaggtgcctaccagtaacacagagggaggctggtcctgctctctcgctgagtacatccgccacaacgacatgcccatctacgaagctgccgacaaagccctgaaaaccttccaggaggagttcatgccagtggagaccttctcagagttcctcgatgtggccggtcttttatcagaaatcaccgatccagagagcttcctgaaggacctgttgaactcagtcccctgaccaccacacagcagctgcggcggcgaagacgaagctggcttgccttccaccctctgttctccctccttgtgcattaagttccctccgcgggatgctgcattgttaccccgccctcccctctctcgtgtgtgtggtgcaccagctatgaggttgtctgtaacccaagccatcaaagggcctgtacatacctaggagccatgagttgtcccggccagcttcatacttgagtgtgcacatcttgagaaataaacaagtgacttaacacacattgaaaa

SEQ ID NO: 356703 - DNA, 12385 bp, Homo sapiens
gtgacctagaggttccgccacaagcgcgatctcaaaggtccaggtctctttggatgagcatttttctaagatggctgctgagactgatcctcataagtcgtctgagattaccaagaacctacttccagccacgctgcaactcattgacacctatgcatcgttcaccagagcctatttgctgcaaaactttaatgaagagggaacaactgagaaaccttccaaggagaaactgcaaggctttgctgctgttttggctattggctctagcaggtgcaaggcaaatactctgggtccgacactggttcagaatttgccatcgtcagtgcagactgtgtgtgagtcctggaacaacatcaataccaatgaatttcccaatattggatcctggcgcaatgcctttgccaatgacaccatcccttcagagagttatattagtgcagtgcaggctgcacacctggggactctctgtagccaaagtctgcccctggctgcttccctgaagcataccctcctctcactggtcaggttgactggagatcttattgtttggtcagatgagatgaacccaccacaggtaattcggacactgctacctcttcttttggaatcaagcactgagagtgttgccgagatcagtagcaactccctggaacgcatcttgggccctgctgagtctgatgagttcttggctcgtgtttatgagaagctgatcactggttgttacaacattctggccaatcatgcagatcctaacagtggactggatgaatccatcctggaggaatgtctccagtacttggaaaagcagctggaaagtagccaggctcgtaaagctatggaggagtttttctctgacagtggagaacttgtacagatcatgatggcaacagccaatgagaacctctctgctaaattctgtaaccgagttttgaaattcttcaccaaactcttccagctgactgagaagagccctaacccgagcctgttgcatctctgtggctccctggcacaactggcctgtgtggaacctgtgcgcctgcaggcctggctcacccgcatgactacatcgcccccaaaagattctgatcagctggatgtaattcaggagaaccggcagctgctgcagttactgaccacatacattgttcgggaaaacagccaagttggggaaggtgtgtgtgctgttcttctgggcaccctgactcccatggcaacagagatgctggccaacggtgatgggactggcttccctgaacttatggttgtgatggccactctggccagtgcaggtcaaggtgctggtcaccttcagcttcataatgctgctgtggattggctgagcagatgcaagaaatacctgtcacagaagaatgtagttgaaaaactgaatgccaatgtaatgcatggaaagcatgtgatgatcttggagtgcacatgccatatcatgtcttacttggctgatgtcacgaatgccctgagccagagtaatggtcaaggcccaagtcatctctcagtggatggggaagagcgggccattgaagtagactcagactgggtggaggagttggcggtggaagaggaagattcccaggctgaggattcagatgaagattctctttgcaataaactctgcacttttacgatcacacagaaagaattcatgaaccagcattggtaccactgtcacacctgtaaaatggtggatggcgtgggtgtctgcacagtgtgtgctaaggtgtgccacaaggatcatgagatttcctatgccaagtatggatccttcttctgtgactgtggagccaaggaagatggcagctgtttggctctggtgaagagaactcctagcagtggcatgagctctaccatgaaggagtcggcatttcagagtgaacccaggatttcagagagtctagtgcgtcatgccagcacctcctcgccagctgacaaagccaaggttaccatcagtgatggaaaggttgctgacgaagagaagcccaagaagagcagcctctgccgcacagtagagggctgccgggaggaattacagaaccaggccaatttctccttcgctcctctcgtgttagacatgcttaatttccttatggatgccattcagaccaacttccagcaagcttcagccgtcgggagcagcagccgtgctcagcaagccctcagtgagctacacactgtggagaaggcagtggagatgacagaccagctgatggttcccaccttagggtcccaggaaggtgcctttgagaatgtgcggatgaattacagtggagaccagggccagaccatccggcagctgatcagtgctcatgtgctcaggcgggtggctatgtgtgtgctctcctctccccatgggcgccgccaacatttggctgtcagccatgagaagggcaagatcaccgttctgcagctctctgcactcctgaagcaagcagattccagcaaaaggaagttaactctgacccgcttggcttctgccccagttccttttactgtgttgagcctcacaggaaatccctgcaaggaagactacttggcggtttgtgggctaaaggactgtcatgtgctcacctttagtagctcaggctctgtttcggatcacttggttttgcaccctcagttggcaacggggaacttcatcatcaaagccgtgtggttacctggttcacagaccgagttagcaattgtcaccgcagactttgttaagatttatgacctgtgtgttgatgccttgagtccaaccttctattttctcctgccaagctcaaagataagagatgttaccttccttttcaatgaggagggaaagaacatcattgttataatgtcttcggctgggtacatctatactcagcttatggaagaggccagcagtgcccagcagggacccttctatgtcactaatgtgttggaaatcaatcatgaggacctgaaggacagtaacagccaggtggcgggcggtggtgtgtccgtgtactactcccacgtgttgcagatgttgttcttcagctattgtcaaggcaaatcattcgcagccaccatcagcaggacaaccctggaggtgttgcaactcttccccatcaacatcaaaagttccaatggtggcagtaagacttctcctgctctttgccagtggtctgaggtgatgaaccaccctggcttggtgtgctgtgtccagcaaactacaggggtgccgctggtagttatggtgaaaccagacacttttcttatccaggagattaagactcttcctgctaaagcgaagatccaagacatggttgctattaggcacacggcctgcaatgagcagcagcggacaacaatgattctgctgtgtgaggatggcagcctgcgcatttacatggccaacgtggagaacacctcctactggctgcagccatccctgcagcccagcagtgtcatcagcatcatgaagcctgttcgaaagcgcaaaacagctacaatcacaacccgcacgtctagccaggtgactttccccattgacttttttgaacacaaccagcagctgacagatgtggagtttggtggtaacgacctcctacaggtctataatgcacaacagataaaacaccggctgaattccactggcatgtatgtggccaacaccaagcccggaggcttcaccattgagattagtaacaacaatagcactatggtgatgacaggcatgcggatccagattgggactcaagcaatagaacgggccccgtcatatatcgagatcttcggcagaactatgcagctcaacctgagtcgctcacgctggtttgacttccccttcaccagagaagaagccctgcaggctgataagaagctgaacctcttcattggggcctcggtggatccagcaggtgtcaccatgatagatgctgtaaaaatttatggcaagactaaggagcagtttggctggcctgatgagcccccagaagaattcccttctgcctctgtcagcaacatctgcccttcaaatctgaaccagagcaacggcactggagatagcgactcagctgcccccactacgaccagtggaactgtcctggagaggctggttgtgagttctttagaagccctggaaagctgctttgccgttggcccaatcatcgagaaggagagaaacaagaatgctgctcaggagctggccactttgctgttgtccctgccagcacctgccagtgtccagcagcagtccaagagccttctggccagcctgcacaccagccgctcggcctaccacagccacaaggatcaggccttgctgagcaaagctgtgcagtgtctcaacacatctagcaaagagggcaaggatttggaccctgaggtgttccagaggctagtgatcacagctcgctccattgccatcatgcgccccaacaaccttgtccactttacggagtcaaagctgccccagatggaaacagactgtttttttcctagatgtgcctgctggagtctagggatagttggcatattgattggggccccacttgaaactccctccccaggcaagcttccttgacctgagttaaccttaaaacaaattaaattccatctcagatttaccatcgttgataattttctttctcctgcttagaaggaatggatgaagggaaggaaccgcagaagcagttggaaggagattgctgtagtttcatcacccagcttgtgaaccacttctggaaactccatgcatccaaacccaagaatgccttcttggcacctgcctgccttccaggactaactcatattgaagctactgtcaatgctctggtggacatcatccatggctactgtacctgtgagctggattgtattaacacagcatccaagatctacatgcagatgctcttgtgtcctgatcctgctgtgagcttctcttgtaaacaagctctaattcgagtcctaaggcccaggaacaaacggagacatgtgactttaccctcttcccctcgaagcaacactccaatgggagacaaggatgatgatgacgatgatgatgcagatgagaaaatgcagtcatcagggatcccgaatggtggtcacatccgtcaggaaagccaggaacagagtgaggtggaccatggagattttgagatggtgtctgagtcgatggtcctggagacagctgaaaatgtcaacaatggcaacccctctcccctggaggccctgctggcaggcgcagagggcttcccccccatgctggacatcccacctgatgcagatgacgagaccatggttgaactagccattgccctgagcctgcagcaggaccaacaaggcagcagcagcagtgccctgggcctgcagagcctgggactgtccggccaggcacccagctcttcctctctggacgcaggaaccctctctgacaccacagcatcagctccagcctcagacgacgagggcagtacagcagcgacagatggttctacccttcggacctctcctgctgaccacggtggtagtgtgggctcggagagcgggggcagtgcagtggactcagtggctggcgagcacagtgtatctggccggagcagtgcttatggcgatgctacagctgaggggcatccggctggaccaggaagtgtcagctcaagcactggagccatcagcaccaccactgggcaccaggagggagatggctccgagggagaaggagaaggagaaactgaaggagatgtccacactagcaacaggctgcacatggtccgtctaatgctgttggagagattactgcagaccctgcctcaattacgaaacgttggcggtgtccgggccatcccatacatgcaggtcattctaatgctcactacagatctggatggagaagatgagaaagacaagggggccctagacaacctgctctcccagcttattgctgagttgggtatggataaaaaggatgtctccaagaagaatgagcgcagcgccctgaatgaagtccatctggtagtaatgagactcctgagtgtcttcatgtcccgcaccaaatctggatccaagtcttccatatgtgagtcatcttccctcatctccagtgccacagcagcagctctactgagctctggggctgtggactactgcctgcacgtgctcaaatcactgctggaatattggaagagccaacagaatgacgaggagcctgtggctaccagccagttgctgaaaccacatactacctcctccccacctgacatgagcccattctttctccgccagtatgtgaagggtcatgctgctgatgtgtttgaggcctatactcagcttctaacagaaatggtactgaggcttccttaccaaatcaaaaagattactgacaccaattctcgaatcccacctcctgtctttgaccactcgtggttttactttctctccgagtacctcatgatccagcagactccatttgtgcgccgtcaagtccgcaaacttctgctcttcatctgtggatccaaagagaagtaccgccagctccgggatttgcacaccctggactctcacgtgcgtgggatcaagaagctgctagaagagcaggggatattcctccgggcaagtgtggttacagccagctcaggctccgccttgcaatatgacacactcatcagcctgatggagcacctgaaagcctgtgcagagattgccgcccagcgaaccatcaactggcagaaattctgcatcaaagatgactccgtcctgtacttcctcctccaagtcagtttccttgtggatgagggcgtgtccccagtgctgctgcaactgctctcctgtgctctctgcggcagcaaggtgctcgctgcactggcagcctcttcgggatcctccagtgcttcttcctcctcagcccctgtggctgccagttctggacaagccacaacacagtccaagtcttccactaaaaagagcaagaaagaagaaaaagaaaaggagaaagatggtgagacctctggcagccaggaggaccagctgtgcacagctctggtgaaccagctgaacaaatttgccgataaggaaaccctgatccagttcctgcgttgtttcctgttagagtccaattcttcctcggtgcgctggcaggcccactgtctgacactgcacatctacagaaattccagcaaatctcaacaggagctcctgctagatctgatgtggtccatctggccagaactcccagcctatggtcgtaaggctgcccagtttgtggacctactaggatatttctccctgaaaactccacaaacagagaagaagttgaaggagtattcacagaaggctgtggagattctgcggactcaaaaccatattcttaccaaccaccccaactcgaacatttataacactttgtctggcttagtggagtttgatggctattacctggagagcgatccctgcctggtgtgtaataacccggaagtaccgttctgttatatcaagctgtcttccattaaagtggacacgcggtacaccaccacccagcaggttgtgaagctcattggcagtcacaccatcagcaaagtgacagtgaaaatcggggatctgaaacggaccaagatggtgcggaccatcaacctgtattataacaaccgaaccgtgcaggccatcgtggagttgaaaaacaagccagctcgctggcacaaagccaagaaggttcagctgacccctggacagacagaggtgaagattgacctgccgttgcccattgtggcctccaatctgatgattgagtttgcagacttctatgaaaactaccaggcctccacagagaccctgcagtgccctcgctgtagtgcctcggtccctgccaacccaggagtctgtggcaactgtggagagaatgtgtaccagtgtcacaaatgcagatccatcaactacgatgaaaaggatcccttcctctgcaatgcctgtggcttctgtaaatatgcccgcttcgacttcatgctctatgccaagccttgctgtgcagtggatcccattgagaatgaagaagaccggaagaaggctgtatccaacatcaatacacttttggacaaagctgatcgagtgtatcatcagctgatgggacaccggccacagctggagaacctgctctgcaaagtgaatgaggcagctccagaaaagccacaggatgactcaggaacagcagggggcatcagctccacttctgccagtgtgaatcgttacatcctgcagttggctcaggagtattgtggagactgcaagaactcttttgatgaactctccaaaatcatccagaaagtctttgcttcgcgcaaagagttgttggaatatgacctacagcagagggaagcagccactaaatcatcccggacctccgtgcagcccacattcactgccagccagtaccgtgccttatccgtcctgggctgtggccacacatcctccaccaagtgctatggctgcgcctcggctgtcacagaacattgtatcacactacttcgggccctggccaccaacccagccttgaggcacatccttgtctcccagggccttatccgggagctctttgattataatcttcgccgaggggctgcggccatgcgggaggaggtccgccagctcatgtgcctcctaactcgagacaacccagaagccacccaacagatgaatgacctgattattggcaaggtctccacagccctgaagggccactgggccaaccccgatctggcaagtagcctgcagtatgaaatgctgctgctgacggattctatctccaaggaggacagctgctgggagctccggttacgctgtgctctcagccttttcctcatggctgtgaacattaagactcctgtggtggttgaaaacattaccctcatgtgcctgaggatcttgcagaagctgataaaaccacctgctcccactagcaagaagaacaaggatgtccccgtcgaggccctcaccacggtgaagccatactgcaatgagatccatgcccaggctcaactgtggctcaagagagaccccaaggcatcctatgatgcctggaagaagtgtcttcctatcagagggatagatggcaatgggaaagcccccagcaaatcagagctccgccatctctatttgactgagaagtatgtgtggaggtggaaacagttcctgagtcgtcgggggaagaggacctcccccttggatctcaaactggggcataacaactggctgcgacaagtgcttttcactccagcaacgcaggccgcacggcaggcagcctgtaccattgtggaagctctagccaccattcccagccgcaagcagcaggtcctggacctgcttaccagttacctggatgagctgagcatagctggggagtgtgcagctgagtacctggctctctaccagaagctcatcacttctgcgcactggaaagtctacttggcagctcggggagtcctaccctatgtgggcaacctcatcaccaaggaaatagctcgtctgctggccctggaggaggctaccctgagtaccgatctgcagcagggttatgcccttaaaagtctcacaggccttctctcctcctttgttgaggtggaatccatcaaaagacattttaaaagtcgcttggtgggtactgtgctgaatggatacctgtgcttgcggaagctggtggtgcagaggaccaagctgatcgatgagacgcaggacatgctgctggagatgctggaggacatgaccacaggtacagaatcagaaaccaaggccttcatggctgtgtgcattgagacagccaagcgctacaatctggatgactaccggaccccggtgttcatcttcgagaggctctgcagcatcatttatcctgaggagaatgaagtcactgagttctttgtgaccctggagaaggatccccaacaagaagacttcttacagggcaggatgcctgggaacccgtatagcagcaatgagccaggcatcgggccgctgatgagggatataaagaacaagatttgccaggactgtgacttagtggccctcctggaagatgacagtggcatggagcttctagtgaacaataaaatcattagtttggaccttcctgtggctgaagtttacaagaaagtctggtgtaccacgaatgagggagagcccatgaggattgtttatcgtatgcgggggctgctgggcgatgccacagaggagttcattgagtccctggactctactacagatgaagaagaagatgaagaagaagtgtataaaatggctggtgtgatggcccagtgtgggggcctggaatgcatgcttaacagactcgcagggatcagagatttcaagcagggacgccaccttctaacagtgctactgaaattgttcagttactgcgtgaaggtgaaagtcaaccggcagcaactggtcaaactggaaatgaacaccttgaacgtcatgctggggaccctaaacctggcccttgtagctgaacaagaaagcaaggacagtgggggtgcagctgtggctgagcaggtgcttagcatcatggagatcattctagatgagtccaatgctgagcccctgagtgaggacaagggcaacctcctcctgacaggtgacaaggatcaactggtgatgctcttggaccagatcaacagcacctttgttcgctccaaccccagtgtgctccagggcctgcttcgcatcatcccgtacctttcctttggagaggtggagaaaatgcagatcttggtggagcgattcaaaccatactgcaactttgataaatatgatgaagatcacagtggtgatgataaagtcttcctggactgcttctgtaaaatagctgctggcatcaagaacaacagcaatgggcaccagctgaaggatctgattctccagaaggggatcacccagaatgcacttgactacatgaaaaagcacatccctagcgccaagaatttggatgccgacatctggaaaaagtttttgtctcgcccagccttgccatttatcctaaggctgcttcggggcctggccatccagcaccctggcacccaggttctgattggaactgattccatcccgaacctgcataagctggagcaggtgtccagtgatgagggcattgggaccttggcagagaacctgctggaagccctgcgggaacaccctgacgtaaacaagaagattgacgcagcccgcagggagacccgggcagagaagaaacgcatggccatggcaatgaggcagaaggccctgggcaccctgggcatgacgacaaatgaaaagggccaggtcgtgaccaagacagcactcctgaagcagatggaagagctgatcgaggagcctggcctcacgtgctgcatctgcagggagggatacaagttccagcccacaaaggtcctgggcatttataccttcacgaagcgggtagccttggaggagttggagaataagccccggaaacagcagggctacagcaccgtgtcccacttcaacattgtgcactacgactgccatctggctgccgtcaggttggctcgaggccgggaagagtgggagagtgccgccctgcagaatgccaacaccaagtgcaacgggctccttccggtctggggacctcatgtccctgaatcagcttttgccacttgcttggcaagacacaacacttacctccaggaatgtacaggccagcgggagcccacgtatcagctcaacatccacgacatcaaactgctcttcctgcgcttcgccatggagcagtcgttcagcgcagacactggcgggggcggccgggagagcaacatccacctgatcccgtacatcattcacactgtgctttacgtcctgaacacaacccgagcaacttcccgagaagagaagaacctccaaggctttctggaacagcccaaggagaagtgggtggagagtgcctttgaagtggacgggccctactatttcacagtcttggcccttcacatcctgccccctgagcagtggagagccacacgtgtggaaatcttgcggaggctgttggtgacctcgcaggctcgggcagtggctccaggtggagccaccaggctgacagatagggcagtgcagtggactcagtggctggcgagcacagtgtatctggccggagcagtgcttatggcgatgctacagctgaggggcatccggctggaccaggaagtgtcagctcaagcactggagccatcagcaccaccactgggcaccaggagggagatggctccgagggagaaggagaaggagaaactgaaggagatgtccacactagcaacaggctgcacatggtccgtctaatgctgttggagagattactgcagaccctgcctcaattacgaaacgttggcggtgtccgggccatcccatacatgcagggacccactcg

SEQ ID NO: 356704 - DNA, 10395 bp, Homo sapiens
gtgacctagaggttccgccacaagcgcgatctcaaaggtccaggtctctttggatgagcatttttctaagatggctgctgagactgatcctcataagtcgtctgagattaccaagaacctacttccagccacgctgcaactcattgacacctatgcatcgttcaccagagcctatttgctgcaaaactttaatgaagagggaacaactgagaaaccttccaaggagaaactgcaaggctttgctgctgttttggctattggctctagcaggtgcaaggcaaatactctgggtccgacactggttcagaatttgccatcgtcagtgcagactgtgtgtgagtcctggaacaacatcaataccaatgaatttcccaatattggatcctggcgcaatgcctttgccaatgacaccatcccttcagagagttatattagtgcagtgcaggctgcacacctggggactctctgtagccaaagtctgcccctggctgcttccctgaagcataccctcctctcactggtcaggttgactggagatcttattgtttggtcagatgagatgaacccaccacaggtaattcggacactgctacctcttcttttggaatcaagcactgagagtgttgccgagatcagtagcaactccctggaacgcatcttgggccctgctgagtctgatgagttcttggctcgtgtttatgagaagctgatcactggttgttacaacattctggccaatcatgcagatcctaacagtggactggatgaatccatcctggaggaatgtctccagtacttggaaaagcagctggaaagtagccaggctcgtaaagctatggaggagtttttctctgacagtggagaacttgtacagatcatgatggcaacagccaatgagaacctctctgctaaattctgtaaccgagttttgaaattcttcaccaaactcttccagctgactgagaagagccctaacccgagcctgttgcatctctgtggctccctggcacaactggcctgtgtggaacctgtgcgcctgcaggcctggctcacccgcatgactacatcgcccccaaaagattctgatcagctggatgtaattcaggagaaccggcagctgctgcagttactgaccacatacattgttcgggaaaacagccaagttggggaaggtgtgtgtgctgttcttctgggcaccctgactcccatggcaacagagatgctggccaacggtgatgggactggcttccctgaacttatggttgtgatggccactctggccagtgcaggtcaaggtgctggtcaccttcagcttcataatgctgctgtggattggctgagcagatgcaagaaatacctgtcacagaagaatgtagttgaaaaactgaatgccaatgtaatgcatggaaagcatgtgatgatcttggagtgcacatgccatatcatgtcttacttggctgatgtcacgaatgccctgagccagagtaatggtcaaggcccaagtcatctctcagtggatggggaagagcgggccattgaagtagactcagactgggtggaggagttggcggtggaagaggaagattcccaggctgaggattcagatgaagattctctttgcaataaactctgcacttttacgatcacacagaaagaattcatgaaccagcattggtaccactgtcacacctgtaaaatggtggatggcgtgggtgtctgcacagtgtgtgctaaggtgtgccacaaggatcatgagatttcctatgccaagtatggatccttcttctgtgactgtggagccaaggaagatggcagctgtttggctctggtgaagagaactcctagcagtggcatgagctctaccatgaaggagtcggcatttcagagtgaacccaggatttcagagagtctagtgcgtcatgccagcacctcctcgccagctgacaaagccaaggttaccatcagtgatggaaaggttgctgacgaagagaagcccaagaagagcagcctctgccgcacagtagagggctgccgggaggaattacagaaccaggccaatttctccttcgctcctctcgtgttagacatgcttaatttccttatggatgccattcagaccaacttccagcaagcttcagccgtcgggagcagcagccgtgctcagcaagccctcagtgagctacacactgtggagaaggcagtggagatgacagaccagctgatggttcccaccttagggtcccaggaaggtgcctttgagaatgtgcggatgaattacagtggagaccagggccagaccatccggcagctgatcagtgctcatgtgctcaggcgggtggctatgtgtgtgctctcctctccccatgggcgccgccaacatttggctgtcagccatgagaagggcaagatcaccgttctgcagctctctgcactcctgaagcaagcagattccagcaaaaggaagttaactctgacccgcttggcttctgccccagttccttttactgtgttgagcctcacaggaaatccctgcaaggaagactacttggcggtttgtgggctaaaggactgtcatgtgctcacctttagtagctcaggctctgtttcggatcacttggttttgcaccctcagttggcaacggggaacttcatcatcaaagccgtgtggttacctggttcacagaccgagttagcaattgtcaccgcagactttgttaagatttatgacctgtgtgttgatgccttgagtccaaccttctattttctcctgccaagctcaaagataagagatgttaccttccttttcaatgaggagggaaagaacatcattgttataatgtcttcggctgggtacatctatactcagcttatggaagaggccagcagtgcccagcagggacccttctatgtcactaatgtgttggaaatcaatcatgaggacctgaaggacagtaacagccaggtggcgggcggtggtgtgtccgtgtactactcccacgtgttgcagatgttgttcttcagctattgtcaaggcaaatcattcgcagccaccatcagcaggacaaccctggaggtgttgcaactcttccccatcaacatcaaaagttccaatggtggcagtaagacttctcctgctctttgccagtggtctgaggtgatgaaccaccctggcttggtgtgctgtgtccagcaaactacaggggtgccgctggtagttatggtgaaaccagacacttttcttatccaggagattaagactcttcctgctaaagcgaagatccaagacatggttgctattaggcacacggcctgcaatgagcagcagcggacaacaatgattctgctgtgtgaggatggcagcctgcgcatttacatggccaacgtggagaacacctcctactggctgcagccatccctgcagcccagcagtgtcatcagcatcatgaagcctgttcgaaagcgcaaaacagctacaatcacaacccgcacgtctagccaggtgactttccccattgacttttttgaacacaaccagcagctgacagatgtggagtttggtggtaacgacctcctacaggtctataatgcacaacagataaaacaccggctgaattccactggcatgtatgtggccaacaccaagcccggaggcttcaccattgagattagtaacaacaatagcactatggtgatgacaggcatgcggatccagattgggactcaagcaatagaacgggccccgtcatatatcgagatcttcggcagaactatgcagctcaacctgagtcgctcacgctggtttgacttccccttcaccagagaagaagccctgcaggctgataagaagctgaacctcttcattggggcctcggtggatccagcaggtgtcaccatgatagatgctgtaaaaatttatggcaagactaaggagcagtttggctggcctgatgagcccccagaagaattcccttctgcctctgtcagcaacatctgcccttcaaatctgaaccagagcaacggcactggagatagcgactcagctgcccccactacgaccagtggaactgtcctggagaggctggttgtgagttctttagaagccctggaaagctgctttgccgttggcccaatcatcgagaaggagagaaacaagaatgctgctcaggagctggccactttgctgttgtccctgccagcacctgccagtgtccagcagcagtccaagagccttctggccagcctgcacaccagccgctcggcctaccacagccacaaggatcaggccttgctgagcaaagctgtgcagtgtctcaacacatctagcaaagagggcaaggatttggaccctgaggtgttccagaggctagtgatcacagctcgctccattgccatcatgcgccccaacaaccttgtccactttacggagtcaaagctgccccagatggaaacagactgtttttttcctagatgtgcctgctggagtctagggatagttggcatattgattggggccccacttgaaactccctccccaggcaagcttccttgacctgagttaaccttaaaacaaattaaattccatctcagatttaccatcgttgataattttctttctcctgcttagaaggaatggatgaagggaaggaaccgcagaagcagttggaaggagattgctgtagtttcatcacccagcttgtgaaccacttctggaaactccatgcatccaaacccaagaatgccttcttggcacctgcctgccttccaggactaactcatattgaagctactgtcaatgctctggtggacatcatccatggctactgtacctgtgagctggattgtattaacacagcatccaagatctacatgcagatgctcttgtgtcctgatcctgctgtgagcttctcttgtaaacaagctctaattcgagtcctaaggcccaggaacaaacggagacatgtgactttaccctcttcccctcgaagcaacactccaatgggagacaaggatgatgatgacgatgatgatgcagatgagaaaatgcagtcatcagggatcccgaatggtggtcacatccgtcaggaaagccaggaacagagtgaggtggaccatggagattttgagatggtgtctgagtcgatggtcctggagacagctgaaaatgtcaacaatggcaacccctctcccctggaggccctgctggcaggcgcagagggcttcccccccatgctggacatcccacctgatgcagatgacgagaccatggttgaactagccattgccctgagcctgcagcaggaccaacaaggcagcagcagcagtgccctgggcctgcagagcctgggactgtccggccaggcacccagctcttcctctctggacgcaggaaccctctctgacaccacagcatcagctccagcctcagacgacgagggcagtacagcagcgacagatggttctacccttcggacctctcctgctgaccacggtggtagtgtgggctcggagagcgggggcagtgcagtggactcagtggctggcgagcacagtgtatctggccggagcagtgcttatggcgatgctacagctgaggggcatccggctggaccaggaagtgtcagctcaagcactggagccatcagcaccaccactgggcaccaggagggagatggctccgagggagaaggagaaggagaaactgaaggagatgtccacactagcaacaggctgcacatggtccgtctaatgctgttggagagattactgcagaccctgcctcaattacgaaacgttggcggtgtccgggccatcccatacatgcaggtcattctaatgctcactacagatctggatggagaagatgagaaagacaagggggccctagacaacctgctctcccagcttattgctgagttgggtatggataaaaaggatgtctccaagaagaatgagcgcagcgccctgaatgaagtccatctggtagtaatgagactcctgagtgtcttcatgtcccgcaccaaatctggatccaagtcttccatatgtgagtcatcttccctcatctccagtgccacagcagcagctctactgagctctggggctgtggactactgcctgcacgtgctcaaatcactgctggaatattggaagagccaacagaatgacgaggagcctgtggctaccagccagttgctgaaaccacatactacctcctccccacctgacatgagcccattctttctccgccagtatgtgaagggtcatgctgctgatgtgtttgaggcctatactcagcttctaacagaaatggtactgaggcttccttaccaaatcaaaaagattactgacaccaattctcgaatcccacctcctgtctttgaccactcgtggttttactttctctccgagtacctcatgatccagcagactccatttgtgcgccgtcaagtccgcaaacttctgctcttcatctgtggatccaaagagaagtaccgccagctccgggatttgcacaccctggactctcacgtgcgtgggatcaagaagctgctagaagagcaggggatattcctccgggcaagtgtggttacagccagctcaggctccgccttgcaatatgacacactcatcagcctgatggagcacctgaaagcctgtgcagagattgccgcccagcgaaccatcaactggcagaaattctgcatcaaagatgactccgtcctgtacttcctcctccaagtcagtttccttgtggatgagggcgtgtccccagtgctgctgcaactgctctcctgtgctctctgcggcagcaaggtgctcgctgcactggcagcctcttcgggatcctccagtgcttcttcctcctcagcccctgtggctgccagttctggacaagccacaacacagtccaagtcttccactaaaaagagcaagaaagaagaaaaagaaaaggagaaagatggtgagacctctggcagccaggaggaccagctgtgcacagctctggtgaaccagctgaacaaatttgccgataaggaaaccctgatccagttcctgcgttgtttcctgttagagtccaattcttcctcggtgcgctggcaggcccactgtctgacactgcacatctacagaaattccagcaaatctcaacaggagctcctgctagatctgatgtggtccatctggccagaactcccagcctatggtcgtaaggctgcccagtttgtggacctactaggatatttctccctgaaaactccacaaacagagaagaagttgaaggagtattcacagaaggctgtggagattctgcggactcaaaaccatattcttaccaaccaccccaactcgaacatttataacactttgtctggcttagtggagtttgatggctattacctggagagcgatccctgcctggtgtgtaataacccggaagtaccgttctgttatatcaagctgtcttccattaaagtggacacgcggtacaccaccacccagcaggttgtgaagctcattggcagtcacaccatcagcaaagtgacagtgaaaatcggggatctgaaacggaccaagatggtgcggaccatcaacctgtattataacaaccgaaccgtgcaggccatcgtggagttgaaaaacaagccagctcgctggcacaaagccaagaaggttcagctgacccctggacagacagaggtgaagattgacctgccgttgcccattgtggcctccaatctgatgattgagtttgcagacttctatgaaaactaccaggcctccacagagaccctgcagtgccctcgctgtagtgcctcggtccctgccaacccaggagtctgtggcaactgtggagagaatgtgtaccagtgtcacaaatgcagatccatcaactacgatgaaaaggatcccttcctctgcaatgcctgtggcttctgtaaatatgcccgcttcgacttcatgctctatgccaagccttgctgtgcagtggatcccattgagaatgaagaagaccggaagaaggctgtatccaacatcaatacacttttggacaaagctgatcgagtgtatcatcagctgatgggacaccggccacagctggagaacctgctctgcaaagtgaatgaggcagctccagaaaagccacaggatgactcaggaacagcagggggcatcagctccacttctgccagtgtgaatcgttacatcctgcagttggctcaggagtattgtggagactgcaagaactcttttgatgaactctccaaaatcatccagaaagtctttgcttcgcgcaaagagttgttggaatatgacctacagcagagggaagcagccactaaatcatcccggacctccgtgcagcccacattcactgccagccagtaccgtgccttatccgtcctgggctgtggccacacatcctccaccaagtgctatggctgcgcctcggctgtcacagaacattgtatcacactacttcgggccctggccaccaacccagccttgaggcacatccttgtctcccagggccttatccgggagctctttgattataatcttcgccgaggggctgcggccatgcgggaggaggtccgccagctcatgtgcctcctaactcgagacaacccagaagccacccaacagatgaatgacctgattattggcaaggtctccacagccctgaagggccactgggccaaccccgatctggcaagtagcctgcagtatgaaatgctgctgctgacggattctatctccaaggaggacagctgctgggagctccggttacgctgtgctctcagccttttcctcatggctgtgaacattaagactcctgtggtggttgaaaacattaccctcatgtgcctgaggatcttgcagaagctgataaaaccacctgctcccactagcaagaagaacaaggatgtccccgtcgaggccctcaccacggtgaagccatactgcaatgagatccatgcccaggctcaactgtggctcaagagagaccccaaggcatcctatgatgcctggaagaagtgtcttcctatcagagggatagatggcaatgggaaagcccccagcaaatcagagctccgccatctctatttgactgagaagtatgtgtggaggtggaaacagttcctgagtcgtcgggggaagaggacctcccccttggatctcaaactggggcataacaactggctgcgacaagtgcttttcactccagcaacgcaggccgcacggcaggcagcctgtaccattgtggaagctctagccaccattcccagccgcaagcagcaggtcctggacctgcttaccagttacctggatgagctgagcatagctggggagtgtgcagctgagtacctggctctctaccagaagctcatcacttctgcgcactggaaagtctacttggcagctcggggagtcctaccctatgtgggcaacctcatcaccaaggaaatagctcgtctgctggccctggaggaggctaccctgagtaccgatctgcagcagggttatgcccttaaaagtctcacaggccttctctcctcctttgttgaggtggaatccatcaaaagacattttaaaagtcgcttggtgggtactgtgctgaatggatacctgtgcttgcggaagctggtggtgcagaggaccaagctgatcgatgagacgcaggacatgctgctggagatgctggaggacatgaccacaggtacagaatcagaaaccaaggccttcatggctgtgtgcattgagacagccaagcgctacaatctggatgactaccggaccccggtgttcatcttcgagaggctctgcagcatcatttatcctgaggagaatgaagtcactgagttctttgtgaccctggagaaggatccccaacaagaagacttcttacagggcaggatgcctgggaacccgtatagcagcaatgagccaggcatcgggccgctgatgagggatataaagaacaagatttgccaggactgtgacttagtggccctcctggaagatgacagtggcatggagcttctagtgaacaataaaatcattagtttggaccttcctgtggctgaagtttacaagaaagtctggtgtaccacgaatgagggagagcccatgaggattgtttatcgtatgcgggggctgctgggcgatgccacagaggagttcattgagtccctggactctactacagatgaaactatgacccagtattcttactgtatttacatttgctgtaattattgcaaaaaagagagagagcagaagaagaagaagaagaagaagaagttcctgagcattatgtggtgcgagaagagatgaaggctgtctagtgtctgaccgtttgtaaggtattgctccatagggggtatggagcgt

SEQ ID NO: 356705 - DNA, 1507 bp, Homo sapiens
gagcacatatactaaaattggaacgatacagagaagattagcatggcccctgcgcaaggatgacacgcaaattcgtgaagcgttccatattttaggcggtatgagtttggctgggggccgggcaccccggaagaccgctgggaaccggctttctgggcttttggaggcagaggaggaagatgagttctaccagacgacttatgggggtttcacagaggaatccggagatgatgagtatcaaggggaccagtcagacacagaggacgaagtggactctgactttgacattgatgaaggggatgaaccatccagtgatggagaagcagaagagccaagaaggaagcgccgagtagtcaccaaggcctataaggaacctctcaagagcttaaggcctcgaaaggtcaacaccccggctggtagctctcagaaggcgcgagaagagaaggcactactgccattagaactacaagatgacggctctgacagtcggaagtctatgcgtcagtctacagctgagcatacacgacaaacgttccttcgggtacaggagaggcagggccagtcaagacggcgaaaggggccccactgtgagcggccactaacccaggaggaactgctccgggaggccaagatcacagaagagcttaatttacggtcactggagacatatgagcggctcgaggctgataaaaagaagcaggttcataagaagcggaagtgccccgggcccataatcacctatcattcagtgacagtgccacttgttggggagccaggccccaaggaagagaacgttgacatagaaggacttgatcctgctccctcggtgtctgcattgactcctcatgctgggactggacccgtcaacccccctgctcgctgctcacgtaccttcatcacttttagtgatgatgcaactttcgaggaatggttcccccaagggcggcccccaaaagtccctgttcgtgaggtctgtccagtgacccatcgtccagccctataccgggaccctgttacagacataccctatgccactgctcgagccttcaagatcattcgtgaggcttacaagaagtacattactgcccatggactgccgcccactgcctcagccctgggccccggcccgccacctcctgagcccctccctggctctgggccccgagccttgcgccagaaaattgtcattaaatgaagagatgtctagtcctcagaaacttctttcctgccctgattggggctcttgctgttccgtttcttctccctgcttctcccctttgtcatctctgatctttgcctaatctgtttctttttccttttcccctagttcttacaggtttcgttgtgttttttaatctaataaaatagaaagatccctttaagaagagaaacgacaggaggagacaagagttgtgcgcgatggtgagtcctgttacaagtcgaggacgccgcgaatttagtagaggtggaggccccgggatatcggtgcggtaccggcgggcgtgag

SEQ ID NO: 356706 - DNA, 6933 bp, Homo sapiens
gtgacctagaggttccgccacaagcgcgatctcaaaggtccaggtctctttggatgagcatttttctaagatggctgctgagactgatcctcataagtcgtctgagattaccaagaacctacttccagccacgctgcaactcattgacacctatgcatcgttcaccagagcctatttgctgcaaaactttaatgaagagggaacaactgagaaaccttccaaggagaaactgcaaggctttgctgctgttttggctattggctctagcaggtgcaaggcaaatactctgggtccgacactggttcagaatttgccatcgtcagtgcagactgtgtgtgagtcctggaacaacatcaataccaatgaatttcccaatattggatcctggcgcaatgcctttgccaatgacaccatcccttcagagagttatattagtgcagtgcaggctgcacacctggggactctctgtagccaaagtctgcccctggctgcttccctgaagcataccctcctctcactggtcaggttgactggagatcttattgtttggtcagatgagatgaacccaccacaggtaattcggacactgctacctcttcttttggaatcaagcactgagagtgttgccgagatcagtagcaactccctggaacgcatcttgggccctgctgagtctgatgagttcttggctcgtgtttatgagaagctgatcactggttgttacaacattctggccaatcatgcagatcctaacagtggactggatgaatccatcctggaggaatgtctccagtacttggaaaagcagctggaaagtagccaggctcgtaaagctatggaggagtttttctctgacagtggagaacttgtacagatcatgatggcaacagccaatgagaacctctctgctaaattctgtaaccgagttttgaaattcttcaccaaactcttccagctgactgagaagagccctaacccgagcctgttgcatctctgtggctccctggcacaactggcctgtgtggaacctgtgcgcctgcaggcctggctcacccgcatgactacatcgcccccaaaagattctgatcagctggatgtaattcaggagaaccggcagctgctgcagttactgaccacatacattgttcgggaaaacagccaagttggggaaggtgtgtgtgctgttcttctgggcaccctgactcccatggcaacagagatgctggccaacggtgatgggactggcttccctgaacttatggttgtgatggccactctggccagtgcaggtcaaggtgctggtcaccttcagcttcataatgctgctgtggattggctgagcagatgcaagaaatacctgtcacagaagaatgtagttgaaaaactgaatgccaatgtaatgcatggaaagcatgtgatgatcttggagtgcacatgccatatcatgtcttacttggctgatgtcacgaatgccctgagccagagtaatggtcaaggcccaagtcatctctcagtggatggggaagagcgggccattgaagtagactcagactgggtggaggagttggcggtggaagaggaagattcccaggctgaggattcagatgaagattctctttgcaataaactctgcacttttacgatcacacagaaagaattcatgaaccagcattggtaccactgtcacacctgtaaaatggtggatggcgtgggtgtctgcacagtgtgtgctaaggtgtgccacaaggatcatgagatttcctatgccaagtatggatccttcttctgtgactgtggagccaaggaagatggcagctgtttggctctggtgaagagaactcctagcagtggcatgagctctaccatgaaggagtcggcatttcagagtgaacccaggatttcagagagtctagtgcgtcatgccagcacctcctcgccagctgacaaagccaaggttaccatcagtgatggaaaggttgctgacgaagagaagcccaagaagagcagcctctgccgcacagtagagggctgccgggaggaattacagaaccaggccaatttctccttcgctcctctcgtgttagacatgcttaatttccttatggatgccattcagaccaacttccagcaagcttcagccgtcgggagcagcagccgtgctcagcaagccctcagtgagctacacactgtggagaaggcagtggagatgacagaccagctgatggttcccaccttagggtcccaggaaggtgcctttgagaatgtgcggatgaattacagtggagaccagggccagaccatccggcagctgatcagtgctcatgtgctcaggcgggtggctatgtgtgtgctctcctctccccatgggcgccgccaacatttggctgtcagccatgagaagggcaagatcaccgttctgcagctctctgcactcctgaagcaagcagattccagcaaaaggaagttaactctgacccgcttggcttctgccccagttccttttactgtgttgagcctcacaggaaatccctgcaaggaagactacttggcggtttgtgggctaaaggactgtcatgtgctcacctttagtagctcaggctctgtttcggatcacttggttttgcaccctcagttggcaacggggaacttcatcatcaaagccgtgtggttacctggttcacagaccgagttagcaattgtcaccgcagactttgttaagatttatgacctgtgtgttgatgccttgagtccaaccttctattttctcctgccaagctcaaagataagagatgttaccttccttttcaatgaggagggaaagaacatcattgttataatgtcttcggctgggtacatctatactcagcttatggaagaggccagcagtgcccagcagggacccttctatgtcactaatgtgttggaaatcaatcatgaggacctgaaggacagtaacagccaggtggcgggcggtggtgtgtccgtgtactactcccacgtgttgcagatgttgttcttcagctattgtcaaggcaaatcattcgcagccaccatcagcaggacaaccctggaggtgttgcaactcttccccatcaacatcaaaagttccaatggtggcagtaagacttctcctgctctttgccagtggtctgaggtgatgaaccaccctggcttggtgtgctgtgtccagcaaactacaggggtgccgctggtagttatggtgaaaccagacacttttcttatccaggagattaagactcttcctgctaaagcgaagatccaagacatggttgctattaggcacacggcctgcaatgagcagcagcggacaacaatgattctgctgtgtgaggatggcagcctgcgcatttacatggccaacgtggagaacacctcctactggctgcagccatccctgcagcccagcagtgtcatcagcatcatgaagcctgttcgaaagcgcaaaacagctacaatcacaacccgcacgtctagccaggtgactttccccattgacttttttgaacacaaccagcagctgacagatgtggagtttggtggtaacgacctcctacaggtctataatgcacaacagataaaacaccggctgaattccactggcatgtatgtggccaacaccaagcccggaggcttcaccattgagattagtaacaacaatagcactatggtgatgacaggcatgcggatccagattgggactcaagcaatagaacgggccccgtcatatatcgagatcttcggcagaactatgcagctcaacctgagtcgctcacgctggtttgacttccccttcaccagagaagaagccctgcaggctgataagaagctgaacctcttcattggggcctcggtggatccagcaggtgtcaccatgatagatgctgtaaaaatttatggcaagactaaggagcagtttggctggcctgatgagcccccagaagaattcccttctgcctctgtcagcaacatctgcccttcaaatctgaaccagagcaacggcactggagatagcgactcagctgcccccactacgaccagtggaactgtcctggagaggctggttgtgagttctttagaagccctggaaagctgctttgccgttggcccaatcatcgagaaggagagaaacaagaatgctgctcaggagctggccactttgctgttgtccctgccagcacctgccagtgtccagcagcagtccaagagccttctggccagcctgcacaccagccgctcggcctaccacagccacaaggatcaggccttgctgagcaaagctgtgcagtgtctcaacacatctagcaaagagggcaaggatttggaccctgaggtgttccagaggctagtgatcacagctcgctccattgccatcatgcgccccaacaaccttgtccactttacggagtcaaagctgccccagatggaaacagactgtttttttcctagatgtgcctgctggagtctagggatagttggcatattgattggggccccacttgaaactccctccccaggcaagcttccttgacctgagttaaccttaaaacaaattaaattccatctcagatttaccatcgttgataattttctttctcctgcttagaaggaatggatgaagggaaggaaccgcagaagcagttggaaggagattgctgtagtttcatcacccagcttgtgaaccacttctggaaactccatgcatccaaacccaagaatgccttcttggcacctgcctgccttccaggactaactcatattgaagctactgtcaatgctctggtggacatcatccatggctactgtacctgtgagctggattgtattaacacagcatccaagatctacatgcagatgctcttgtgtcctgatcctgctgtgagcttctcttgtaaacaagctctaattcgagtcctaaggcccaggaacaaacggagacatgtgactttaccctcttcccctcgaagcaacactccaatgggagacaaggatgatgatgacgatgatgatgcagatgagaaaatgcagtcatcagggatcccgaatggtggtcacatccgtcaggaaagccaggaacagagtgaggtggaccatggagattttgagatggtgtctgagtcgatggtcctggagacagctgaaaatgtcaacaatggcaacccctctcccctggaggccctgctggcaggcgcagagggcttcccccccatgctggacatcccacctgatgcagatgacgagaccatggttgaactagccattgccctgagcctgcagcaggaccaacaaggcagcagcagcagtgccctgggcctgcagagcctgggactgtccggccaggcacccagctcttcctctctggacgcaggaaccctctctgacaccacagcatcagctccagcctcagacgacgagggcagtacagcagcgacagatggttctacccttcggacctctcctgctgaccacggtggtagtgtgggctcggagagcgggggcagtgcagtggactcagtggctggcgagcacagtgtatctggccggagcagtgcttatggcgatgctacagctgaggggcatccggctggaccaggaagtgtcagctcaagcactggagccatcagcaccaccactgggcaccaggagggagatggctccgagggagaaggagaaggagaaactgaaggagatgtccacactagcaacaggctgcacatggtccgtctaatgctgttggagagattactgcagaccctgcctcaattacgaaacgttggcggtgtccgggccatcccatacatgcaggtcattctaatgctcactacagatctggatggagaagatgagaaagacaagggggccctagacaacctgctctcccagcttattgctgagttgggtatggataaaaaggatgtctccaagaagaatgagcgcagcgccctgaatgaagtccatctggtagtaatgagactcctgagtgtcttcatgtcccgcaccaaatctggatccaagtcttccatatgtgagtcatcttccctcatctccagtgccacagcagcagctctactgagctctggggctgtggactactgcctgcacgtgctcaaatcactgctggaatattggaagagccaacagaatgacgaggagcctgtggctaccagccagttgctgaaaccacatactacctcctccccacctgacatgagcccattctttctccgccagtatgtgaagggtcatgctgctgatgtgtttgaggcctatactcagcttctaacagaaatggtactgaggcttccttaccaaatcaaaaagattactgacaccaattctcgaatcccacctcctgtctttgaccactcgtggttttactttctctccgagtacctcatgatccagcagactccatttgtgcgccgtcaagtccgcaaacttctgctcttcatctgtggatccaaagagaagtaccgccagctccgggatttgcacaccctggactctcacgtgcgtgggatcaagaagctgctagaagagcaggggatattcctccgggcaagtgtggttacagccagctcaggctccgccttgcaatatgacacactcatcagcctgatggagcacctgaaagcctgtgcagagattgccgcccagcgaaccatcaactggcagaaattctgcatcaaagatgactccgtcctgtacttcctcctccaagtcagtttccttgtggatgagggcgtgtccccagtgctgctgcaactgctctcctgtgctctctgcggcagcaaggtgctcgctgcactggcagcctcttcgggatcctccagtgcttcttcctcctcagcccctgtggctgccagttctggacaagccacaacacagtccaagtcttccactaaaaagagcaag

SEQ ID NO: 356707 - DNA, 1275 bp, Homo sapiens
gagcacatatactaaaattggaacgatacagagaagattagcatggcccctgcgcaaggatgacacgcaaattcgtgaagcgttccatattttaggcggtatgagtttggctgggggccgggcaccccggaagaccgctgggaaccggctttctgggcttttggaggcagaggaggaagatgagttctaccagacgacttatgggggtttcacagaggaatccggagatgatgagtatcaaggggaccagtcagacacagaggacgaagtggactctgactttgacattgatgaaggggatgaaccatccagtgatggagaagcagaagagccaagaaggaagcgccgagtagtcaccaaggcctataaggaacctctcaagagcttaaggcctcgaaaggtcaacaccccggctggtagctctcagaaggcgcgagaagagaaggcactactgccattagaactacaagatgacggctctgacagtcggaagtctatgcgtcagtctacagctgagcatacacgacaaacgttccttcgggtacaggagaggcagggccagtcaagacggcgaaaggggccccactgtgagcggccactaacccaggaggaactgctccgggaggccaagatcacagaagagcttaatttacggtcactggagacatatgagcggctcgaggctgataaaaagaagcaggttcataagaagcggaagtgccccgggcccataatcacctatcattcagtgacagtgccacttgttggggagccaggccccaaggaagagaacgttgacatagaaggacttgatcctgctccctcggtgtctgcattgactcctcatgctgggactggacccgtcaacccccctgctcgctgctcacgtaccttcatcacttttagtgatgatgcaactttcgaggaatggttcccccaagggcggcccccaaaagtccctgttcgtgaggtctgtccagtgacccatcgtccagccctataccgggaccctgttacagacataccctatgccactgctcgagccttcaagatcattcgtgaggcttacaagaagtacattactgcccatggactgccgcccactgcctcagccctgggccccggcccgccacctcctgagcccctccctggctctgggccccgagccttgcgcgtcatctctgatctttgcctaatctgtttctttttccttttcccctagttcttacaggtttcgttgtgttttttaatctaataaaatagaaagatcccttt

SEQ ID NO: 356708 - DNA, 6457 bp, Homo sapiens
gtgacctagaggttccgccacaagcgcgatctcaaaggtccaggtctctttggatgagcatttttctaagatggctgctgagactgatcctcataagtcgtctgagattaccaagaacctacttccagccacgctgcaactcattgacacctatgcatcgttcaccagagcctatttgctgcaaaactttaatgaagagggaacaactgagaaaccttccaaggagaaactgcaaggctttgctgctgttttggctattggctctagcaggtgcaaggcaaatactctgggtccgacactggttcagaatttgccatcgtcagtgcagactgtgtgtgagtcctggaacaacatcaataccaatgaatttcccaatattggatcctggcgcaatgcctttgccaatgacaccatcccttcagagagttatattagtgcagtgcaggctgcacacctggggactctctgtagccaaagtctgcccctggctgcttccctgaagcataccctcctctcactggtcaggttgactggagatcttattgtttggtcagatgagatgaacccaccacaggtaattcggacactgctacctcttcttttggaatcaagcactgagagtgttgccgagatcagtagcaactccctggaacgcatcttgggccctgctgagtctgatgagttcttggctcgtgtttatgagaagctgatcactggttgttacaacattctggccaatcatgcagatcctaacagtggactggatgaatccatcctggaggaatgtctccagtacttggaaaagcagctggaaagtagccaggctcgtaaagctatggaggagtttttctctgacagtggagaacttgtacagatcatgatggcaacagccaatgagaacctctctgctaaattctgtaaccgagttttgaaattcttcaccaaactcttccagctgactgagaagagccctaacccgagcctgttgcatctctgtggctccctggcacaactggcctgtgtggaacctgtgcgcctgcaggcctggctcacccgcatgactacatcgcccccaaaagattctgatcagctggatgtaattcaggagaaccggcagctgctgcagttactgaccacatacattgttcgggaaaacagccaagttggggaaggtgtgtgtgctgttcttctgggcaccctgactcccatggcaacagagatgctggccaacggtgatgggactggcttccctgaacttatggttgtgatggccactctggccagtgcaggtcaaggtgctggtcaccttcagcttcataatgctgctgtggattggctgagcagatgcaagaaatacctgtcacagaagaatgtagttgaaaaactgaatgccaatgtaatgcatggaaagcatgtgatgatcttggagtgcacatgccatatcatgtcttacttggctgatgtcacgaatgccctgagccagagtaatggtcaaggcccaagtcatctctcagtggatggggaagagcgggccattgaagtagactcagactgggtggaggagttggcggtggaagaggaagattcccaggctgaggattcagatgaagattctctttgcaataaactctgcacttttacgatcacacagaaagaattcatgaaccagcattggtaccactgtcacacctgtaaaatggtggatggcgtgggtgtctgcacagtgtgtgctaaggtgtgccacaaggatcatgagatttcctatgccaagtatggatccttcttctgtgactgtggagccaaggaagatggcagctgtttggctctggtgaagagaactcctagcagtggcatgagctctaccatgaaggagtcggcatttcagagtgaacccaggatttcagagagtctagtgcgtcatgccagcacctcctcgccagctgacaaagccaaggttaccatcagtgatggaaaggttgctgacgaagagaagcccaagaagagcagcctctgccgcacagtagagggctgccgggaggaattacagaaccaggccaatttctccttcgctcctctcgtgttagacatgcttaatttccttatggatgccattcagaccaacttccagcaagcttcagccgtcgggagcagcagccgtgctcagcaagccctcagtgagctacacactgtggagaaggcagtggagatgacagaccagctgatggttcccaccttagggtcccaggaaggtgcctttgagaatgtgcggatgaattacagtggagaccagggccagaccatccggcagctgatcagtgctcatgtgctcaggcgggtggctatgtgtgtgctctcctctccccatgggcgccgccaacatttggctgtcagccatgagaagggcaagatcaccgttctgcagctctctgcactcctgaagcaagcagattccagcaaaaggaagttaactctgacccgcttggcttctgccccagttccttttactgtgttgagcctcacaggaaatccctgcaaggaagactacttggcggtttgtgggctaaaggactgtcatgtgctcacctttagtagctcaggctctgtttcggatcacttggttttgcaccctcagttggcaacggggaacttcatcatcaaagccgtgtggttacctggttcacagaccgagttagcaattgtcaccgcagactttgttaagatttatgacctgtgtgttgatgccttgagtccaaccttctattttctcctgccaagctcaaagataagagatgttaccttccttttcaatgaggagggaaagaacatcattgttataatgtcttcggctgggtacatctatactcagcttatggaagaggccagcagtgcccagcagggacccttctatgtcactaatgtgttggaaatcaatcatgaggacctgaaggacagtaacagccaggtggcgggcggtggtgtgtccgtgtactactcccacgtgttgcagatgttgttcttcagctattgtcaaggcaaatcattcgcagccaccatcagcaggacaaccctggaggtgttgcaactcttccccatcaacatcaaaagttccaatggtggcagtaagacttctcctgctctttgccagtggtctgaggtgatgaaccaccctggcttggtgtgctgtgtccagcaaactacaggggtgccgctggtagttatggtgaaaccagacacttttcttatccaggagattaagactcttcctgctaaagcgaagatccaagacatggttgctattaggcacacggcctgcaatgagcagcagcggacaacaatgattctgctgtgtgaggatggcagcctgcgcatttacatggccaacgtggagaacacctcctactggctgcagccatccctgcagcccagcagtgtcatcagcatcatgaagcctgttcgaaagcgcaaaacagctacaatcacaacccgcacgtctagccaggtgactttccccattgacttttttgaacacaaccagcagctgacagatgtggagtttggtggtaacgacctcctacaggtctataatgcacaacagataaaacaccggctgaattccactggcatgtatgtggccaacaccaagcccggaggcttcaccattgagattagtaacaacaatagcactatggtgatgacaggcatgcggatccagattgggactcaagcaatagaacgggccccgtcatatatcgagatcttcggcagaactatgcagctcaacctgagtcgctcacgctggtttgacttccccttcaccagagaagaagccctgcaggctgataagaagctgaacctcttcattggggcctcggtggatccagcaggtgtcaccatgatagatgctgtaaaaatttatggcaagactaaggagcagtttggctggcctgatgagcccccagaagaattcccttctgcctctgtcagcaacatctgcccttcaaatctgaaccagagcaacggcactggagatagcgactcagctgcccccactacgaccagtggaactgtcctggagaggctggttgtgagttctttagaagccctggaaagctgctttgccgttggcccaatcatcgagaaggagagaaacaagaatgctgctcaggagctggccactttgctgttgtccctgccagcacctgccagtgtccagcagcagtccaagagccttctggccagcctgcacaccagccgctcggcctaccacagccacaaggatcaggccttgctgagcaaagctgtgcagtgtctcaacacatctagcaaagagggcaaggatttggaccctgaggtgttccagaggctagtgatcacagctcgctccattgccatcatgcgccccaacaaccttgtccactttacggagtcaaagctgccccagatggaaacagactgtttttttcctagatgtgcctgctggagtctagggatagttggcatattgattggggccccacttgaaactccctccccaggcaagcttccttgacctgagttaaccttaaaacaaattaaattccatctcagatttaccatcgttgataattttctttctcctgcttagaaggaatggatgaagggaaggaaccgcagaagcagttggaaggagattgctgtagtttcatcacccagcttgtgaaccacttctggaaactccatgcatccaaacccaagaatgccttcttggcacctgcctgccttccaggactaactcatattgaagctactgtcaatgctctggtggacatcatccatggctactgtacctgtgagctggattgtattaacacagcatccaagatctacatgcagatgctcttgtgtcctgatcctgctgtgagcttctcttgtaaacaagctctaattcgagtcctaaggcccaggaacaaacggagacatgtgactttaccctcttcccctcgaagcaacactccaatgggagacaaggatgatgatgacgatgatgatgcagatgagaaaatgcagtcatcagggatcccgaatggtggtcacatccgtcaggaaagccaggaacagagtgaggtggaccatggagattttgagatggtgtctgagtcgatggtcctggagacagctgaaaatgtcaacaatggcaacccctctcccctggaggccctgctggcaggcgcagagggcttcccccccatgctggacatcccacctgatgcagatgacgagaccatggttgaactagccattgccctgagcctgcagcaggaccaacaaggcagcagcagcagtgccctgggcctgcagagcctgggactgtccggccaggcacccagctcttcctctctggacgcaggaaccctctctgacaccacagcatcagctccagcctcagacgacgagggcagtacagcagcgacagatggttctacccttcggacctctcctgctgaccacggtggtagtgtgggctcggagagcgggggcagtgcagtggactcagtggctggcgagcacagtgtatctggccggagcagtgcttatggcgatgctacagctgaggggcatccggctggaccaggaagtgtcagctcaagcactggagccatcagcaccaccactgggcaccaggagggagatggctccgagggagaaggagaaggagaaactgaaggagatgtccacactagcaacaggctgcacatggtccgtctaatgctgttggagagattactgcagaccctgcctcaattacgaaacgttggcggtgtccgggccatcccatacatgcaggtcattctaatgctcactacagatctggatggagaagatgagaaagacaagggggccctagacaacctgctctcccagcttattgctgagttgggtatggataaaaaggatgtctccaagaagaatgagcgcagcgccctgaatgaagtccatctggtagtaatgagactcctgagtgtcttcatgtcccgcaccaaatctggatccaagtcttccatatgtgaggtatttttgctttgggttcatgggtttggggaaaggtaagcggattgtctgggtagtgctagggccagcacagaggtggtagtcctctgtaagaataaagccattgttccctgaggggagtaagattctaagctgtcaccttttcaagagcagaacctccaccttttcccgaatcccttccaagctctggtctttggtaacaatccctccaatggaggggtaaaagggtttggaagttccattattgaagagcagggctctcttctgcaaggcacagagtggctaagaggattcccctagtgtatgttgctataaggtatggtaataaagcagagagaaagcaatgtgtgtgtggtgaaaggagattagcataaagcagagaaggtagaaattgaggtaccgtgacggg

SEQ ID NO: 356709 - DNA, 1573 bp, Homo sapiens
gagcacatatactaaaattggaacgatacagagaagattagcatggcccctgcgcaaggatgacacgcaaattcgtgaagcgttccatattttaggcggtatgagtttggctgggggccgggcaccccggaagaccgctgggaaccggctttctgggcttttggaggcagaggaggaagatgagttctaccagacgacttatgggggtttcacagaggaatccggagatgatgagtatcaaggggaccagtcagacacagaggacgaagtggactctgactttgacattgatgaaggggatgaaccatccagtgatggagaagcagaagagccaagaaggaagcgccgagtagtcaccaaggcctataaggaacctctcaagagcttaaggcctcgaaaggtcaacaccccggctggtagctctcagaaggcgcgagaagagaaggcactactgccattagaactacaagatgacggctctgacagtcggaagtctatgcgtcagtctacagctgagcatacacgacaaacgttccttcgggtacaggagaggcagggccagtcaagacggcgaaaggggccccactgtgagcggccactaacccaggaggaactgctccgggaggccaagatcacagaagagcttaatttacggtcactggagacatatgagcggctcgaggctgataaaaagaagcaggttcataagaagcggaagtgccccgggcccataatcacctatcattcagtgacagtgccacttgttggggagccaggccccaaggaagagaacgttgacatagaagggtgagtgaatctcaagaggaaaagagattgtgtgttcagctcatgttctcttggccccattttgcttgcttttctcacacagctctccttaacacttggagatttctttcagattcctaactcccttcagctcaatttctttttctttttttttttttgagacatgatgctgctctgtcacctaggctggaatgcagtggtgcagtctcggctcactgcaacctccacctcctgtgctcaggcgatcctcccaccttagcctcccaagtagctgggagtacagccacacatgctaatttttgtattttttgtagagacggtttcgctgtgttgcccagactcctgggttaaagtaatcgtcccgcttcatcttcctaaaatactgggattacaggtgtgagccaccgcgcccagcccagcttatttctttcttattcctttttcttttagcttctctgttcttctctttcctgtttttccttctagcctagctttcttttcccatcagtcacttagtacgttcctcagaatgttcccaacaccctgcctcctttttctctttcctcatctctctgatttccttctttctttcttttcttttttttttttttttgagatggagtctcgctgctctgtcacccaggctggagtgtaatggcacgatcttggttccatgcaacctccgcctcctggcttcaagtgattctcctgcctcaacctcctgagtagctgtgattacaggcatccgccaccacgcccggctaat

SEQ ID NO: 356710 - DNA, 4579 bp, Homo sapiens
gtgacctagaggttccgccacaagcgcgatctcaaaggtccaggtctctttggatgagcatttttctaagatggctgctgagactgatcctcataagtcgtctgagattaccaagaacctacttccagccacgctgcaactcattgacacctatgcatcgttcaccagagcctatttgctgcaaaactttaatgaagagggaacaactgagaaaccttccaaggagaaactgcaaggctttgctgctgttttggctattggctctagcaggtgcaaggcaaatactctgggtccgacactggttcagaatttgccatcgtcagtgcagactgtgtgtgagtcctggaacaacatcaataccaatgaatttcccaatattggatcctggcgcaatgcctttgccaatgacaccatcccttcagagagttatattagtgcagtgcaggctgcacacctggggactctctgtagccaaagtctgcccctggctgcttccctgaagcataccctcctctcactggtcaggttgactggagatcttattgtttggtcagatgagatgaacccaccacaggtaattcggacactgctacctcttcttttggaatcaagcactgagagtgttgccgagatcagtagcaactccctggaacgcatcttgggccctgctgagtctgatgagttcttggctcgtgtttatgagaagctgatcactggttgttacaacattctggccaatcatgcagatcctaacagtggactggatgaatccatcctggaggaatgtctccagtacttggaaaagcagctggaaagtagccaggctcgtaaagctatggaggagtttttctctgacagtggagaacttgtacagatcatgatggcaacagccaatgagaacctctctgctaaattctgtaaccgagttttgaaattcttcaccaaactcttccagctgactgagaagagccctaacccgagcctgttgcatctctgtggctccctggcacaactggcctgtgtggaacctgtgcgcctgcaggcctggctcacccgcatgactacatcgcccccaaaagattctgatcagctggatgtaattcaggagaaccggcagctgctgcagttactgaccacatacattgttcgggaaaacagccaagttggggaaggtgtgtgtgctgttcttctgggcaccctgactcccatggcaacagagatgctggccaacggtgatgggactggcttccctgaacttatggttgtgatggccactctggccagtgcaggtcaaggtgctggtcaccttcagcttcataatgctgctgtggattggctgagcagatgcaagaaatacctgtcacagaagaatgtagttgaaaaactgaatgccaatgtaatgcatggaaagcatgtgatgatcttggagtgcacatgccatatcatgtcttacttggctgatgtcacgaatgccctgagccagagtaatggtcaaggcccaagtcatctctcagtggatggggaagagcgggccattgaagtagactcagactgggtggaggagttggcggtggaagaggaagattcccaggctgaggattcagatgaagattctctttgcaataaactctgcacttttacgatcacacagaaagaattcatgaaccagcattggtaccactgtcacacctgtaaaatggtggatggcgtgggtgtctgcacagtgtgtgctaaggtgtgccacaaggatcatgagatttcctatgccaagtatggatccttcttctgtgactgtggagccaaggaagatggcagctgtttggctctggtgaagagaactcctagcagtggcatgagctctaccatgaaggagtcggcatttcagagtgaacccaggatttcagagagtctagtgcgtcatgccagcacctcctcgccagctgacaaagccaaggttaccatcagtgatggaaaggttgctgacgaagagaagcccaagaagagcagcctctgccgcacagtagagggctgccgggaggaattacagaaccaggccaatttctccttcgctcctctcgtgttagacatgcttaatttccttatggatgccattcagaccaacttccagcaagcttcagccgtcgggagcagcagccgtgctcagcaagccctcagtgagctacacactgtggagaaggcagtggagatgacagaccagctgatggttcccaccttagggtcccaggaaggtgcctttgagaatgtgcggatgaattacagtggagaccagggccagaccatccggcagctgatcagtgctcatgtgctcaggcgggtggctatgtgtgtgctctcctctccccatgggcgccgccaacatttggctgtcagccatgagaagggcaagatcaccgttctgcagctctctgcactcctgaagcaagcagattccagcaaaaggaagttaactctgacccgcttggcttctgccccagttccttttactgtgttgagcctcacaggaaatccctgcaaggaagactacttggcggtttgtgggctaaaggactgtcatgtgctcacctttagtagctcaggctctgtttcggatcacttggttttgcaccctcagttggcaacggggaacttcatcatcaaagccgtgtggttacctggttcacagaccgagttagcaattgtcaccgcagactttgttaagatttatgacctgtgtgttgatgccttgagtccaaccttctattttctcctgccaagctcaaagataagagatgttaccttccttttcaatgaggagggaaagaacatcattgttataatgtcttcggctgggtacatctatactcagcttatggaagaggccagcagtgcccagcagggacccttctatgtcactaatgtgttggaaatcaatcatgaggacctgaaggacagtaacagccaggtggcgggcggtggtgtgtccgtgtactactcccacgtgttgcagatgttgttcttcagctattgtcaaggcaaatcattcgcagccaccatcagcaggacaaccctggaggtgttgcaactcttccccatcaacatcaaaagttccaatggtggcagtaagacttctcctgctctttgccagtggtctgaggtgatgaaccaccctggcttggtgtgctgtgtccagcaaactacaggggtgccgctggtagttatggtgaaaccagacacttttcttatccaggagattaagactcttcctgctaaagcgaagatccaagacatggttgctattaggcacacggcctgcaatgagcagcagcggacaacaatgattctgctgtgtgaggatggcagcctgcgcatttacatggccaacgtggagaacacctcctactggctgcagccatccctgcagcccagcagtgtcatcagcatcatgaagcctgttcgaaagcgcaaaacagctacaatcacaacccgcacgtctagccaggtgactttccccattgacttttttgaacacaaccagcagctgacagatgtggagtttggtggtaacgacctcctacaggtctataatgcacaacagataaaacaccggctgaattccactggcatgtatgtggccaacaccaagcccggaggcttcaccattgagattagtaacaacaatagcactatggtgatgacaggcatgcggatccagattgggactcaagcaatagaacgggccccgtcatatatcgagatcttcggcagaactatgcagctcaacctgagtcgctcacgctggtttgacttccccttcaccagagaagaagccctgcaggctgataagaagctgaacctcttcagtgagtcaccaacccctggtgcagactctgtcctcattgtgactgcgaaattgggagccactggcctgtggctgtccaacattctgggatctctccactctgctgatttttctgtcctttcatcaggaaactttgagcttcatttgatgtattaaagaggcaaggtgacaggaaaggagtacaccggagcatggtagcagtaaagatagggctgcactgtgttgagtattcatttcaatagtgttgtgtccacctcactaatggggctacttctgtgtttaggccgagaggaggcagattgacatgaaattgcaaggctttcttaacgcacagaggaagacctcaggtcacacatggctgagagatggttggcaatggcttgctatgccactgaaaactaaactctcagaatacaaatccttgagccttactcaagactgcatttctctgtcatttattggccactgtctgatattctttcttctagatatagttgctgttagtgtgaatgatcatgatctgtactttgaacaaagaaagtgtgtagagacccctgggagtgaggggtaggggatacaatactctgaagcagaagaggacccttgcagtgatggttagggactcttctgagtaggagacgtaatcggcttttggtccatggaacttttaccacatgtattcagcatatatacacgattaaagtgctgcaaatatctcag

SEQ ID NO: 356711 - DNA, 554 bp, Homo sapiens
gagcacatatactaaaattggaacgatacagagaagattagcatggcccctgcgcaaggatgacacgcaaattcgtgaagcgttccatattttaggcggtatgagtttggctgggggccgggcaccccggaagaccgctgggaaccggctttctgggcttttggaggcagcctataccgggaccctgttacagacataccctatgccactgctcgagccttcaagatcattcgtgaggcttacaagaagtacattactgcccatggactgccgcccactgcctcagccctgggccccggcccgccacctcctgagcccctccctggctctgggccccgagccttgcgccagaaaattgtcattaaatgaagagatgtctagtcctcagaaacttctttcctgccctgattggggctcttgctgttccgtttcttctccctgcttctcccctttgtcatctctgatctttgcctaatctgtttctttttccttttcccctagttcttacaggtttcgttgtgttttttaatctaataaaatagaaagatcccttt

SEQ ID NO: 356712 - DNA, 405 bp, Homo sapiens
atcaagaaaagtaaactggattatagtttcttaggtcatggtctaccttttgctgttgccttattgagtagtctgaaggttcctgaaaacagcgccttgcgtggggatggggtagaacaaaggcaggttcggtaagagctgcagcggttgcagcagtgtgtgggtcatggtcccaggttgaccagacatctcagcaagcatctgccttgctcagaagatcatgttcaggtgtagtccaaagtcagggagatggctccaggcagcaggtgtggtgcttgtctgggcaatgtggtggagttactcctttcccgtggttggttcctatttcagatggagcacctgaaagcctgtgcagagattgccgcccagcgaaccatcaactggcagaaattctgcatcaaagat

SEQ ID NO: 356713 - DNA, 251 bp, Homo sapiens
ctctggtgaagagaactcctagcagtggcatgagctctaccatgaaggagtcggcatttcagagtgaacccaggatttcagagagtctagtgcgtcatgccagcacctcctcgccagctgacaaagccaaggttaccatcagtgatggaaaggttgctgacgaagagaagcccaagaagagcagcctctgccgcacagtagagggctgccgggaggaattacagaaccaggtggggctgactgatgctccc

SEQ ID NO: 356714 - DNA, 1322 bp, Homo sapiens
tgctttaattccaagcaaatttgttttttaaaatataattattaaacacaaactaaaatactatactgtatacttgtcagtaaacctttttaaagatatggcttaaatcattaaaacaatgttacacttaccatttgaaaatttgtcattttaggaggtgaaaggagcagtgtcattttggctttttggattcagttattatataactaagtatatttaggtgtgaaattaagaagaactgcgtttttaaaaattgctccttcttcttacattagcactaagccaagggacaattacattttaattggtaaagtagatacagtcagcctttcacatacatggtttctgcatcatggattcaaccaaacacggagtgaaaatatttggaaaaaaaattgagtctgtagtgacacgtacagacatgttttcttgtcgttattacataaacaatatagtatagcaactgtttacatagcacttacattgtataggcattgtaagtaatctagagatgatttaaagtactgtatagtgcatagggctatatgcaagtactatgcattttatatcagggacttttaagcatttgcagattttggtatccacagaaggtattggaaccaatccctcatggatactgagggatgactactatgaaaaatttactatactgtaataatttgtagtaaaaatttactgtagtacagtaaaggaaaattaatcttagatgcaaaaatttgagattaaattaccagttcttacttgattactagttcttaatgtcataatgttgatattatgatgtctttttaaggttatattgcctggagatatatttcatggttactaaataattgatttattattagtataaattgtatgttttaaagaaattttttaaagcagaaaagtgcaaaggataatataaaaaacatctttatttttgtcctccttaattaacagcaaattttaaaaacttgctttcagtcactagtttctacatgtgtattcttgtttattatgcatgaagttgaaactttattcattaataaacttattaatgtataaacttttaactttgtcatccatcaaaacagctaactctggtttcccaaaaccagattatgaaatattaggttgagcttttttacacacgaactcaaggagaaactgggaagcaaatttgacacatttgaaatagacacagccaggtgtggtggtatgcacttgtaatcccagcactgtaggaggctggggcagaggaatcatttgagcccaggagctcaagaccagcctgcgcaacatagtgggaccctgtctct

SEQ ID NO: 356715 - DNA, 751 bp, Homo sapiens
taacaaaagttgtgtcagatatcaactggattttcagtttagtctttagggtagataatttataaggacaaattattgtctggctgtgccattataatgcctgtcactatttgttatgggtttaagggtgagtctgcattggatatttcataggttgggagaagtggcagcagaaataggtaactgaaatgttttctaaaatggaagccatatcttaattataccaagaaatattatttaacatgcagataactgagtttcctcagactttgttttaccatttttttggagtggacatacgtgtatagactgacggtttttgttttcttttaagaaatgaatgagctcatttttgtaatatctttttgctctgtaggagtctctacagacctgatgctgttgcacagcctgtgacagagaatgagttttctttggaatctgagattatttcaaaactatacatcccaaagagaaagattatttctccacgatctataaaagatgtgcttcctcctgttgaagaggctgttgacaggtgtctctacctactggaccgttttgcacagcctgtgacaaaggataagtttgctttggaatctgaggtagagtactctcttgtgaaattaattttctcattctgaatctcattttttgtattattttcttctagcaaataataggtagcaattgtctacctatcattgttttatgttagtattaaaacttttattagagataaccattttaaaga

SEQ ID NO: 356716 - DNA, 758 bp, Homo sapiens
taacaaaagttgtgtcagatatcaactggattttcagtttagtctttagggtagataatttataaggacaaattattgtctggctgtgccattataatgcctgtcactatttgttatgggtttaagggtgagtctgcattggatatttcataggttgggagaagtggcagcagaaataggtaactgaaatgttttctaaaatggaagccatatcttaattataccaagaaatattatttaacatgcagataactgagtttcctcagactttgttttaccatttttttggagtggacatacgtgtatagactgacggtttttgttttcttttaagaaatgaatgagctcatttttgtaatatctttttgctctgtaggagtctctacagacctgatgctgttgcacagcctgtgacagagaatgagttttctttggaatctgagattatttcaaaactatacatcccaaagagaaagattatttctccacgatctataaaagatgtgcttcctcctgttgaagaggctgttgacaggtgtctctacctactggaccgttttgcacagcctgtgacaaaggataagtttgctttggaatctgagaatatttcagaaccatactttacgaacagaaggactatttctcaacaatctgcagaaaattagatgctgcatgtggcattgcaaacaggaaatggaacatgttttagccaaatgttgataggaggaagcctccagcactgcaaagcaaattttcct

SEQ ID NO: 356717 - DNA, 976 bp, Homo sapiens
taacaaaagttgtgtcagatatcaactggattttcagtttagtctttagggtagataatttataaggacaaattattgtctggctgtgccattataatgcctgtcactatttgttatgggtttaagggtgagtctgcattggatatttcataggttgggagaagtggcagcagaaataggtaactgaaatgttttctaaaatggaagccatatcttaattataccaagaaatattatttaacatgcagataactgagtttcctcagactttgttttaccatttttttggagtggacatacgtgtatagactgacggtttttgttttcttttaagaaatgaatgagctcatttttgtaatatctttttgctctgtaggagtctctacagacctgatgctgttgcacagcctgtgacagagaatgagttttctttggaatctgagattatttcaaaactatacatcccaaagagaaagattatttctccacgatctataaaagatgtgcttcctcctgttgaagaggctgttgacaggtgtctctacctactggaccgttttgcacagcctgtgacaaaggataagtttgctttggaatctgagaatatttcagaaccatactttacgaacagaaggactatttctcaacaatctgcagaaaatttagatgctgcatgtggcattgacaaaacagaaaatggaaacatgtttgaagaccaaaatgttgataaggaaggaaaagcactaccagcaactggacaaaaagcaaatgtgaatgaaaagatggcaagagaactaaagttgagaatccagaagttgaaaatatcagaagccttcatgactgtggatgacatgagtatttttagaaacgatttttctccaagtagatatctaaagtaatgattgagagcatttcctgccagcagaagcgaatgatacattttcttttctttttttttgagacggagtctcactct

SEQ ID NO: 356718 - DNA, 5595 bp, Homo sapiens
agcggggcggaggcggtgagcgcgggcggcgcggacggcagcggttggcgggcgggtcctccgctgttgcggccgctgcggcctccttgcccgggcttggggcgccgcgctggggaaagccgggggcccggacacattggcgtgagacctgggagtacgttgtgccaaatcattgccacttgccacatgagtgtaaatgatggcggatgccaagtatgtcctctgccgatgggaaaagcgattatggcctgcgaaggttttggcccgaaccgcgacttcaacaaaaaataagagaagaaaggaatattttctagctgtgcaaatcctctccctagaggaaaagttaagtgttgtgttgttttaatactgttttttcccgtgtagatttctgatacttcaatcccctactcccccaaaacagttgaagcccagcccactcttaatgggcttattcaccatttgtgtaattcattaatgctcataataacctcatgagaaagcaactagtttgattttatgtcagtttggaagctgaagatccaaacgaggcattctgtgagatctatggagagattggtacaaacactgaatacatgtaaattatactcagggtagaccctatttgtggttaaaatagggatatttccttttttttttttttttttgactgtttcttaatcagtgccatgccaggaaaatagggatgtttccttcccagagatctgtgtgtcttttttcagaaacgtctgtgacaggcccatcaattttgaaatatttggtttttgagcctgtcactctaaaccagcgtttaacgttcaaaaggcaaataactgatgaccaggcggcacattgttctgctccgtgagtgtctggcactgggaaaggtgtagattgtctagaatgacagcaattccgacgccccagtcagtcctgcgtgattgtggcgagggcgcgtctggcaccgggaaggtgtagatcatctagaatgacggcgattccgacgccccggtcagtcctgcgtgattggcgagggtgcatctgtcgtgagaattcccagttctgaagagagcaaggagactgatcccgcgtagtccaaggcattggctcccctgttgctcttccttgtggagctccccctgccccactccctcctgcctgcatcttcagagctgcctctgaagctcgcttggtccctagctcacactttccctgcggctgggaaggtaattgaatactcgagtttaaaaggaaagcacatccttttaaaccaaaacacacctgctgggctgtaaacagcttttagtgacattaccatctactctgaaaatctaacaaaggagtgatttgtgcagttgaaagtaggatttgcttcataaaagtcacaatttgaattcatttttgcttttaaatccagccaaccttttctgtcttaaaaggaaaaaaaaaaaaaaaccattcaccagggttcttgctgcctgtaacctcaggcagatgaattcctagttggctgtgacttttggtttaagtggaaggttgaggaggaaaatgaaaataattcttttgttatctaaaggaaaacatgtttgaaaatgtcttggcggcgttggctggtggtgtgtaacgtcgattttgtctctgcagaattaaggtgaaaagcactgaagttgagatcctagagaagtctcaaattgaagccattgcttcctcgttagggaacgcgaatcccctgagctgaaggagaaggaaaaatggatccgctttcttaaacctttccagaatttgcccctagaaccactcctattcttgacgcccagaatggtccctcacagaatgaggttcctgcggcacccctggaagaactggcctacagacggtcgcttcgcgtggctctggacgttctgagcgagggctcgatttggagtcaagaaagctctgcagggacaggtagagctgaccggtctctgcgagggaagcccatggagcatgtctcctcgccctgtgattcgaactcctcatctcttccccgcggagacgtgttgggcagttccagacctcacaggaggaggccatgtgtgcaacaaagcctgtcaagttcgttcacttgtgaaaaggaccccgagtgcaaagtggaccacaagaaggggctcaggaaaagtgaaaacccaagaggcccgttggtcctcccagctggaggtggtgcccaagatgagagtgggtccagaatccaccacaaaaattggactcttgcaagtaagaggggaagaaactcagcgcagaaggctagcttgtgcctgaatggatcttccctttcagaggacgacacggagagagacatggggagcaaaggaggcagctgggcagccccgtccttgccctccggggtcagggaggacgatccctgtgccaacgctgagggacacgaccccggtctgccgttgggcagcctcactgcgcccccagcccctgagccctcggcctgctcagagcctggagaatgccctgcgaaaaagaggccgcgcctggatggcagccaaaggccgcctgccgtgcagctggagcccatggcagcaggggccgcaccatcccccgggccggggccagggcccagagagtctgtgaccccgcgcagcaccgccaggctgggcccgcctccctcccacgcctctgcggatgcaaccagatgtcttccttgcccggattcccagaagctggagaaagagtgccagtcttccgaagagtccatggggtctaattccatgcgttctatcctggaggaagacgaggaagacgaggagccaccaagagtccttttataccacgaaccacgttcgtttgaagtaggaatgctagtctggcataaacataaaaaataccccttctggccagcagtggtcaaaagcgtcaggcagagagataagaaagcaagtgtgctatacatcgaaggacacatgaacccgaaaatgaaaggtttcacagtgtctcttaaaagtttaaagcactttgattgtaaagagaaacagacgcttctgaatcaagccagggaggacttcaaccaggacatcggctggtgtgtctccctcatcaccgactacagggtccggttaggctgcgggtcttttgctggctctttcctggaatattacgcggctgatataagctatcctgtccgaaaatccatccagcaggacgtcttggggaccaagcttcctcaactgagcaaggggagccccgaggagcccgtggtggggtgccccctggggcagaggcagccctgccggaaaatgctccccgaccgctcgcgggccgcccgggaccgggccaaccagaagctggtggagtacattgtgaaggccaagggcgcggagagccacctgcgggccatcctaaagagcaggaagccatctcgctggctgcagaccttcctgagctccagccagtacgtgacctgtgtggagacctacctggaggatgaggggcagctggacctggtggtgaagtacctgcagggcgtctaccaggaggtgggggccaaggtgctccagcgcaccaacggcgaccggatccggttcattctggacgtgcttctgcccgaggccatcatctgtgcgatctctgcggtggacgaggtggactacaagacggctgaggagaagtacatcaaggggccttcgctgagctaccgggaaaaagaaatatttgacaaccagctccttgaagagcggaaccggcgccgtcggtgagggagcagccggctgtgctgtcagcggggcctggcggtggaagcgcctccagtgtgcatgagcgtgtctgaagatggggggctcagggggcacgtttgcgtttggacctgtctgtgcgttctcctgcgtggcagtcctgatttccatacttctggagaatccatttcgttaacactgaaagccagttctcttttcctggcagtttttttcattttatttttggcattttttacaagataccgttcgggaaaggcttttgaaaggacggaagcgtattcactgtgcgccagtactcctggctgtgctgtggtttctcccgacgtgcacatcgatctcgtatgtgtggcatctgatattaaacgggaggttttaagaagcgtctgccgtgatcatggagcttcggaagcgggaatggttcttccgggtttgctgttttgtctgtttcccccttgtgtggtttccgcctgcgacagttccagaatttgctctcccactcagtgtgctctgcagctgtgaggaaacagccttcgttagaggcgggagcagagacgagccgctgctctgtgtcgtgtttgctgtggccgcagggagaggagcgggacacgcacctttccaggggcctctgtgtcccgcactgtgtgtgagtggaccgcagcgcgcagccacatgccctggctgccatgggccagaccgcctccacctcccccgcccgcctggcctgtcctgagtgcatttccctgcactgtgtcgtcactgcacagccagtcaccgcggtctcagtcatcggcgcggatggctatgctggggtcccagggtggccgcagcagtcagggtcactgtgggagccctggggtggagtgacaaaccgcattgtcctgtgcccgccatggcagaagcgcagcctttgtatggaggcccaaccgcgctcccgtctggagaagcggcttccggggtgtggctgccgggtcggctctggtccacagcacggtgccggggctgcaggttgttgagggctgtgactccgtggggctcagccaggctccagcagggtcagacgtgctgttaagagcaaagccacagacgatgacttgtccattctcagtggatgctccaggctgtgcctacacagcagtgctggtgacatgtccagggttccagggcccggtggcctgggagctgctttctccccactggctgggctgcatctggccctggctggaggccttgctttgaggggctgtgaccctcttcccccaggccctccccagccgacgacagccaccggagaggagatcggaacacgattgtctcagatgcagggcgctgtgcgggacgaagccgcaaggactctcgtatcgggcccttgggactcgggaggtgccagaggcggcggctgctctggacctcggtgttcactgacctttgtttcacttgcctctgctcgactccgagagcaggaaacccggccgtggcctggcagctccgcctcccatgcccgcacgctggggtctgtcttgtctggagcagtggggcacaccccggaggaggcgggggtcagggctgtcggccttggccccctgctggtcgctgtttcggggactcggggcggccagtaccaccgcctgaggcggggctcagcagcgttgcatgtacgggcctcgtactgcctcatggaaaatcctccggagccgccctccattgtgggttcctgagagtaggacacattgccatggttttgtgggaatcacgcgcccctgatggaacttttctgctgttgtgaagtacttttatccatttgcttctctgctgaccttgccaagttgttcgaggtggaattaaacacctcccagacctc

SEQ ID NO: 356719 - DNA, 6484 bp, Homo sapiens
agcggggcggaggcggtgagcgcgggcggcgcggacggcagcggttggcgggcgggtcctccgctgttgcggccgctgcggcctccttgcccgggcttggggcgccgcgctggggaaagccgggggcccggacacattggcgtgagacctgggagtacgttgtgccaaatcattgccacttgccacatgagtgtaaatgatggcggatgccaagtatgtcctctgccgatgggaaaagcgattatggcctgcgaaggttttggcccgaaccgcgacttcaacaaaaaataagagaagaaaggaatattttctagctgtgcaaatcctctccctagaggaaaagttaagtgttgtgttgttttaatactgttttttcccgtgtagatttctgatacttcaatcccctactcccccaaaacagttgaagcccagcccactcttaatgggcttattcaccatttgtgtaattcattaatgctcataataacctcatgagaaagcaactagtttgattttatgtcagtttggaagctgaagatccaaacgaggcattctgtgagatctatggagagattggtacaaacactgaatacatgtaaattatactcagggtagaccctatttgtggttaaaatagggatatttccttttttttttttttttttgactgtttcttaatcagtgccatgccaggaaaatagggatgtttccttcccagagatctgtgtgtcttttttcagaaacgtctgtgacaggcccatcaattttgaaatatttggtttttgagcctgtcactctaaaccagcgtttaacgttcaaaaggcaaataactgatgaccaggcggcacattgttctgctccgtgagtgtctggcactgggaaaggtgtagattgtctagaatgacagcaattccgacgccccagtcagtcctgcgtgattgtggcgagggcgcgtctggcaccgggaaggtgtagatcatctagaatgacggcgattccgacgccccggtcagtcctgcgtgattggcgagggtgcatctgtcgtgagaattcccagttctgaagagagcaaggagactgatcccgcgtagtccaaggcattggctcccctgttgctcttccttgtggagctccccctgccccactccctcctgcctgcatcttcagagctgcctctgaagctcgcttggtccctagctcacactttccctgcggctgggaaggtaattgaatactcgagtttaaaaggaaagcacatccttttaaaccaaaacacacctgctgggctgtaaacagcttttagtgacattaccatctactctgaaaatctaacaaaggagtgatttgtgcagttgaaagtaggatttgcttcataaaagtcacaatttgaattcatttttgcttttaaatccagccaaccttttctgtcttaaaaggaaaaaaaaaaaaaaaccattcaccagggttcttgctgcctgtaacctcaggcagatgaattcctagttggctgtgacttttggtttaagtggaaggttgaggaggaaaatgaaaataattcttttgttatctaaaggaaaacatgtttgaaaatgtcttggcggcgttggctggtggtgtgtaacgtcgattttgtctctgcagaattaaggtgaaaagcactgaagttgagatcctagagaagtctcaaattgaagccattgcttcctcgttagggaacgcgaatcccctgagctgaaggagaaggaaaaatggatccgctttcttaaacctttccagaatttgcccctagaaccactcctattcttgacgcccagaatggtccctcacagaatgaggttcctgcggcacccctggaagaactggcctacagacggtcgcttcgcgtggctctggacgttctgagcgagggctcgatttggagtcaagaaagctctgcagggacaggtagagctgaccggtctctgcgagggaagcccatggagcatgtctcctcgccctgtgattcgaactcctcatctcttccccgcggagacgtgttgggcagttccagacctcacaggaggaggccatgtgtgcaacaaagcctgtcaagttcgttcacttgtgaaaaggaccccgagtgcaaagtggaccacaagaaggggctcaggaaaagtgaaaacccaagaggcccgttggtcctcccagctggaggtggtgcccaagatgagagtgggtccagaatccaccacaaaaattggactcttgcaagtaagaggggaagaaactcagcgcagaaggctagcttgtgcctgaatggatcttccctttcagaggacgacacggagagagacatggggagcaaaggaggcagctgggcagccccgtccttgccctccggggtcagggaggacgatccctgtgccaacgctgagggacacgaccccggtctgccgttgggcagcctcactgcgcccccagcccctgagccctcggcctgctcagagcctggagaatgccctgcgaaaaagaggccgcgcctggatggcagccaaaggccgcctgccgtgcagctggagcccatggcagcaggggccgcaccatcccccgggccggggccagggcccagagagtctgtgaccccgcgcagcaccgccaggctgggcccgcctccctcccacgcctctgcggatgcaaccagatgtcttccttgcccggattcccagaagctggagaaagagtgccagtcttccgaagagtccatggggtctaattccatgcgttctatcctggaggaagacgaggaagacgaggagccaccaagagtccttttataccacgaaccacgttcgtttgaagtaggaatgctagtctggcataaacataaaaaataccccttctggccagcagtggtcaaaagcgtcaggcagagagataagaaagcaagtgtgctatacatcgaaggacacatgaacccgaaaatgaaaggtttcacagtgtctcttaaaagtttaaagcactttgattgtaaagagaaacagacgcttctgaatcaagccagggaggacttcaaccaggacatcggctggtgtgtctccctcatcaccgactacagggtccggttaggctgcgggtcttttgctggctctttcctggaatattacgcggctgatataagctatcctgtccgaaaatccatccagcaggacgtcttggggaccaagcttcctcaactgagcaaggggagccccgaggagcccgtggtggggtgccccctggggcagaggcagccctgccggaaaatgctccccgaccgctcgcgggccgcccgggaccgggccaaccagaagctggtggagtacattgtgaaggccaagggcgcggagagccacctgcgggccatcctaaagagcaggaagccatctcgctggctgcagaccttcctgagctccagccagtacgtgacctgtgtggagacctacctggaggatgaggggcagctggacctggtggtgaagtacctgcagggcgtctaccaggaggtgggggccaaggtgctccagcgcaccaacggcgaccggatccggttcattctggacgtgcttctgcccgaggccatcatctgtgcgatctctgcggtggacgaggtggactacaagacggctgaggagaagtacatcaaggggccttcgctgagctaccggtaggccgctcccggcgctatctccagccacttgcgtctctgccttgcagtttctatttccacacccacaggcagtttgactccaggctgccgcagcccctctccctcatgaggtggcccaggtgctgggtggtgagctgatcacatacgctgaactcaccctgtgggtcactcctgccccccaggaaggctgtgcccgggtctcccagctggtcgctgtgggcagcacggggccacgggcacgtgcctgggccgtgtctgttcttaatctctttttgcaggggctgatgtttgctttttgcactttcctcccctctttccacagccccatggctgtgtgagaaatacagcaagattaagcagcagcacggcccggtgctttccagcagccagaagaatgctgtgatcaagatgtttctctcacatccgtgtgcttagctgcccttggatgtttggcccccagagcgcctaatcctgtctctgggcatgcggccaggccttgctgggagccaggcggggcccacggggcagtgacaggctgaagactcaactagagtcaaggacagggtctccggccagggtggcttgcgcagccaccgacgtctcccgggcccacagtcacaggagactcctggtgaagacactgaactccctcaccagccccatgtcctccctgggcagggcaggaggggcccctggagaggccagggaggaggtgtggggcctcggtggcattggcaggccacccccgcagagctgcacaaaggtggaatttggccttgtttagggagtgttggcccagctggcttaccaaaacaggaaaggcctttggatacagaaactgggtgttttcctgctggatcttcatggttcccccgtcatgcttgccggaaaaagaaatatttgacaaccagctccttgaagagcggaaccggcgccgtcggtgagggagcagccggctgtgctgtcagcggggcctggcggtggaagcgcctccagtgtgcatgagcgtgtctgaagatggggggctcagggggcacgtttgcgtttggacctgtctgtgcgttctcctgcgtggcagtcctgatttccatacttctggagaatccatttcgttaacactgaaagccagttctcttttcctggcagtttttttcattttatttttggcattttttacaagataccgttcgggaaaggcttttgaaaggacggaagcgtattcactgtgcgccagtactcctggctgtgctgtggtttctcccgacgtgcacatcgatctcgtatgtgtggcatctgatattaaacgggaggttttaagaagcgtctgccgtgatcatggagcttcggaagcgggaatggttcttccgggtttgctgttttgtctgtttcccccttgtgtggtttccgcctgcgacagttccagaatttgctctcccactcagtgtgctctgcagctgtgaggaaacagccttcgttagaggcgggagcagagacgagccgctgctctgtgtcgtgtttgctgtggccgcagggagaggagcgggacacgcacctttccaggggcctctgtgtcccgcactgtgtgtgagtggaccgcagcgcgcagccacatgccctggctgccatgggccagaccgcctccacctcccccgcccgcctggcctgtcctgagtgcatttccctgcactgtgtcgtcactgcacagccagtcaccgcggtctcagtcatcggcgcggatggctatgctggggtcccagggtggccgcagcagtcagggtcactgtgggagccctggggtggagtgacaaaccgcattgtcctgtgcccgccatggcagaagcgcagcctttgtatggaggcccaaccgcgctcccgtctggagaagcggcttccggggtgtggctgccgggtcggctctggtccacagcacggtgccggggctgcaggttgttgagggctgtgactccgtggggctcagccaggctccagcagggtcagacgtgctgttaagagcaaagccacagacgatgacttgtccattctcagtggatgctccaggctgtgcctacacagcagtgctggtgacatgtccagggttccagggcccggtggcctgggagctgctttctccccactggctgggctgcatctggccctggctggaggccttgctttgaggggctgtgaccctcttcccccaggccctccccagccgacgacagccaccggagaggagatcggaacacgattgtctcagatgcagggcgctgtgcgggacgaagccgcaaggactctcgtatcgggcccttgggactcgggaggtgccagaggcggcggctgctctggacctcggtgttcactgacctttgtttcacttgcctctgctcgactccgagagcaggaaacccggccgtggcctggcagctccgcctcccatgcccgcacgctggggtctgtcttgtctggagcagtggggcacaccccggaggaggcgggggtcagggctgtcggccttggccccctgctggtcgctgtttcggggactcggggcggccagtaccaccgcctgaggcggggctcagcagcgttgcatgtacgggcctcgtactgcctcatggaaaatcctccggagccgccctccattgtgggttcctgagagtaggacacattgccatggttttgtgggaatcacgcgcccctgatggaacttttctgctgttgtgaagtacttttatccatttgcttctctgctgaccttgccaagttgttcgaggtggaattaaacacctcccagacctc

SEQ ID NO: 356720 - DNA, 5718 bp, Homo sapiens
agcggggcggaggcggtgagcgcgggcggcgcggacggcagcggttggcgggcgggtcctccgctgttgcggccgctgcggcctccttgcccgggcttggggcgccgcgctggggaaagccgggggcccggacacattggcgtgagacctgggagtacgttgtgccaaatcattgccacttgccacatgagtgtaaatgatggcggatgccaagtatgtcctctgccgatgggaaaagcgattatggcctgcgaaggttttggcccgaaccgcgacttcaacaaaaaataagagaagaaaggaatattttctagctgtgcaaatcctctccctagaggaaaagttaagtgttgtgttgttttaatactgttttttcccgtgtagatttctgatacttcaatcccctactcccccaaaacagttgaagcccagcccactcttaatgggcttattcaccatttgtgtaattcattaatgctcataataacctcatgagaaagcaactagtttgattttatgtcagtttggaagctgaagatccaaacgaggcattctgtgagatctatggagagattggtacaaacactgaatacatgtaaattatactcagggtagaccctatttgtggttaaaatagggatatttccttttttttttttttttttgactgtttcttaatcagtgccatgccaggaaaatagggatgtttccttcccagagatctgtgtgtcttttttcagaaacgtctgtgacaggcccatcaattttgaaatatttggtttttgagcctgtcactctaaaccagcgtttaacgttcaaaaggcaaataactgatgaccaggcggcacattgttctgctccgtgagtgtctggcactgggaaaggtgtagattgtctagaatgacagcaattccgacgccccagtcagtcctgcgtgattgtggcgagggcgcgtctggcaccgggaaggtgtagatcatctagaatgacggcgattccgacgccccggtcagtcctgcgtgattggcgagggtgcatctgtcgtgagaattcccagttctgaagagagcaaggagactgatcccgcgtagtccaaggcattggctcccctgttgctcttccttgtggagctccccctgccccactccctcctgcctgcatcttcagagctgcctctgaagctcgcttggtccctagctcacactttccctgcggctgggaaggtaattgaatactcgagtttaaaaggaaagcacatccttttaaaccaaaacacacctgctgggctgtaaacagcttttagtgacattaccatctactctgaaaatctaacaaaggagtgatttgtgcagttgaaagtaggatttgcttcataaaagtcacaatttgaattcatttttgcttttaaatccagccaaccttttctgtcttaaaaggaaaaaaaaaaaaaaaccattcaccagggttcttgctgcctgtaacctcaggcagatgaattcctagttggctgtgacttttggtttaagtggaaggttgaggaggaaaatgaaaataattcttttgttatctaaaggaaaacatgtttgaaaatgtcttggcggcgttggctggtggtgtgtaacgtcgattttgtctctgcagaattaaggtgaaaagcactgaagttgagatcctagagaagtctcaaattgaagccattgcttcctcgttaggtaagagcgtatttttaagtggccactaggttttcataaaataagaggtcatttgggagaatgtgaaggctcagctttctgggtaaaaattcaccctgttcaccatgtttttcttcatacaagggaacgcgaatcccctgagctgaaggagaaggaaaaatggatccgctttcttaaacctttccagaatttgcccctagaaccactcctattcttgacgcccagaatggtccctcacagaatgaggttcctgcggcacccctggaagaactggcctacagacggtcgcttcgcgtggctctggacgttctgagcgagggctcgatttggagtcaagaaagctctgcagggacaggtagagctgaccggtctctgcgagggaagcccatggagcatgtctcctcgccctgtgattcgaactcctcatctcttccccgcggagacgtgttgggcagttccagacctcacaggaggaggccatgtgtgcaacaaagcctgtcaagttcgttcacttgtgaaaaggaccccgagtgcaaagtggaccacaagaaggggctcaggaaaagtgaaaacccaagaggcccgttggtcctcccagctggaggtggtgcccaagatgagagtgggtccagaatccaccacaaaaattggactcttgcaagtaagaggggaagaaactcagcgcagaaggctagcttgtgcctgaatggatcttccctttcagaggacgacacggagagagacatggggagcaaaggaggcagctgggcagccccgtccttgccctccggggtcagggaggacgatccctgtgccaacgctgagggacacgaccccggtctgccgttgggcagcctcactgcgcccccagcccctgagccctcggcctgctcagagcctggagaatgccctgcgaaaaagaggccgcgcctggatggcagccaaaggccgcctgccgtgcagctggagcccatggcagcaggggccgcaccatcccccgggccggggccagggcccagagagtctgtgaccccgcgcagcaccgccaggctgggcccgcctccctcccacgcctctgcggatgcaaccagatgtcttccttgcccggattcccagaagctggagaaagagtgccagtcttccgaagagtccatggggtctaattccatgcgttctatcctggaggaagacgaggaagacgaggagccaccaagagtccttttataccacgaaccacgttcgtttgaagtaggaatgctagtctggcataaacataaaaaataccccttctggccagcagtggtcaaaagcgtcaggcagagagataagaaagcaagtgtgctatacatcgaaggacacatgaacccgaaaatgaaaggtttcacagtgtctcttaaaagtttaaagcactttgattgtaaagagaaacagacgcttctgaatcaagccagggaggacttcaaccaggacatcggctggtgtgtctccctcatcaccgactacagggtccggttaggctgcgggtcttttgctggctctttcctggaatattacgcggctgatataagctatcctgtccgaaaatccatccagcaggacgtcttggggaccaagcttcctcaactgagcaaggggagccccgaggagcccgtggtggggtgccccctggggcagaggcagccctgccggaaaatgctccccgaccgctcgcgggccgcccgggaccgggccaaccagaagctggtggagtacattgtgaaggccaagggcgcggagagccacctgcgggccatcctaaagagcaggaagccatctcgctggctgcagaccttcctgagctccagccagtacgtgacctgtgtggagacctacctggaggatgaggggcagctggacctggtggtgaagtacctgcagggcgtctaccaggaggtgggggccaaggtgctccagcgcaccaacggcgaccggatccggttcattctggacgtgcttctgcccgaggccatcatctgtgcgatctctgcggtggacgaggtggactacaagacggctgaggagaagtacatcaaggggccttcgctgagctaccgggaaaaagaaatatttgacaaccagctccttgaagagcggaaccggcgccgtcggtgagggagcagccggctgtgctgtcagcggggcctggcggtggaagcgcctccagtgtgcatgagcgtgtctgaagatggggggctcagggggcacgtttgcgtttggacctgtctgtgcgttctcctgcgtggcagtcctgatttccatacttctggagaatccatttcgttaacactgaaagccagttctcttttcctggcagtttttttcattttatttttggcattttttacaagataccgttcgggaaaggcttttgaaaggacggaagcgtattcactgtgcgccagtactcctggctgtgctgtggtttctcccgacgtgcacatcgatctcgtatgtgtggcatctgatattaaacgggaggttttaagaagcgtctgccgtgatcatggagcttcggaagcgggaatggttcttccgggtttgctgttttgtctgtttcccccttgtgtggtttccgcctgcgacagttccagaatttgctctcccactcagtgtgctctgcagctgtgaggaaacagccttcgttagaggcgggagcagagacgagccgctgctctgtgtcgtgtttgctgtggccgcagggagaggagcgggacacgcacctttccaggggcctctgtgtcccgcactgtgtgtgagtggaccgcagcgcgcagccacatgccctggctgccatgggccagaccgcctccacctcccccgcccgcctggcctgtcctgagtgcatttccctgcactgtgtcgtcactgcacagccagtcaccgcggtctcagtcatcggcgcggatggctatgctggggtcccagggtggccgcagcagtcagggtcactgtgggagccctggggtggagtgacaaaccgcattgtcctgtgcccgccatggcagaagcgcagcctttgtatggaggcccaaccgcgctcccgtctggagaagcggcttccggggtgtggctgccgggtcggctctggtccacagcacggtgccggggctgcaggttgttgagggctgtgactccgtggggctcagccaggctccagcagggtcagacgtgctgttaagagcaaagccacagacgatgacttgtccattctcagtggatgctccaggctgtgcctacacagcagtgctggtgacatgtccagggttccagggcccggtggcctgggagctgctttctccccactggctgggctgcatctggccctggctggaggccttgctttgaggggctgtgaccctcttcccccaggccctccccagccgacgacagccaccggagaggagatcggaacacgattgtctcagatgcagggcgctgtgcgggacgaagccgcaaggactctcgtatcgggcccttgggactcgggaggtgccagaggcggcggctgctctggacctcggtgttcactgacctttgtttcacttgcctctgctcgactccgagagcaggaaacccggccgtggcctggcagctccgcctcccatgcccgcacgctggggtctgtcttgtctggagcagtggggcacaccccggaggaggcgggggtcagggctgtcggccttggccccctgctggtcgctgtttcggggactcggggcggccagtaccaccgcctgaggcggggctcagcagcgttgcatgtacgggcctcgtactgcctcatggaaaatcctccggagccgccctccattgtgggttcctgagagtaggacacattgccatggttttgtgggaatcacgcgcccctgatggaacttttctgctgttgtgaagtacttttatccatttgcttctctgctgaccttgccaagttgttcgaggtggaattaaacacctcccagacctc

SEQ ID NO: 356721 - DNA, 6752 bp, Homo sapiens
agcggggcggaggcggtgagcgcgggcggcgcggacggcagcggttggcgggcgggtcctccgctgttgcggccgctgcggcctccttgcccgggcttggggcgccgcgctggggaaagccgggggcccggacacattggcgtgagacctgggagtacgttgtgccaaatcattgccacttgccacatgagtgtaaatgatggcggatgccaagtatgtcctctgccgatgggaaaagcgattatggcctgcgaaggttttggcccgaaccgcgacttcaacaaaaaataagagaagaaaggaatattttctagctgtgcaaatcctctccctagaggaaaagttaagtgttgtgttgttttaatactgttttttcccgtgtagatttctgatacttcaatcccctactcccccaaaacagttgaagcccagcccactcttaatgggcttattcaccatttgtgtaattcattaatgctcataataacctcatgagaaagcaactagtttgattttatgtcagtttggaagctgaagatccaaacgaggcattctgtgagatctatggagagattggtacaaacactgaatacatgtaaattatactcagggtagaccctatttgtggttaaaatagggatatttccttttttttttttttttttgactgtttcttaatcagtgccatgccaggaaaatagggatgtttccttcccagagatctgtgtgtcttttttcagaaacgtctgtgacaggcccatcaattttgaaatatttggtttttgagcctgtcactctaaaccagcgtttaacgttcaaaaggcaaataactgatgaccaggcggcacattgttctgctccgtgagtgtctggcactgggaaaggtgtagattgtctagaatgacagcaattccgacgccccagtcagtcctgcgtgattgtggcgagggcgcgtctggcaccgggaaggtgtagatcatctagaatgacggcgattccgacgccccggtcagtcctgcgtgattggcgagggtgcatctgtcgtgagaattcccagttctgaagagagcaaggagactgatcccgcgtagtccaaggcattggctcccctgttgctcttccttgtggagctccccctgccccactccctcctgcctgcatcttcagagctgcctctgaagctcgcttggtccctagctcacactttccctgcggctgggaaggtaattgaatactcgagtttaaaaggaaagcacatccttttaaaccaaaacacacctgctgggctgtaaacagcttttagtgacattaccatctactctgaaaatctaacaaaggagtgatttgtgcagttgaaagtaggatttgcttcataaaagtcacaatttgaattcatttttgcttttaaatccagccaaccttttctgtcttaaaaggaaaaaaaaaaaaaaaccattcaccagggttcttgctgcctgtaacctcaggcagatgaattcctagttggctgtgacttttggtttaagtggaaggttgaggaggaaaatgaaaataattcttttgttatctaaaggaaaacatgtttgaaaatgtcttggcggcgttggctggtggtgtgtaacgtcgattttgtctctgcagaattaaggtgaaaagcactgaagttgagatcctagagaagtctcaaattgaagccattgcttcctcgttagggaacgcgaatcccctgagctgaaggagaaggaaaaatggatccgctttcttaaacctttccagaatttgcccctagaaccactcctattcttgacgcccagaatggtccctcacagaatgaggttcctgcggcacccctggaagaactggcctacagacggtcgcttcgcgtggctctggacgttctgagcgagggctcgatttggagtcaagaaagctctgcagggacaggtagagctgaccggtctctgcgagggaagcccatggagcatgtctcctcgccctgtgattcgaactcctcatctcttccccgcggagacgtgttgggcagttccagacctcacaggaggaggccatgtgtgcaacaaagcctgtcaagttcgttcacttgtgaaaaggaccccgagtgcaaagtggaccacaagaaggggctcaggaaaagtgaaaacccaagaggcccgttggtcctcccagctggaggtggtgcccaagatgagagtgggtccagaatccaccacaaaaattggactcttgcaagtaagaggggaagaaactcagcgcagaaggctagcttgtgcctgaatggatcttccctttcagaggacgacacggagagagacatggggagcaaaggaggcagctgggcagccccgtccttgccctccggggtcagggaggacgatccctgtgccaacgctgagggacacgaccccggtctgccgttgggcagcctcactgcgcccccagcccctgagccctcggcctgctcagagcctggagaatgccctgcgaaaaagaggccgcgcctggatggcagccaaaggccgcctgccgtgcagctggagcccatggcagcaggggccgcaccatcccccgggccggggccagggcccagagagtctgtgaccccgcgcagcaccgccaggctgggcccgcctccctcccacgcctctgcggatgcaaccagatgtcttccttgcccggattcccagaagctggagaaagagtgccagtcttccgaagagtccatggggtctaattccatgcgttctatcctggaggaagacgaggaagacgaggagccaccaagagtccttttataccacgaaccacgttcgtttgaagtaggaatgctagtctggcataaacataaaaaataccccttctggccagcagtggtcaaaagcgtcaggcagagagataagaaagcaagtgtgctatacatcgaaggacacatgaacccgaaaatgaaaggtttcacagtgtctcttaaaagtttaaagcactttgattgtaaagagaaacagacgcttctgaatcaagccagggaggacttcaaccaggacatcggctggtgtgtctccctcatcaccgactacagggtccggttaggctgcgggtcttttgctggctctttcctggaatattacgcggctgatataagctatcctgtccgaaaatccatccagcaggacgtcttggggaccaagcttcctcaactgagcaaggggagccccgaggagcccgtggtggggtgccccctggggcagaggcagccctgccggaaaatgctccccgaccgctcgcgggccgcccgggaccgggccaaccagaagctggtggagtacattgtgaaggccaagggcgcggagagccacctgcgggccatcctaaagagcaggaagccatctcgctggctgcagaccttcctgagctccagccagtacgtgacctgtgtggagacctacctggaggatgaggggcagctggacctggtggtgaagtacctgcagggcgtctaccaggaggtgggggccaaggtgctccagcgcaccaacggcgaccggatccggttcattctggacgtgcttctgcccgaggccatcatctgtgcgatctctgcggtggacgaggtggactacaagacggctgaggagaagtacatcaaggggccttcgctgagctaccggtaggccgctcccggcgctatctccagccacttgcgtctctgccttgcagtttctatttccacacccacaggcagtttgactccaggctgccgcagcccctctccctcatgaggtggcccaggtgctgggtggtgagctgatcacatacgctgaactcaccctgtgggtcactcctgccccccaggaaggctgtgcccgggtctcccagctggtcgctgtgggcagcacggggccacgggcacgtgcctgggccgtgtctgttcttaatctctttttgcaggggctgatgtttgctttttgcactttcctcccctctttccacagccccatggctgtgtgagaaatacagcaagattaagcagcagcacggcccggtgctttccagcagccagaagaatgctgtgatcaagatgtttctctcacatccgtgtgcttagctgcccttggatgtttggcccccagagcgcctaatcctgtctctgggcatgcggccaggccttgctgggagccaggcggggcccacggggcagtgacaggctgaagactcaactagagtcaaggacagggtctccggccagggtggcttgcgcagccaccgacgtctcccgggcccacagtcacaggagactcctggtgaagacactgaactccctcaccagccccatgtcctccctgggcagggcaggaggggcccctggagaggccagggaggaggtgtggggcctcggtggcattggcaggccacccccgcagagctgcacaaaggtggaatttggccttgtttagggagtgttggcccagctggcttaccaaaacaggaaaggcctttggatacagaaactgggtgttttcctgctggatcttcatggttcccccgtcatgcttgccgtaagaataagtgaggtccggggagggggtaaggtcggagccaggacacctggacccagcctgctggtttgtcctctccctccgtctcagaagcctcttcaccgctccacgcccatctgtggaaatctttcatcctgatttttttttttgagtctgggttgccgacatcaaaacccgttaggagttcatcacagcttccagttgccatgaaagcctcccgtgacctgtgagaatggtgctggtgctgatggagaagttacttgggctgagcacacaggccgtgatttcatcacgccggggacatgctcaaaataacaagccaggaagggagcagccggctgtgctgtcagcggggcctggcggtggaagcgcctccagtgtgcatgagcgtgtctgaagatggggggctcagggggcacgtttgcgtttggacctgtctgtgcgttctcctgcgtggcagtcctgatttccatacttctggagaatccatttcgttaacactgaaagccagttctcttttcctggcagtttttttcattttatttttggcattttttacaagataccgttcgggaaaggcttttgaaaggacggaagcgtattcactgtgcgccagtactcctggctgtgctgtggtttctcccgacgtgcacatcgatctcgtatgtgtggcatctgatattaaacgggaggttttaagaagcgtctgccgtgatcatggagcttcggaagcgggaatggttcttccgggtttgctgttttgtctgtttcccccttgtgtggtttccgcctgcgacagttccagaatttgctctcccactcagtgtgctctgcagctgtgaggaaacagccttcgttagaggcgggagcagagacgagccgctgctctgtgtcgtgtttgctgtggccgcagggagaggagcgggacacgcacctttccaggggcctctgtgtcccgcactgtgtgtgagtggaccgcagcgcgcagccacatgccctggctgccatgggccagaccgcctccacctcccccgcccgcctggcctgtcctgagtgcatttccctgcactgtgtcgtcactgcacagccagtcaccgcggtctcagtcatcggcgcggatggctatgctggggtcccagggtggccgcagcagtcagggtcactgtgggagccctggggtggagtgacaaaccgcattgtcctgtgcccgccatggcagaagcgcagcctttgtatggaggcccaaccgcgctcccgtctggagaagcggcttccggggtgtggctgccgggtcggctctggtccacagcacggtgccggggctgcaggttgttgagggctgtgactccgtggggctcagccaggctccagcagggtcagacgtgctgttaagagcaaagccacagacgatgacttgtccattctcagtggatgctccaggctgtgcctacacagcagtgctggtgacatgtccagggttccagggcccggtggcctgggagctgctttctccccactggctgggctgcatctggccctggctggaggccttgctttgaggggctgtgaccctcttcccccaggccctccccagccgacgacagccaccggagaggagatcggaacacgattgtctcagatgcagggcgctgtgcgggacgaagccgcaaggactctcgtatcgggcccttgggactcgggaggtgccagaggcggcggctgctctggacctcggtgttcactgacctttgtttcacttgcctctgctcgactccgagagcaggaaacccggccgtggcctggcagctccgcctcccatgcccgcacgctggggtctgtcttgtctggagcagtggggcacaccccggaggaggcgggggtcagggctgtcggccttggccccctgctggtcgctgtttcggggactcggggcggccagtaccaccgcctgaggcggggctcagcagcgttgcatgtacgggcctcgtactgcctcatggaaaatcctccggagccgccctccattgtgggttcctgagagtaggacacattgccatggttttgtgggaatcacgcgcccctgatggaacttttctgctgttgtgaagtacttttatccatttgcttctctgctgaccttgccaagttgttcgaggtggaattaaacacctcccagacctc

SEQ ID NO: 356722 - DNA, 4187 bp, Homo sapiens
agcggggcggaggcggtgagcgcgggcggcgcggacggcagcggttggcgggcgggtcctccgctgttgcggccgctgcggcctccttgcccgggcttggggcgccgcgctggggaaagccgggggcccggacacattggcgtgagacctgggagtacgttgtgccaaatcattgccacttgccacatgagtgtaaatgatggcggatgccaagtatgtcctctgccgatgggaaaagcgattatggcctgcgaaggttttggcccgaaccgcgacttcaacaaaaaataagagaagaaaggaatattttctagctgtgcaaatcctctccctagaggaaaaaattaaggtgaaaagcactgaagttgagatcctagagaagtctcaaattgaagccattgcttcctcgttagcctcacagaatgaggttcctgcggcacccctggaagaactggcctacagacggtcgcttcgcgtggctctggacgttctgagcgagggctcgatttggagtcaagaaagctctgcagggacaggtagagctgaccggtctctgcgagggaagcccatggagcatgtctcctcgccctgtgattcgaactcctcatctcttccccgcggagacgtgttgggcagttccagacctcacaggaggaggccatgtgtgcaacaaagcctgtcaagttcgttcacttgtgaaaaggaccccgagtgcaaagtggaccacaagaaggggctcaggaaaagtgaaaacccaagaggcccgttggtcctcccagctggaggtggtgcccaagatgagagtgggtccagaatccaccacaaaaattggactcttgcaagtaagaggggaagaaactcagcgcagaaggctagcttgtgcctgaatggatcttccctttcagaggacgacacggagagagacatggggagcaaaggaggcagctgggcagccccgtccttgccctccggggtcagggaggacgatccctgtgccaacgctgagggacacgaccccggtctgccgttgggcagcctcactgcgcccccagcccctgagccctcggcctgctcagagcctggagaatgccctgcgaaaaagaggccgcgcctggatggcagccaaaggccgcctgccgtgcagctggagcccatggcagcaggggccgcaccatcccccgggccggggccagggcccagagagtctgtgaccccgcgcagcaccgccaggctgggcccgcctccctcccacgcctctgcggatgcaaccagatgtcttccttgcccggattcccagaagctggagaaagagtgccagtcttccgaagagtccatggggtctaattccatgcgttctatcctggaggaagacgaggaagacgaggagccaccaagagtccttttataccacgaaccacgttcgtttgaagtaggaatgctagtctggcataaacataaaaaataccccttctggccagcagtggtcaaaagcgtcaggcagagagataagaaagcaagtgtgctatacatcgaaggacacatgaacccgaaaatgaaaggtttcacagtgtctcttaaaagtttaaagcactttgattgtaaagagaaacagacgcttctgaatcaagccagggaggacttcaaccaggacatcggctggtgtgtctccctcatcaccgactacagggtccggttaggctgcgggtcttttgctggctctttcctggaatattacgcggctgatataagctatcctgtccgaaaatccatccagcaggacgtcttggggaccaagcttcctcaactgagcaaggggagccccgaggagcccgtggtggggtgccccctggggcagaggcagccctgccggaaaatgctccccgaccgctcgcgggccgcccgggaccgggccaaccagaagctggtggagtacattgtgaaggccaagggcgcggagagccacctgcgggccatcctaaagagcaggaagccatctcgctggctgcagaccttcctgagctccagccagtacgtgacctgtgtggagacctacctggaggatgaggggcagctggacctggtggtgaagtacctgcagggcgtctaccaggaggtgggggccaaggtgctccagcgcaccaacggcgaccggatccggttcattctggacgtgcttctgcccgaggccatcatctgtgcgatctctgcggtggacgaggtggactacaagacggctgaggagaagtacatcaaggggccttcgctgagctaccgggaaaaagaaatatttgacaaccagctccttgaagagcggaaccggcgccgtcggtgagggagcagccggctgtgctgtcagcggggcctggcggtggaagcgcctccagtgtgcatgagcgtgtctgaagatggggggctcagggggcacgtttgcgtttggacctgtctgtgcgttctcctgcgtggcagtcctgatttccatacttctggagaatccatttcgttaacactgaaagccagttctcttttcctggcagtttttttcattttatttttggcattttttacaagataccgttcgggaaaggcttttgaaaggacggaagcgtattcactgtgcgccagtactcctggctgtgctgtggtttctcccgacgtgcacatcgatctcgtatgtgtggcatctgatattaaacgggaggttttaagaagcgtctgccgtgatcatggagcttcggaagcgggaatggttcttccgggtttgctgttttgtctgtttcccccttgtgtggtttccgcctgcgacagttccagaatttgctctcccactcagtgtgctctgcagctgtgaggaaacagccttcgttagaggcgggagcagagacgagccgctgctctgtgtcgtgtttgctgtggccgcagggagaggagcgggacacgcacctttccaggggcctctgtgtcccgcactgtgtgtgagtggaccgcagcgcgcagccacatgccctggctgccatgggccagaccgcctccacctcccccgcccgcctggcctgtcctgagtgcatttccctgcactgtgtcgtcactgcacagccagtcaccgcggtctcagtcatcggcgcggatggctatgctggggtcccagggtggccgcagcagtcagggtcactgtgggagccctggggtggagtgacaaaccgcattgtcctgtgcccgccatggcagaagcgcagcctttgtatggaggcccaaccgcgctcccgtctggagaagcggcttccggggtgtggctgccgggtcggctctggtccacagcacggtgccggggctgcaggttgttgagggctgtgactccgtggggctcagccaggctccagcagggtcagacgtgctgttaagagcaaagccacagacgatgacttgtccattctcagtggatgctccaggctgtgcctacacagcagtgctggtgacatgtccagggttccagggcccggtggcctgggagctgctttctccccactggctgggctgcatctggccctggctggaggccttgctttgaggggctgtgaccctcttcccccaggccctccccagccgacgacagccaccggagaggagatcggaacacgattgtctcagatgcagggcgctgtgcgggacgaagccgcaaggactctcgtatcgggcccttgggactcgggaggtgccagaggcggcggctgctctggacctcggtgttcactgacctttgtttcacttgcctctgctcgactccgagagcaggaaacccggccgtggcctggcagctccgcctcccatgcccgcacgctggggtctgtcttgtctggagcagtggggcacaccccggaggaggcgggggtcagggctgtcggccttggccccctgctggtcgctgtttcggggactcggggcggccagtaccaccgcctgaggcggggctcagcagcgttgcatgtacgggcctcgtactgcctcatggaaaatcctccggagccgccctccattgtgggttcctgagagtaggacacattgccatggttttgtgggaatcacgcgcccctgatggaacttttctgctgttgtgaagtacttttatccatttgcttctctgctgaccttgccaagttgttcgaggtggaattaaacacctcccagacctc

SEQ ID NO: 356723 - DNA, 4189 bp, Homo sapiens
  misc_feature (14)..(14): n is a, c, g, or t
tacgcgcggcggtngcggaggcggacacattggcgtgagacctgggagtacgttgtgccaaatcattgccacttgccacatgagtgtaaatgatggcggatgccaagtatgtcctctgccgatgggaaaagcgattatggcctgcgaaggttttggcccgaaccgcgacttcaacaaaaaataagagaagaaaggaatattttctagctgtgcaaatcctctccctagaggaaaaaattaaggtgaaaagcactgaagttgagatcctagagaagtctcaaattgaagccattgcttcctcgttagggaacgcgaatcccctgagctgaaggagaaggaaaaatggatccgctttcttaaacctttccagaatttgcccctagaaccactcctattcttgacgcccagaatggtccctcacagaatgaggttcctgcggcacccctggaagaactggcctacagacggtcgcttcgcgtggctctggacgttctgagcgagggctcgatttggagtcaagaaagctctgcagggacaggtagagctgaccggtctctgcgagggaagcccatggagcatgtctcctcgccctgtgattcgaactcctcatctcttccccgcggagacgtgttgggcagttccagacctcacaggaggaggccatgtgtgcaacaaagcctgtcaagttcgttcacttgtgaaaaggaccccgagtgcaaagtggaccacaagaaggggctcaggaaaagtgaaaacccaagaggcccgttggtcctcccagctggaggtggtgcccaagatgagagtgggtccagaatccaccacaaaaattggactcttgcaagtaagaggggaagaaactcagcgcagaaggctagcttgtgcctgaatggatcttccctttcagaggacgacacggagagagacatggggagcaaaggaggcagctgggcagccccgtccttgccctccggggtcagggaggacgatccctgtgccaacgctgagggacacgaccccggtctgccgttgggcagcctcactgcgcccccagcccctgagccctcggcctgctcagagcctggagaatgccctgcgaaaaagaggccgcgcctggatggcagccaaaggccgcctgccgtgcagctggagcccatggcagcaggggccgcaccatcccccgggccggggccagggcccagagagtctgtgaccccgcgcagcaccgccaggctgggcccgcctccctcccacgcctctgcggatgcaaccagatgtcttccttgcccggattcccagaagctggagaaagagtgccagtcttccgaagagtccatggggtctaattccatgcgttctatcctggaggaagacgaggaagacgaggagccaccaagagtccttttataccacgaaccacgttcgtttgaagtaggaatgctagtctggcataaacataaaaaataccccttctggccagcagtggtcaaaagcgtcaggcagagagataagaaagcaagtgtgctatacatcgaaggacacatgaacccgaaaatgaaaggtttcacagtgtctcttaaaagtttaaagcactttgattgtaaagagaaacagacgcttctgaatcaagccagggaggacttcaaccaggacatcggctggtgtgtctccctcatcaccgactacagggtccggttaggctgcgggtcttttgctggctctttcctggaatattacgcggctgatataagctatcctgtccgaaaatccatccagcaggacgtcttggggaccaagcttcctcaactgagcaaggggagccccgaggagcccgtggtggggtgccccctggggcagaggcagccctgccggaaaatgctccccgaccgctcgcgggccgcccgggaccgggccaaccagaagctggtggagtacattgtgaaggccaagggcgcggagagccacctgcgggccatcctaaagagcaggaagccatctcgctggctgcagaccttcctgagctccagccagtacgtgacctgtgtggagacctacctggaggatgaggggcagctggacctggtggtgaagtacctgcagggcgtctaccaggaggtgggggccaaggtgctccagcgcaccaacggcgaccggatccggttcattctggacgtgcttctgcccgaggccatcatctgtgcgatctctgcggtggacgaggtggactacaagacggctgaggagaagtacatcaaggggccttcgctgagctaccgggaaaaagaaatatttgacaaccagctccttgaagagcggaaccggcgccgtcggtgagggagcagccggctgtgctgtcagcggggcctggcggtggaagcgcctccagtgtgcatgagcgtgtctgaagatggggggctcagggggcacgtttgcgtttggacctgtctgtgcgttctcctgcgtggcagtcctgatttccatacttctggagaatccatttcgttaacactgaaagccagttctcttttcctggcagtttttttcattttatttttggcattttttacaagataccgttcgggaaaggcttttgaaaggacggaagcgtattcactgtgcgccagtactcctggctgtgctgtggtttctcccgacgtgcacatcgatctcgtatgtgtggcatctgatattaaacgggaggttttaagaagcgtctgccgtgatcatggagcttcggaagcgggaatggttcttccgggtttgctgttttgtctgtttcccccttgtgtggtttccgcctgcgacagttccagaatttgctctcccactcagtgtgctctgcagctgtgaggaaacagccttcgttagaggcgggagcagagacgagccgctgctctgtgtcgtgtttgctgtggccgcagggagaggagcgggacacgcacctttccaggggcctctgtgtcccgcactgtgtgtgagtggaccgcagcgcgcagccacatgccctggctgccatgggccagaccgcctccacctcccccgcccgcctggcctgtcctgagtgcatttccctgcactgtgtcgtcactgcacagccagtcaccgcggtctcagtcatcggcgcggatggctatgctggggtcccagggtggccgcagcagtcagggtcactgtgggagccctggggtggagtgacaaaccgcattgtcctgtgcccgccatggcagaagcgcagcctttgtatggaggcccaaccgcgctcccgtctggagaagcggcttccggggtgtggctgccgggtcggctctggtccacagcacggtgccggggctgcaggttgttgagggctgtgactccgtggggctcagccaggctccagcagggtcagacgtgctgttaagagcaaagccacagacgatgacttgtccattctcagtggatgctccaggctgtgcctacacagcagtgctggtgacatgtccagggttccagggcccggtggcctgggagctgctttctccccactggctgggctgcatctggccctggctggaggccttgctttgaggggctgtgaccctcttcccccaggccctccccagccgacgacagccaccggagaggagatcggaacacgattgtctcagatgcagggcgctgtgcgggacgaagccgcaaggactctcgtatcgggcccttgggactcgggaggtgccagaggcggcggctgctctggacctcggtgttcactgacctttgtttcacttgcctctgctcgactccgagagcaggaaacccggccgtggcctggcagctccgcctcccatgcccgcacgctggggtctgtcttgtctggagcagtggggcacaccccggaggaggcgggggtcagggctgtcggccttggccccctgctggtcgctgtttcggggactcggggcggccagtaccaccgcctgaggcggggctcagcagcgttgcatgtacgggcctcgtactgcctcatggaaaatcctccggagccgccctccattgtgggttcctgagagtaggacacattgccatggttttgtgggaatcacgcgcccctgatggaacttttctgctgttgtgaagtacttttatccatttgcttctctgctgaccttgccaagttgttcgaggtggaattaaacacctcccagacctc

SEQ ID NO: 356724 - DNA, 5499 bp, Homo sapiens
agcggggcggaggcggtgagcgcgggcggcgcggacggcagcggttggcgggcgggtcctccgctgttgcggccgctgcggcctccttgcccgggcttggggcgccgcgctggggaaagccgggggcccggacacattggcgtgagacctgggagtacgttgtgccaaatcattgccacttgccacatgagtgtaaatgatggcggatgccaagtatgtcctctgccgatgggaaaagcgattatggcctgcgaaggttttggcccgaaccgcgacttcaacaaaaaataagagaagaaaggaatattttctagctgtgcaaatcctctccctagaggaaaagttaagtgttgtgttgttttaatactgttttttcccgtgtagatttctgatacttcaatcccctactcccccaaaacagttgaagcccagcccactcttaatgggcttattcaccatttgtgtaattcattaatgctcataataacctcatgagaaagcaactagtttgattttatgtcagtttggaagctgaagatccaaacgaggcattctgtgagatctatggagagattggtacaaacactgaatacatgtaaattatactcagggtagaccctatttgtggttaaaatagggatatttccttttttttttttttttttgactgtttcttaatcagtgccatgccaggaaaatagggatgtttccttcccagagatctgtgtgtcttttttcagaaacgtctgtgacaggcccatcaattttgaaatatttggtttttgagcctgtcactctaaaccagcgtttaacgttcaaaaggcaaataactgatgaccaggcggcacattgttctgctccgtgagtgtctggcactgggaaaggtgtagattgtctagaatgacagcaattccgacgccccagtcagtcctgcgtgattgtggcgagggcgcgtctggcaccgggaaggtgtagatcatctagaatgacggcgattccgacgccccggtcagtcctgcgtgattggcgagggtgcatctgtcgtgagaattcccagttctgaagagagcaaggagactgatcccgcgtagtccaaggcattggctcccctgttgctcttccttgtggagctccccctgccccactccctcctgcctgcatcttcagagctgcctctgaagctcgcttggtccctagctcacactttccctgcggctgggaaggtaattgaatactcgagtttaaaaggaaagcacatccttttaaaccaaaacacacctgctgggctgtaaacagcttttagtgacattaccatctactctgaaaatctaacaaaggagtgatttgtgcagttgaaagtaggatttgcttcataaaagtcacaatttgaattcatttttgcttttaaatccagccaaccttttctgtcttaaaaggaaaaaaaaaaaaaaaccattcaccagggttcttgctgcctgtaacctcaggcagatgaattcctagttggctgtgacttttggtttaagtggaaggttgaggaggaaaatgaaaataattcttttgttatctaaaggaaaacatgtttgaaaatgtcttggcggcgttggctggtggtgtgtaacgtcgattttgtctctgcagaattaaggtgaaaagcactgaagttgagatcctagagaagtctcaaattgaagccattgcttcctcgttagggaacgcgaatcccctgagctgaaggagaaggaaaaatggatccgctttcttaaacctttccagaatttgcccctagaaccactcctattcttgacgcccagaatggtccctcacagaatgaggttcctgcggcacccctggaagaactggcctacagacggtcgcttcgcgtggctctggacgttctgagcgagggctcgatttggagtcaagaaagctctgcagggacaggtagagctgaccggtctctgcgagggaagcccatggagcatgtctcctcgccctgtgattcgaactcctcatctcttccccgcggagacgtgttgggcagttccagacctcacaggaggaggccatgtgtgcaacaaagcctgtcaagttcgttcacttgtgaaaaggaccccgagtgcaaagtggaccacaagaaggggctcaggaaaagtgaaaacccaagaggcccgttggtcctcccagctggaggtggtgcccaagatgagagtgggtccagaatccaccacaaaaattggactcttgcaagtaagaggggaagaaactcagcgcagaaggctagcttgtgcctgaatggatcttccctttcagaggacgacacggagagagacatggggagcaaaggaggcagctgggcagccccgtccttgccctccggggtcagggaggacgatccctgtgccaacgctgagggacacgaccccggtctgccgttgggcagcctcactgcgcccccagcccctgagccctcggcctgctcagagcctggagaatgccctgcgaaaaagaggccgcgcctggatggcagccaaaggccgcctgccgtgcagctggagcccatggcagcaggggccgcaccatcccccgggccggggccagggcccagagagtctgtgaccccgcgcagcaccgccaggctgggcccgcctccctcccacgcctctgcggatgcaaccagatgtcttccttgcccggattcccagaagctggagaaagagtgccagtcttccgaagagtccatggggtctaattccatgcgttctatcctggaggaagacgaggaagacgaggagccaccaagagtccttttataccacgaaccacgttcgtttgaagtaggaatgctagtctggcataaacataaaaaataccccttctggccagcagtggtcaaaagcgtcaggcagagagataagaaagcaagtgtgctatacatcgaaggacacatgaacccgaaaatgaaaggtttcacagtgtctcttaaaagtttaaagcactttgattgtaaagagaaacagacgcttctgaatcaagccagggaggacttcaaccaggacatcggctggtgtgtctccctcatcaccgactacagggtccggttaggctgcgggtcttttgctggctctttcctggaatattacgcggctgatataagctatcctgtccgaaaatccatccagcaggacgtcttggggaccaagcttcctcaactgagcaaggggagccccgaggagcccgtggtggggtgccccctggggcagaggcagccctgccggaaaatgctccccgaccgctcgcgggccgcccgggaccgggccaaccagaagctggtggagtacattgtgaaggccaagggcgcggagagccacctgcgggccatcctaaagagcaggaagccatctcgctggctgcagaccttcctgagctccagccagtacgtgacctgtgtggagacctacctggaggatgaggggcagctggacctggtggtgaagtacctgcagggcgtctaccaggaggtgggggccaaggtgctccagcgcaccaacggcgaccggatccggttcattctggacgtgcttctgcccgaggccatcatctgtgcgatctctgcggtggacgaggtggactacaagacggctgaggagaagtacatcaaggggccttcgctgagctaccgggaaaaagaaatatttgacaaccagctccttgaagagcggaaccggcgccgtcggtgagggagcagccggctgtgctgtcagcggggcctggcggtggaagcgcctccagtgtgcatgagcgtgtctgaagatggggggctcagggggcacgtttgcgtttggacctgtctgtgcgttctcctgcgtggcagtcctgatttccatacttctggagaatccatttcgttaacactgaaagccagttctcttttcctggcagtttttttcattttatttttggcattttttacaagataccgttcgggaaaggcttttgaaaggacggaagcgtattcactgtgcgccagtactcctggctgtgctgtggtttctcccgacgtgcacatcgatctcgtatgtgtggcatctgatattaaacgggaggttttaagaagcgtctgccgtgatcatggagcttcggaagcgggaatggttcttccgggtttgctgttttgtctgtttcccccttgtgtggtttccgcctgcgacagttccagaatttgctctcccactcagtgtgctctgcgcacctttccaggggcctctgtgtcccgcactgtgtgtgagtggaccgcagcgcgcagccacatgccctggctgccatgggccagaccgcctccacctcccccgcccgcctggcctgtcctgagtgcatttccctgcactgtgtcgtcactgcacagccagtcaccgcggtctcagtcatcggcgcggatggctatgctggggtcccagggtggccgcagcagtcagggtcactgtgggagccctggggtggagtgacaaaccgcattgtcctgtgcccgccatggcagaagcgcagcctttgtatggaggcccaaccgcgctcccgtctggagaagcggcttccggggtgtggctgccgggtcggctctggtccacagcacggtgccggggctgcaggttgttgagggctgtgactccgtggggctcagccaggctccagcagggtcagacgtgctgttaagagcaaagccacagacgatgacttgtccattctcagtggatgctccaggctgtgcctacacagcagtgctggtgacatgtccagggttccagggcccggtggcctgggagctgctttctccccactggctgggctgcatctggccctggctggaggccttgctttgaggggctgtgaccctcttcccccaggccctccccagccgacgacagccaccggagaggagatcggaacacgattgtctcagatgcagggcgctgtgcgggacgaagccgcaaggactctcgtatcgggcccttgggactcgggaggtgccagaggcggcggctgctctggacctcggtgttcactgacctttgtttcacttgcctctgctcgactccgagagcaggaaacccggccgtggcctggcagctccgcctcccatgcccgcacgctggggtctgtcttgtctggagcagtggggcacaccccggaggaggcgggggtcagggctgtcggccttggccccctgctggtcgctgtttcggggactcggggcggccagtaccaccgcctgaggcggggctcagcagcgttgcatgtacgggcctcgtactgcctcatggaaaatcctccggagccgccctccattgtgggttcctgagagtaggacacattgccatggttttgtgggaatcacgcgcccctgatggaacttttctgctgttgtgaagtacttttatccatttgcttctctgctgaccttgccaagttgttcgaggtggaattaaacacctcccagacctc

SEQ ID NO: 356725 - DNA, 5331 bp, Homo sapiens
agcggggcggaggcggtgagcgcgggcggcgcggacggcagcggttggcgggcgggtcctccgctgttgcggccgctgcggcctccttgcccgggcttggggcgccgcgctggggaaagccgggggcccggacacattggcgtgagacctgggagtacgttgtgccaaatcattgccacttgccacatgagtgtaaatgatggcggatgccaagtatgtcctctgccgatgggaaaagcgattatggcctgcgaaggttttggcccgaaccgcgacttcaacaaaaaataagagaagaaaggaatattttctagctgtgcaaatcctctccctagaggaaaagttaagtgttgtgttgttttaatactgttttttcccgtgtagatttctgatacttcaatcccctactcccccaaaacagttgaagcccagcccactcttaatgggcttattcaccatttgtgtaattcattaatgctcataataacctcatgagaaagcaactagtttgattttatgtcagtttggaagctgaagatccaaacgaggcattctgtgagatctatggagagattggtacaaacactgaatacatgtaaattatactcagggtagaccctatttgtggttaaaatagggatatttccttttttttttttttttttgactgtttcttaatcagtgccatgccaggaaaatagggatgtttccttcccagagatctgtgtgtcttttttcagaaacgtctgtgacaggcccatcaattttgaaatatttggtttttgagcctgtcactctaaaccagcgtttaacgttcaaaaggcaaataactgatgaccaggcggcacattgttctgctccgtgagtgtctggcactgggaaaggtgtagattgtctagaatgacagcaattccgacgccccagtcagtcctgcgtgattgtggcgagggcgcgtctggcaccgggaaggtgtagatcatctagaatgacggcgattccgacgccccggtcagtcctgcgtgattggcgagggtgcatctgtcgtgagaattcccagttctgaagagagcaaggagactgatcccgcgtagtccaaggcattggctcccctgttgctcttccttgtggagctccccctgccccactccctcctgcctgcatcttcagagctgcctctgaagctcgcttggtccctagctcacactttccctgcggctgggaaggtaattgaatactcgagtttaaaaggaaagcacatccttttaaaccaaaacacacctgctgggctgtaaacagcttttagtgacattaccatctactctgaaaatctaacaaaggagtgatttgtgcagttgaaagtaggatttgcttcataaaagtcacaatttgaattcatttttgcttttaaatccagccaaccttttctgtcttaaaaggaaaaaaaaaaaaaaaccattcaccagggttcttgctgcctgtaacctcaggcagatgaattcctagttggctgtgacttttggtttaagtggaaggttgaggaggaaaatgaaaataattcttttgttatctaaaggaaaacatgtttgaaaatgtcttggcggcgttggctggtggtgtgtaacgtcgattttgtctctgcagaattaaggtgaaaagcactgaagttgagatcctagagaagtctcaaattgaagccattgcttcctcgttagggaacgcgaatcccctgagctgaaggagaaggaaaaatggatccgctttcttaaacctttccagaatttgcccctagaaccactcctattcttgacgcccagaatggtccctcacagaatgaggttcctgcggcacccctggaagaactggcctacagacggtcgcttcgcgtggctctggacgttctgagcgagggctcgatttggagtcaagaaagctctgcagggacaggtagagctgaccggtctctgcgagggaagcccatggagcatgtctcctcgccctgtgattcgaactcctcatctcttccccgcggagacgtgttgggcagttccagacctcacaggaggaggccatgtgtgcaacaaagcctgtcaagttcgttcacttgtgaaaaggaccccgagtgcaaagtggaccacaagaaggggctcaggaaaagtgaaaacccaagaggcccgttggtcctcccagctggaggtggtgcccaagatgagagtgggtccagaatccaccacaaaaattggactcttgcaagtaagaggggaagaaactcagcgcagaaggctagcttgtgcctgaatggatcttccctttcagaggacgacacggagagagacatggggagcaaaggaggcagctgggcagccccgtccttgccctccggggtcagggaggacgatccctgtgccaacgctgagggacacgaccccggtctgccgttgggcagcctcactgcgcccccagcccctgagccctcggcctgctcagagcctggagaatgccctgcgaaaaagaggccgcgcctggatggcagccaaaggccgcctgccgtgcagctggagcccatggcagcaggggccgcaccatcccccgggccggggccagggcccagagagtctgtgaccccgcgcagcaccgccaggctgggcccgcctccctcccacgcctctgcggatgcaaccagatgtcttccttgcccggattcccagaagctggagaaagagtgccagtcttccgaagagtccatggggtctaattccatgcgttctatcctggaggaagacgaggaagacgaggagccaccaagagtccttttataccacgaaccacgttcgtttgaagtaggaatgctagtctggcataaacataaaaaataccccttctggccagcagtggtcaaaagcgtcaggcagagagataagaaagcaagtgtgctatacatcgaaggacacatgaacccgaaaatgaaaggtttcacagtgtctcttaaaagtttaaagcactttgattgtaaagagaaacagacgcttctgaatcaagccagggaggacttcaaccaggacatcggctggtgtgtctccctcatcaccgactacagggtccggttaggctgcgggtcttttgctggctctttcctggaatattacgcggctgatataagctatcctgtccgaaaatccatccagcaggacgtcttggggaccaagcttcctcaactgagcaaggggagccccgaggagcccgtggtggggtgccccctggggcagaggcagccctgccggaaaatgctccccgaccgctcgcgggccgcccgggaccgggccaaccagaagctggtggagtacattgtgaaggccaagggcgcggagagccacctgcgggccatcctaaagagcaggaagccatctcgctggctgcagaccttcctgagctccagccagtacgtgacctgtgtggagacctacctggaggatgaggggcagctggacctggtggtgaagtacctgcagggcgtctaccaggaggtgggggccaaggtgctccagcgcaccaacggcgaccggatccggttcattctggacgtgcttctgcccgaggccatcatctgtgcgatctctgcggtggacgaggtggactacaagacggctgaggagaagtacatcaaggggccttcgctgagctaccggtaggccgctcccggcgctatctccagccacttgcgtctctgccttgcagtttctatttccacacccacaggcagtttgactccaggctgccgcagcccctctccctcatgaggtggcccaggtgctgggtggtgagctgatcacatacgctgaactcaccctgtgggtcactcctgccccccaggaaggctgtgcccgggtctcccagctggtcgctgtgggcagcacggggccacgggcacgtgcctgggccgtgtctgttcttaatctctttttgcaggggctgatgtttgctttttgcactttcctcccctctttccacagccccatggctgtgtgagaaatacagcaagattaagcagcagcacggcccggtgctttccagcagccagaagaatgctgtgatcaagatgtttctctcacatccgtgtgcttagctgcccttggatgtttggcccccagagcgcctaatcctgtctctgggcatgcggccaggccttgctgggagccaggcggggcccacggggcagtgacaggctgaagactcaactagagtcaaggacagggtctccggccagggtggcttgcgcagccaccgacgtctcccgggcccacagtcacaggagactcctggtgaagacactgaactccctcaccagccccatgtcctccctgggcagggcaggaggggcccctggagaggccagggaggaggtgtggggcctcggtggcattggcaggccacccccgcagagctgcacaaaggtggaatttggccttgtttagggagtgttggcccagctggcttaccaaaacaggaaaggcctttggatacagaaactgggtgttttcctgctggatcttcatggttcccccgtcatgcttgccgtaagaataagtgaggtccggggagggggtaaggtcggagccaggacacctggacccagcctgctggtttgtcctctccctccgtctcagaagcctcttcaccgctccacgcccatctgtggaaatctttcatcctgatttttttttttgagtctgggttgccgacatcaaaacccgttaggagttcatcacagcttccagttgccatgaaagcctcccgtgacctgtgagaatggtgctggtgctgatggagaagttacttgggctgagcacacaggccgtgatttcatcacgccggggacatgctcaaaataacaagccaggaggaaaaagaaatatttgacaaccagctccttgaagagcggaaccggcgccgtcggtgagggagcagccggctgtgctgtcagcggggcctggcggtggaagcgcctccagtgtgcatgagcgtgtctgaagatggggggctcagggggcacgtttgcgtttggacctgtctgtgcgttctcctgcgtggcagtcctgatttccatacttctggagaatccatttcgttaacactgaaagccagttctcttttcctggcagtttttttcattttatttttggcattttttacaagataccgttcgggaaaggcttttgaaaggacggaagcgtattcactgtgcgccagtactcctggctgtgctgtggtttctcccgacgtgcacatcgatctcgtatgtgtggcatctgatattaaacgggaggttttaagaag

SEQ ID NO: 356726 - DNA, 2596 bp, Homo sapiens
agcggggcggaggcggtgagcgcgggcggcgcggacggcagcggttggcgggcgggtcctccgctgttgcggccgctgcggcctccttgcccgggcttggggcgccgcgctggggaaagccgggggcccggacacattggcgtgagacctgggagtacgttgtgccaaatcattgccacttgccacatgagtgtaaatgatggcggatgccaagtatgtcctctgccgatgggaaaagcgattatggcctgcgaaggttttggcccgaaccgcgacttcaacaaaaaataagagaagaaaggaatattttctagctgtgcaaatcctctccctagaggaaaagttaagtgttgtgttgttttaatactgttttttcccgtgtagatttctgatacttcaatcccctactcccccaaaacagttgaagcccagcccactcttaatgggcttattcaccatttgtgtaattcattaatgctcataataacctcatgagaaagcaactagtttgattttatgtcagtttggaagctgaagatccaaacgaggcattctgtgagatctatggagagattggtacaaacactgaatacatgtaaattatactcagggtagaccctatttgtggttaaaatagggatatttccttttttttttttttttttgactgtttcttaatcagtgccatgccaggaaaatagggatgtttccttcccagagatctgtgtgtcttttttcagaaacgtctgtgacaggcccatcaattttgaaatatttggtttttgagcctgtcactctaaaccagcgtttaacgttcaaaaggcaaataactgatgaccaggcggcacattgttctgctccgtgagtgtctggcactgggaaaggtgtagattgtctagaatgacagcaattccgacgccccagtcagtcctgcgtgattgtggcgagggcgcgtctggcaccgggaaggtgtagatcatctagaatgacggcgattccgacgccccggtcagtcctgcgtgattggcgagggtgcatctgtcgtgagaattcccagttctgaagagagcaaggagactgatcccgcgtagtccaaggcattggctcccctgttgctcttccttgtggagctccccctgccccactccctcctgcctgcatcttcagagctgcctctgaagctcgcttggtccctagctcacactttccctgcggctgggaaggtaattgaatactcgagtttaaaaggaaagcacatccttttaaaccaaaacacacctgctgggctgtaaacagcttttagtgacattaccatctactctgaaaatctaacaaaggagtgatttgtgcagttgaaagtaggatttgcttcataaaagtcacaatttgaattcatttttgcttttaaatccagccaaccttttctgtcttaaaaggaaaaaaaaaaaaaaaccattcaccagggttcttgctgcctgtaacctcaggcagatgaattcctagttggctgtgacttttggtttaagtggaaggttgaggaggaaaatgaaaataattcttttgttatctaaaggaaaacatgtttgaaaatgtcttggcggcgttggctggtggtgtgtaacgtcgattttgtctctgcagaattaaggtgaaaagcactgaagttgagatcctagagaagtctcaaattgaagccattgcttcctcgttaggtaagagcgtatttttaagtggccactaggttttcataaaataagaggtcatttgggagaatgtgaaggctcagctttctgggtaaaaattcaccctgttcaccatgtttttcttcatacaagggaacgcgaatcccctgagctgaaggagaaggaaaaatggatccgctttcttaaacctttccagaatttgcccctagaaccactcctattcttgacgcccagaatggtcagtggtgagcatcaaggtcatctcgtaccctcgtggcctccagtacacaagacgaggaaggactttgctgccataaggggggaggtcctcctttttcctttcctcttcctatagtaagatttgctgtggtactgtcgctgcctggccagtctggtctcagcccaaggtttgagaagcagttggttgtgtgtttaaaattccagagcagagcccaagggagagaacgggtggcctggcactggggttggtggcacccattgtttgaggcactgtcatggggggcacgaggcaggtcggaagtggagctctcggcttcccatccatccgggtgcgctttctcccaggccttcagtttagcacccacctcctttgcacactgtgggtgagaaaagctttgcctgagtccagccggggactggtcatgcacatacatgacaagtgaggagcactggtgactgcctgccccctagccacagttgtgcaaacccaaacctgccagccttccttctcaaagtggaactgtttatcccatttgcaaataattgtttctcttgtgaaaagatggaccggaattccttccaatgatgtttataaaatcaggtctattttcctgtgtcttccgaaaaacagctcttgtttaaagcaggatcca

SEQ ID NO: 356727 - DNA, 461 bp, Homo sapiens
tccttgtgtttgggtcttctccgcgtgccattacctcacctctgttttgtgccacacactctttaaaagtgtcttcccgcggggtttagagttaggaaagtcgcgcacacataggacagagccccagccgcccctcgtggcacccctcccatcccaagggtgcgtttgtcgcagctgggaacccagtgcagcaccccactcagctgctggtttcactgtctcatcattggtggttagactcaagtagtgtggggtatgtgaatctgcctttcagattctcctgatcttttaagcgaatgacacaaagtcaggttttaacaatatcgtgctaactgtgttttctcaggctgttacacctggtgcttgatatggatttgacttgtctattcttttttttttgtttttcttttttctttaattctagaaccacgttcgtttgaagtaggaatgctagtctggca

SEQ ID NO: 356728 - DNA, 311 bp, Homo sapiens
atcttttttgttttgacgttttattttcttggatttgtgaacaggtcaaaagcgtcaggcagagagataagaaagcaagtgtgctatacatcgaaggacacatgaacccgaaaatgaaagggtaacccgctgttcttggtttctgtgaatgggcctgaggggccaggccggccgctctcagagtcagagcgggcgtggggatggagggacagaggggaggccccggcaggagtccaggcccgggcagggctagtgaggtctcactggaggtgtgcccttcttgtggcctctcactccctgggatgggtgag

SEQ ID NO: 356729 - DNA, 475 bp, Homo sapiens
tttttgttttgacgttttattttcttggatttgtgaacaggtcaaaagcgtcaggcagagagataagaaagcaagtgtgctatacatcgaaggacacatgaacccgaaaatgaaagggtaacccgctgttcttggtttctgtgaatgggcctgaggggccaggccggccgctctcagagtcagagcgggcgtggggatggagggacagaggggaggccccggcaggagtccaggcccgggcagggctagtgaggtctcactggaggtgtgcccttcttgtggcctctcactccctgggatgggtgagtcagacagaggctgggtgtgaagggtctggtcaaacaccccagttttcacaacttgatttgctggctttgaaaggcagcccaaccagacactcactggggccctgtttcccacaaaccagcaaaatgtccacgcaggtgtgcagacagcatccctgcgtccacctgag

SEQ ID NO: 356730 - DNA, 286 bp, Homo sapiens
taacaaggattttcttttgttttaaatgtaggttttggcccgaaccgcgacttcaacaaaaaataagagaagaaaggaatattttctagctgtgcaaatcctctccctagaggaaaagttaagtgttgtgttgttttaatactgttttttcccgtgtagatttctgatacttcaatcccctactcccccaaaacagttgaagcccagcccactcttaatgggcttattcaccatttgtgtaattcattaatgctcataataacctcatgagaaagcaactagtttg

SEQ ID NO: 356731 - DNA, 465 bp, Homo sapiens
tttcacagtgtctcttaaaagtttaaagcactttgattgtaaagagaaacagacgcttctggtaggtggatgatgttttgtgcttgctttaaatggtttactttgtgattagtaaatatgtcctctgtgtgtagctcttgaaatccatggctgcggtgtacgcgtgtgaatgattgtgggaagtagcagagccaggctgcgctctggccgttagagttagatcgtgggctcagtcactgcgctgaattctcacaactgtcctgggaagttgcggccccatttccccgctttacgggtaaggaagctggggctccggcgaggacagtttacccagggccaccaggcaaggctacagcagagagcctctgcgcaaggccaccgccttccctggccgactgtctcagtccaccccatgtcacggtggcctcggtagccagccccttgcggccgggggcgtccctagct

SEQ ID NO: 356732 - DNA, 430 bp, Homo sapiens
tttggtattttttgtagagacagggtttcaccgtgttagccaggatggtcctgatctcctgaccttgtgatccgcctgcctcggcctcccaaagtgctgggattacaggcgtgagcgaccacacccagtcctctctctcatattctttaacacacaatgattaattactaaaatgaagactcttgttttctgaagggaaaaagaaatatttgacaaccagctccttgaagagcggaaccggcgccgtcggtgagggagcagccggctgtgctgtcagcggggcctggcggtggaagcgcctccagtgtgcatgagcgtgtctgaagatggggggctcagggggcacgtttgcgtttggacctgtctgtgcgttctcctgcgtggcagtcctgatttccatacttctggagaatccatttcgttaacactg

SEQ ID NO: 356733 - DNA, 5488 bp, Homo sapiens
  misc_feature (14)..(14): n is a, c, g, or t
tacgcgcggcggtngcggaggcggacacattggcgtgagacctgggagtacgttgtgccaaatcattgccacttgccacatgagtgtaaatgatggcggatgccaagtatgtcctctgccgatgggaaaagcgattatggcctgcgaaggttttggcccgaaccgcgacttcaacaaaaaataagagaagaaaggaatattttctagctgtgcaaatcctctccctagaggaaaagttaagtgttgtgttgttttaatactgttttttcccgtgtagatttctgatacttcaatcccctactcccccaaaacagttgaagcccagcccactcttaatgggcttattcaccatttgtgtaattcattaatgctcataataacctcatgagaaagcaactagtttgattttatgtcagtttggaagctgaagatccaaacgaggcattctgtgagatctatggagagattggtacaaacactgaatacatgtaaattatactcagggtagaccctatttgtggttaaaatagggatatttccttttttttttttttttttgactgtttcttaatcagtgccatgccaggaaaatagggatgtttccttcccagagatctgtgtgtcttttttcagaaacgtctgtgacaggcccatcaattttgaaatatttggtttttgagcctgtcactctaaaccagcgtttaacgttcaaaaggcaaataactgatgaccaggcggcacattgttctgctccgtgagtgtctggcactgggaaaggtgtagattgtctagaatgacagcaattccgacgccccagtcagtcctgcgtgattgtggcgagggcgcgtctggcaccgggaaggtgtagatcatctagaatgacggcgattccgacgccccggtcagtcctgcgtgattggcgagggtgcatctgtcgtgagaattcccagttctgaagagagcaaggagactgatcccgcgtagtccaaggcattggctcccctgttgctcttccttgtggagctccccctgccccactccctcctgcctgcatcttcagagctgcctctgaagctcgcttggtccctagctcacactttccctgcggctgggaaggtaattgaatactcgagtttaaaaggaaagcacatccttttaaaccaaaacacacctgctgggctgtaaacagcttttagtgacattaccatctactctgaaaatctaacaaaggagtgatttgtgcagttgaaagtaggatttgcttcataaaagtcacaatttgaattcatttttgcttttaaatccagccaaccttttctgtcttaaaaggaaaaaaaaaaaaaaaccattcaccagggttcttgctgcctgtaacctcaggcagatgaattcctagttggctgtgacttttggtttaagtggaaggttgaggaggaaaatgaaaataattcttttgttatctaaaggaaaacatgtttgaaaatgtcttggcggcgttggctggtggtgtgtaacgtcgattttgtctctgcagaattaaggtgaaaagcactgaagttgagatcctagagaagtctcaaattgaagccattgcttcctcgttagggaacgcgaatcccctgagctgaaggagaaggaaaaatggatccgctttcttaaacctttccagaatttgcccctagaaccactcctattcttgacgcccagaatggtccctcacagaatgaggttcctgcggcacccctggaagaactggcctacagacggtcgcttcgcgtggctctggacgttctgagcgagggctcgatttggagtcaagaaagctctgcagggacaggtagagctgaccggtctctgcgagggaagcccatggagcatgtctcctcgccctgtgattcgaactcctcatctcttccccgcggagacgtgttgggcagttccagacctcacaggaggaggccatgtgtgcaacaaagcctgtcaagttcgttcacttgtgaaaaggaccccgagtgcaaagtggaccacaagaaggggctcaggaaaagtgaaaacccaagaggcccgttggtcctcccagctggaggtggtgcccaagatgagagtgggtccagaatccaccacaaaaattggactcttgcaagtaagaggggaagaaactcagcgcagaaggctagcttgtgcctgaatggatcttccctttcagaggacgacacggagagagacatggggagcaaaggaggcagctgggcagccccgtccttgccctccggggtcagggaggacgatccctgtgccaacgctgagggacacgaccccggtctgccgttgggcagcctcactgcgcccccagcccctgagccctcggcctgctcagagcctggagaatgccctgcgaaaaagaggccgcgcctggatggcagccaaaggccgcctgccgtgcagctggagcccatggcagcaggggccgcaccatcccccgggccggggccagggcccagagagtctgtgaccccgcgcagcaccgccaggctgggcccgcctccctcccacgcctctgcggatgcaaccagatgtcttccttgcccggattcccagaagctggagaaagagtgccagtcttccgaagagtccatggggtctaattccatgcgttctatcctggaggaagacgaggaagacgaggagccaccaagagtccttttataccacgaaccacgttcgtttgaagtaggaatgctagtctggcataaacataaaaaataccccttctggccagcagtggtcaaaagcgtcaggcagagagataagaaagcaagtgtgctatacatcgaaggacacatgaacccgaaaatgaaaggtttcacagtgtctcttaaaagtttaaagcactttgattgtaaagagaaacagacgcttctgaatcaagccagggaggacttcaaccaggacatcggctggtgtgtctccctcatcaccgactacagggtccggttaggctgcgggtcttttgctggctctttcctggaatattacgcggctgatataagctatcctgtccgaaaatccatccagcaggacgtcttggggaccaagcttcctcaactgagcaaggggagccccgaggagcccgtggtggggtgccccctggggcagaggcagccctgccggaaaatgctccccgaccgctcgcgggccgcccgggaccgggccaaccagaagctggtggagtacattgtgaaggccaagggcgcggagagccacctgcgggccatcctaaagagcaggaagccatctcgctggctgcagaccttcctgagctccagccagtacgtgacctgtgtggagacctacctggaggatgaggggcagctggacctggtggtgaagtacctgcagggcgtctaccaggaggtgggggccaaggtgctccagcgcaccaacggcgaccggatccggttcattctggacgtgcttctgcccgaggccatcatctgtgcgatctctgcggtggacgaggtggactacaagacggctgaggagaagtacatcaaggggccttcgctgagctaccgggaaaaagaaatatttgacaaccagctccttgaagagcggaaccggcgccgtcggtgagggagcagccggctgtgctgtcagcggggcctggcggtggaagcgcctccagtgtgcatgagcgtgtctgaagatggggggctcagggggcacgtttgcgtttggacctgtctgtgcgttctcctgcgtggcagtcctgatttccatacttctggagaatccatttcgttaacactgaaagccagttctcttttcctggcagtttttttcattttatttttggcattttttacaagataccgttcgggaaaggcttttgaaaggacggaagcgtattcactgtgcgccagtactcctggctgtgctgtggtttctcccgacgtgcacatcgatctcgtatgtgtggcatctgatattaaacgggaggttttaagaagcgtctgccgtgatcatggagcttcggaagcgggaatggttcttccgggtttgctgttttgtctgtttcccccttgtgtggtttccgcctgcgacagttccagaatttgctctcccactcagtgtgctctgcagctgtgaggaaacagccttcgttagaggcgggagcagagacgagccgctgctctgtgtcgtgtttgctgtggccgcagggagaggagcgggacacgcacctttccaggggcctctgtgtcccgcactgtgtgtgagtggaccgcagcgcgcagccacatgccctggctgccatgggccagaccgcctccacctcccccgcccgcctggcctgtcctgagtgcatttccctgcactgtgtcgtcactgcacagccagtcaccgcggtctcagtcatcggcgcggatggctatgctggggtcccagggtggccgcagcagtcagggtcactgtgggagccctggggtggagtgacaaaccgcattgtcctgtgcccgccatggcagaagcgcagcctttgtatggaggcccaaccgcgctcccgtctggagaagcggcttccggggtgtggctgccgggtcggctctggtccacagcacggtgccggggctgcaggttgttgagggctgtgactccgtggggctcagccaggctccagcagggtcagacgtgctgttaagagcaaagccacagacgatgacttgtccattctcagtggatgctccaggctgtgcctacacagcagtgctggtgacatgtccagggttccagggcccggtggcctgggagctgctttctccccactggctgggctgcatctggccctggctggaggccttgctttgaggggctgtgaccctcttcccccaggccctccccagccgacgacagccaccggagaggagatcggaacacgattgtctcagatgcagggcgctgtgcgggacgaagccgcaaggactctcgtatcgggcccttgggactcgggaggtgccagaggcggcggctgctctggacctcggtgttcactgacctttgtttcacttgcctctgctcgactccgagagcaggaaacccggccgtggcctggcagctccgcctcccatgcccgcacgctggggtctgtcttgtctggagcagtggggcacaccccggaggaggcgggggtcagggctgtcggccttggccccctgctggtcgctgtttcggggactcggggcggccagtaccaccgcctgaggcggggctcagcagcgttgcatgtacgggcctcgtactgcctcatggaaaatcctccggagccgccctccattgtgggttcctgagagtaggacacattgccatggttttgtgggaatcacgcgcccctgatggaacttttctgctgttgtgaagtacttttatccatttgcttctctgctgaccttgccaagttgttcgaggtggaattaaacacctcccagacctc

SEQ ID NO: 356734 - DNA, 5445 bp, Homo sapiens
tcagctcggtaccaatagttacacaacacttgccacatgagtgtaaatgatggcggatgccaagtatgtcctctgccgatgggaaaagcgattatggcctgcgaaggttttggcccgaaccgcgacttcaacaaaaaataagagaagaaaggaatattttctagctgtgcaaatcctctccctagaggaaaagttaagtgttgtgttgttttaatactgttttttcccgtgtagatttctgatacttcaatcccctactcccccaaaacagttgaagcccagcccactcttaatgggcttattcaccatttgtgtaattcattaatgctcataataacctcatgagaaagcaactagtttgattttatgtcagtttggaagctgaagatccaaacgaggcattctgtgagatctatggagagattggtacaaacactgaatacatgtaaattatactcagggtagaccctatttgtggttaaaatagggatatttccttttttttttttttttttgactgtttcttaatcagtgccatgccaggaaaatagggatgtttccttcccagagatctgtgtgtcttttttcagaaacgtctgtgacaggcccatcaattttgaaatatttggtttttgagcctgtcactctaaaccagcgtttaacgttcaaaaggcaaataactgatgaccaggcggcacattgttctgctccgtgagtgtctggcactgggaaaggtgtagattgtctagaatgacagcaattccgacgccccagtcagtcctgcgtgattgtggcgagggcgcgtctggcaccgggaaggtgtagatcatctagaatgacggcgattccgacgccccggtcagtcctgcgtgattggcgagggtgcatctgtcgtgagaattcccagttctgaagagagcaaggagactgatcccgcgtagtccaaggcattggctcccctgttgctcttccttgtggagctccccctgccccactccctcctgcctgcatcttcagagctgcctctgaagctcgcttggtccctagctcacactttccctgcggctgggaaggtaattgaatactcgagtttaaaaggaaagcacatccttttaaaccaaaacacacctgctgggctgtaaacagcttttagtgacattaccatctactctgaaaatctaacaaaggagtgatttgtgcagttgaaagtaggatttgcttcataaaagtcacaatttgaattcatttttgcttttaaatccagccaaccttttctgtcttaaaaggaaaaaaaaaaaaaaaccattcaccagggttcttgctgcctgtaacctcaggcagatgaattcctagttggctgtgacttttggtttaagtggaaggttgaggaggaaaatgaaaataattcttttgttatctaaaggaaaacatgtttgaaaatgtcttggcggcgttggctggtggtgtgtaacgtcgattttgtctctgcagaattaaggtgaaaagcactgaagttgagatcctagagaagtctcaaattgaagccattgcttcctcgttagggaacgcgaatcccctgagctgaaggagaaggaaaaatggatccgctttcttaaacctttccagaatttgcccctagaaccactcctattcttgacgcccagaatggtccctcacagaatgaggttcctgcggcacccctggaagaactggcctacagacggtcgcttcgcgtggctctggacgttctgagcgagggctcgatttggagtcaagaaagctctgcagggacaggtagagctgaccggtctctgcgagggaagcccatggagcatgtctcctcgccctgtgattcgaactcctcatctcttccccgcggagacgtgttgggcagttccagacctcacaggaggaggccatgtgtgcaacaaagcctgtcaagttcgttcacttgtgaaaaggaccccgagtgcaaagtggaccacaagaaggggctcaggaaaagtgaaaacccaagaggcccgttggtcctcccagctggaggtggtgcccaagatgagagtgggtccagaatccaccacaaaaattggactcttgcaagtaagaggggaagaaactcagcgcagaaggctagcttgtgcctgaatggatcttccctttcagaggacgacacggagagagacatggggagcaaaggaggcagctgggcagccccgtccttgccctccggggtcagggaggacgatccctgtgccaacgctgagggacacgaccccggtctgccgttgggcagcctcactgcgcccccagcccctgagccctcggcctgctcagagcctggagaatgccctgcgaaaaagaggccgcgcctggatggcagccaaaggccgcctgccgtgcagctggagcccatggcagcaggggccgcaccatcccccgggccggggccagggcccagagagtctgtgaccccgcgcagcaccgccaggctgggcccgcctccctcccacgcctctgcggatgcaaccagatgtcttccttgcccggattcccagaagctggagaaagagtgccagtcttccgaagagtccatggggtctaattccatgcgttctatcctggaggaagacgaggaagacgaggagccaccaagagtccttttataccacgaaccacgttcgtttgaagtaggaatgctagtctggcataaacataaaaaataccccttctggccagcagtggtcaaaagcgtcaggcagagagataagaaagcaagtgtgctatacatcgaaggacacatgaacccgaaaatgaaaggtttcacagtgtctcttaaaagtttaaagcactttgattgtaaagagaaacagacgcttctgaatcaagccagggaggacttcaaccaggacatcggctggtgtgtctccctcatcaccgactacagggtccggttaggctgcgggtcttttgctggctctttcctggaatattacgcggctgatataagctatcctgtccgaaaatccatccagcaggacgtcttggggaccaagcttcctcaactgagcaaggggagccccgaggagcccgtggtggggtgccccctggggcagaggcagccctgccggaaaatgctccccgaccgctcgcgggccgcccgggaccgggccaaccagaagctggtggagtacattgtgaaggccaagggcgcggagagccacctgcgggccatcctaaagagcaggaagccatctcgctggctgcagaccttcctgagctccagccagtacgtgacctgtgtggagacctacctggaggatgaggggcagctggacctggtggtgaagtacctgcagggcgtctaccaggaggtgggggccaaggtgctccagcgcaccaacggcgaccggatccggttcattctggacgtgcttctgcccgaggccatcatctgtgcgatctctgcggtggacgaggtggactacaagacggctgaggagaagtacatcaaggggccttcgctgagctaccgggaaaaagaaatatttgacaaccagctccttgaagagcggaaccggcgccgtcggtgagggagcagccggctgtgctgtcagcggggcctggcggtggaagcgcctccagtgtgcatgagcgtgtctgaagatggggggctcagggggcacgtttgcgtttggacctgtctgtgcgttctcctgcgtggcagtcctgatttccatacttctggagaatccatttcgttaacactgaaagccagttctcttttcctggcagtttttttcattttatttttggcattttttacaagataccgttcgggaaaggcttttgaaaggacggaagcgtattcactgtgcgccagtactcctggctgtgctgtggtttctcccgacgtgcacatcgatctcgtatgtgtggcatctgatattaaacgggaggttttaagaagcgtctgccgtgatcatggagcttcggaagcgggaatggttcttccgggtttgctgttttgtctgtttcccccttgtgtggtttccgcctgcgacagttccagaatttgctctcccactcagtgtgctctgcagctgtgaggaaacagccttcgttagaggcgggagcagagacgagccgctgctctgtgtcgtgtttgctgtggccgcagggagaggagcgggacacgcacctttccaggggcctctgtgtcccgcactgtgtgtgagtggaccgcagcgcgcagccacatgccctggctgccatgggccagaccgcctccacctcccccgcccgcctggcctgtcctgagtgcatttccctgcactgtgtcgtcactgcacagccagtcaccgcggtctcagtcatcggcgcggatggctatgctggggtcccagggtggccgcagcagtcagggtcactgtgggagccctggggtggagtgacaaaccgcattgtcctgtgcccgccatggcagaagcgcagcctttgtatggaggcccaaccgcgctcccgtctggagaagcggcttccggggtgtggctgccgggtcggctctggtccacagcacggtgccggggctgcaggttgttgagggctgtgactccgtggggctcagccaggctccagcagggtcagacgtgctgttaagagcaaagccacagacgatgacttgtccattctcagtggatgctccaggctgtgcctacacagcagtgctggtgacatgtccagggttccagggcccggtggcctgggagctgctttctccccactggctgggctgcatctggccctggctggaggccttgctttgaggggctgtgaccctcttcccccaggccctccccagccgacgacagccaccggagaggagatcggaacacgattgtctcagatgcagggcgctgtgcgggacgaagccgcaaggactctcgtatcgggcccttgggactcgggaggtgccagaggcggcggctgctctggacctcggtgttcactgacctttgtttcacttgcctctgctcgactccgagagcaggaaacccggccgtggcctggcagctccgcctcccatgcccgcacgctggggtctgtcttgtctggagcagtggggcacaccccggaggaggcgggggtcagggctgtcggccttggccccctgctggtcgctgtttcggggactcggggcggccagtaccaccgcctgaggcggggctcagcagcgttgcatgtacgggcctcgtactgcctcatggaaaatcctccggagccgccctccattgtgggttcctgagagtaggacacattgccatggttttgtgggaatcacgcgcccctgatggaacttttctgctgttgtgaagtacttttatccatttgcttctctgctgaccttgccaagttgttcgaggtggaattaaacacctcccagacctc

SEQ ID NO: 356735 - DNA, 6267 bp, Homo sapiens
  misc_feature (6267)..(6267): n is a, c, g, or t
agcggggcggaggcggtgagcgcgggcggcgcggacggcagcggttggcgggcgggtcctccgctgttgcggccgctgcggcctccttgcccgggcttggggcgccgcgctggggaaagccgggggcccggacacattggcgtgagacctgggagtacgttgtgccaaatcattgccacttgccacatgagtgtaaatgatggcggatgccaagtatgtcctctgccgatgggaaaagcgattatggcctgcgaaggttttggcccgaaccgcgacttcaacaaaaaataagagaagaaaggaatattttctagctgtgcaaatcctctccctagaggaaaagttaagtgttgtgttgttttaatactgttttttcccgtgtagatttctgatacttcaatcccctactcccccaaaacagttgaagcccagcccactcttaatgggcttattcaccatttgtgtaattcattaatgctcataataacctcatgagaaagcaactagtttgattttatgtcagtttggaagctgaagatccaaacgaggcattctgtgagatctatggagagattggtacaaacactgaatacatgtaaattatactcagggtagaccctatttgtggttaaaatagggatatttccttttttttttttttttttgactgtttcttaatcagtgccatgccaggaaaatagggatgtttccttcccagagatctgtgtgtcttttttcagaaacgtctgtgacaggcccatcaattttgaaatatttggtttttgagcctgtcactctaaaccagcgtttaacgttcaaaaggcaaataactgatgaccaggcggcacattgttctgctccgtgagtgtctggcactgggaaaggtgtagattgtctagaatgacagcaattccgacgccccagtcagtcctgcgtgattgtggcgagggcgcgtctggcaccgggaaggtgtagatcatctagaatgacggcgattccgacgccccggtcagtcctgcgtgattggcgagggtgcatctgtcgtgagaattcccagttctgaagagagcaaggagactgatcccgcgtagtccaaggcattggctcccctgttgctcttccttgtggagctccccctgccccactccctcctgcctgcatcttcagagctgcctctgaagctcgcttggtccctagctcacactttccctgcggctgggaaggtaattgaatactcgagtttaaaaggaaagcacatccttttaaaccaaaacacacctgctgggctgtaaacagcttttagtgacattaccatctactctgaaaatctaacaaaggagtgatttgtgcagttgaaagtaggatttgcttcataaaagtcacaatttgaattcatttttgcttttaaatccagccaaccttttctgtcttaaaaggaaaaaaaaaaaaaaaccattcaccagggttcttgctgcctgtaacctcaggcagatgaattcctagttggctgtgacttttggtttaagtggaaggttgaggaggaaaatgaaaataattcttttgttatctaaaggaaaacatgtttgaaaatgtcttggcggcgttggctggtggtgtgtaacgtcgattttgtctctgcagaattaaggtgaaaagcactgaagttgagatcctagagaagtctcaaattgaagccattgcttcctcgttagggaacgcgaatcccctgagctgaaggagaaggaaaaatggatccgctttcttaaacctttccagaatttgcccctagaaccactcctattcttgacgcccagaatggtccctcacagaatgaggttcctgcggcacccctggaagaactggcctacagacggtcgcttcgcgtggctctggacgttctgagcgagggctcgatttggagtcaagaaagctctgcagggacaggtagagctgaccggtctctgcgagggaagcccatggagcatgtctcctcgccctgtgattcgaactcctcatctcttccccgcggagacgtgttgggcagttccagacctcacaggaggaggccatgtgtgcaacaaagcctgtcaagttcgttcacttgtgaaaaggaccccgagtgcaaagtggaccacaagaaggggctcaggaaaagtgaaaacccaagaggcccgttggtcctcccagctggaggtggtgcccaagatgagagtgggtccagaatccaccacaaaaattggactcttgcaagtaagaggggaagaaactcagcgcagaaggctagcttgtgcctgaatggatcttccctttcagaggacgacacggagagagacatggggagcaaaggaggcagctgggcagccccgtccttgccctccggggtcagggaggacgatccctgtgccaacgctgagggacacgaccccggtctgccgttgggcagcctcactgcgcccccagcccctgagccctcggcctgctcagagcctggagaatgccctgcgaaaaagaggccgcgcctggatggcagccaaaggccgcctgccgtgcagctggagcccatggcagcaggggccgcaccatcccccgggccggggccagggcccagagagtctgtgaccccgcgcagcaccgccaggctgggcccgcctccctcccacgcctctgcggatgcaaccagatgtcttccttgcccggattcccagaagctggagaaagagtgccagtcttccgaagagtccatggggtctaattccatgcgttctatcctggaggaagacgaggaagacgaggagccaccaagagtccttttataccacgaaccacgttcgtttgaagtaggaatgctagtctggcataaacataaaaaataccccttctggccagcagtggtcaaaagcgtcaggcagagagataagaaagcaagtgtgctatacatcgaaggacacatgaacccgaaaatgaaaggtttcacagtgtctcttaaaagtttaaagcactttgattgtaaagagaaacagacgcttctgaatcaagccagggaggacttcaaccaggacatcggctggtgtgtctccctcatcaccgactacagggtccggttaggctgcgggtcttttgctggctctttcctggaatattacgcggctgatataagctatcctgtccgaaaatccatccagcaggacgtcttggggaccaagcttcctcaactgagcaaggggagccccgaggagcccgtggtggggtgccccctggggcagaggcagccctgccggaaaatgctccccgaccgctcgcgggccgcccgggaccgggccaaccagaagctggtggagtacattgtgaaggccaagggcgcggagagccacctgcgggccatcctaaagagcaggaagccatctcgctggctgcagaccttcctgagctccagccagtacgtgacctgtgtggagacctacctggaggatgaggggcagctggacctggtggtgaagtacctgcagggcgtctaccaggaggtgggggccaaggtgctccagcgcaccaacggcgaccggatccggttcattctggacgtgcttctgcccgaggccatcatctgtgcgatctctgcggtggacgaggtggactacaagacggctgaggagaagtacatcaaggggccttcgctgagctaccgggaaaaagaaatatttgacaaccagctccttgaagagcggaaccggcgccgtcggtgagggagcagccggctgtgctgtcagcggggcctggcggtggaagcgcctccagtgtgcatgagcgtgtctgaagatggggggctcagggggcacgtttgcgtttggacctgtctgtgcgttctcctgcgtggcagtcctgatttccatacttctggagaatccatttcgttaacactgaaagccagttctcttttcctggcagtttttttcattttatttttggcattttttacaagataccgttcgggaaaggcttttgaaaggacggaagcgtattcactgtgcgccagtactcctggctgtgctgtggtttctcccgacgtgcacatcgatctcgtatgtgtggcatctgatattaaacgggaggttttaagaagcgtctgccgtgatcatggagcttcggaagcgggaatggttcttccgggtttgctgttttgtctgtttcccccttgtgtggtttccgcctgcgacagttccagaatttgctctcccactcagtgtgctctgcagctgtgaggaaacagccttcgttagaggcgggagcagagacgagccgctgctctgtgtcgtgtttgctgtggccgcagggagaggagcgggacacgcacctttccaggggcctctgtgtcccgcactgtgtgtgagtggaccgcagcgcgcagccacatgccctggctgccatgggccagaccgcctccacctcccccgcccgcctggcctgtcctgagtgcatttccctgcactgtgtcgtcactgcacagccagtcaccgcggtctcagtcatcggcgcggatggctatgctggggtcccagggtggccgcagcagtcagggtcactgtgggagccctggggtggagtgacaaaccgcattgtcctgtgcccgccatggcagaagcgcagcctttgtatggaggcccaaccgcgctcccgtctggagaagcggcttccggggtgtggctgccgggtcggctctggtccacagcacggtgccggggctgcaggttgttgagggctgtgactccgtggggctcagccaggctccagcagggtcagacgtgctgttaagagcaaagccacagacgatgacttgtccattctcagtggatgctccaggctgtgcctacacagcagtgctggtgacatgtccagggttccagggcccggtggcctgggagctgctttctccccactggctgggctgcatctggccctggctggaggccttgctttgaggggctgtgaccctcttcccccaggccctccccagccgacgacagccaccggagaggagatcggaacacgattgtctcagatgcagggcgctgtgcgggacgaagccgcaaggactctcgtatcgggcccttgggactcgggaggtgccagaggcggcggctgctctggacctcggtgttcactgacctttgtttcacttgcctctgctcgactccgagagcaggaaacccggccgtggcctggcagctccgcctcccatgcccgcacgctggggtctgtcttgtctggagcagtggggcacaccccggaggaggcgggggtcagggctgtcggccttggccccctgctggtcgctgtttcggggactcggggcggccagtaccaccgcctgaggcggggctcagcagcgttgcatgtacgggcctcgtactgcctcatggaaaatcctccggagccgccctccattgtgggttcctgagagtaggacacattgccatggttttgtgggaatcacgcgcccctgatggaacttttctgctgttgtgaagtacttttatccatttgcttctctgctgaccttgccaagttgttcgaggtggaattaaacacctcccagacctcaaaaaaaaaaaaaacaaacaaacaaagaaaaaaaataaaaaaaagaacaaaaaaagaaacaacaagacaaaaaaaaaaacaaaagaaaacaagaaaaaaaaaaagaaaaaaaaaaaaaagagggggggggggggcgaatatattaatttccacgaggggggggggacactaagtatcgttagcgactagctggttgttgttatgtaaaagaaggaggggggccctcacaaataagtggaggggctgtattatattataattacaaggcagcaggggggtcgtgacgtgttgttataaaaatagagtggtgggatgcgggagtaaaaaacatagtgtctgtgggtagtaggatattttgtgaggaaaggcaaacccccaacacaacgtaggggggagggagtgagacacacaataagtggcggaacccaacaaacacacatccaacgccgaagggcgatgtatacatacgctggcacggggcggggagccaaaaaaaaaaaatcacaatccgatggactatgaaagagatgcgcagtggacaccaccaccaccacaaaatgatagttagagcggcggacggggaaacaagaaccgtgaggccacagaaagcgagcgtagacaacgcagcagaaaaatactttccaccgggcgagaggtacttcacaccacgcn

SEQ ID NO: 356736 - DNA, 4117 bp, Homo sapiens
agcggggcggaggcggtgagcgcgggcggcgcggacggcagcggttggcgggcgggtcctccgctgttgcggccgctgcggcctccttgcccgggcttggggcgccgcgctggggaaagccgggggcccggacacattggcgtgagacctgggagtacgttgtgccaaatcattgccacttgccacatgagtgtaaatgatggcggatgccaagtatgtcctctgccgatgggaaaagcgattatggcctgcgaaggttttggcccgaaccgcgacttcaacaaaaaataagagaagaaaggaatattttctagctgtgcaaatcctctccctagaggaaaagttaagtgttgtgttgttttaatactgttttttcccgtgtagatttctgatacttcaatcccctactcccccaaaacagttgaagcccagcccactcttaatgggcttattcaccatttgtgtaattcattaatgctcataataacctcatgagaaagcaactagtttgattttatgtcagtttggaagctgaagatccaaacgaggcattctgtgagatctatggagagattggtacaaacactgaatacatgtaaattatactcagggtagaccctatttgtggttaaaatagggatatttccttttttttttttttttttgactgtttcttaatcagtgccatgccaggaaaatagggatgtttccttcccagagatctgtgtgtcttttttcagaaacgtctgtgacaggcccatcaattttgaaatatttggtttttgagcctgtcactctaaaccagcgtttaacgttcaaaaggcaaataactgatgaccaggcggcacattgttctgctccgtgagtgtctggcactgggaaaggtgtagattgtctagaatgacagcaattccgacgccccagtcagtcctgcgtgattgtggcgagggcgcgtctggcaccgggaaggtgtagatcatctagaatgacggcgattccgacgccccggtcagtcctgcgtgattggcgagggtgcatctgtcgtgagaattcccagttctgaagagagcaaggagactgatcccgcgtagtccaaggcattggctcccctgttgctcttccttgtggagctccccctgccccactccctcctgcctgcatcttcagagctgcctctgaagctcgcttggtccctagctcacactttccctgcggctgggaaggtaattgaatactcgagtttaaaaggaaagcacatccttttaaaccaaaacacacctgctgggctgtaaacagcttttagtgacattaccatctactctgaaaatctaacaaaggagtgatttgtgcagttgaaagtaggatttgcttcataaaagtcacaatttgaattcatttttgcttttaaatccagccaaccttttctgtcttaaaaggaaaaaaaaaaaaaaaccattcaccagggttcttgctgcctgtaacctcaggcagatgaattcctagttggctgtgacttttggtttaagtggaaggttgaggaggaaaatgaaaataattcttttgttatctaaaggaaaacatgtttgaaaatgtcttggcggcgttggctggtggtgtgtaacgtcgattttgtctctgcagaattaaggtgaaaagcactgaagttgagatcctagagaagtctcaaattgaagccattgcttcctcgttagggaacgcgaatcccctgagctgaaggagaaggaaaaatggatccgctttcttaaacctttccagaatttgcccctagaaccactcctattcttgacgcccagaatggtccctcacagaatgaggttcctgcggcacccctggaagaactggcctacagacggtcgcttcgcgtggctctggacgttctgagcgagggctcgatttggagtcaagaaagctctgcagggacaggtagagctgaccggtctctgcgagggaagcccatggagcatgtctcctcgccctgtgattcgaactcctcatctcttccccgcggagacgtgttgggcagttccagacctcacaggaggaggccatgtgtgcaacaaagcctgtcaagttcgttcacttgtgaaaaggaccccgagtgcaaagtggaccacaagaaggggctcaggaaaagtgaaaacccaagaggcccgttggtcctcccagctggaggtggtgcccaagatgagagtgggtccagaatccaccacaaaaattggactcttgcaagtaagaggggaagaaactcagcgcagaaggctagcttgtgcctgaatggatcttccctttcagaggacgacacggagagagacatggggagcaaaggaggcagctgggcagccccgtccttgccctccggggtcagggaggacgatccctgtgccaacgctgagggacacgaccccggtctgccgttgggcagcctcactgcgcccccagcccctgagccctcggcctgctcagagcctggagaatgccctgcgaaaaagaggccgcgcctggatggcagccaaaggccgcctgccgtgcagctggagcccatggcagcaggggccgcaccatcccccgggccggggccagggcccagagagtctgtgaccccgcgcagcaccgccaggctgggcccgcctccctcccacgcctctgcggatgcaaccagatgtcttccttgcccggattcccagaagctggagaaagagtgccagtcttccgaagagtccatggggtctaattccatgcgttctatcctggaggaagacgaggaagacgaggagccaccaagagtccttttataccacgaaccacgttcgtttgaagtaggaatgctagtctggcataaacataaaaaataccccttctggccagcagtggtcaaaagcgtcaggcagagagataagaaagcaagtgtgctatacatcgaaggacacatgaacccgaaaatgaaaggtttcacagtgtctcttaaaagtttaaagcactttgattgtaaagagaaacagacgcttctgaatcaagccagggaggacttcaaccaggacatcggctggtgtgtctccctcatcaccgactacagggtccggttaggctgcgggtcttttgctggctctttcctggaatattacgcggctgatataagctatcctgtccgaaaatccatccagcaggacgtcttggggaccaagcttcctcaactgagcaaggggagccccgaggagcccgtggtggggtgccccctggggcagaggcagccctgccggaaaatgctccccgaccgctcgcgggccgcccgggaccgggccaaccagaagctggtggagtacattgtgaaggccaagggcgcggagagccacctgcgggccatcctaaagagcaggaagccatctcgctggctgcagaccttcctgagctccagccagtacgtgacctgtgtggagacctacctggaggatgaggggcagctggacctggtggtgaagtacctgcagggcgtctaccaggaggtgggggccaaggtgctccagcgcaccaacggcgaccggatccggttcattctggacgtgcttctgcccgaggccatcatctgtgcgatctctgcggtggacgaggtggactacaagacggctgaggagaagtacatcaaggggccttcgctgagctaccgggaaaaagaaatatttgacaaccagctccttgaagagcggaaccggcgccgtcggtgagggagcagccggctgtgctgtcagcggggcctggcggtggaagcgcctccagtgtgcatgagcgtgtctgaagatggggggctcagggggcacgtttgcgtttggacctgtctgtgcgttctcctgcgtggcagtcctgatttccatacttctggagaatccatttcgttaacactgaaagccagttctcttttcctggcagtttttttcattttatttttggcattttttacaagataccgttcgggaaaggcttttgaaaggacggaagcgtattcactgtgcgccagtactcctggctgtgctgtggtttctcccgacgtgcacatcgatctcgtatgtgtggcatctgatattaaacgggaggttttaagaag

SEQ ID NO: 356737 - DNA, 4021 bp, Homo sapiens
  misc_feature (28)..(28): n is a, c, g, or t
  misc_feature (382)..(382): n is a, c, g, or t
ctggatctattgaaacatgtttaaaacngggttggggcagggacgctgctcagcaccctgcagcgcctaggacagccccacctcagagaacagtctggccccgacgtccacagggccgagtgggagagactctgctctgaaccgaatggactctgttaaaaatgtgtttaccataatcacaaaagtaaaaaatagggatgatttcttaatgtcaggtatgtattgtgtattcaggatactcttttttttttataacaataaacttaaggccgggtgtggtggctcgcatcggtaattccagcactttgggaggccgaggcaggtggatcatgaggccaggagcttgagaccagcctggccaacatggtgaaaccccgtttcnactaaaaatacaaaaattagctgggcgtggtggcgcgtacctataatcccagctactcgggaggctgaggcaggagaatcacctgaacccgggaggcagaggttgcagtgagctgagattatgccattgcgctccagcctgggcgacagggcgagactctgtaccagaaaaaaccgccaccaaaaaaaaaacttaaaatttttgagaaatgctcttgtgggtttgggtcttgccttttcttctctgcttttagtgatctgagctattgtgtctagtccgaaagatagtactgatttaattaagaaacatcattacaagcagggattcatggactaggtttgcaccttctgaaccatgagctagaccatgtctggaggctggaacctggtgacccaggctccctgcggccttcttaaccgcaggccacttggggccagttgggcagtgcctgctgctattgagccccgtgccctctcacaggccatcatctgtgcgatctctgcggtggacgaggtggactacaagacggctgaggagaagtacatcaaggggccttcgctgagctaccggtaggccgctcccggcgctatctccagccacttgcgtctctgccttgcagtttctatttccacacccacaggcagtttgactccaggctgccgcagcccctctccctcatgaggtggcccaggtgctgggtggtgagctgatcacatacgctgaactcaccctgtgggtcactcctgccccccaggaaggctgtgcccgggtctcccagctggtcgctgtgggcagcacggggccacgggcacgtgcctgggccgtgtctgttcttaatctctttttgcaggggctgatgtttgctttttgcactttcctcccctctttccacagccccatggctgtgtgagaaatacagcaagattaagcagcagcacggcccggtgctttccagcagccagaagaatgctgtgatcaagatgtttctctcacatccgtgtgcttagctgcccttggatgtttggcccccagagcgcctaatcctgtctctgggcatgcggccaggccttgctgggagccaggcggggcccacggggcagtgacaggctgaagactcaactagagtcaaggacagggtctccggccagggtggcttgcgcagccaccgacgtctcccgggcccacagtcacaggagactcctggtgaagacactgaactccctcaccagccccatgtcctccctgggcagggcaggaggggcccctggagaggccagggaggaggtgtggggcctcggtggcattggcaggccacccccgcagagctgcacaaaggtggaatttggccttgtttagggagtgttggcccagctggcttaccaaaacaggaaaggcctttggatacagaaactgggtgttttcctgctggatcttcatggttcccccgtcatgcttgccgtaagaataagtgaggtccggggagggggtaaggtcggagccaggacacctggacccagcctgctggtttgtcctctccctccgtctcagaagcctcttcaccgctccacgcccatctgtggaaatctttcatcctgatttttttttttgagtctgggttgccgacatcaaaacccgttaggagttcatcacagcttccagttgccatgaaagcctcccgtgacctgtgagaatggtgctggtgctgatggagaagttacttgggctgagcacacaggccgtgatttcatcacgccggggacatgctcaaaataacaagccaggaagggagcagccggctgtgctgtcagcggggcctggcggtggaagcgcctccagtgtgcatgagcgtgtctgaagatggggggctcagggggcacgtttgcgtttggacctgtctgtgcgttctcctgcgtggcagtcctgatttccatacttctggagaatccatttcgttaacactgaaagccagttctcttttcctggcagtttttttcattttatttttggcattttttacaagataccgttcgggaaaggcttttgaaaggacggaagcgtattcactgtgcgccagtactcctggctgtgctgtggtttctcccgacgtgcacatcgatctcgtatgtgtggcatctgatattaaacgggaggttttaagaagcgtctgccgtgatcatggagcttcggaagcgggaatggttcttccgggtttgctgttttgtctgtttcccccttgtgtggtttccgcctgcgacagttccagaatttgctctcccactcagtgtgctctgcagctgtgaggaaacagccttcgttagaggcgggagcagagacgagccgctgctctgtgtcgtgtttgctgtggccgcagggagaggagcgggacacgcacctttccaggggcctctgtgtcccgcactgtgtgtgagtggaccgcagcgcgcagccacatgccctggctgccatgggccagaccgcctccacctcccccgcccgcctggcctgtcctgagtgcatttccctgcactgtgtcgtcactgcacagccagtcaccgcggtctcagtcatcggcgcggatggctatgctggggtcccagggtggccgcagcagtcagggtcactgtgggagccctggggtggagtgacaaaccgcattgtcctgtgcccgccatggcagaagcgcagcctttgtatggaggcccaaccgcgctcccgtctggagaagcggcttccggggtgtggctgccgggtcggctctggtccacagcacggtgccggggctgcaggttgttgagggctgtgactccgtggggctcagccaggctccagcagggtcagacgtgctgttaagagcaaagccacagacgatgacttgtccattctcagtggatgctccaggctgtgcctacacagcagtgctggtgacatgtccagggttccagggcccggtggcctgggagctgctttctccccactggctgggctgcatctggccctggctggaggccttgctttgaggggctgtgaccctcttcccccaggccctccccagccgacgacagccaccggagaggagatcggaacacgattgtctcagatgcagggcgctgtgcgggacgaagccgcaaggactctcgtatcgggcccttgggactcgggaggtgccagaggcggcggctgctctggacctcggtgttcactgacctttgtttcacttgcctctgctcgactccgagagcaggaaacccggccgtggcctggcagctccgcctcccatgcccgcacgctggggtctgtcttgtctggagcagtggggcacaccccggaggaggcgggggtcagggctgtcggccttggccccctgctggtcgctgtttcggggactcggggcggccagtaccaccgcctgaggcggggctcagcagcgttgcatgtacgggcctcgtactgcctcatggaaaatcctccggagccgccctccattgtgggttcctgagagtaggacacattgccatggttttgtgggaatcacgcgcccctgatggaacttttctgctgttgtgaagtacttttatccatttgcttctctgctgaccttgccaagttgttcgaggtggaattaaacacctcccagacctc

SEQ ID NO: 356738 - DNA, 5236 bp, Homo sapiens
agcggggcggaggcggtgagcgcgggcggcgcggacggcagcggttggcgggcgggtcctccgctgttgcggccgctgcggcctccttgcccgggcttggggcgccgcgctggggaaagccgggggcccggacacattggcgtgagacctgggagtacgttgtgccaaatcattgccacttgccacatgagtgtaaatgatggcggatgccaagtatgtcctctgccgatgggaaaagcgattatggcctgcgaaggttttggcccgaaccgcgacttcaacaaaaaataagagaagaaaggaatattttctagctgtgcaaatcctctccctagaggaaaagttaagtgttgtgttgttttaatactgttttttcccgtgtagatttctgatacttcaatcccctactcccccaaaacagttgaagcccagcccactcttaatgggcttattcaccatttgtgtaattcattaatgctcataataacctcatgagaaagcaactagtttgattttatgtcagtttggaagctgaagatccaaacgaggcattctgtgagatctatggagagattggtacaaacactgaatacatgtaaattatactcagggtagaccctatttgtggttaaaatagggatatttccttttttttttttttttttgactgtttcttaatcagtgccatgccaggaaaatagggatgtttccttcccagagatctgtgtgtcttttttcagaaacgtctgtgacaggcccatcaattttgaaatatttggtttttgagcctgtcactctaaaccagcgtttaacgttcaaaaggcaaataactgatgaccaggcggcacattgttctgctccgtgagtgtctggcactgggaaaggtgtagattgtctagaatgacagcaattccgacgccccagtcagtcctgcgtgattgtggcgagggcgcgtctggcaccgggaaggtgtagatcatctagaatgacggcgattccgacgccccggtcagtcctgcgtgattggcgagggtgcatctgtcgtgagaattcccagttctgaagagagcaaggagactgatcccgcgtagtccaaggcattggctcccctgttgctcttccttgtggagctccccctgccccactccctcctgcctgcatcttcagagctgcctctgaagctcgcttggtccctagctcacactttccctgcggctgggaaggtaattgaatactcgagtttaaaaggaaagcacatccttttaaaccaaaacacacctgctgggctgtaaacagcttttagtgacattaccatctactctgaaaatctaacaaaggagtgatttgtgcagttgaaagtaggatttgcttcataaaagtcacaatttgaattcatttttgcttttaaatccagccaaccttttctgtcttaaaaggaaaaaaaaaaaaaaaccattcaccagggttcttgctgcctgtaacctcaggcagatgaattcctagttggctgtgacttttggtttaagtggaaggttgaggaggaaaatgaaaataattcttttgttatctaaaggaaaacatgtttgaaaatgtcttggcggcgttggctggtggtgtgtaacgtcgattttgtctctgcagaattaaggtgaaaagcactgaagttgagatcctagagaagtctcaaattgaagccattgcttcctcgttagggaacgcgaatcccctgagctgaaggagaaggaaaaatggatccgctttcttaaacctttccagaatttgcccctagaaccactcctattcttgacgcccagaatggtccctcacagaatgaggttcctgcggcacccctggaagaactggcctacagacggtcgcttcgcgtggctctggacgttctgagcgagggctcgatttggagtcaagaaagctctgcagggacaggtagagctgaccggtctctgcgagggaagcccatggagcatgtctcctcgccctgtgattcgaactcctcatctcttccccgcggagacgtgttgggcagttccagacctcacaggaggaggccatgtgtgcaacaaagcctgtcaagttcgttcacttgtgaaaaggaccccgagtgcaaagtggaccacaagaaggggctcaggaaaagtgaaaacccaagaggcccgttggtcctcccagctggaggtggtgcccaagatgagagtgggtccagaatccaccacaaaaattggactcttgcaagtaagaggggaagaaactcagcgcagaaggctagcttgtgcctgaatggatcttccctttcagaggacgacacggagagagacatggggagcaaaggaggcagctgggcagccccgtccttgccctccggggtcagggaggacgatccctgtgccaacgctgagggacacgaccccggtctgccgttgggcagcctcactgcgcccccagcccctgagccctcggcctgctcagagcctggagaatgccctgcgaaaaagaggccgcgcctggatggcagccaaaggccgcctgccgtgcagctggagcccatggcagcaggggccgcaccatcccccgggccggggccagggcccagagagtctgtgaccccgcgcagcaccgccaggctgggcccgcctccctcccacgcctctgcggatgcaaccagatgtcttccttgcccggattcccagaagctggagaaagagtgccagtcttccgaagagtccatggggtctaattccatgcgttctatcctggaggaagacgaggaagacgaggagccaccaagagtccttttataccacgaaccacgttcgtttgaagtaggaatgctagtctggcataaacataaaaaataccccttctggccagcagtggtcaaaagcgtcaggcagagagataagaaagcaagtgtgctatacatcgaaggacacatgaacccgaaaatgaaaggtttcacagtgtctcttaaaagtttaaagcactttgattgtaaagagaaacagacgcttctgaatcaagccagggaggacttcaaccaggacatcggctggtgtgtctccctcatcaccgactacagggtccggttaggctgcgggtcttttgctggctctttcctggaatattacgcggctgatataagctatcctgtccgaaaatccatccagcaggacgtcttggggaccaagcttcctcaactgagcaaggggagccccgaggagcccgtggtggggtgccccctggggcagaggcagccctgccggaaaatgctccccgaccgctcgcgggccgcccgggaccgggccaaccagaagctggtggagtacattgtgaaggccaagggcgcggagagccacctgcgggccatcctaaagagcaggaagccatctcgctggctgcagaccttcctgagctccagccagtacgtgacctgtgtggagacctacctggaggatgaggggcagctggacctggtggtgaagtacctgcagggcgtctaccaggaggtgggggccaaggtgctccagcgcaccaacggcgaccggatccggttcattctggacgtgcttctgcccgaggccatcatctgtgcgatctctgcggtggacgaggtggactacaagacggctgaggagaagtacatcaaggggccttcgctgagctaccgggaaaaagaaatatttgacaaccagctccttgaagagcggaaccggcgccgtcggtgagggagcagccggctgtgctgtcagcggggcctggcggtggaagcgcctccagtgtgcatgagcgtgtctgaagatggggggctcagggggcacgtttgcgtttggacctgtctgtgcgttctcctgcgtggcagtcctgatttccatacttctggagaatccatttcgttaacactgaaagccagttctcttttcctggcagtttttttcattttatttttggcattttttacaagataccgttcgggaaaggcttttgaaaggacggaagcgtattcactgtgcgccagtactcctggctgtgctgtggtttctcccgacgtgcacatcgatctcgtatgtgtggcatctgatattaaacgggaggttttaagaagcgtctgccgtgatcatggagcttcggaagcgggaatggttcttccgggtttgctgttttgtctgtttcccccttgtgtggtttccgcctgcgacagttccagaatttgctctcccactcagtgtgctctgcgcattgtcctgtgcccgccatggcagaagcgcagcctttgtatggaggcccaaccgcgctcccgtctggagaagcggcttccggggtgtggctgccgggtcggctctggtccacagcacggtgccggggctgcaggttgttgagggctgtgactccgtggggctcagccaggctccagcagggtcagacgtgctgttaagagcaaagccacagacgatgacttgtccattctcagtggatgctccaggctgtgcctacacagcagtgctggtgacatgtccagggttccagggcccggtggcctgggagctgctttctccccactggctgggctgcatctggccctggctggaggccttgctttgaggggctgtgaccctcttcccccaggccctccccagccgacgacagccaccggagaggagatcggaacacgattgtctcagatgcagggcgctgtgcgggacgaagccgcaaggactctcgtatcgggcccttgggactcgggaggtgccagaggcggcggctgctctggacctcggtgttcactgacctttgtttcacttgcctctgctcgactccgagagcaggaaacccggccgtggcctggcagctccgcctcccatgcccgcacgctggggtctgtcttgtctggagcagtggggcacaccccggaggaggcgggggtcagggctgtcggccttggccccctgctggtcgctgtttcggggactcggggcggccagtaccaccgcctgaggcggggctcagcagcgttgcatgtacgggcctcgtactgcctcatggaaaatcctccggagccgccctccattgtgggttcctgagagtaggacacattgccatggttttgtgggaatcacgcgcccctgatggaacttttctgctgttgtgaagtacttttatccatttgcttctctgctgaccttgccaagttgttcgaggtggaattaaacacctcccagacctc

SEQ ID NO: 356739 - DNA, 2650 bp, Homo sapiens
gactgtctgtgatttcgaacttcagctgcggatttggggcttggtgaggagcaaatacagatgattttgaagtttgtatctgaaatttcagagaggacattgctgggcatatgtgtacatctgtgggaaaaaaacatactcaaaactatttaactttataactatgggaattttcaaatagacccaaaaagaaaatagcataatgaactctaatgtgcccataacctgcctggaattattttttggagcataaaaaccctcaagctttttttttttttttttgagattatgccattgcgctccagcctgggcgacagggcgagactctgtaccagaaaaaaccgccaccaaaaaaaaaacttaaaatttttgagaaatgctcttgtgggtttgggtcttgccttttcttctctgcttttagtgatctgagctattgtgtctagtccgaaagatagtactgatttaattaagaaacatcattacaagcagggattcatggactaggtttgcaccttctgaaccatgagctagaccatgtctggaggctggaacctggtgacccaggctccctgcggccttcttaaccgcaggccacttggggccagttgggcagtgcctgctgctattgagccccgtgccctctcacaggccatcatctgtgcgatctctgcggtggacgaggtggactacaagacggctgaggagaagtacatcaaggggccttcgctgagctaccgggaaaaagaaatatttgacaaccagctccttgaagagcggaaccggcgccgtcggtgagggagcagccggctgtgctgtcagcggggcctggcggtggaagcgcctccagtgtgcatgagcgtgtctgaagatggggggctcagggggcacgtttgcgtttggacctgtctgtgcgttctcctgcgtggcagtcctgatttccatacttctggagaatccatttcgttaacactgaaagccagttctcttttcctggcagtttttttcattttatttttggcattttttacaagataccgttcgggaaaggcttttgaaaggacggaagcgtattcactgtgcgccagtactcctggctgtgctgtggtttctcccgacgtgcacatcgatctcgtatgtgtggcatctgatattaaacgggaggttttaagaagcgtctgccgtgatcatggagcttcggaagcgggaatggttcttccgggtttgctgttttgtctgtttcccccttgtgtggtttccgcctgcgacagttccagaatttgctctcccactcagtgtgctctgcagctgtgaggaaacagccttcgttagaggcgggagcagagacgagccgctgctctgtgtcgtgtttgctgtggccgcagggagaggagcgggacacgcacctttccaggggcctctgtgtcccgcactgtgtgtgagtggaccgcagcgcgcagccacatgccctggctgccatgggccagaccgcctccacctcccccgcccgcctggcctgtcctgagtgcatttccctgcactgtgtcgtcactgcacagccagtcaccgcggtctcagtcatcggcgcggatggctatgctggggtcccagggtggccgcagcagtcagggtcactgtgggagccctggggtggagtgacaaaccgcattgtcctgtgcccgccatggcagaagcgcagcctttgtatggaggcccaaccgcgctcccgtctggagaagcggcttccggggtgtggctgccgggtcggctctggtccacagcacggtgccggggctgcaggttgttgagggctgtgactccgtggggctcagccaggctccagcagggtcagacgtgctgttaagagcaaagccacagacgatgacttgtccattctcagtggatgctccaggctgtgcctacacagcagtgctggtgacatgtccagggttccagggcccggtggcctgggagctgctttctccccactggctgggctgcatctggccctggctggaggccttgctttgaggggctgtgaccctcttcccccaggccctccccagccgacgacagccaccggagaggagatcggaacacgattgtctcagatgcagggcgctgtgcgggacgaagccgcaaggactctcgtatcgggcccttgggactcgggaggtgccagaggcggcggctgctctggacctcggtgttcactgacctttgtttcacttgcctctgctcgactccgagagcaggaaacccggccgtggcctggcagctccgcctcccatgcccgcacgctggggtctgtcttgtctggagcagtggggcacaccccggaggaggcgggggtcagggctgtcggccttggccccctgctggtcgctgtttcggggactcggggcggccagtaccaccgcctgaggcggggctcagcagcgttgcatgtacgggcctcgtactgcctcatggaaaatcctccggagccgccctccattgtgggttcctgagagtaggacacattgccatggttttgtgggaatcacgcgcccctgatggaacttttctgctgttgtgaagtacttttatccatttgcttctctgctgaccttgccaagttgttcgaggtggaattaaacacctcccagacctc

SEQ ID NO: 356740 - DNA, 1282 bp, Homo sapiens
  misc_feature (15)..(15): n is a, c, g, or t
  misc_feature (29)..(29): n is a, c, g, or t
caaattaggctagtngaggctgggtttangcgcacctttccaggggcctctgtgtcccgcactgtgtgtgagtggaccgcagcgcgcagccacatgccctggctgccatgggccagaccgcctccacctcccccgcccgcctggcctgtcctgagtgcatttccctgcactgtgtcgtcactgcacagccagtcaccgcggtctcagtcatcggcgcggatggctatgctggggtcccagggtggccgcagcagtcagggtcactgtgggagccctggggtggagtgacaaaccgcattgtcctgtgcccgccatggcagaagcgcagcctttgtatggaggcccaaccgcgctcccgtctggagaagcggcttccggggtgtggctgccgggtcggctctggtccacagcacggtgccggggctgcaggttgttgagggctgtgactccgtggggctcagccaggctccagcagggtcagacgtgctgttaagagcaaagccacagacgatgacttgtccattctcagtggatgctccaggctgtgcctacacagcagtgctggtgacatgtccagggttccagggcccggtggcctgggagctgctttctccccactggctgggctgcatctggccctggctggaggccttgctttgaggggctgtgaccctcttcccccaggccctccccagccgacgacagccaccggagaggagatcggaacacgattgtctcagatgcagggcgctgtgcgggacgaagccgcaaggactctcgtatcgggcccttgggactcgggaggtgccagaggcggcggctgctctggacctcggtgttcactgacctttgtttcacttgcctctgctcgactccgagagcaggaaacccggccgtggcctggcagctccgcctcccatgcccgcacgctggggtctgtcttgtctggagcagtggggcacaccccggaggaggcgggggtcagggctgtcggccttggccccctgctggtcgctgtttcggggactcggggcggccagtaccaccgcctgaggcggggctcagcagcgttgcatgtacgggcctcgtactgcctcatggaaaatcctccggagccgccctccattgtgggttcctgagagtaggacacattgccatggttttgtgggaatcacgcgcccctgatggaacttttctgctgttgtgaagtacttttatccatttgcttctctgctgaccttgccaagttgttcgaggtggaattaaacacctcccagacctc

SEQ ID NO: 356741 - DNA, 1067 bp, Homo sapiens
  misc_feature (14)..(14): n is a, c, g, or t
tacgcgcggcggtngcggaggcggacacattggcgtgagacctgggagtacgttgtgccaaatcattgccacttgccacatgagtgtaaatgatggcggatgccaagtatgtcctctgccgatgggaaaagcgattatggcctgcgaaggttttggcccgaaccgcgacttcaacaaaaaataagagaagaaaggaatattttctagctgtgcaaatcctctccctagaggaaaaaattaaggtgaaaagcactgaagttgagatcctagagaagtctcaaattgaagccattgcttcctcgttagggaacgcgaatcccctgagctgaaggagaaggaaaaatggatccgctttcttaaacctttccagaatttgcccctagaaccactcctattcttgacgcccagaatggtcagtggtgagcatcaaggtcatctcgtaccctcgtggcctccagtacacaagacgaggaaggactttgctgccataaggggggaggtcctcctttttcctttcctcttcctatagtaagatttgctgtggtactgtcgctgcctggccagtctggtctcagcccaaggtttgagaagcagttggttgtgtgtttaaaattccagagcagagcccaagggagagaacgggtggcctggcactggggttggtggcacccattgtttgaggcactgtcatggggggcacgaggcaggtcggaagtggagctctcggcttcccatccatccgggtgcgctttctcccaggccttcagtttagcacccacctcctttgcacactgtgggtgagaaaagctttgcctgagtccagccggggactggtcatgcacatacatgacaagtgaggagcactggtgactgcctgccccctagccacagttgtgcaaacccaaacctgccagccttccttctcaaagtggaactgtttatcccatttgcaaataattgtttctcttgtgaaaagatggaccggaattccttccaatgatgtttataaaatcaggtctattttcctgtgtcttccgaaaaacagctcttgtttaaagcaggatcca

SEQ ID NO: 356742 - DNA, 2471 bp, Homo sapiens
gccgcggcaaccagcacaccccggcacctcctctgcggcagctgcgcctcgcaagcgcagtgccgcagcgcacgccggagtggctgtagctgcccggcgcggcgccgccctgcgcgggctgtgggctgcgggctgcgcccccgctgctggccagctctgcacggctgcgggctctgcggcgcccggtgctctgcaacgctgcggcgggcggcatgggataacgcggccatggtgcgccgagatcgcctccgcaggatgagggagtggtgggtccaggtggggctgctggccgtgcccctgcttgctgcgtacctgcacatcccaccccctcagctctcccctgcccttcactcatggaagtcttcaggcaagtttttcacttacaagggactgcgtatcttctaccaagactctgtgggtgtggttggaagtccagagatagttgtgcttttacacggttttccaacatccagctacgactggtacaagatttgggaaggtctgaccttgaggtttcatcgggtgattgcccttgatttcttaggctttggcttcagtgacaaaccgagaccacatcactattccatatttgagcaggccagcatcgtggaagcgcttttgcggcatctggggctccagaaccgcaggatcaaccttctttctcatgactatggagatattgttgctcaggagcttctctacaggtacaagcagaatcgatctggtcggcttaccataaagagtctctgtctgtcaaatggaggtatctttcctgagactcaccgtccactccttctccaaaagctactcaaagatggaggtgtgctgtcacccatcctcacacgactgatgaacttctttgtattctctcgaggtctcaccccagtctttgggccgtatactcggccctctgagagtgagctgtgggacatgtgggcagggatccgcaacaatgacgggaacttagtcattgacagtctcttacagtacatcaatcagaggaagaagttcagaaggcgctgggtgggagctcttgcctctgtaactatccccattcattttatctatgggccattggatcctgtaaatccctatccagagtttttggagctgtacaggaaaacgctgccgcggtccacagtgtcgattctggatgaccacattagccactatccacagctagaggatcccatgggcttcttgaatgcatatatgggcttcatcaactccttctgagctggaaagagtagcttccctgtattacctcccctactcccttatctgttgtgtattccacttaggaagaaatgcccaaaagaggtcctggccatcaaacataattctctcacaaagtccactttactcaaattggtgaacagtgtataggaagaagccagcaggagctctgactaaggttgacataatagtccacctcccattactttgatatctgatcaaatgtatagacttggctttgttttttgtgctattaggaaattctgatgagcattactattcactgatgcagaaagacgttcttttgcataaaagactttttttaacactttggacttctctgaaatatttagaagtgctaatttctggcccacccccaacaggaattctatagtaaggaggaggagaaggggggctccttccctctcctcgaatgacgttatgggcacatgccttttaaaagttctttaagcaacacagagctgagtcctctttgtcatacctttggatttagtgtttcatcagctgtttttagttataaacattttgttaaaatagatattggtttaaatgatacagtattttaggtatgatttaagactatgatttacctatacattatatatattttataaagatactaaaccagcatacccttactctgccagagtagtgaagctaattaaacacgtttggtttctgaataaattgaactaaatccaaactatttcctaaaatcacaggacattaaggaccaatagcatctgtgccagagatgtactgttattagctgggaagaccaattctaacagcaaataacagtctgagactcctcatacctcagtggttagaagcatgtctctcttgagctacagtagaggggaagggattgttgtgtagtcaagtcaccatgctgaatgtacactgattcctttatgatgactgcttaactccccactgcctgtcccagagaggctttccaatgtagctcagtaattcctgttactttacagacaggaaagttccagaaactttaagaacaaactctgaaagacctatgagcaaatggtgctgaatactttttttttaaagccacatttcattgtcttagtcaaagcaggattattaagtgattatttaaaattcgtttttttaaattagcaacttcaagtataacaactttgaaactggaataagtgtttattttctattaataaaaatgaattgtgacaaaa

SEQ ID NO: 356743 - DNA, 1558 bp, Homo sapiens
gtttgctcagctacatgtgtgtttcctcgtctcccttctaggtacaagcagaatcgatctggtcggcttaccataaagagtctctgtctgtcaaatggaggtatctttcctgagactcaccgtccactccttctccaaaagctactcaaagatggaggtgtgctgtcacccatcctcacacgactgatgaacttctttgggtaagtgtcactgtcaaagattgtggcctagagcaatgtcgtgaaaagttgctgccattacaattctgggccaaatcctaaggcttgatattttaaagcaaaggtgttggccgcttgccagggaagtagaaggaattcataaatcacttatgggtcagactgcatggcccagactgcatggcctctgaggttccagccatattgaacattctgagttctcctcacacttatcttcctgcgttttggactattctctcgaggtctcaccccagtctttgggccgtatactcggccctctgagagtgagctgtgggacatgtgggcagggatccgcaacaatgacgggaacttagtcattgacaggtaagaagttaccctttgctttggtttccagagacgtgtttctgtggagaagtggggattgcttgttctgttccttggctggcttattccctatcacaggaaggctgatgatgacctatggggcaaaccaaaaagtcatggtctatatgaagaaagaaatagaaaataagagtgaaactggactctttgttagtattaaatgcttcaaagtattgaatcatggttgtgaaagtagcctagtgcctccctcaaggtacaaggctcttccttttgcctatctttctgcagcaacggggagtgagagggcagacttctctttctctgtcttgtacaaagaattcccatgccttggttcaaatgagaatgtagacactttcacaagggacccagaggtggtgatagctgtaactacttgggataagactctgacttctagccacctggctcagtgtagcttccagtgtttttactgatggctttgctggggattgtatgttagagggagccaatcctcccaccctctcctaagccccaacaggatccctgaatatttcattttagtattaaaaaactgaagaacaattaagactgtcttttaaaattatattttcctttccaaaaagtaaatactatttgtaagatgagatatttgaggttcacaaaaataactgtcctggagttgccaggcagaatgagtagaatacatgagtttgagttctaaaatgtggcagtggtgtcttacgctggagaaagaggaatcctctccattttatctgtggtcagatgaagctttgtgctcatcaacatctacacttagaattttgaagtagatgtcggctgggcacagtggctcacgcctgtaatttgagcactttgggaggccaaggtgggcgaatcatatgaggtcaggagtttagagaccagcctggccaacatgatgaaaccccgtgtctactaaaaatacaaaaattagccagtaattccagctactcagg

SEQ ID NO: 356744 - DNA, 1270 bp, Homo sapiens
atttactgaagggaataaacaactccttggcactctggaagggatcactgccaagttaccctccctcaacagggattaattaccaggaataaagcattttccaagaggatcatctgtgggacctgtggtagtttcatggcgttttctctttatggaagtctgttaagccaagatagggctgaagctcctgtgcaactgtaggtctggtgaaagggaggggcaggagcagaaagcccaaatcatcgtttctttcttgtagatttgggaaggtctgaccttgaggtttcatcgggtgattgcccttgatttcttaggctttggcttcagtgacaaaccgagaccacatcactattccatatttgagcaggccagcatcgtggaagcgcttttgcggcatctggggctccagaaccgcaggatcaaccttctttctcatgactatggagatattgttgctcaggagcttctctacaggtacaagcagaatcgatctggtcggcttaccataaagagtctctgtctgtcaaatggaggtaattgccttggcggtaggtagaaagtgggtgtaatctagaagggccatctttagatacagcggcacctaaatggtaatctgataatatttcaagtagacataattaaactatgggatctctacctcttctgtgccatcaactcctttggtggtctgacaagatttatggaccctttctcagaatgttttaaaataaagaaacaaacagcattacaaaggatagtgactttacttacatagtcaataaaaagctgcattatagtcacatgtgctttttcaatgcattagatagcaagttctagtggaggacctagtaacagctatatcagaaggagtgaggagtgtaaagactgtttgccatatctgaaacaactgcaataggttatgagagtgtaggattgaagatacagaaaaaagccacaagtgtttctaatactactatgatgttagtgtagaaaatccttacttaatgtcatcaatgggttcttggaaactgtgactttaaatgaaacgttataatggaaccaattttttttctcatcaatgttttaaagaaaggatgttattcaaggacctgctgtacctcattctgcttaaagccgaagtttccaagaacctatcctgatgttaagtgaggacttaactgtatgagattccccaactcctaactgatggcagtgccaagtttcagttagaaaataccgaacccctgattagactttctgggtagccagc

SEQ ID NO: 356745 - DNA, 569 bp, Homo sapiens
ggggataggggcggggacagcgcaaggtggatcagaaagctggggactcacgaagtggcccaaagatcaaagctattcctcagctccagggctacctgcgatctgtgtttgctctgacgaatggaatttatcctcacaaattggtgttctaaatgtcttaagaacctaattaaatagctgactaccaaaaaaaaaataaaaaaaaaaaaaacctcgtgccgaattcggcacgagcggcacgagaagcatgtctctcttgagctacagtagaggggaagggattgttgtgtagtcaagtcaccatgctgaatgtacactgattcctttatgatgactgcttaactccccactgcctgtcccagagaggctttccaatgtagctcagtaattcctgttactttacagacaggaaagttccagataaagccacatttcattgtcttagtcaaagcaggattattaagtgattatttaaaattcgtttttttaaattagcaacttcaagtataacaactttgaaactggaataagtgtttattttctattaataaaaatgaattgtgacaaaa

SEQ ID NO: 356746 - DNA, 2611 bp, Homo sapiens
gccgcggcaaccagcacaccccggcacctcctctgcggcagctgcgcctcgcaagcgcagtgccgcagcgcacgccggagtggctgtagctgcccggcgcggcgccgccctgcgcgggctgtgggctgcgggctgcgcccccgctgctggccagctctgcacggctgcgggctctgcggcgcccggtgctctgcaacgctgcggcgggcggcatgggataacgcggccatggtgcgccgagatcgcctccgcaggatgagggagtggtgggtccaggtggggctgctggccgtgcccctgcttgctgcgtacctgcacatcccaccccctcagctctcccctgcccttcactcatggaagtcttcaggcaagtttttcacttacaagggactgcgtatcttctaccaagactctgtgggtgtggttggaagtccagagatagttgtgcttttacacggttttccaacatccagctacgactggtacaagatttgggaaggtctgaccttgaggtttcatcgggtgattgcccttgatttcttaggctttggcttcagtgacaaaccgagaccacatcactattccatatttgagcaggccagcatcgtggaagcgcttttgcggcatctggggctccagaaccgcaggatcaaccttctttctcatgactatggagatattgttgctcaggagcttctctacaggtacaagcagaatcgatctggtcggcttaccataaagagtctctgtctgtcaaatggaggtatctttcctgagactcaccgtccactccttctccaaaagctactcaaagatggaggtgtgctgtcacccatcctcacacgactgatgaacttctttgtattctctcgaggtctcaccccagtctttgggccgtatactcggccctctgagagtgagctgtgggacatgtgggcagggatccgcaacaatgacgggaacttagtcattgacagtctcttacagtacatcaatcagaggaagaagttcagaaggcgctgggtgggagctcttgcctctgtaactatccccattcattttatctatgggccattggatcctgtaaatccctatccagagtttttggagctgtacaggaaaacgctgccgcggtccacagtgtcgattctggatgaccacattagccactatccacagctagaggatcccatgggcttcttgaatgcatatatgggcttcatcaactccttctgagctggaaagagtagcttccctgtattacctcccctactcccttatctgttgtgtattccacttaggaagaaatgcccaaaagaggtcctggccatcaaacataattctctcacaaagtccactttactcaaattggtgaacagtgtataggaagaagccagcaggagctctgactaaggttgacataatagtccacctcccattactttgatatctgatcaaatgtatagacttggctttgttttttgtgctattaggaaattctgatgagcattactattcactgatgcagaaagacgttcttttgcataaaagactttttttaacactttggacttctctgaaatatttagaagtgctaatttctggcccacccccaacaggaattctatagtaaggaggaggagaaggggggctccttccctctcctcgaatgacgttatgggcacatgccttttaaaagttctttaagcaacacagagctgagtcctctttgtcatacctttggatttagtgtttcatcagctgtttttagttataaacattttgttaaaatagatattggtttaaatgatacagtattttaggtatgatttaagactatgatttacctatacattatatatattttataaagatactaaaccagcatacccttactctgccagagtagtgaagctaattaaacacgtttggtttctgaataaattgaactaaatccaaactatttcctaaaatcacaggacattaaggaccaatagcatctgtgccagagatgtactgttattagctgggaagaccaattctaacagcaaataacagtctgagactcctcatacctcagtggttagaagcatgtctctcttgagctacagtagaggggaagggattgttgtgtagtcaagtcaccatgctgaatgtacactgattcctttatgatgactgcttaactccccactgcctgtcccagagaggctttccaatgtagctcagtaattcctgttactttacagacaggaaagttccagaaactttaagaacaaactctgaaagacctatgagcaaatggtgctgaatactttttttttaaagccacatttcattgtcttagtcaaagcaggattattaagtgattatttaaaattcgtttttttaaattagcaacttcaagtataacaactttgaaactggaataagtgtttattttctattaataaaaatgaattgtgacaaaaaaaaaaaaaaaaaaaaaaaaaaaaaaaaaagtaaaaaaagtaaactgaaaaggtattaaactatctaccaagaattatgtatataattattcttccattccattttacattttgggggggggccctggtccaaaattccc

SEQ ID NO: 356747 - DNA, 2385 bp, Homo sapiens
ggctgcgagggcgctgctgtggccaggcgtctggcatgctgaccacgtcgcgctgctgtaaaggaaacctgccccgcgcagcggcggtggctggagcgggagaaaccggactttgtgcaactttggccatagtggccatcccatgaatctgtttactagcttggtcaggatgagggagtggtgggtccaggtggggctgctggccgtgcccctgcttgctgcgtacctgcacatcccaccccctcagctctcccctgcccttcactcatggaagtcttcaggcaagtttttcacttacaagggactgcgtatcttctaccaagactctgtgggtgtggttggaagtccagagatagttgtgcttttacacggttttccaacatccagctacgactggtacaagatttgggaaggtctgaccttgaggtttcatcgggtgattgcccttgatttcttaggctttggcttcagtgacaaaccgagaccacatcactattccatatttgagcaggccagcatcgtggaagcgcttttgcggcatctggggctccagaaccgcaggatcaaccttctttctcatgactatggagatattgttgctcaggagcttctctacaggtacaagcagaatcgatctggtcggcttaccataaagagtctctgtctgtcaaatggaggtatctttcctgagactcaccgtccactccttctccaaaagctactcaaagatggaggtgtgctgtcacccatcctcacacgactgatgaacttctttgtattctctcgaggtctcaccccagtctttgggccgtatactcggccctctgagagtgagctgtgggacatgtgggcagggatccgcaacaatgacgggaacttagtcattgacagtctcttacagtacatcaatcagaggaagaagttcagaaggcgctgggtgggagctcttgcctctgtaactatccccattcattttatctatgggccattggatcctgtaaatccctatccagagtttttggagctgtacaggaaaacgctgccgcggtccacagtgtcgattctggatgaccacattagccactatccacagctagaggatcccatgggcttcttgaatgcatatatgggcttcatcaactccttctgagctggaaagagtagcttccctgtattacctcccctactcccttatctgttgtgtattccacttaggaagaaatgcccaaaagaggtcctggccatcaaacataattctctcacaaagtccactttactcaaattggtgaacagtgtataggaagaagccagcaggagctctgactaaggttgacataatagtccacctcccattactttgatatctgatcaaatgtatagacttggctttgttttttgtgctattaggaaattctgatgagcattactattcactgatgcagaaagacgttcttttgcataaaagactttttttaacactttggacttctctgaaatatttagaagtgctaatttctggcccacccccaacaggaattctatagtaaggaggaggagaaggggggctccttccctctcctcgaatgacgttatgggcacatgccttttaaaagttctttaagcaacacagagctgagtcctctttgtcatacctttggatttagtgtttcatcagctgtttttagttataaacattttgttaaaatagatattggtttaaatgatacagtattttaggtatgatttaagactatgatttacctatacattatatatattttataaagatactaaaccagcatacccttactctgccagagtagtgaagctaattaaacacgtttggtttctgaataaattgaactaaatccaaactatttcctaaaatcacaggacattaaggaccaatagcatctgtgccagagatgtactgttattagctgggaagaccaattctaacagcaaataacagtctgagactcctcatacctcagtggttagaagcatgtctctcttgagctacagtagaggggaagggattgttgtgtagtcaagtcaccatgctgaatgtacactgattcctttatgatgactgcttaactccccactgcctgtcccagagaggctttccaatgtagctcagtaattcctgttactttacagacaggaaagttccagaaactttaagaacaaactctgaaagacctatgagcaaatggtgctgaatactttttttttaaagccacatttcattgtcttagtcaaagcaggattattaagtgattatttaaaattcgtttttttaaattagcaacttcaagtataacaactttgaaactggaataagtgtttattttctattaataaaaatgaattgtgacaaaa

SEQ ID NO: 356748 - DNA, 2703 bp, Homo sapiens
tcaaaatgtcacttctttggccttcacttttattatgtaaaagtactcagatcaggccgaatacaattttattctctttatccaatgccggaggctattgtcgaagccacggcctgccatttcataccctttgcaataggtggcgctgacgcctggcagggagaaggcggcagcacatgctgggctcgggggcgatgggcttgtgcgcggacctggcgacgctctagccccgagccgcgtattcgtggccgggtcctccctgggaacagggtgaaggccgagaacctctggcctcaggaagcgcatgcgcaaccggttctccgaaacatggagtcctgtaggcaaggtcttacctgaatcaggtaagaggcgggcggggaaggagtggagcctccccgtgcaccctcgcagcccgctccaggagtgggactagccctccttgggggtgtggctcgtgtgcgtgggccacaccagtcctaggggcaggatgagggagtggtgggtccaggtggggctgctggccgtgcccctgcttgctgcgtacctgcacatcccaccccctcagctctcccctgcccttcactcatggaagtcttcaggcaagtttttcacttacaagggactgcgtatcttctaccaagactctgtgggtgtggttggaagtccagagatagttgtgcttttacacggttttccaacatccagctacgactggtacaagatttgggaaggtctgaccttgaggtttcatcgggtgattgcccttgatttcttaggctttggcttcagtgacaaaccgagaccacatcactattccatatttgagcaggccagcatcgtggaagcgcttttgcggcatctggggctccagaaccgcaggatcaaccttctttctcatgactatggagatattgttgctcaggagcttctctacaggtacaagcagaatcgatctggtcggcttaccataaagagtctctgtctgtcaaatggaggtatctttcctgagactcaccgtccactccttctccaaaagctactcaaagatggaggtgtgctgtcacccatcctcacacgactgatgaacttctttgtattctctcgaggtctcaccccagtctttgggccgtatactcggccctctgagagtgagctgtgggacatgtgggcagggatccgcaacaatgacgggaacttagtcattgacagtctcttacagtacatcaatcagaggaagaagttcagaaggcgctgggtgggagctcttgcctctgtaactatccccattcattttatctatgggccattggatcctgtaaatccctatccagagtttttggagctgtacaggaaaacgctgccgcggtccacagtgtcgattctggatgaccacattagccactatccacagctagaggatcccatgggcttcttgaatgcatatatgggcttcatcaactccttctgagctggaaagagtagcttccctgtattacctcccctactcccttatctgttgtgtattccacttaggaagaaatgcccaaaagaggtcctggccatcaaacataattctctcacaaagtccactttactcaaattggtgaacagtgtataggaagaagccagcaggagctctgactaaggttgacataatagtccacctcccattactttgatatctgatcaaatgtatagacttggctttgttttttgtgctattaggaaattctgatgagcattactattcactgatgcagaaagacgttcttttgcataaaagactttttttaacactttggacttctctgaaatatttagaagtgctaatttctggcccacccccaacaggaattctatagtaaggaggaggagaaggggggctccttccctctcctcgaatgacgttatgggcacatgccttttaaaagttctttaagcaacacagagctgagtcctctttgtcatacctttggatttagtgtttcatcagctgtttttagttataaacattttgttaaaatagatattggtttaaatgatacagtattttaggtatgatttaagactatgatttacctatacattatatatattttataaagatactaaaccagcatacccttactctgccagagtagtgaagctaattaaacacgtttggtttctgaataaattgaactaaatccaaactatttcctaaaatcacaggacattaaggaccaatagcatctgtgccagagatgtactgttattagctgggaagaccaattctaacagcaaataacagtctgagactcctcatacctcagtggttagaagcatgtctctcttgagctacagtagaggggaagggattgttgtgtagtcaagtcaccatgctgaatgtacactgattcctttatgatgactgcttaactccccactgcctgtcccagagaggctttccaatgtagctcagtaattcctgttactttacagacaggaaagttccagaaactttaagaacaaactctgaaagacctatgagcaaatggtgctgaatactttttttttaaagccacatttcattgtcttagtcaaagcaggattattaagtgattatttaaaattcgtttttttaaattagcaacttcaagtataacaactttgaaactggaataagtgtttattttctattaataaaaatgaattgtgacaaaa

SEQ ID NO: 356749 - DNA, 2411 bp, Homo sapiens
gccgcggcaaccagcacaccccggcacctcctctgcggcagctgcgcctcgcaagcgcagtgccgcagcgcacgccggagtggctgtagctgcccggcgcggcgccgccctgcgcgggctgtgggctgcgggctgcgcccccgctgctggccagctctgcacggctgcgggctctgcggcgcccggtgctctgcaacgctgcggcgggcggcatgggataacgcggccatggtgcgccgagatcgcctccgcaggatgagggagtggtgggtccaggtggggctgctggccgtgcccctgcttgctgcgtacctgcacatcccaccccctcagctctcccctgcccttcactcatggaagtcttcaggcaagtttttcacttacaagggactgcgtatcttctaccaagactctgtgggtgtggttggaagtccagagatagttgtgcttttacacggttttccaacatccagctacgactggtacaagatttgggaaggtctgaccttgaggtttcatcgggtgattgcccttgatttcttaggctttggcttcagtgacaaaccgagaccacatcactattccatatttgagcaggccagcatcgtggaagcgcttttgcggcatctggggctccagaaccgcaggatcaaccttctttctcatgactatggagatattgttgctcaggagcttctctacaggtacaagcagaatcgatctggtcggcttaccataaagagtctctgtctgtcaaatggaggtatctttcctgagactcaccgtccactccttctccaaaagctactcaaagatggaggtgtgctgtcacccatcctcacacgactgatgaacttctttgtgtgggacatgtgggcagggatccgcaacaatgacgggaacttagtcattgacagtctcttacagtacatcaatcagaggaagaagttcagaaggcgctgggtgggagctcttgcctctgtaactatccccattcattttatctatgggccattggatcctgtaaatccctatccagagtttttggagctgtacaggaaaacgctgccgcggtccacagtgtcgattctggatgaccacattagccactatccacagctagaggatcccatgggcttcttgaatgcatatatgggcttcatcaactccttctgagctggaaagagtagcttccctgtattacctcccctactcccttatctgttgtgtattccacttaggaagaaatgcccaaaagaggtcctggccatcaaacataattctctcacaaagtccactttactcaaattggtgaacagtgtataggaagaagccagcaggagctctgactaaggttgacataatagtccacctcccattactttgatatctgatcaaatgtatagacttggctttgttttttgtgctattaggaaattctgatgagcattactattcactgatgcagaaagacgttcttttgcataaaagactttttttaacactttggacttctctgaaatatttagaagtgctaatttctggcccacccccaacaggaattctatagtaaggaggaggagaaggggggctccttccctctcctcgaatgacgttatgggcacatgccttttaaaagttctttaagcaacacagagctgagtcctctttgtcatacctttggatttagtgtttcatcagctgtttttagttataaacattttgttaaaatagatattggtttaaatgatacagtattttaggtatgatttaagactatgatttacctatacattatatatattttataaagatactaaaccagcatacccttactctgccagagtagtgaagctaattaaacacgtttggtttctgaataaattgaactaaatccaaactatttcctaaaatcacaggacattaaggaccaatagcatctgtgccagagatgtactgttattagctgggaagaccaattctaacagcaaataacagtctgagactcctcatacctcagtggttagaagcatgtctctcttgagctacagtagaggggaagggattgttgtgtagtcaagtcaccatgctgaatgtacactgattcctttatgatgactgcttaactccccactgcctgtcccagagaggctttccaatgtagctcagtaattcctgttactttacagacaggaaagttccagaaactttaagaacaaactctgaaagacctatgagcaaatggtgctgaatactttttttttaaagccacatttcattgtcttagtcaaagcaggattattaagtgattatttaaaattcgtttttttaaattagcaacttcaagtataacaactttgaaactggaataagtgtttattttctattaataaaaatgaattgtgacaaaa

SEQ ID NO: 356750 - DNA, 2340 bp, Homo sapiens
gccgcggcaaccagcacaccccggcacctcctctgcggcagctgcgcctcgcaagcgcagtgccgcagcgcacgccggagtggctgtagctgcccggcgcggcgccgccctgcgcgggctgtgggctgcgggctgcgcccccgctgctggccagctctgcacggctgcgggctctgcggcgcccggtgctctgcaacgctgcggcgggcggcatgggataacgcggccatggtgcgccgagatcgcctccgcaggatgagggagtggtgggtccaggtggggctgctggccgtgcccctgcttgctgcgtacctgcacatcccaccccctcagctctcccctgcccttcactcatggaagtcttcaggcaagtttttcacttacaagggactgcgtatcttctaccaagactctgtgggtgtggttggaagtccagagatagttgtgcttttacacggttttccaacatccagctacgactggtacaagatttgggaaggtctgaccttgaggtttcatcgggtgattgcccttgatttcttaggctttggcttcagtgacaaaccgagaccacatcactattccatatttgagcaggccagcatcgtggaagcgcttttgcggcatctggggctccagaaccgcaggatcaaccttctttctcatgactatggagatattgttgctcaggagcttctctacaggtacaagcagaatcgatctggtcggcttaccataaagagtctctgtctgtcaaatggaggtatctttcctgagactcaccgtccactccttctccaaaagctactcaaagatggaggtgtgctgtcacccatcctcacacgactgatgaacttctttgtattctctcgaggtctcaccccagtctttgggccgtatactcggccctctgagagtgagctgtgggacatgtgggcagggatccgcaacaatgacgggaacttagtcattgacagtctcttacagtacatcaatcagaggaagaagttcagaaggcgctgggtgggagctcttgcctctgtaactatccccattcattttatctatgggccattggatcctgtaaatccctatccagagtttttggagctgtacaggaaaacgctgccgcggtccacagtgtcgattctggatgaccacattagccactatccacagctagaggatcccatgggcttcttgaatgcatatatgggcttcatcaactccttctgagctggaaagagtagcttccctgtattacctcccctactcccttatctgttgtgtattccacttaggaagaaatgcccaaaagaggtcctggccatcaaacataattctctcacaaagtccactttactcaaattggtgaacagtgtataggaagaagccagcaggagctctgactaaggttgacataatagtccacctcccattactttgatatctgatcaaatgtatagacttggctttgttttttgtgctattaggaaattctgatgagcattactattcactgatgcagaaagacgttcttttgcataaaagactttttttaacactttggacttctctgaaatatttagaagtgctaatttctggcccacccccaacaggaattctatagtaaggaggaggagaaggggggctccttccctctcctcgaatgacgttatgggcacatgccttttaaaagttctttaagcaacacagagctgagtcctctttgtcatacctttggatttagtgtttcatcagctgtttttagttataaacattttgttaaaatagatattggtttctgaataaattgaactaaatccaaactatttcctaaaatcacaggacattaaggaccaatagcatctgtgccagagatgtactgttattagctgggaagaccaattctaacagcaaataacagtctgagactcctcatacctcagtggttagaagcatgtctctcttgagctacagtagaggggaagggattgttgtgtagtcaagtcaccatgctgaatgtacactgattcctttatgatgactgcttaactccccactgcctgtcccagagaggctttccaatgtagctcagtaattcctgttactttacagacaggaaagttccagaaactttaagaacaaactctgaaagacctatgagcaaatggtgctgaatactttttttttaaagccacatttcattgtcttagtcaaagcaggattattaagtgattatttaaaattcgtttttttaaattagcaacttcaagtataacaactttgaaactggaataagtgtttattttctattaataaaaatgaattgtgacaaaa

SEQ ID NO: 356751 - DNA, 2477 bp, Homo sapiens
tcaaaatgtcacttctttggccttcacttttattatgtaaaagtactcagatcaggccgaatacaattttattctctttatccaatgccggaggctattgtcgaagccacggcctgccatttcataccctttgcaataggtggcgctgacgcctggcagggagaaggcggcagcacatgctgggctcgggggcgatgggcttgtgcgcggacctggcgacgctctagccccgagccgcgtattcgtggccgggtcctccctgggaacagggtgaaggccgagaacctctggcctcaggaagcgcatgcgcaaccggttctccgaaacatggagtcctgtaggcaaggtcttacctgaatcaggatgagggagtggtgggtccaggtggggctgctggccgtgcccctgcttgctgcgtacctgcacatcccaccccctcagctctcccctgcccttcactcatggaagtcttcaggcaagtttttcacttacaagatttgggaaggtctgaccttgaggtttcatcgggtgattgcccttgatttcttaggctttggcttcagtgacaaaccgagaccacatcactattccatatttgagcaggccagcatcgtggaagcgcttttgcggcatctggggctccagaaccgcaggatcaaccttctttctcatgactatggagatattgttgctcaggagcttctctacaggtacaagcagaatcgatctggtcggcttaccataaagagtctctgtctgtcaaatggaggtatctttcctgagactcaccgtccactccttctccaaaagctactcaaagatggaggtgtgctgtcacccatcctcacacgactgatgaacttctttgtattctctcgaggtctcaccccagtctttgggccgtatactcggccctctgagagtgagctgtgggacatgtgggcagggatccgcaacaatgacgggaacttagtcattgacagtctcttacagtacatcaatcagaggaagaagttcagaaggcgctgggtgggagctcttgcctctgtaactatccccattcattttatctatgggccattggatcctgtaaatccctatccagagtttttggagctgtacaggaaaacgctgccgcggtccacagtgtcgattctggatgaccacattagccactatccacagctagaggatcccatgggcttcttgaatgcatatatgggcttcatcaactccttctgagctggaaagagtagcttccctgtattacctcccctactcccttatctgttgtgtattccacttaggaagaaatgcccaaaagaggtcctggccatcaaacataattctctcacaaagtccactttactcaaattggtgaacagtgtataggaagaagccagcaggagctctgactaaggttgacataatagtccacctcccattactttgatatctgatcaaatgtatagacttggctttgttttttgtgctattaggaaattctgatgagcattactattcactgatgcagaaagacgttcttttgcataaaagactttttttaacactttggacttctctgaaatatttagaagtgctaatttctggcccacccccaacaggaattctatagtaaggaggaggagaaggggggctccttccctctcctcgaatgacgttatgggcacatgccttttaaaagttctttaagcaacacagagctgagtcctctttgtcatacctttggatttagtgtttcatcagctgtttttagttataaacattttgttaaaatagatattggtttaaatgatacagtattttaggtatgatttaagactatgatttacctatacattatatatattttataaagatactaaaccagcatacccttactctgccagagtagtgaagctaattaaacacgtttggtttctgaataaattgaactaaatccaaactatttcctaaaatcacaggacattaaggaccaatagcatctgtgccagagatgtactgttattagctgggaagaccaattctaacagcaaataacagtctgagactcctcatacctcagtggttagaagcatgtctctcttgagctacagtagaggggaagggattgttgtgtagtcaagtcaccatgctgaatgtacactgattcctttatgatgactgcttaactccccactgcctgtcccagagaggctttccaatgtagctcagtaattcctgttactttacagacaggaaagttccagaaactttaagaacaaactctgaaagacctatgagcaaatggtgctgaatactttttttttaaagccacatttcattgtcttagtcaaagcaggattattaagtgattatttaaaattcgtttttttaaattagcaacttcaagtataacaactttgaaactggaataagtgtttattttctattaataaaaatgaattgtgacaaaa

SEQ ID NO: 356752 - DNA, 2723 bp, Homo sapiens
  misc_feature (2472)..(2472): n is a, c, g, or t
gccgcggcaaccagcacaccccggcacctcctctgcggcagctgcgcctcgcaagcgcagtgccgcagcgcacgccggagtggctgtagctgcccggcgcggcgccgccctgcgcgggctgtgggctgcgggctgcgcccccgctgctggccagctctgcacggctgcgggctctgcggcgcccggtgctctgcaacgctgcggcgggcggcatgggataacgcggccatggtgcgccgagatcgcctccgcaggatgagggagtggtgggtccaggtggggctgctggccgtgcccctgcttgctgcgtacctgcacatcccaccccctcagctctcccctgcccttcactcatggaagtcttcaggcaagtttttcacttacaagggactgcgtatcttctaccaagactctgtgggtgtggttggaagtccagagatagttgtgcttttacacggttttccaacatccagctacgactggtacaagatttgggaaggtctgaccttgaggtttcatcgggtgattgcccttgatttcttaggctttggcttcagtgacaaaccgagaccacatcactattccatatttgagcaggccagcatcgtggaagcgcttttgcggcatctggggctccagaaccgcaggatcaaccttctttctcatgactatggagatattgttgctcaggagcttctctacaggtacaagcagaatcgatctggtcggcttaccataaagagtctctgtctgtcaaatggaggtatctttcctgagactcaccgtccactccttctccaaaagctactcaaagatggaggtgtgctgtcacccatcctcacacgactgatgaacttctttgtattctctcgaggtctcaccccagtctttgggccgtatactcggccctctgagagtgagctgtgggacatgtgggcagggatccgcaacaatgacgggaacttagtcattgacagtctcttacagtacatcaatcagaggaagaagttcagaaggcgctgggtgggagctcttgcctctgtaactatccccattcattttatctatgggccattggatcctgtaaatccctatccagagtttttggagctgtacaggaaaacgctgccgcggtccacagtgtcgattctggatgaccacattagccactatccacagctagaggatcccatgggcttcttgaatgcatatatgggcttcatcaactccttctgagctggaaagagtagcttccctgtattacctcccctactcccttatctgttgtgtattccacttaggaagaaatgcccaaaagaggtcctggccatcaaacataattctctcacaaagtccactttactcaaattggtgaacagtgtataggaagaagccagcaggagctctgactaaggttgacataatagtccacctcccattactttgatatctgatcaaatgtatagacttggctttgttttttgtgctattaggaaattctgatgagcattactattcactgatgcagaaagacgttcttttgcataaaagactttttttaacactttggacttctctgaaatatttagaagtgctaatttctggcccacccccaacaggaattctatagtaaggaggaggagaaggggggctccttccctctcctcgaatgacgttatgggcacatgccttttaaaagttctttaagcaacacagagctgagtcctctttgtcatacctttggatttagtgtttcatcagctgtttttagttataaacattttgttaaaatagatattggtttaaatgatacagtattttaggtatgatttaagactatgatttacctatacattatatatattttataaagatactaaaccagcatacccttactctgccagagtagtgaagctaattaaacacgtttggtttctgaataaattgaactaaatccaaactatttcctaaaatcacaggacattaaggaccaatagcatctgtgccagagatgtactgttattagctgggaagaccaattctaacagcaaataacagtctgagactcctcatacctcagtggttagaagcatgtctctcttgagctacagtagaggggaagggattgttgtgtagtcaagtcaccatgctgaatgtacactgattcctttatgatgactgcttaactccccactgcctgtcccagagaggctttccaatgtagctcagtaattcctgttactttacagacaggaaagttccagaaactttaagaacaaactctgaaagacctatgagcaaatggtgctgaatactttttttttaaagccacatttcattgtcttagtcaaagcaggattattaagtgattatttaaaattcgtttttttaaattagcaacttcaagtataacaactttgaaactggaataagtgtttattttctattaataaaaatgaattgtgacaaaanaaaataaaaaaaaaaaaaacaaaaaaaaaaaaaaaaaaaaaaaataaaaaaatctacaacaaacaatccataccacactcatattctgctactccacataaaaaaaaaaaaacccctgggggggggggccgggccccaaatttccccaatagggggggggtataaaaaatcacgggcccgggttttaacaagggggggggggaaaaaaccccgggggtcccccaaaaaaaaacgcttttgaaaaaaaaccc

SEQ ID NO: 356753 - DNA, 1551 bp, Homo sapiens
atccctgtaacagtaaaggtttcttgttctgcacatgctgacttacctgtcctacagtctcttacagtacatcaatcagaggaagaagttcagaaggcgctgggtgggagctcttgcctctgtaactatccccattcattttatctatgggccattggatcctgtaaatccctatccagagtttttggagctgtacaggaaaacgctgccgcggtccacagtgtcgattctggatgaccacattagccactatccacagctagaggatcccatgggcttcttgaatgcatatatgggcttcatcaactccttctgagctggaaagagtagcttccctgtattacctcccctactcccttatctgttgtgtattccacttaggaagaaatgcccaaaagaggtcctggccatcaaacataattctctcacaaagtccactttactcaaattggtgaacagtgtataggaagaagccagcaggagctctgactaaggttgacataatagtccacctcccattactttgatatctgatcaaatgtatagacttggctttgttttttgtgctattaggaaattctgatgagcattactattcactgatgcagaaagacgttcttttgcataaaagactttttttaacactttggacttctctgaaatatttagaagtgctaatttctggcccacccccaacaggaattctatagtaaggaggaggagaaggggggctccttccctctcctcgaatgacgttatgggcacatgccttttaaaagttctttaagcaacacagagctgagtcctctttgtcatacctttggatttagtgtttcatcagctgtttttagttataaacattttgttaaaatagatattggtttaaatgatacagtattttaggtatgatttaagactatgatttacctatacattatatatattttataaagatactaaaccagcatacccttactctgccagagtagtgaagctaattaaacacgtttggtttctgaataaattgaactaaatccaaactatttcctaaaatcacaggacattaaggaccaatagcatctgtgccagagatgtactgttattagctgggaagaccaattctaacagcaaataacagtctgagactcctcatacctcagtggttagaagcatgtctctcttgagctacagtagaggggaagggattgttgtgtagtcaagtcaccatgctgaatgtacactgattcctttatgatgactgcttaactccccactgcctgtcccagagaggctttccaatgtagctcagtaattcctgttactttacagacaggaaagttccagaaactttaagaacaaactctgaaagacctatgagcaaatggtgctgaatactttttttttaaagccacatttcattgtcttagtcaaagcaggattattaagtgattatttaaaattcgtttttttaaattagcaacttcaagtataacaactttgaaactggaataagtgtttattttctattaataaaaatgaattgtgacaaaa

SEQ ID NO: 356754 - DNA, 1368 bp, Homo sapiens
  misc_feature (9)..(9): n is a, c, g, or t
gggtgccgngcccagcacagccccccagcgtgtccctgttgcctccccatccggccacattagccactatccacagctagaggatcccatgggcttcttgaatgcatatatgggcttcatcaactccttctgagctggaaagagtagcttccctgtattacctcccctactcccttatctgttgtgtattccacttaggaagaaatgcccaaaagaggtcctggccatcaaacataattctctcacaaagtccactttactcaaattggtgaacagtgtataggaagaagccagcaggagctctgactaaggttgacataatagtccacctcccattactttgatatctgatcaaatgtatagacttggctttgttttttgtgctattaggaaattctgatgagcattactattcactgatgcagaaagacgttcttttgcataaaagactttttttaacactttggacttctctgaaatatttagaagtgctaatttctggcccacccccaacaggaattctatagtaaggaggaggagaaggggggctccttccctctcctcgaatgacgttatgggcacatgccttttaaaagttctttaagcaacacagagctgagtcctctttgtcatacctttggatttagtgtttcatcagctgtttttagttataaacattttgttaaaatagatattggtttaaatgatacagtattttaggtatgatttaagactatgatttacctatacattatatatattttataaagatactaaaccagcatacccttactctgccagagtagtgaagctaattaaacacgtttggtttctgaataaattgaactaaatccaaactatttcctaaaatcacaggacattaaggaccaatagcatctgtgccagagatgtactgttattagctgggaagaccaattctaacagcaaataacagtctgagactcctcatacctcagtggttagaagcatgtctctcttgagctacagtagaggggaagggattgttgtgtagtcaagtcaccatgctgaatgtacactgattcctttatgatgactgcttaactccccactgcctgtcccagagaggctttccaatgtagctcagtaattcctgttactttacagacaggaaagttccagaaactttaagaacaaactctgaaagacctatgagcaaatggtgctgaatactttttttttaaagccacatttcattgtcttagtcaaagcaggattattaagtgattatttaaaattcgtttttttaaattagcaacttcaagtataacaactttgaaactggaataagtgtttattttctattaataaaaatgaattgtgacaaaa

SEQ ID NO: 356755 - DNA, 2413 bp, Homo sapiens
gccgcggcaaccagcacaccccggcacctcctctgcggcagctgcgcctcgcaagcgcagtgccgcagcgcacgccggagtggctgtagctgcccggcgcggcgccgccctgcgcgggctgtgggctgcgggctgcgcccccgctgctggccagctctgcacggctgcgggctctgcggcgcccggtgctctgcaacgctgcggcgggcggcatgggataacgcggccatggtgcgccgagatcgcctccgcaggatgagggagtggtgggtccaggtggggctgctggccgtgcccctgcttgctgcgtacctgcacatcccaccccctcagctctcccctgcccttcactcatggaagtcttcaggcaagtttttcacttacaagggactgcgtatcttctaccaagactctgtgggtgtggttggaagtccagagatagttgtgcttttacacggttttccaacatccagctacgactggtacaagatttgggaaggtctgaccttgaggtttcatcgggtgattgcccttgatttcttaggctttggcttcagtgacaaaccgagaccacatcactattccatatttgagcaggccagcatcgtggaagcgcttttgcggcatctggggctccagaaccgcaggatcaaccttctttctcatgactatggagatattgttgctcaggagcttctctacaggtacaagcagaatcgatctggtcggcttaccataaagagtctctgtctgtcaaatggaggtatctttcctgagactcaccgtccactccttctccaaaagctactcaaagatggaggtgtgctgtcacccatcctcacacgactgatgaacttctttgtattctctcgaggtctcaccccagtctttgggccgtatactcggccctctgagagtgagctgtgggacatgtgggcagggatccgcaacaatgacgggaacttagtcattgacagtctcttacagtacatcaatcagaggaagaagttcagaaggcgctgggtgggagctcttgcctctgtaactatccccattcattttatctatgggccattggatcctgtaaatccctatccagagtttttggagctgtacaggaaaacgctgccgcggtccacagtgtcgattctggatgaccacattagccactatccacagctagaggatcccatgggcttcttgaatgcatatatgggcttcatcaactccttctgagctggaaagagtagcttccctgtattacctcccctactcccttatctgttgtgtattccacttaggaagaaatgcccaaaagaggtcctggccatcaaacataattctctcacaaagtccactttactcaaattggtgaacagtgtataggaagaagccagcaggagctctgactaaggttgacataatagtccacctcccattactttgatatctgatcaaatgtatagacttggctttgttttttgtgctattaggaaattctgatgagcattactattcactgatgcagaaagacgttcttttgcataaaagactttttttaacactttggacttctctgaaatatttagaagtgctaatttctggcccacccccaacaggaattctatagtaaggaggaggagaaggggggctccttccctctcctcgaatgacgttatgggcacatgccttttaaaagttctttaagcaacacagagctgagtcctctttgtcatacctttggatttagtgtttcatcagctgtttttagttataaacattttgttaaaatagatattggtttaaatgatacagtattttaggtatgatttaagactatgatttacctatacattatatatattttataaagatactaaaccagcatacccttactctgccagagtagtgaagctaattaaacacgtttggtttctgaataaattgaactaaatccaaactatttcctaaaatcacaggacattaaggaccaatagcatctgtgccagagatgtactgttattagctgggaagaccaattctaacagcaaataacagtctgagactcctcatacctcagtggttagaagcatgtctctcttgagctacagtagaggggaagggattgttgtgtagtcaagtcaccatgctgaatgtacactgattcctttatgatgactgcttaactccccactgcctgtcccagagaggctttccaatgtagctcagtaattcctgttactttacagacaggaaagttccagataaagccacatttcattgtcttagtcaaagcaggattattaagtgattatttaaaattcgtttttttaaattagcaacttcaagtataacaactttgaaactggaataagtgtttattttctattaataaaaatgaattgtgacaaaa

SEQ ID NO: 356756 - DNA, 2258 bp, Homo sapiens
gccgcggcaaccagcacaccccggcacctcctctgcggcagctgcgcctcgcaagcgcagtgccgcagcgcacgccggagtggctgtagctgcccggcgcggcgccgccctgcgcgggctgtgggctgcgggctgcgcccccgctgctggccagctctgcacggctgcgggctctgcggcgcccggtgctctgcaacgctgcggcgggcggcatgggataacgcggccatggtgcgccgagatcgcctccgcaggatgagggagtggtgggtccaggtggggctgctggccgtgcccctgcttgctgcgtacctgcacatcccaccccctcagctctcccctgcccttcactcatggaagtcttcaggcaagtttttcacttacaagggactgcgtatcttctaccaagactctgtgggtgtggttggaagtccagagatagttgtgcttttacacggttttccaacatccagctacgactggtacaagatttgggaaggtctgaccttgaggtttcatcgggtgattgcccttgatttcttaggctttggcttcagtgacaaaccgagaccacatcactattccatatttgagcaggccagcatcgtggaagcgcttttgcggcatctggggctccagaaccgcaggatcaaccttctttctcatgactatggagatattgttgctcaggagcttctctacaggtacaagcagaatcgatctggtcggcttaccataaagagtctctgtctgtcaaatggaggtatctttcctgagactcaccgtccactccttctccaaaagctactcaaagatggaggtgtgctgtcacccatcctcacacgactgatgaacttctttgtattctctcgaggtctcaccccagtctttgggccgtatactcggccctctgagagtgagctgtgggacatgtgggcagggatccgcaacaatgacgggaacttagtcattgacagtctcttacagtacatcaatcagaggaagaagttcagaaggcgctgggtgggagctcttgcctctgtaactatccccattcattttatctatgggccattggatcctgtaaatccctatccagagtttttggagctgtacaggaaaacgctgccgcggtccacagtgtcgattctggatgaccacattagccactatccacagctagaggatcccatgggcttcttgaatgcatatatgggcttcatcaactccttctgagctggaaagagtagcttccctgtattacctcccctactcccttatctgttgtgtattccacttaggaagaaatgcccaaaagaggtcctggccatcaaacataattctctcacaaagtccactttactcaaattggtgaacagtgtataggaagaagccagcaggagctctgactaaggttgacataatagtccacctcccattactttgatatctgatcaaatgtatagacttggctttgttttttgtgctattaggaaattctgatgagcattactattcactgatgcagaaagacgttcttttgcataaaagactttttttaacactttggacttctctgaaatatttagaagtgctaatttctggcccacccccaacaggaattctatagtaaggaggaggagaaggggggctccttccctctcctcgaatgacgttatgggcacatgccttttaaaagttctttaagcaacacagagctgagtcctctttgtcatacctttggatttagtgtttcatcagctgtttttagttataaacattttgttaaaatagatattggtttaaatgatacagtattttaggtatgatttaagactatgatttacctatacattatatatattttataaagatactaaaccagcatacccttactctgccagagtagtgaagctaattaaacacgtttggtttctgaataaattgaactaaatccaaactatttcctaaaatcacaggacattaaggaccaatagcatctgtgccagagatgtactgttattagctgggaagaccaattctaacagcaaataacagtctgagactcctcatacctcagtggttagaagcatgtctctcttgagctacagtagaggggaagggattgttgtgtagtcaagtcaccatgctgaatgtacactgattcctttatgatgactgcttaactccccactgcctgtcgggctagtcggggactgtcggactagtagtggggatacagagtcataattcgtaat

SEQ ID NO: 356757 - DNA, 1334 bp, Homo sapiens
gccgcggcaaccagcacaccccggcacctcctctgcggcagctgcgcctcgcaagcgcagtgccgcagcgcacgccggagtggctgtagctgcccggcgcggcgccgccctgcgcgggctgtgggctgcgggctgcgcccccgctgctggccagctctgcacggctgcgggctctgcggcgcccggtgctctgcaacgctgcggcgggcggcatgggataacgcggccatggtgcgccgagatcgcctccgcaggatgagggagtggtgggtccaggtggggctgctggccgtgcccctgcttgctgcgtacctgcacatcccaccccctcagctctcccctgcccttcactcatggaagtcttcaggcaagtttttcacttacaagggactgcgtatcttctaccaagactctgtgggtgtggttggaagtccagagatagttgtgcttttacacggttttccaacatccagctacgactggtacaagatttgggaaggtctgaccttgaggtttcatcgggtgattgcccttgatttcttaggctttggcttcagtgacaaaccgagaccacatcactattccatatttgagcaggccagcatcgtggaagcgcttttgcggcatctggggctccagaaccgcaggatcaaccttctttctcatgactatggagatattgttgctcaggagcttctctacaggtacaagcagaatcgatctggtcggcttaccataaagagtctctgtctgtcaaatggaggtatctttcctgagactcaccgtccactccttctccaaaagctactcaaagatggaggtgtgctgtcacccatcctcacacgactgatgaacttctttgtattctctcgaggtctcaccccagtctttgggccgtatactcggccctctgagagtgagctgtgggacatgtgggcagggatccgcaacaatgacgggaacttagtcattgacagtctcttacagtacatcaatcagaggaagaagttcagaaggcgctgggtgggagctcttgcctctgtaactatccccattcattttatctatgggccattggatcctgtaaatccctatccagagtttttggagctgtacaggaaaacgctgccgcggtccacagtgtcgattctggatgaccacattagccactatccacagctagaggatcccatgggcttcttgaatgcatatatgggcttcatcaactccttctgagctggaaagagtagcttccctgtattacctcccctactcccttatagtgttgcgggatccctgaccaccctcctctttaagatcctgtagagtcgatc

SEQ ID NO: 356758 - DNA, 1972 bp, Homo sapiens
gccgcggcaaccagcacaccccggcacctcctctgcggcagctgcgcctcgcaagcgcagtgccgcagcgcacgccggagtggctgtagctgcccggcgcggcgccgccctgcgcgggctgtgggctgcgggctgcgcccccgctgctggccagctctgcacggctgcgggctctgcggcgcccggtgctctgcaacgctgcggcgggcggcatgggataacgcggccatggtgcgccgagatcgcctccgcaggatgagggagtggtgggtccaggtggggctgctggccgtgcccctgcttgctgcgtacctgcacatcccaccccctcagctctcccctgcccttcactcatggaagtcttcaggcaagtttttcacttacaagggactgcgtatcttctaccaagactctgtgggtgtggttggaagtccagagatagttgtgcttttacacggttttccaacatccagctacgactggtacaagatttgggaaggtctgaccttgaggtttcatcgggtgattgcccttgatttcttaggctttggcttcagtgacaaaccgagaccacatcactattccatatttgagcaggccagcatcgtggaagcgcttttgcggcatctggggctccagaaccgcaggatcaaccttctttctcatgactatggagatattgttgctcaggagcttctctacaggtacaagcagaatcgatctggtcggcttaccataaagagtctctgtctgtcaaatggaggtatctttcctgagactcaccgtccactccttctccaaaagctactcaaagatggaggtgtgctgtcacccatcctcacacgactgatgaacttctttgtattctctcgaggtctcaccccagtctttgggccgtatactcggccctctgagagtgagctgtgggacatgtgggcagggatccgcaacaatgacgggaacttagtcattgacaggtaagaagttaccctttgctttggtttccagagacgtgtttctgtggagaagtggggattgcttgttctgttccttggctggcttattccctatcacaggaaggctgatgatgacctatggggcaaaccaaaaagtcatggtctatatgaagaaagaaatagaaaataagagtgaaactggactctttgttagtattaaatgcttcaaagtattgaatcatggttgtgaaagtagcctagtgcctccctcaaggtacaaggctcttccttttgcctatctttctgcagcaacggggagtgagagggcagacttctctttctctgtcttgtacaaagaattcccatgccttggttcaaatgagaatgtagacactttcacaagggacccagaggtggtgatagctgtaactacttgggataagactctgacttctagccacctggctcagtgtagcttccagtgtttttactgatggctttgctggggattgtatgttagagggagccaatcctcccaccctctcctaagccccaacaggatccctgaatatttcattttagtattaaaaaactgaagaacaattaagactgtcttttaaaattatattttcctttccaaaaagtaaatactatttgtaagatgagatatttgaggttcacaaaaataactgtcctggagttgccaggcagaatgagtagaatacatgagtttgagttctaaaatgtggcagtggtgtcttacgctggagaaagaggaatcctctccattttatctgtggtcagatgaagctttgtgctcatcaacatctacacttagaattttgaagtagatgtcggctgggcacagtggctcacgcctgtaatttgagcactttgggaggccaaggtgggcgaatcatatgaggtcaggagtttagagaccagcctggccaacatgatgaaaccccgtgtctactaaaaatacaaaaattagccagtaattccagctactcagg

SEQ ID NO: 356759 - DNA, 410 bp, Homo sapiens
tgaacatttaaaaactagtttgtataaatggaattggcaagtttatctgcctaagatacaatttcagagtagaaggtgaataagctctttggtggctccttccagtgtggtgtgtccacagggtcatttactggggcttcccactggcttacatccctcccgctccagcctcaagttcacctgcgtgctgttctcttccactaggaaaacgctgccgcggtccacagtgtcgattctggatgaccacattagccactatccacagctagaggatcccatgggcttcttgaatgcatatatgggcttcatcaactccttctgagctggaaagagtagcttccctgtattacctcccctactcccttatctgttgtgtattccacttaggaagaaatgcccaaaagaggtcc

SEQ ID NO: 356760 - DNA, 2940 bp, Homo sapiens
  misc_feature (2940)..(2940): n is a, c, g, or t
gccgcggcaaccagcacaccccggcacctcctctgcggcagctgcgcctcgcaagcgcagtgccgcagcgcacgccggagtggctgtagctgcccggcgcggcgccgccctgcgcgggctgtgggctgcgggctgcgcccccgctgctggccagctctgcacggctgcgggctctgcggcgcccggtgctctgcaacgctgcggcgggcggcatgggataacgcggccatggtgcgccgagatcgcctccgcaggatgagggagtggtgggtccaggtggggctgctggccgtgcccctgcttgctgcgtacctgcacatcccaccccctcagctctcccctgcccttcactcatggaagtcttcaggcaagtttttcacttacaagggactgcgtatcttctaccaagactctgtgggtgtggttggaagtccagagatagttgtgcttttacacggttttccaacatccagctacgactggtacaagatttgggaaggtctgaccttgaggtttcatcgggtgattgcccttgatttcttaggctttggcttcagtgacaaaccgagaccacatcactattccatatttgagcaggccagcatcgtggaagcgcttttgcggcatctggggctccagaaccgcaggatcaaccttctttctcatgactatggagatattgttgctcaggagcttctctacaggtacaagcagaatcgatctggtcggcttaccataaagagtctctgtctgtcaaatggaggtatctttcctgagactcaccgtccactccttctccaaaagctactcaaagatggaggtgtgctgtcacccatcctcacacgactgatgaacttctttgtattctctcgaggtctcaccccagtctttgggccgtatactcggccctctgagagtgagctgtgggacatgtgggcagggatccgcaacaatgacgggaacttagtcattgacagtctcttacagtacatcaatcagaggaagaagttcagaaggcgctgggtgggagctcttgcctctgtaactatccccattcattttatctatgggccattggatcctgtaaatccctatccagagtttttggagctgtacaggaaaacgctgccgcggtccacagtgtcgattctggatgaccacattagccactatccacagctagaggatcccatgggcttcttgaatgcatatatgggcttcatcaactccttctgagctggaaagagtagcttccctgtattacctcccctactcccttatctgttgtgtattccacttaggaagaaatgcccaaaagaggtcctggccatcaaacataattctctcacaaagtccactttactcaaattggtgaacagtgtataggaagaagccagcaggagctctgactaaggttgacataatagtccacctcccattactttgatatctgatcaaatgtatagacttggctttgttttttgtgctattaggaaattctgatgagcattactattcactgatgcagaaagacgttcttttgcataaaagactttttttaacactttggacttctctgaaatatttagaagtgctaatttctggcccacccccaacaggaattctatagtaaggaggaggagaaggggggctccttccctctcctcgaatgacgttatgggcacatgccttttaaaagttctttaagcaacacagagctgagtcctctttgtcatacctttggatttagtgtttcatcagctgtttttagttataaacattttgttaaaatagatattggtttaaatgatacagtattttaggtatgatttaagactatgatttacctatacattatatatattttataaagatactaaaccagcatacccttactctgccagagtagtgaagctaattaaacacgtttggtttctgaataaattgaactaaatccaaactatttcctaaaatcacaggacattaaggaccaatagcatctgtgccagagatgtactgttattagctgggaagaccaattctaacagcaaataacagtctgagactcctcatacctcagtggttagaagcatgtctctcttgagctacagtagaggggaagggattgttgtgtagtcaagtcaccatgctgaatgtacactgattcctttatgatgactgcttaactccccactgcctgtcccagagaggctttccaatgtagctcagtaattcctgttactttacagacaggaaagttccagaaactttaagaacaaactctgaaagacctatgagcaaatggtgctgaatactttttttttaaagccacatttcattgtcttagtcaaagcaggattattaagtgattatttaaaattcgtttttttaaattagcaacttcaagtataacaactttgaaactggaataagtgtttattttctattaataaaaatgaattgtgacaaaaaaaaaaaaaaaaaaaaaaaaaaaaaaaaaaaaaaaaaaaaaaaaaaaaaaaaaaaaaaaaaaaaaaagaaaaaaagaagaacaaaagcgacgcacgacagaggaacgcaaagaagaaagaagaagaaaagaggcagagcgcgagagacacgaggaccagcgggagacaggacgcgaacgcaacaagaagggaaggggcgggggggacgcagaagaacggagaagaaaaaagagggaggagaaggaaacaggcggagaagagcaaaagagaggaaaagaaaggagggagggggggcacgacgacagacagcaaaagagagaggaggaggaaaagagaacagaggcacagcaaagaagagaacagaagggaagaaagaacgatgagagacagaaggaaggaaggaagagaacagaggaagataaagatgaaaggaggagaagaaagagagcaggccggagggggggaggan

SEQ ID NO: 356761 - DNA, 2579 bp, Homo sapiens
tcaaaatgtcacttctttggccttcacttttattatgtaaaagtactcagatcaggccgaatacaattttattctctttatccaatgccggaggctattgtcgaagccacggcctgccatttcataccctttgcaataggtggcgctgacgcctggcagggagaaggcggcagcacatgctgggctcgggggcgatgggcttgtgcgcggacctggcgacgctctagccccgagccgcgtattcgtggccgggtcctccctgggaacagggtgaaggccgagaacctctggcctcaggaagcgcatgcgcaaccggttctccgaaacatggagtcctgtaggcaaggtcttacctgaatcaggatgagggagtggtgggtccaggtggggctgctggccgtgcccctgcttgctgcgtacctgcacatcccaccccctcagctctcccctgcccttcactcatggaagtcttcaggcaagtttttcacttacaagggactgcgtatcttctaccaagactctgtgggtgtggttggaagtccagagatagttgtgcttttacacggttttccaacatccagctacgactggtacaagatttgggaaggtctgaccttgaggtttcatcgggtgattgcccttgatttcttaggctttggcttcagtgacaaaccgagaccacatcactattccatatttgagcaggccagcatcgtggaagcgcttttgcggcatctggggctccagaaccgcaggatcaaccttctttctcatgactatggagatattgttgctcaggagcttctctacaggtacaagcagaatcgatctggtcggcttaccataaagagtctctgtctgtcaaatggaggtatctttcctgagactcaccgtccactccttctccaaaagctactcaaagatggaggtgtgctgtcacccatcctcacacgactgatgaacttctttgtattctctcgaggtctcaccccagtctttgggccgtatactcggccctctgagagtgagctgtgggacatgtgggcagggatccgcaacaatgacgggaacttagtcattgacagtctcttacagtacatcaatcagaggaagaagttcagaaggcgctgggtgggagctcttgcctctgtaactatccccattcattttatctatgggccattggatcctgtaaatccctatccagagtttttggagctgtacaggaaaacgctgccgcggtccacagtgtcgattctggatgaccacattagccactatccacagctagaggatcccatgggcttcttgaatgcatatatgggcttcatcaactccttctgagctggaaagagtagcttccctgtattacctcccctactcccttatctgttgtgtattccacttaggaagaaatgcccaaaagaggtcctggccatcaaacataattctctcacaaagtccactttactcaaattggtgaacagtgtataggaagaagccagcaggagctctgactaaggttgacataatagtccacctcccattactttgatatctgatcaaatgtatagacttggctttgttttttgtgctattaggaaattctgatgagcattactattcactgatgcagaaagacgttcttttgcataaaagactttttttaacactttggacttctctgaaatatttagaagtgctaatttctggcccacccccaacaggaattctatagtaaggaggaggagaaggggggctccttccctctcctcgaatgacgttatgggcacatgccttttaaaagttctttaagcaacacagagctgagtcctctttgtcatacctttggatttagtgtttcatcagctgtttttagttataaacattttgttaaaatagatattggtttaaatgatacagtattttaggtatgatttaagactatgatttacctatacattatatatattttataaagatactaaaccagcatacccttactctgccagagtagtgaagctaattaaacacgtttggtttctgaataaattgaactaaatccaaactatttcctaaaatcacaggacattaaggaccaatagcatctgtgccagagatgtactgttattagctgggaagaccaattctaacagcaaataacagtctgagactcctcatacctcagtggttagaagcatgtctctcttgagctacagtagaggggaagggattgttgtgtagtcaagtcaccatgctgaatgtacactgattcctttatgatgactgcttaactccccactgcctgtcccagagaggctttccaatgtagctcagtaattcctgttactttacagacaggaaagttccagaaactttaagaacaaactctgaaagacctatgagcaaatggtgctgaatactttttttttaaagccacatttcattgtcttagtcaaagcaggattattaagtgattatttaaaattcgtttttttaaattagcaacttcaagtataacaactttgaaactggaataagtgtttattttctattaataaaaatgaattgtgacaaaa

SEQ ID NO: 356762 - DNA, 2360 bp, Homo sapiens
gccgcggcaaccagcacaccccggcacctcctctgcggcagctgcgcctcgcaagcgcagtgccgcagcgcacgccggagtggctgtagctgcccggcgcggcgccgccctgcgcgggctgtgggctgcgggctgcgcccccgctgctggccagctctgcacggctgcgggctctgcggcgcccggtgctctgcaacgctgcggcgggcggcatgggataacgcggccatggtgcgccgagatcgcctccgcaggatgagggagtggtgggtccaggtggggctgctggccgtgcccctgcttgctgcgtacctgcacatcccaccccctcagctctcccctgcccttcactcatggaagtcttcaggcaagtttttcacttacaagggactgcgtatcttctaccaagactctgtgggtgtggttggaagtccagagatagttgtgcttttacacggttttccaacatccagctacgactggtacaagatttgggaaggtctgaccttgaggtttcatcgggtgattgcccttgatttcttaggctttggcttcagtgacaaaccgagaccacatcactattccatatttgagcaggccagcatcgtggaagcgcttttgcggcatctggggctccagaaccgcaggatcaaccttctttctcatgactatggagatattgttgctcaggagcttctctacaggtacaagcagaatcgatctggtcggcttaccataaagagtctctgtctgtcaaatggaggtatctttcctgagactcaccgtccactccttctccaaaagctactcaaagatggaggtgtgctgtcacccatcctcacacgactgatgaacttctttgacagtctcttacagtacatcaatcagaggaagaagttcagaaggcgctgggtgggagctcttgcctctgtaactatccccattcattttatctatgggccattggatcctgtaaatccctatccagagtttttggagctgtacaggaaaacgctgccgcggtccacagtgtcgattctggatgaccacattagccactatccacagctagaggatcccatgggcttcttgaatgcatatatgggcttcatcaactccttctgagctggaaagagtagcttccctgtattacctcccctactcccttatctgttgtgtattccacttaggaagaaatgcccaaaagaggtcctggccatcaaacataattctctcacaaagtccactttactcaaattggtgaacagtgtataggaagaagccagcaggagctctgactaaggttgacataatagtccacctcccattactttgatatctgatcaaatgtatagacttggctttgttttttgtgctattaggaaattctgatgagcattactattcactgatgcagaaagacgttcttttgcataaaagactttttttaacactttggacttctctgaaatatttagaagtgctaatttctggcccacccccaacaggaattctatagtaaggaggaggagaaggggggctccttccctctcctcgaatgacgttatgggcacatgccttttaaaagttctttaagcaacacagagctgagtcctctttgtcatacctttggatttagtgtttcatcagctgtttttagttataaacattttgttaaaatagatattggtttaaatgatacagtattttaggtatgatttaagactatgatttacctatacattatatatattttataaagatactaaaccagcatacccttactctgccagagtagtgaagctaattaaacacgtttggtttctgaataaattgaactaaatccaaactatttcctaaaatcacaggacattaaggaccaatagcatctgtgccagagatgtactgttattagctgggaagaccaattctaacagcaaataacagtctgagactcctcatacctcagtggttagaagcatgtctctcttgagctacagtagaggggaagggattgttgtgtagtcaagtcaccatgctgaatgtacactgattcctttatgatgactgcttaactccccactgcctgtcccagagaggctttccaatgtagctcagtaattcctgttactttacagacaggaaagttccagaaactttaagaacaaactctgaaagacctatgagcaaatggtgctgaatactttttttttaaagccacatttcattgtcttagtcaaagcaggattattaagtgattatttaaaattcgtttttttaaattagcaacttcaagtataacaactttgaaactggaataagtgtttattttctattaataaaaatgaattgtgacaaaa

SEQ ID NO: 356763 - DNA, 2441 bp, Homo sapiens
gccgcggcaaccagcacaccccggcacctcctctgcggcagctgcgcctcgcaagcgcagtgccgcagcgcacgccggagtggctgtagctgcccggcgcggcgccgccctgcgcgggctgtgggctgcgggctgcgcccccgctgctggccagctctgcacggctgcgggctctgcggcgcccggtgctctgcaacgctgcggcgggcggcatgggataacgcggccatggtgcgccgagatcgcctccgcaggatgagggagtggtgggtccaggtggggctgctggccgtgcccctgcttgctgcgtacctgcacatcccaccccctcagctctcccctgcccttcactcatggaagtcttcaggcaagtttttcacttacaagggactgcgtatcttctaccaagactctgtgggtgtggttggaagtccagagatagttgtgcttttacacggttttccaacatccagctacgactggtacaagatttgggaaggtctgaccttgaggtttcatcgggtgattgcccttgatttcttaggctttggcttcagtgacaaaccggccagcatcgtggaagcgcttttgcggcatctggggctccagaaccgcaggatcaaccttctttctcatgactatggagatattgttgctcaggagcttctctacaggtacaagcagaatcgatctggtcggcttaccataaagagtctctgtctgtcaaatggaggtatctttcctgagactcaccgtccactccttctccaaaagctactcaaagatggaggtgtgctgtcacccatcctcacacgactgatgaacttctttgtattctctcgaggtctcaccccagtctttgggccgtatactcggccctctgagagtgagctgtgggacatgtgggcagggatccgcaacaatgacgggaacttagtcattgacagtctcttacagtacatcaatcagaggaagaagttcagaaggcgctgggtgggagctcttgcctctgtaactatccccattcattttatctatgggccattggatcctgtaaatccctatccagagtttttggagctgtacaggaaaacgctgccgcggtccacagtgtcgattctggatgaccacattagccactatccacagctagaggatcccatgggcttcttgaatgcatatatgggcttcatcaactccttctgagctggaaagagtagcttccctgtattacctcccctactcccttatctgttgtgtattccacttaggaagaaatgcccaaaagaggtcctggccatcaaacataattctctcacaaagtccactttactcaaattggtgaacagtgtataggaagaagccagcaggagctctgactaaggttgacataatagtccacctcccattactttgatatctgatcaaatgtatagacttggctttgttttttgtgctattaggaaattctgatgagcattactattcactgatgcagaaagacgttcttttgcataaaagactttttttaacactttggacttctctgaaatatttagaagtgctaatttctggcccacccccaacaggaattctatagtaaggaggaggagaaggggggctccttccctctcctcgaatgacgttatgggcacatgccttttaaaagttctttaagcaacacagagctgagtcctctttgtcatacctttggatttagtgtttcatcagctgtttttagttataaacattttgttaaaatagatattggtttaaatgatacagtattttaggtatgatttaagactatgatttacctatacattatatatattttataaagatactaaaccagcatacccttactctgccagagtagtgaagctaattaaacacgtttggtttctgaataaattgaactaaatccaaactatttcctaaaatcacaggacattaaggaccaatagcatctgtgccagagatgtactgttattagctgggaagaccaattctaacagcaaataacagtctgagactcctcatacctcagtggttagaagcatgtctctcttgagctacagtagaggggaagggattgttgtgtagtcaagtcaccatgctgaatgtacactgattcctttatgatgactgcttaactccccactgcctgtcccagagaggctttccaatgtagctcagtaattcctgttactttacagacaggaaagttccagaaactttaagaacaaactctgaaagacctatgagcaaatggtgctgaatactttttttttaaagccacatttcattgtcttagtcaaagcaggattattaagtgattatttaaaattcgtttttttaaattagcaacttcaagtataacaactttgaaactggaataagtgtttattttctattaataaaaatgaattgtgacaaaa

SEQ ID NO: 356764 - DNA, 3174 bp, Homo sapiens
gccgcggcaaccagcacaccccggcacctcctctgcggcagctgcgcctcgcaagcgcagtgccgcagcgcacgccggagtggctgtagctgcccggcgcggcgccgccctgcgcgggctgtgggctgcgggctgcgcccccgctgctggccagctctgcacggctgcgggctctgcggcgcccggtgctctgcaacgctgcggcgggcggcatgggataacgcggccatggtgcgccgagatcgcctccgcaggatgagggagtggtgggtccaggtggggctgctggccgtgcccctgcttgctgcgtacctgcacatcccaccccctcagctctcccctgcccttcactcatggaagtcttcaggcaagtttttcacttacaagggactgcgtatcttctaccaagactctgtgggtgtggttggaagtccagagatagttgtgcttttacacggttttccaacatccagctacgactggtacaagatttgggaaggtctgaccttgaggtttcatcgggtgattgcccttgatttcttaggctttggcttcagtgacaaaccgagaccacatcactattccatatttgagcaggccagcatcgtggaagcgcttttgcggcatctggggctccagaaccgcaggatcaaccttctttctcatgactatggagatattgttgctcaggagcttctctacaggtacaagcagaatcgatctggtcggcttaccataaagagtctctgtctgtcaaatggaggtatctttcctgagactcaccgtccactccttctccaaaagctactcaaagatggaggtgtgctgtcacccatcctcacacgactgatgaacttctttgtattctctcgaggtctcaccccagtctttgggccgtatactcggccctctgagagtgagctgtgggacatgtgggcagggatccgcaacaatgacgggaacttagtcattgacagtctcttacagtacatcaatcagaggaagaagttcagaaggcgctgggtgggagctcttgcctctgtaactatccccattcattttatctatgggccattggatcctgtaaatccctatccagagtttttggagctgtacaggaaaacgctgccgcggtccacagtgtcgattctggatgaccacattagccactatccacagctagaggatcccatgggcttcttgaatgcatatatgggcttcatcaactccttctgagctggaaagagtagcttccctgtattacctcccctactcccttatctgttgtgtattccacttaggaagaaatgcccaaaagaggtcctggccatcaaacataattctctcacaaagtccactttactcaaattggtgaacagtgtataggaagaagccagcaggagctctgactaaggttgacataatagtccacctcccattactttgatatctgatcaaatgtatagacttggctttgttttttgtgctattaggaaattctgatgagcattactattcactgatgcagaaagacgttcttttgcataaaagactttttttaacactttggacttctctgaaatatttagaagtgctaatttctggcccacccccaacaggaattctatagtaaggaggaggagaaggggggctccttccctctcctcgaatgacgttatgggcacatgccttttaaaagttctttaagcaacacagagctgagtcctctttgtcatacctttggatttagtgtttcatcagctgtttttagttataaacattttgttaaaatagatattggtttaaatgatacagtattttaggtatgatttaagactatgatttacctatacattatatatattttataaagatactaaaccagcatacccttactctgccagagtagtgaagctaattaaacacgtttggtttctgaataaattgaactaaatccaaactatttcctaaaatcacaggacattaaggaccaatagcatctgtgccagagatgtactgttattagctgggaagaccaattctaacagcaaataacagtctgagactcctcatacctcagtggttagaagcatgtctctcttgagctacagtagaggggaagggattgttgtgtagtcaagtcaccatgctgaatgtacactgattcctttatgatgactgcttaactccccactgcctgtcccagagaggctttccaatgtagctcagtaattcctgttactttacagacaggaaagttccagaaactttaagaacaaactctgaaagacctatgagcaaatggtgctgaatactttttttttaaagccacatttcattgtcttagtcaaagcaggattattaagtgattatttaaaattcgtttttttaaattagcaacttcaagtataacaactttgaaactggaataagtgtttattttctattaataaaaatgaattgtgacaaaagtggactctggcttcccctcccccctacccctctgggataaaaattttccagcattgccaggagctttcaggtacacattaaagaataaaatgaagttaagcagctggagtataggatagtatttgattttcaagatcacccaaagctgcactatcgtcccaaagctgaccaagtagaataaaaagaaaaaaaaaaaaaacaacccatgcgcaaagatagacatttgcttgatctgctggctcagggccaaatgtttaatttgcttctccaaagtcattcatcttcaaaagtctgattctgggaaactgatgccactagcctaaaagcccactgaccatgtagtgtgcatcagtttcctcttgtccagtaagcatttatccaacagaagctaagataacatctacaggtgttctctctttacttctgacagtcacctgcatggtcactccatcggctaaggccagcctggacctcaccaataaatcatagccacctctgaatatacctgagagaaaaaagtaaggaaaaccatattaagaacccaaaacaagcactggataatgaaatttatcatgctatccctgcatctcctttctattagtttagtttagcttttccagagacttgtggaaactgaatcctaaacaaacataaattccaaatatatatatttttatattcccatgaaaccaggtacataga

SEQ ID NO: 356765 - DNA, 2468 bp, Homo sapiens
tcaaaatgtcacttctttggccttcacttttattatgtaaaagtactcagatcaggccgaatacaattttattctctttatccaatgccggaggctattgtcgaagccacggcctgccatttcataccctttgcaataggtggcgctgacgcctggcagggagaaggcggcagcacatgctgggctcgggggcgatgggcttgtgcgcggacctggcgacgctctagccccgagccgcgtattcgtggccgggtcctccctgggaacagggtgaaggccgagaacctctggcctcaggaagcgcatgcgcaaccggttctccgaaacatggagtcctgtaggcaaggtcttacctgaatcaggatgagggagtggtgggtccaggtggggctgctggccgtgcccctgcttgctgcgtacctgcacatcccaccccctcagctctcccctgcccttcactcatggaagtcttcaggcaagtttttcacttacaagggactgcgtatcttctaccaagactctgtgggtgtggttggaagtccagagatagttgtgcttttacacggttttccaacatccagctacgactggtacaagatttgggaaggtctgaccttgaggtttcatcgggtgattgcccttgatttcttaggctttggcttcagtgacaaaccgagaccacatcactattccatatttgagcaggccagcatcgtggaagcgcttttgcggcatctggggctccagaaccgcaggatcaaccttctttctcatgactatggagatattgttgctcaggagcttctctacaggtacaagcagaatcgatctggtcggcttaccataaagagtctctgtctgtcaaatggaggtatctttcctgagactcaccgtccactccttctccaaaagctactcaaagatggaggtgtgctgtcacccatcctcacacgactgatgaacttctttgacagtctcttacagtacatcaatcagaggaagaagttcagaaggcgctgggtgggagctcttgcctctgtaactatccccattcattttatctatgggccattggatcctgtaaatccctatccagagtttttggagctgtacaggaaaacgctgccgcggtccacagtgtcgattctggatgaccacattagccactatccacagctagaggatcccatgggcttcttgaatgcatatatgggcttcatcaactccttctgagctggaaagagtagcttccctgtattacctcccctactcccttatctgttgtgtattccacttaggaagaaatgcccaaaagaggtcctggccatcaaacataattctctcacaaagtccactttactcaaattggtgaacagtgtataggaagaagccagcaggagctctgactaaggttgacataatagtccacctcccattactttgatatctgatcaaatgtatagacttggctttgttttttgtgctattaggaaattctgatgagcattactattcactgatgcagaaagacgttcttttgcataaaagactttttttaacactttggacttctctgaaatatttagaagtgctaatttctggcccacccccaacaggaattctatagtaaggaggaggagaaggggggctccttccctctcctcgaatgacgttatgggcacatgccttttaaaagttctttaagcaacacagagctgagtcctctttgtcatacctttggatttagtgtttcatcagctgtttttagttataaacattttgttaaaatagatattggtttaaatgatacagtattttaggtatgatttaagactatgatttacctatacattatatatattttataaagatactaaaccagcatacccttactctgccagagtagtgaagctaattaaacacgtttggtttctgaataaattgaactaaatccaaactatttcctaaaatcacaggacattaaggaccaatagcatctgtgccagagatgtactgttattagctgggaagaccaattctaacagcaaataacagtctgagactcctcatacctcagtggttagaagcatgtctctcttgagctacagtagaggggaagggattgttgtgtagtcaagtcaccatgctgaatgtacactgattcctttatgatgactgcttaactccccactgcctgtcccagagaggctttccaatgtagctcagtaattcctgttactttacagacaggaaagttccagaaactttaagaacaaactctgaaagacctatgagcaaatggtgctgaatactttttttttaaagccacatttcattgtcttagtcaaagcaggattattaagtgattatttaaaattcgtttttttaaattagcaacttcaagtataacaactttgaaactggaataagtgtttattttctattaataaaaatgaattgtgacaaaa

SEQ ID NO: 356766 - DNA, 2330 bp, Homo sapiens
gccgcggcaaccagcacaccccggcacctcctctgcggcagctgcgcctcgcaagcgcagtgccgcagcgcacgccggagtggctgtagctgcccggcgcggcgccgccctgcgcgggctgtgggctgcgggctgcgcccccgctgctggccagctctgcacggctgcgggctctgcggcgcccggtgctctgcaacgctgcggcgggcggcatgggataacgcggccatggtgcgccgagatcgcctccgcaggatgagggagtggtgggtccaggtggggctgctggccgtgcccctgcttgctgcgtacctgcacatcccaccccctcagctctcccctgcccttcactcatggaagtcttcaggcaagtttttcacttacaagggactgcgtatcttctaccaagactctgtgggtgtggttggaagtccagagatagttgtgcttttacacggttttccaacatccagctacgactggtacaagatttgggaaggtctgaccttgaggtttcatcgggtgattgcccttgatttcttaggctttggcttcagtgacaaaccggccagcatcgtggaagcgcttttgcggcatctggggctccagaaccgcaggatcaaccttctttctcatgactatggagatattgttgctcaggagcttctctacaggtacaagcagaatcgatctggtcggcttaccataaagagtctctgtctgtcaaatggaggtatctttcctgagactcaccgtccactccttctccaaaagctactcaaagatggaggtgtgctgtcacccatcctcacacgactgatgaacttctttgacagtctcttacagtacatcaatcagaggaagaagttcagaaggcgctgggtgggagctcttgcctctgtaactatccccattcattttatctatgggccattggatcctgtaaatccctatccagagtttttggagctgtacaggaaaacgctgccgcggtccacagtgtcgattctggatgaccacattagccactatccacagctagaggatcccatgggcttcttgaatgcatatatgggcttcatcaactccttctgagctggaaagagtagcttccctgtattacctcccctactcccttatctgttgtgtattccacttaggaagaaatgcccaaaagaggtcctggccatcaaacataattctctcacaaagtccactttactcaaattggtgaacagtgtataggaagaagccagcaggagctctgactaaggttgacataatagtccacctcccattactttgatatctgatcaaatgtatagacttggctttgttttttgtgctattaggaaattctgatgagcattactattcactgatgcagaaagacgttcttttgcataaaagactttttttaacactttggacttctctgaaatatttagaagtgctaatttctggcccacccccaacaggaattctatagtaaggaggaggagaaggggggctccttccctctcctcgaatgacgttatgggcacatgccttttaaaagttctttaagcaacacagagctgagtcctctttgtcatacctttggatttagtgtttcatcagctgtttttagttataaacattttgttaaaatagatattggtttaaatgatacagtattttaggtatgatttaagactatgatttacctatacattatatatattttataaagatactaaaccagcatacccttactctgccagagtagtgaagctaattaaacacgtttggtttctgaataaattgaactaaatccaaactatttcctaaaatcacaggacattaaggaccaatagcatctgtgccagagatgtactgttattagctgggaagaccaattctaacagcaaataacagtctgagactcctcatacctcagtggttagaagcatgtctctcttgagctacagtagaggggaagggattgttgtgtagtcaagtcaccatgctgaatgtacactgattcctttatgatgactgcttaactccccactgcctgtcccagagaggctttccaatgtagctcagtaattcctgttactttacagacaggaaagttccagaaactttaagaacaaactctgaaagacctatgagcaaatggtgctgaatactttttttttaaagccacatttcattgtcttagtcaaagcaggattattaagtgattatttaaaattcgtttttttaaattagcaacttcaagtataacaactttgaaactggaataagtgtttattttctattaataaaaatgaattgtgacaaaa

SEQ ID NO: 356767 - DNA, 1500 bp, Homo sapiens
gccgcggcaaccagcacaccccggcacctcctctgcggcagctgcgcctcgcaagcgcagtgccgcagcgcacgccggagtggctgtagctgcccggcgcggcgccgccctgcgcgggctgtgggctgcgggctgcgcccccgctgctggccagctctgcacggctgcgggctctgcggcgcccggtgctctgcaacgctgcggcgggcggcatgggataacgcggccatggtgcgccgagatcgcctccgcaggatgagggagtggtgggtccaggtggggctgctggccgtgcccctgcttgctgcgtacctgcacatcccaccccctcagctctcccctgcccttcactcatggaagtcttcaggcaagtttttcacttacaagggactgcgtatcttctaccaagactctgtgggtgtggttggaagtccagagatagttgtgcttttacacggttttccaacatccagctacgactggtacaagatttgggaaggtctgaccttgaggtttcatcgggtgattgcccttgatttcttaggctttggcttcagtgacaaaccgagaccacatcactattccatatttgagcaggccagcatcgtggaagcgcttttgcggcatctggggctccagaaccgcaggatcaaccttctttctcatgactatggagatattgttgctcaggagcttctctacaggtacaagcagaatcgatctggtcggcttaccataaagagtctctgtctgtcaaatggaggtaattgccttggcggtaggtagaaagtgggtgtaatctagaagggccatctttagatacagcggcacctaaatggtaatctgataatatttcaagtagacataattaaactatgggatctctacctcttctgtgccatcaactcctttggtggtctgacaagatttatggaccctttctcagaatgttttaaaataaagaaacaaacagcattacaaaggatagtgactttacttacatagtcaataaaaagctgcattatagtcacatgtgctttttcaatgcattagatagcaagttctagtggaggacctagtaacagctatatcagaaggagtgaggagtgtaaagactgtttgccatatctgaaacaactgcaataggttatgagagtgtaggattgaagatacagaaaaaagccacaagtgtttctaatactactatgatgttagtgtagaaaatccttacttaatgtcatcaatgggttcttggaaactgtgactttaaatgaaacgttataatggaaccaattttttttctcatcaatgttttaaagaaaggatgttattcaaggacctgctgtacctcattctgcttaaagccgaagtttccaagaacctatcctgatgttaagtgaggacttaactgtatgagattccccaactcctaactgatggcagtgccaagtttcagttagaaaataccgaacccctgattagactttctgggtagccagc

SEQ ID NO: 356768 - DNA, 8349 bp, Homo sapiens
cgttcgggcagcggcctcttgttacccggggcccgcttgcctcagcttcttgctgccgccagcacgctaagctccagtcggcgccgaaggagagcttcccgaccctcgtgtccagtagccgcaatcccaggctgggagggtgaggcgccgcgctctgccgcccccccgcccctcgctccctgtgtcctggcggatttgcacgtaatctatccgaaagcccagtcccacccgccacccgactctggagctcccattcttcaggaccctgctgaagtatcgcttctcagccgccttctccaggcgcagctgcattcgcttctcggtttttgcactcgctgtgcaccgagttactttcccggcccctcgttgacaccgttcacaggtggctgttggtctttagtaagggtgctgtcttccctgtctgatccttagcaaaagtaggaaggtagagttgttggcagaaatcctgggataagagaatagtttcctggaagatctgtgcctccaaccagcagagagggattgagcttcattgaactcaacagagccaacatttcatagcaccatgttcaagaggaggttgaagtggcatggcaatggttagagaccctgctgggcgtgaacaccctctggctacctagggacctgtgggcctaccacctggtgccctcatggagacaagaagccctgggttgaacaacatgaagccccagtcactgcagctggtactggaagagcaggtgctggcactacagcagcagatggcagagaatcaggcagcctcctggcggaagctgaagaactcccaggaggcccagcagagacaagcaacccttgtgaggaagctgcaggccaaggtgctgcagtaccgaagctggtgccaagagctggagaagcggctagaagccactggaggaccaatcccccagaggtgggaaaatgtggaggagccaaacctggatgagctgctggtccgattggaggaggagcaacagaggtgtgagagtctagcagaggtgaacacccagcttcgactgcacatggaaaaagctgacgtggtgaataaagcccttagggaagatgtggaaaaactgacagtggactggagccgggcccgggatgagctaatgaggaaggagagccagtggcagatggagcaggagttcttcaagggctacctgaaaggggagcacggtcgccttctcagtctatggcgggaggttgtgacattccgacgccacttcctggaaatgaagtcagctactgacagagatctgatggagctaaaagctgagcatgtgaggctttcagggtctctgttgacctgttgtctgcgcttgactgtgggagcacagtctcgggaacccaacggatctggaagaatggatgggcgggagccggcccagctgctgctgctactagccaagacccaggagctggagaaggaagcccatgaaaggagccaggagttaatacagctgaagagtcaaggggatctggagaaggctgaacttcaggaccgggtgaccgagctctctgctctgttgacccagtctcagaagcaaaatgaagattatgaaaagatgataaaggctctgagagagacagtggagatcctggagacaaatcacacagaattaatggaacatgaagcatctcttagtaggaatgcgcaagaggagaagttgtctttacagcaggtgatcaaggatataacccaggtcatggtggaagaaggggacaatatagcccaaggctctggtcatgagaactctttggaattggactctagtatcttctcccagtttgattaccaggatgcagacaaggctcttactctggtgcgttcagtgctgactcggagacgccaggctgtgcaggacctaaggcagcagcttgcaggctgtcaagaggctgtgaacttgttgcaacagcagcatgatcagtgggaggaagagggcaaagccttgagacagcggctgcagaagctcactggggagcgggacactctggcagggcagactgtggacctccagggagaggtggactctctcagcaaggagcgagagctgctgcagaaggccagggaagagctgcggcagcagctggaggtgctagagcaggaggcatggcgcctgcgaagggtaaatgtggagcttcagctgcagggggactctgcccagggccagaaggaggaacagcaggaggagctgcacctggctgtccgggagagggagcgtcttcaggagatgctgatgggcctggaagccaaacagtcagaatcactcagtgaactgatcactcttcgggaagccctggagtcaagtcacctggaaggggagttactgaggcaagagcaaacggaagtgaccgcagcgctggctagggcagagcagtcaattgcagagctgtcgagttctgaaaacaccctgaagacagaagtagctgatcttcgggctgcagctgtcaagctcagtgccttaaatgaggctttggcgttagataaagttgggctgaaccagcagcttctccagttagaggaggagaaccagtctgtgtgcagcagaatggaggccgcagagcaggcgagaaatgctttgcaggtcgacctggcggaggcagagaagaggagggaagccctgtgggaaaagaacactcacctggaggctcagctgcagaaagctgaggaggctggggctgagctgcaggcagatctcagggacatccaagaagagaaggaagaaattcaaaagaaactaagtgagtcacgtcaccagcaggaggcagccacgactcagctggagcagctacatcaggaggcaaagcgacaggaagaagtgcttgccagggcagtccaggagaaggaggccctagtacgagagaaagcggctctagaggtgcggctgcaggccgtggagcgtgaccggcaggacctcgctgaacaactacaggggctcagctcagccaaggagctactggagagcagtctgtttgaagcccaacaacaaaattctgtgatagaggtcaccaaggggcagctggaggtccagattcaaactgtcactcaagccaaggaagtaatccaaggggaagtgaggtgcctgaagctggaactggacactgaacggagtcaggcagagcaggagcgggatgctgcagccagacagctggcccaggctgagcaagaagggaagactgccttggagcagcagaaggcagcccatgagaaagaggtgaaccagctccgggagaaatgggagaaggagcgctcctggcaccagcaggagctggcaaaggctctggagagcttagaaagggaaaaaatggagctggaaatgaggctaaaggagcagcagacagaaatggaggccatccaggcccagagggaagaagaacggacccaggcagagagtgccctatgccagatgcagctggaaacagagaaggagagagtatccctcctggagacactgctgcagacgcagaaggagctagcagatgccagccaacaactggaacgactgaggcaggacatgaaagtccagaaattaaaggagcaggagaccactgggatactacagacccagctccaggaggctcaacgggagctgaaggaggcagcccggcagcacagagatgaccttgctgccctccaagaagagagcagctccctgctgcaggataagatggacctgcagaagcaggtggaggacttgaagtctcagctggtggcccaggatgactcccagaggctggtggagcaggaggttcaggagaagctgagagagacccaggagtataaccgaattcagaaggagctggagagagagaaagccagcctgactctgtcactgatggaaaaggaacagagactccttgttttacaagaagctgactctattcgacaacaagagctgagtgccctgcgccaggacatgcaggaggcccagggagaacagaaagagctcagtgctcagatggaattactaaggcaagaggtgaaggaaaaggaggctgactttctggcccaggaagcacagctgctggaggagctggaggcgtctcatatcacggagcagcagctgcgagcctccttgtgggcccaggaagccaaggcagcccaactacagctgcgactgcgcagcacagagagccagctagaagcgctggccgcagagcagcagcccgggaaccaggcccaggcccaggcccagctggccagcctctactctgccctgcagcaggccctggggtctgtttgtgagagcaggcctgagctgagtggtgggggagactctgctccttccgtctggggccttgagccagaccagaatggagctaggagcctctttaagagagggcccctgctgactgctctctccgctgaggcagtagcatctgccctccacaagcttcatcaagacctgtggaagactcaacagacccgggatgttctgagggatcaggtccagaaactggaagagcgtctaactgatactgaggctgagaagagccaggtccacacagagttgcaggatctgcagagacagctctcccagaatcaggaagagaaatccaagtgggaaggaaagcagaactccctagaatctgagctgatggaactacatgaaactatggcatccttacagagtcgcctgcggagagcagagctacagcgaatggaagcccagggtgagcgagagttacttcaggcagccaaggagaacctgacagcccaggtggaacacctgcaagcagctgtcgtagaagccagggctcaggcaagtgctgctggcatcctggaagaagacctgagaacggctcgctcagcactgaagctgaaaaatgaggaagtagagagtgagcgtgagagagcccaggctctgcaagagcagggcgaactgaaggtggcccaagggaaggctctgcaagagaatttggccctcctgacccagaccctagctgaaagagaagaggaggtggagactctgcggggacaaatccaggaactggagaagcaacgggaaatgcagaaggctgctttggaattgctgtctctggacctgaagaagaggaaccaagaggtagatctgcagcaagaacagattcaggagctagagaagtgtaggtctgttttagagcatctgcccatggccgtccaggagcgagagcagaagctgactgtgcagagggagcagatcagagagctcgagaaggatcgggagactcagaggaacgtcttggagcatcagcttctagaacttgagaagaaagaccaaatgattgagtcccagagaggacaggttcaggacctgaaaaagcagttggttactctggaatgcctggccctggaactggaggaaaaccatcacaagatggagtgccagcaaaaactgatcaaggagctggagggccagagggaaacccagagagtggctttgacccaccttacgctggacctagaagaaaggagccaggagctgcaggcacaaagcagccagatccatgacctggagagccacagcaccgttctggcaagagagctgcaggagagggaccaggaggtgaagtctcagcgagaacagatcgaggagctgcagaggcagaaagagcatctgactcaggatctcgagaggagagaccaggagctgatgctgcagaaggagaggattcaggttctcgaggatcagaggacccggcagaccaagatcctggaggaggacctggaacagatcaagctgtccttgagagagcgaggccgggagctgaccactcagaggcagctgatgcaggaacgggcagaggaagggaagggcccaagtaaagcacagcgcgggagcctagagcacatgaagctgatcctgcgtgataaggagaaggaggtggaatgtcagcaggagcatatccatgaactccaggagctcaaagaccagctggagcagcagctccagggcctgcacaggaaggtaggtgagaccagcctcctcctgtcccagcgagagcaggaaatagtggtcctgcagcagcaactgcaggaagccagggaacaaggggagctgaaggagcagtcacttcagagtcaactggatgaggcccagagagccctagcccagagggaccaggaactggaggctctgcagcaagaacagcagcaggcccagggacaggaggagagggtgaaggaaaaggcagacgccctccagggagctctggagcaagcccatatgacactgaaggagcgtcatggagagcttcaggaccacaaggaacaggcacgaaggctggaggaagagctggcagtggagggacggcgggtccaggccctggaggaggtgctgggagacctaagggctgagtctcgggaacaggagaaagctctgttggccctccagcagcagtgtgctgagcaggcacaggagcatgaggtggagaccagggccctgcaggacagctggctgcaggcccaggcagtgctcaaggaacgggaccaggagctggaagctctgcgggcagaaagtcagtcctcccggcatcaggaggaggctgcccgggcccgggctgaggctctgcaggaggcccttggcaaggctcatgctgccctgcaggggaaagagcagcatctcctcgagcaggcagaattgagccgcagtctggaggccagcactgcaaccctgcaagcctccctggatgcctgccaggcacacagtcggcagctggaggaggctctgaggatacaagaaggtgagatccaggaccaggatctccgataccaggaggatgtgcagcagctgcagcaggcacttgcccagagggatgaagagctgagacatcagcaggaacgggagcagctgctggagaagtctctggcccagagggtccaagagaatatgatccaagagaagcagaatctggggcaagagagagaagaggaggagataaggggccttcatcagagtgtaagggagctacagctgactctagcccaaaaggaacaggagattctggagctgagggagacccagcaaaggaacaacctggaagccttaccccacagccacaaaacctccccaatggaggaacaatctctaaaacttgattctttagagcccaggctgcagcgggagctggagcggctacaggcagccctgagacagacagaagccagggagattgagtggagggagaaggcccaggacttggcactctccctagcgcagaccaaggccagtgtcagcagtctgcaggaggtagccatgttcctacaagcctctgtcctggagcgggactcagaacagcaaaggctgcaggatgaactggagctcaccagacgggctctggagaaggagcggctacacagcccaggtgcaaccagcacagcagaactggggtccagaggggagcagggtgtgcagctgggagaggtctcaggagtggaggctgagcctagtcctgatggaatggagaagcagtcatggagacaaaggcttgaacacctgcagcaagcagtggcccggctggagattgacaggagcaggctgcagcgccacaatgtccagctgcggagtaccttggagcaggtggagcgagaacggaggaagctgaagagggaggccatgcgtgcggcccaggcagggtccctagagatcagcaaggccacggcttcttcacccacacagcaggatgggagaggacagaagaactcagatgccaagtgtgtggctgaactgcagaaagaggtggtcctgctgcaagctcagctgactttggagcggaagcagaagcaggactacatcacccgctcagcacagaccagccgtgagctagcaggcctgcaccacagcctctcacactcacttcttgccgtggcccaggcccctgaggccactgtcctggaggcagagacccgcaggctggatgagtccctgactcaaagtctgacatccccagggccagtcctgctacaccccagccccagcactacccaagccgcctccaggtagcagccacagccaggagcacacagacagaagactgtgtcatgggtcatggcccctccgcacacctacaggtttgccaaaggaaaagcctggctctgttaggcacccaggagccccaggtcggcgggtgttcccaggaagaggaagtaaatctgcaaccctggggaggaccccaactcacctgggaatgaggcaaattgcatttgcttgctccctatggaatcacccagaggggtgccttgccctggctgagggacatgtactgcctctcatctagaatttattttcctagcacttcaccacctccttcatcttctccttcaacaataaaccctgagatctttgcattcat

SEQ ID NO: 356769 - DNA, 466 bp, Homo sapiens
tggtaaatccctgcatgtgtctgagtggttttttgcttccccacttcaaggctatagcatcatgtggtattcagggagtgcagacgggctgggggtgcctaagggatttgggggaggctgcagttgggagtggttggggttggggctggggctggggtgtgctgcatcgtagctctgtccacatccatgggctgttctggtgacagtgctatgctcttctctttagggtgaccgagctctctgctctgttgacccagtctcagaagcaaaatgaagattatgaaaagatgataaaggctctgagagagacagtggagatcctggtacatgatcctttgctctggaaaggagttgggcgtgggcttgtaggttccttgtgctttatggacagatagtgcaggataccagttacatattccatgatgaaatcctctaaagctaaaaaataaattttggctgaatctga

SEQ ID NO: 356770 - DNA, 199 bp, Homo sapiens
ccctggcttgagggacatgtactgcctctcatctagggcaaggcacccctctgggtgattccatagggagcaagcaaaggggtgccttgccctggctgagggacatgtactgcctctcatctagaatttattttcctagcacttcaccacctccttcatcttctccttcaacaataaaccctgagatctttgcattcat

SEQ ID NO: 356771 - DNA, 8043 bp, Homo sapiens
agcagcggctgccgcagctcaatcgcggagcaactagccgggcgtctgcgggagccgagcgtggtgaggttcacaggtggctgttggtctttagtaagggtgctgtcttccctgtctgatccttagcaaaagtaggaaggtagagttgttggcagaaatcctgggataagagaatagtttcctggaagatctgtgcctccaaccagcagagagggattgagcttcattgaactcaacagagccaacatttcatagcaccatgttcaagaggaggttgaagtggcatggcaatggttagagaccctgctgggcgtgaacaccctctggctacctagggacctgtgggcctaccacctggtgccctcatggagacaagaagccctgggttgaacaacatgaagccccagtcactgcagctggtactggaagagcaggtgctggcactacagcagcagatggcagagaatcaggcagcctcctggcggaagctgaagaactcccaggaggcccagcagagacaagcaacccttgtgaggaagctgcaggccaaggtgctgcagtaccgaagctggtgccaagagctggagaagcggctagaagccactggaggaccaatcccccagaggtgggaaaatgtggaggagccaaacctggatgagctgctggtccgattggaggaggagcaacagaggtgtgagagtctagcagaggtgaacacccagcttcgactgcacatggaaaaagctgacgtggtgaataaagcccttagggaagatgtggaaaaactgacagtggactggagccgggcccgggatgagctaatgaggaaggagagccagtggcagatggagcaggagttcttcaagggctacctgaaaggggagcacggtcgccttctcagtctatggcgggaggttgtgacattccgacgccacttcctggaaatgaagtcagctactgacagagatctgatggagctaaaagctgagcatgtgaggctttcagggtctctgttgacctgttgtctgcgcttgactgtgggagcacagtctcgggaacccaacggatctggaagaatggatgggcgggagccggcccagctgctgctgctactagccaagacccaggagctggagaaggaagcccatgaaaggagccaggagttaatacagctgaagagtcaaggggatctggagaaggctgaacttcaggaccgggtgaccgagctctctgctctgttgacccagtctcagaagcaaaatgaagattatgaaaagatgataaaggctctgagagagacagtggagatcctggagacaaatcacacagaattaatggaacatgaagcatctcttagtaggaatgcgcaagaggagaagttgtctttacagcaggtgatcaaggatataacccaggtcatggtggaagaaggggacaatatagcccaaggctctggtcatgagaactctttggaattggactctagtatcttctcccagtttgattaccaggatgcagacaaggctcttactctggtgcgttcagtgctgactcggagacgccaggctgtgcaggacctaaggcagcagcttgcaggctgtcaagaggctgtgaacttgttgcaacagcagcatgatcagtgggaggaagagggcaaagccttgagacagcggctgcagaagctcactggggagcgggacactctggcagggcagactgtggacctccagggagaggtggactctctcagcaaggagcgagagctgctgcagaaggccagggaagagctgcggcagcagctggaggtgctagagcaggaggcatggcgcctgcgaagggtaaatgtggagcttcagctgcagggggactctgcccagggccagaaggaggaacagcaggaggagctgcacctggctgtccgggagagggagcgtcttcaggagatgctgatgggcctggaagccaaacagtcagaatcactcagtgaactgatcactcttcgggaagccctggagtcaagtcacctggaaggggagttactgaggcaagagcaaacggaagtgaccgcagcgctggctagggcagagcagtcaattgcagagctgtcgagttctgaaaacaccctgaagacagaagtagctgatcttcgggctgcagctgtcaagctcagtgccttaaatgaggctttggcgttagataaagttgggctgaaccagcagcttctccagttagaggaggagaaccagtctgtgtgcagcagaatggaggccgcagagcaggcgagaaatgctttgcaggtcgacctggcggaggcagagaagaggagggaagccctgtgggaaaagaacactcacctggaggctcagctgcagaaagctgaggaggctggggctgagctgcaggcagatctcagggacatccaagaagagaaggaagaaattcaaaagaaactaagtgagtcacgtcaccagcaggaggcagccacgactcagctggagcagctacatcaggaggcaaagcgacaggaagaagtgcttgccagggcagtccaggagaaggaggccctagtacgagagaaagcggctctagaggtgcggctgcaggccgtggagcgtgaccggcaggacctcgctgaacaactacaggggctcagctcagccaaggagctactggagagcagtctgtttgaagcccaacaacaaaattctgtgatagaggtcaccaaggggcagctggaggtccagattcaaactgtcactcaagccaaggaagtaatccaaggggaagtgaggtgcctgaagctggaactggacactgaacggagtcaggcagagcaggagcgggatgctgcagccagacagctggcccaggctgagcaagaagggaagactgccttggagcagcagaaggcagcccatgagaaagaggtgaaccagctccgggagaaatgggagaaggagcgctcctggcaccagcaggagctggcaaaggctctggagagcttagaaagggaaaaaatggagctggaaatgaggctaaaggagcagcagacagaaatggaggccatccaggcccagagggaagaagaacggacccaggcagagagtgccctatgccagatgcagctggaaacagagaaggagagagtatccctcctggagacactgctgcagacgcagaaggagctagcagatgccagccaacaactggaacgactgaggcaggacatgaaagtccagaaattaaaggagcaggagaccactgggatactacagacccagctccaggaggctcaacgggagctgaaggaggcagcccggcagcacagagatgaccttgctgccctccaagaagagagcagctccctgctgcaggataagatggacctgcagaagcaggtggaggacttgaagtctcagctggtggcccaggatgactcccagaggctggtggagcaggaggttcaggagaagctgagagagacccaggagtataaccgaattcagaaggagctggagagagagaaagccagcctgactctgtcactgatggaaaaggaacagagactccttgttttacaagaagctgactctattcgacaacaagagctgagtgccctgcgccaggacatgcaggaggcccagggagaacagaaagagctcagtgctcagatggaattactaaggcaagaggtgaaggaaaaggaggctgactttctggcccaggaagcacagctgctggaggagctggaggcgtctcatatcacggagcagcagctgcgagcctccttgtgggcccaggaagccaaggcagcccaactacagctgcgactgcgcagcacagagagccagctagaagcgctggccgcagagcagcagcccgggaaccaggcccaggcccaggcccagctggccagcctctactctgccctgcagcaggccctggggtctgtttgtgagagcaggcctgagctgagtggtgggggagactctgctccttccgtctggggccttgagccagaccagaatggagctaggagcctctttaagagagggcccctgctgactgctctctccgctgaggcagtagcatctgccctccacaagcttcatcaagacctgtggaagactcaacagacccgggatgttctgagggatcaggtccagaaactggaagagcgtctaactgatactgaggctgagaagagccaggtccacacagagttgcaggatctgcagagacagctctcccagaatcaggaagagaaatccaagtgggaaggaaagcagaactccctagaatctgagctgatggaactacatgaaactatggcatccttacagagtcgcctgcggagagcagagctacagcgaatggaagcccagggtgagcgagagttacttcaggcagccaaggagaacctgacagcccaggtggaacacctgcaagcagctgtcgtagaagccagggctcaggcaagtgctgctggcatcctggaagaagacctgagaacggctcgctcagcactgaagctgaaaaatgaggaagtagagagtgagcgtgagagagcccaggctctgcaagagcagggcgaactgaaggtggcccaagggaaggctctgcaagagaatttggccctcctgacccagaccctagctgaaagagaagaggaggtggagactctgcggggacaaatccaggaactggagaagcaacgggaaatgcagaaggctgctttggaattgctgtctctggacctgaagaagaggaaccaagaggtagatctgcagcaagaacagattcaggagctagagaagtgtaggtctgttttagagcatctgcccatggccgtccaggagcgagagcagaagctgactgtgcagagggagcagatcagagagctcgagaaggatcgggagactcagaggaacgtcttggagcatcagcttctagaacttgagaagaaagaccaaatgattgagtcccagagaggacaggttcaggacctgaaaaagcagttggttactctggaatgcctggccctggaactggaggaaaaccatcacaagatggagtgccagcaaaaactgatcaaggagctggagggccagagggaaacccagagagtggctttgacccaccttacgctggacctagaagaaaggagccaggagctgcaggcacaaagcagccagatccatgacctggagagccacagcaccgttctggcaagagagctgcaggagagggaccaggaggtgaagtctcagcgagaacagatcgaggagctgcagaggcagaaagagcatctgactcaggatctcgagaggagagaccaggagctgatgctgcagaaggagaggattcaggttctcgaggatcagaggacccggcagaccaagatcctggaggaggacctggaacagatcaagctgtccttgagagagcgaggccgggagctgaccactcagaggcagctgatgcaggaacgggcagaggaagggaagggcccaagtaaagcacagcgcgggagcctagagcacatgaagctgatcctgcgtgataaggagaaggaggtggaatgtcagcaggagcatatccatgaactccaggagctcaaagaccagctggagcagcagctccagggcctgcacaggaaggtaggtgagaccagcctcctcctgtcccagcgagagcaggaaatagtggtcctgcagcagcaactgcaggaagccagggaacaaggggagctgaaggagcagtcacttcagagtcaactggatgaggcccagagagccctagcccagagggaccaggaactggaggctctgcagcaagaacagcagcaggcccagggacaggaggagagggtgaaggaaaaggcagacgccctccagggagctctggagcaagcccatatgacactgaaggagcgtcatggagagcttcaggaccacaaggaacaggcacgaaggctggaggaagagctggcagtggagggacggcgggtccaggccctggaggaggtgctgggagacctaagggctgagtctcgggaacaggagaaagctctgttggccctccagcagcagtgtgctgagcaggcacaggagcatgaggtggagaccagggccctgcaggacagctggctgcaggcccaggcagtgctcaaggaacgggaccaggagctggaagctctgcgggcagaaagtcagtcctcccggcatcaggaggaggctgcccgggcccgggctgaggctctgcaggaggcccttggcaaggctcatgctgccctgcaggggaaagagcagcatctcctcgagcaggcagaattgagccgcagtctggaggccagcactgcaaccctgcaagcctccctggatgcctgccaggcacacagtcggcagctggaggaggctctgaggatacaagaaggtgagatccaggaccaggatctccgataccaggaggatgtgcagcagctgcagcaggcacttgcccagagggatgaagagctgagacatcagcaggaacgggagcagctgctggagaagtctctggcccagagggtccaagagaatatgatccaagagaagcagaatctggggcaagagagagaagaggaggagataaggggccttcatcagagtgtaagggagctacagctgactctagcccaaaaggaacaggagattctggagctgagggagacccagcaaaggaacaacctggaagccttaccccacagccacaaaacctccccaatggaggaacaatctctaaaacttgattctttagagcccaggctgcagcgggagctggagcggctacaggcagccctgagacagacagaagccagggagattgagtggagggagaaggcccaggacttggcactctccctagcgcagaccaaggccagtgtcagcagtctgcaggaggtagccatgttcctacaagcctctgtcctggagcgggactcagaacagcaaaggctgcaggatgaactggagctcaccagacgggctctggagaaggagcggctacacagcccaggtgcaaccagcacagcagaactggggtccagaggggagcagggtgtgcagctgggagaggtctcaggagtggaggctgagcctagtcctgatggaatggagaagcagtcatggagacaaaggcttgaacacctgcagcaagcagtggcccggctggagattgacaggagcaggctgcagcgccacaatgtccagctgcggagtaccttggagcaggtggagcgagaacggaggaagctgaagagggaggccatgcgtgcggcccaggcagggtccctagagatcagcaaggccacggcttcttcacccacacagcaggatgggagaggacagaagaactcagatgccaagtgtgtggctgaactgcagaaagaggtggtcctgctgcaagctcagctgactttggagcggaagcagaagcaggactacatcacccgctcagcacagaccagccgtgagctagcaggcctgcaccacagcctctcacactcacttcttgccgtggcccaggcccctgaggccactgtcctggaggcagagacccgcaggctggatgagtccctgactcaaagtctgacatccccagggccagtcctgctacaccccagccccagcactacccaagccgcctccaggtagcagccacagccaggagcacacagacagaagactgtgtcatgggtcatggcccctccgcacacctacaggtttgccaaaggaaaagcctggctctgttaggcacccaggagccccaggtcggcgggtgttcccaggaagaggaagtaaatctgcaaccctggggaggaccccaactcacctgggaatgaggcaaattgcatttgcttgctccctatggaatcacccagaggggtgccttgccctggctgagggacatgtactgcctctcatctagaatttattttcctagcacttcaccacctccttcatcttctccttcaacaataaaccctgagatctttgcattcat

SEQ ID NO: 356772 - DNA, 7053 bp, Homo sapiens
tggtaaatccctgcatgtgtctgagtggttttttgcttccccacttcaaggctatagcatcatgtggtattcagggagtgcagacgggctgggggtgcctaagggatttgggggaggctgcagttgggagtggttggggttggggctggggctggggtgtgctgcatcgtagctctgtccacatccatgggctgttctggtgacagtgctatgctcttctctttagggtgaccgagctctctgctctgttgacccagtctcagaagcaaaatgaagattatgaaaagatgataaaggctctgagagagacagtggagatcctggagacaaatcacacagaattaatggaacatgaagcatctcttagtaggaatgcgcaagaggagaagttgtctttacagcaggtgatcaaggatataacccaggtcatggtggaagaaggggacaatatagcccaaggctctggtcatgagaactctttggaattggactctagtatcttctcccagtttgattaccaggatgcagacaaggctcttactctggtgcgttcagtgctgactcggagacgccaggctgtgcaggacctaaggcagcagcttgcaggctgtcaagaggctgtgaacttgttgcaacagcagcatgatcagtgggaggaagagggcaaagccttgagacagcggctgcagaagctcactggggagcgggacactctggcagggcagactgtggacctccagggagaggtggactctctcagcaaggagcgagagctgctgcagaaggccagggaagagctgcggcagcagctggaggtgctagagcaggaggcatggcgcctgcgaagggtaaatgtggagcttcagctgcagggggactctgcccagggccagaaggaggaacagcaggaggagctgcacctggctgtccgggagagggagcgtcttcaggagatgctgatgggcctggaagccaaacagtcagaatcactcagtgaactgatcactcttcgggaagccctggagtcaagtcacctggaaggggagttactgaggcaagagcaaacggaagtgaccgcagcgctggctagggcagagcagtcaattgcagagctgtcgagttctgaaaacaccctgaagacagaagtagctgatcttcgggctgcagctgtcaagctcagtgccttaaatgaggctttggcgttagataaagttgggctgaaccagcagcttctccagttagaggaggagaaccagtctgtgtgcagcagaatggaggccgcagagcaggcgagaaatgctttgcaggtcgacctggcggaggcagagaagaggagggaagccctgtgggaaaagaacactcacctggaggctcagctgcagaaagctgaggaggctggggctgagctgcaggcagatctcagggacatccaagaagagaaggaagaaattcaaaagaaactaagtgagtcacgtcaccagcaggaggcagccacgactcagctggagcagctacatcaggaggcaaagcgacaggaagaagtgcttgccagggcagtccaggagaaggaggccctagtacgagagaaagcggctctagaggtgcggctgcaggccgtggagcgtgaccggcaggacctcgctgaacaactacaggggctcagctcagccaaggagctactggagagcagtctgtttgaagcccaacaacaaaattctgtgatagaggtcaccaaggggcagctggaggtccagattcaaactgtcactcaagccaaggaagtaatccaaggggaagtgaggtgcctgaagctggaactggacactgaacggagtcaggcagagcaggagcgggatgctgcagccagacagctggcccaggctgagcaagaagggaagactgccttggagcagcagaaggcagcccatgagaaagaggtgaaccagctccgggagaaatgggagaaggagcgctcctggcaccagcaggagctggcaaaggctctggagagcttagaaagggaaaaaatggagctggaaatgaggctaaaggagcagcagacagaaatggaggccatccaggcccagagggaagaagaacggacccaggcagagagtgccctatgccagatgcagctggaaacagagaaggagagagtatccctcctggagacactgctgcagacgcagaaggagctagcagatgccagccaacaactggaacgactgaggcaggacatgaaagtccagaaattaaaggagcaggagaccactgggatactacagacccagctccaggaggctcaacgggagctgaaggaggcagcccggcagcacagagatgaccttgctgccctccaagaagagagcagctccctgctgcaggataagatggacctgcagaagcaggtggaggacttgaagtctcagctggtggcccaggatgactcccagaggctggtggagcaggaggttcaggagaagctgagagagacccaggagtataaccgaattcagaaggagctggagagagagaaagccagcctgactctgtcactgatggaaaaggaacagagactccttgttttacaagaagctgactctattcgacaacaagagctgagtgccctgcgccaggacatgcaggaggcccagggagaacagaaagagctcagtgctcagatggaattactaaggcaagaggtgaaggaaaaggaggctgactttctggcccaggaagcacagctgctggaggagctggaggcgtctcatatcacggagcagcagctgcgagcctccttgtgggcccaggaagccaaggcagcccaactacagctgcgactgcgcagcacagagagccagctagaagcgctggccgcagagcagcagcccgggaaccaggcccaggcccaggcccagctggccagcctctactctgccctgcagcaggccctggggtctgtttgtgagagcaggcctgagctgagtggtgggggagactctgctccttccgtctggggccttgagccagaccagaatggagctaggagcctctttaagagagggcccctgctgactgctctctccgctgaggcagtagcatctgccctccacaagcttcatcaagacctgtggaagactcaacagacccgggatgttctgagggatcaggtccagaaactggaagagcgtctaactgatactgaggctgagaagagccaggtccacacagagttgcaggatctgcagagacagctctcccagaatcaggaagagaaatccaagtgggaaggaaagcagaactccctagaatctgagctgatggaactacatgaaactatggcatccttacagagtcgcctgcggagagcagagctacagcgaatggaagcccagggtgagcgagagttacttcaggcagccaaggagaacctgacagcccaggtggaacacctgcaagcagctgtcgtagaagccagggctcaggcaagtgctgctggcatcctggaagaagacctgagaacggctcgctcagcactgaagctgaaaaatgaggaagtagagagtgagcgtgagagagcccaggctctgcaagagcagggcgaactgaaggtggcccaagggaaggctctgcaagagaatttggccctcctgacccagaccctagctgaaagagaagaggaggtggagactctgcggggacaaatccaggaactggagaagcaacgggaaatgcagaaggctgctttggaattgctgtctctggacctgaagaagaggaaccaagaggtagatctgcagcaagaacagattcaggagctagagaagtgtaggtctgttttagagcatctgcccatggccgtccaggagcgagagcagaagctgactgtgcagagggagcagatcagagagctcgagaaggatcgggagactcagaggaacgtcttggagcatcagcttctagaacttgagaagaaagaccaaatgattgagtcccagagaggacaggttcaggacctgaaaaagcagttggttactctggaatgcctggccctggaactggaggaaaaccatcacaagatggagtgccagcaaaaactgatcaaggagctggagggccagagggaaacccagagagtggctttgacccaccttacgctggacctagaagaaaggagccaggagctgcaggcacaaagcagccagatccatgacctggagagccacagcaccgttctggcaagagagctgcaggagagggaccaggaggtgaagtctcagcgagaacagatcgaggagctgcagaggcagaaagagcatctgactcaggatctcgagaggagagaccaggagctgatgctgcagaaggagaggattcaggttctcgaggatcagaggacccggcagaccaagatcctggaggaggacctggaacagatcaagctgtccttgagagagcgaggccgggagctgaccactcagaggcagctgatgcaggaacgggcagaggaagggaagggcccaagtaaagcacagcgcgggagcctagagcacatgaagctgatcctgcgtgataaggagaaggaggtggaatgtcagcaggagcatatccatgaactccaggagctcaaagaccagctggagcagcagctccagggcctgcacaggaaggtaggtgagaccagcctcctcctgtcccagcgagagcaggaaatagtggtcctgcagcagcaactgcaggaagccagggaacaaggggagctgaaggagcagtcacttcagagtcaactggatgaggcccagagagccctagcccagagggaccaggaactggaggctctgcagcaagaacagcagcaggcccagggacaggaggagagggtgaaggaaaaggcagacgccctccagggagctctggagcaagcccatatgacactgaaggagcgtcatggagagcttcaggaccacaaggaacaggcacgaaggctggaggaagagctggcagtggagggacggcgggtccaggccctggaggaggtgctgggagacctaagggctgagtctcgggaacaggagaaagctctgttggccctccagcagcagtgtgctgagcaggcacaggagcatgaggtggagaccagggccctgcaggacagctggctgcaggcccaggcagtgctcaaggaacgggaccaggagctggaagctctgcgggcagaaagtcagtcctcccggcatcaggaggaggctgcccgggcccgggctgaggctctgcaggaggcccttggcaaggctcatgctgccctgcaggggaaagagcagcatctcctcgagcaggcagaattgagccgcagtctggaggccagcactgcaaccctgcaagcctccctggatgcctgccaggcacacagtcggcagctggaggaggctctgaggatacaagaaggtgagatccaggaccaggatctccgataccaggaggatgtgcagcagctgcagcaggcacttgcccagagggatgaagagctgagacatcagcaggaacgggagcagctgctggagaagtctctggcccagagggtccaagagaatatgatccaagagaagcagaatctggggcaagagagagaagaggaggagataaggggccttcatcagagtgtaagggagctacagctgactctagcccaaaaggaacaggagattctggagctgagggagacccagcaaaggaacaacctggaagccttaccccacagccacaaaacctccccaatggaggaacaatctctaaaacttgattctttagagcccaggctgcagcgggagctggagcggctacaggcagccctgagacagacagaagccagggagattgagtggagggagaaggcccaggacttggcactctccctagcgcagaccaaggccagtgtcagcagtctgcaggaggtagccatgttcctacaagcctctgtcctggagcgggactcagaacagcaaaggctgcaggatgaactggagctcaccagacgggctctggagaaggagcggctacacagcccaggtgcaaccagcacagcagaactggggtccagaggggagcagggtgtgcagctgggagaggtctcaggagtggaggctgagcctagtcctgatggaatggagaagcagtcatggagacaaaggcttgaacacctgcagcaagcagtggcccggctggagattgacaggagcaggctgcagcgccacaatgtccagctgcggagtaccttggagcaggtggagcgagaacggaggaagctgaagagggaggccatgcgtgcggcccaggcagggtccctagagatcagcaaggccacggcttcttcacccacacagcaggatgggagaggacagaagaactcagatgccaagtgtgtggctgaactgcagaaagaggtggtcctgctgcaagctcagctgactttggagcggaagcagaagcaggactacatcacccgctcagcacagaccagccgtgagctagcaggcctgcaccacagcctctcacactcacttcttgccgtggcccaggcccctgaggccactgtcctggaggcagagacccgcaggctggatgagtccctgactcaaagtctgacatccccagggccagtcctgctacaccccagccccagcactacccaagccgcctccaggtagcagccacagccaggagcacacagacagaagactgtgtcatgggtcatggcccctccgcacacctacaggtttgccaaaggaaaagcctggctctgttaggcacccaggagccccaggtcggcgggtgttcccaggaagaggaagtaaatctgcaaccctggggaggaccccaactcacctgggaatgaggcaaattgcatttgcttgctccctatggaatcacccagaggggtgccttgccctggctgagggacatgtactgcctctcatctagaatttattttcctagcacttcaccacctccttcatcttctccttcaacaataaaccctgagatctttgcattcat

SEQ ID NO: 356773 - DNA, 6138 bp, Homo sapiens
tgatggcctgtcttcttgaatagttgcatctcccttctcagctttcttttgttgcaccagcccccgacccccttctccagccccactttcggggttctgacatccctcctttgcccttgttcatcatctggtttctcttgctctctctccacaggacctaaggcagcagcttgcaggctgtcaagaggctgtgaacttgttgcaacagcagcatgatcagtgggaggaagagggcaaagccttgagacagcgctgtcaagctcagtgccttaaatgaggctttggcgttagataaagttgggctgaaccagcagcttctccagttagaggaggagaaccagtctgtgtgcagcagaatggaggccgcagagcaggcgagaaatgctttgcaggtcgacctggcggaggcagagaagaggagggaagccctgtgggaaaagaacactcacctggaggctcagctgcagaaagctgaggaggctggggctgagctgcaggcagatctcagggacatccaagaagagaaggaagaaattcaaaagaaactaagtgagtcacgtcaccagcaggaggcagccacgactcagctggagcagctacatcaggaggcaaagcgacaggaagaagtgcttgccagggcagtccaggagaaggaggccctagtacgagagaaagcggctctagaggtgcggctgcaggccgtggagcgtgaccggcaggacctcgctgaacaactacaggggctcagctcagccaaggagctactggagagcagtctgtttgaagcccaacaacaaaattctgtgatagaggtcaccaaggggcagctggaggtccagattcaaactgtcactcaagccaaggaagtaatccaaggggaagtgaggtgcctgaagctggaactggacactgaacggagtcaggcagagcaggagcgggatgctgcagccagacagctggcccaggctgagcaagaagggaagactgccttggagcagcagaaggcagcccatgagaaagaggtgaaccagctccgggagaaatgggagaaggagcgctcctggcaccagcaggagctggcaaaggctctggagagcttagaaagggaaaaaatggagctggaaatgaggctaaaggagcagcagacagaaatggaggccatccaggcccagagggaagaagaacggacccaggcagagagtgccctatgccagatgcagctggaaacagagaaggagagagtatccctcctggagacactgctgcagacgcagaaggagctagcagatgccagccaacaactggaacgactgaggcaggacatgaaagtccagaaattaaaggagcaggagaccactgggatactacagacccagctccaggaggctcaacgggagctgaaggaggcagcccggcagcacagagatgaccttgctgccctccaagaagagagcagctccctgctgcaggataagatggacctgcagaagcaggtggaggacttgaagtctcagctggtggcccaggatgactcccagaggctggtggagcaggaggttcaggagaagctgagagagacccaggagtataaccgaattcagaaggagctggagagagagaaagccagcctgactctgtcactgatggaaaaggaacagagactccttgttttacaagaagctgactctattcgacaacaagagctgagtgccctgcgccaggacatgcaggaggcccagggagaacagaaagagctcagtgctcagatggaattactaaggcaagaggtgaaggaaaaggaggctgactttctggcccaggaagcacagctgctggaggagctggaggcgtctcatatcacggagcagcagctgcgagcctccttgtgggcccaggaagccaaggcagcccaactacagctgcgactgcgcagcacagagagccagctagaagcgctggccgcagagcagcagcccgggaaccaggcccaggcccaggcccagctggccagcctctactctgccctgcagcaggccctggggtctgtttgtgagagcaggcctgagctgagtggtgggggagactctgctccttccgtctggggccttgagccagaccagaatggagctaggagcctctttaagagagggcccctgctgactgctctctccgctgaggcagtagcatctgccctccacaagcttcatcaagacctgtggaagactcaacagacccgggatgttctgagggatcaggtccagaaactggaagagcgtctaactgatactgaggctgagaagagccaggtccacacagagttgcaggatctgcagagacagctctcccagaatcaggaagagaaatccaagtgggaaggaaagcagaactccctagaatctgagctgatggaactacatgaaactatggcatccttacagagtcgcctgcggagagcagagctacagcgaatggaagcccagggtgagcgagagttacttcaggcagccaaggagaacctgacagcccaggtggaacacctgcaagcagctgtcgtagaagccagggctcaggcaagtgctgctggcatcctggaagaagacctgagaacggctcgctcagcactgaagctgaaaaatgaggaagtagagagtgagcgtgagagagcccaggctctgcaagagcagggcgaactgaaggtggcccaagggaaggctctgcaagagaatttggccctcctgacccagaccctagctgaaagagaagaggaggtggagactctgcggggacaaatccaggaactggagaagcaacgggaaatgcagaaggctgctttggaattgctgtctctggacctgaagaagaggaaccaagaggtagatctgcagcaagaacagattcaggagctagagaagtgtaggtctgttttagagcatctgcccatggccgtccaggagcgagagcagaagctgactgtgcagagggagcagatcagagagctcgagaaggatcgggagactcagaggaacgtcttggagcatcagcttctagaacttgagaagaaagaccaaatgattgagtcccagagaggacaggttcaggacctgaaaaagcagttggttactctggaatgcctggccctggaactggaggaaaaccatcacaagatggagtgccagcaaaaactgatcaaggagctggagggccagagggaaacccagagagtggctttgacccaccttacgctggacctagaagaaaggagccaggagctgcaggcacaaagcagccagatccatgacctggagagccacagcaccgttctggcaagagagctgcaggagagggaccaggaggtgaagtctcagcgagaacagatcgaggagctgcagaggcagaaagagcatctgactcaggatctcgagaggagagaccaggagctgatgctgcagaaggagaggattcaggttctcgaggatcagaggacccggcagaccaagatcctggaggaggacctggaacagatcaagctgtccttgagagagcgaggccgggagctgaccactcagaggcagctgatgcaggaacgggcagaggaagggaagggcccaagtaaagcacagcgcgggagcctagagcacatgaagctgatcctgcgtgataaggagaaggaggtggaatgtcagcaggagcatatccatgaactccaggagctcaaagaccagctggagcagcagctccagggcctgcacaggaaggtaggtgagaccagcctcctcctgtcccagcgagagcaggaaatagtggtcctgcagcagcaactgcaggaagccagggaacaaggggagctgaaggagcagtcacttcagagtcaactggatgaggcccagagagccctagcccagagggaccaggaactggaggctctgcagcaagaacagcagcaggcccagggacaggaggagagggtgaaggaaaaggcagacgccctccagggagctctggagcaagcccatatgacactgaaggagcgtcatggagagcttcaggaccacaaggaacaggcacgaaggctggaggaagagctggcagtggagggacggcgggtccaggccctggaggaggtgctgggagacctaagggctgagtctcgggaacaggagaaagctctgttggccctccagcagcagtgtgctgagcaggcacaggagcatgaggtggagaccagggccctgcaggacagctggctgcaggcccaggcagtgctcaaggaacgggaccaggagctggaagctctgcgggcagaaagtcagtcctcccggcatcaggaggaggctgcccgggcccgggctgaggctctgcaggaggcccttggcaaggctcatgctgccctgcaggggaaagagcagcatctcctcgagcaggcagaattgagccgcagtctggaggccagcactgcaaccctgcaagcctccctggatgcctgccaggcacacagtcggcagctggaggaggctctgaggatacaagaaggtgagatccaggaccaggatctccgataccaggaggatgtgcagcagctgcagcaggcacttgcccagagggatgaagagctgagacatcagcaggaacgggagcagctgctggagaagtctctggcccagagggtccaagagaatatgatccaagagaagcagaatctggggcaagagagagaagaggaggagataaggggccttcatcagagtgtaagggagctacagctgactctagcccaaaaggaacaggagattctggagctgagggagacccagcaaaggaacaacctggaagccttaccccacagccacaaaacctccccaatggaggaacaatctctaaaacttgattctttagagcccaggctgcagcgggagctggagcggctacaggcagccctgagacagacagaagccagggagattgagtggagggagaaggcccaggacttggcactctccctagcgcagaccaaggccagtgtcagcagtctgcaggaggtagccatgttcctacaagcctctgtcctggagcgggactcagaacagcaaaggctgcaggatgaactggagctcaccagacgggctctggagaaggagcggctacacagcccaggtgcaaccagcacagcagaactggggtccagaggggagcagggtgtgcagctgggagaggtctcaggagtggaggctgagcctagtcctgatggaatggagaagcagtcatggagacaaaggcttgaacacctgcagcaagcagtggcccggctggagattgacaggagcaggctgcagcgccacaatgtccagctgcggagtaccttggagcaggtggagcgagaacggaggaagctgaagagggaggccatgcgtgcggcccaggcagggtccctagagatcagcaaggccacggcttcttcacccacacagcaggatgggagaggacagaagaactcagatgccaagtgtgtggctgaactgcagaaagaggtggtcctgctgcaagctcagctgactttggagcggaagcagaagcaggactacatcacccgctcagcacagaccagccgtgagctagcaggcctgcaccacagcctctcacactcacttcttgccgtggcccaggcccctgaggccactgtcctggaggcagagacccgcaggctggatgagtccctgactcaaagtctgacatccccagggccagtcctgctacaccccagccccagcactacccaagccgcctccaggtagcagccacagccaggagcacacagacagaagactgtgtcatgggtcatggcccctccgcacacctacaggtttgccaaaggaaaagcctggctctgttaggcacccaggagccccaggtcggcgggtgttcccaggaagaggaagtaaatctgcaaccctggggaggaccccaactcacctgggaatgaggcaaattgcatttgcttgctccctatggaatcacccagaggggtgccttgccctggctgagggacatgtactgcctctcatctagaatttattttcctagcacttcaccacctccttcatcttctccttcaacaataaaccctgagatctttgcattcat

SEQ ID NO: 356774 - DNA, 4795 bp, Homo sapiens
cagtgtgtaggaattggtagaatcgccagagcattggaaatggccactgactatggtaaacctcgaaggaccctgaagccctaggtgaggagcatcttcccaccggccccctgccctgccatcttggtcttcatgcccttaattttccaggtggaggacttgaagtctcagctggtggcccaggatgactcccagaggctggtggagcaggaggttcaggagaagctgagagagacccaggagtataaccgaattcagaaggagctggagagagagaaagccagcctgactctgtcactgatggaaaaggaacagagactccttgttttacaagaagctgactctattcgacaacaagagctgagtgccctgcgccaggacatgcaggaggcccagggagaacagaaagagctcagtgctcagatggaattactaaggcaagaggtgaaggaaaaggaggctgactttctggcccaggaagcacagctgctggaggagctggaggcgtctcatatcacggagcagcagctgcgagcctccttgtgggcccaggaagccaaggcagcccaactacagctgcgactgcgcagcacagagagccagctagaagcgctggccgcagagcagcagcccgggaaccaggcccaggcccaggcccagctggccagcctctactctgccctgcagcaggccctggggtctgtttgtgagagcaggcctgagctgagtggtgggggagactctgctccttccgtctggggccttgagccagaccagaatggagctaggagcctctttaagagagggcccctgctgactgctctctccgctgaggcagtagcatctgccctccacaagcttcatcaagacctgtggaagactcaacagacccgggatgttctgagggatcaggtccagaaactggaagagcgtctaactgatactgaggctgagaagagccaggtccacacagagttgcaggatctgcagagacagctctcccagaatcaggaagagaaatccaagtgggaaggaaagcagaactccctagaatctgagctgatggaactacatgaaactatggcatccttacagagtcgcctgcggagagcagagctacagcgaatggaagcccagggtgagcgagagttacttcaggcagccaaggagaacctgacagcccaggtggaacacctgcaagcagctgtcgtagaagccagggctcaggcaagtgctgctggcatcctggaagaagacctgagaacggctcgctcagcactgaagctgaaaaatgaggaagtagagagtgagcgtgagagagcccaggctctgcaagagcagggcgaactgaaggtggcccaagggaaggctctgcaagagaatttggccctcctgacccagaccctagctgaaagagaagaggaggtggagactctgcggggacaaatccaggaactggagaagcaacgggaaatgcagaaggctgctttggaattgctgtctctggacctgaagaagaggaaccaagaggtagatctgcagcaagaacagattcaggagctagagaagtgtaggtctgttttagagcatctgcccatggccgtccaggagcgagagcagaagctgactgtgcagagggagcagatcagagagctcgagaaggatcgggagactcagaggaacgtcttggagcatcagcttctagaacttgagaagaaagaccaaatgattgagtcccagagaggacaggttcaggacctgaaaaagcagttggttactctggaatgcctggccctggaactggaggaaaaccatcacaagatggagtgccagcaaaaactgatcaaggagctggagggccagagggaaacccagagagtggctttgacccaccttacgctggacctagaagaaaggagccaggagctgcaggcacaaagcagccagatccatgacctggagagccacagcaccgttctggcaagagagctgcaggagagggaccaggaggtgaagtctcagcgagaacagatcgaggagctgcagaggcagaaagagcatctgactcaggatctcgagaggagagaccaggagctgatgctgcagaaggagaggattcaggttctcgaggatcagaggacccggcagaccaagatcctggaggaggacctggaacagatcaagctgtccttgagagagcgaggccgggagctgaccactcagaggcagctgatgcaggaacgggcagaggaagggaagggcccaagtaaagcacagcgcgggagcctagagcacatgaagctgatcctgcgtgataaggagaaggaggtggaatgtcagcaggagcatatccatgaactccaggagctcaaagaccagctggagcagcagctccagggcctgcacaggaaggtaggtgagaccagcctcctcctgtcccagcgagagcaggaaatagtggtcctgcagcagcaactgcaggaagccagggaacaaggggagctgaaggagcagtcacttcagagtcaactggatgaggcccagagagccctagcccagagggaccaggaactggaggctctgcagcaagaacagcagcaggcccagggacaggaggagagggtgaaggaaaaggcagacgccctccagggagctctggagcaagcccatatgacactgaaggagcgtcatggagagcttcaggaccacaaggaacaggcacgaaggctggaggaagagctggcagtggagggacggcgggtccaggccctggaggaggtgctgggagacctaagggctgagtctcgggaacaggagaaagctctgttggccctccagcagcagtgtgctgagcaggcacaggagcatgaggtggagaccagggccctgcaggacagctggctgcaggcccaggcagtgctcaaggaacgggaccaggagctggaagctctgcgggcagaaagtcagtcctcccggcatcaggaggaggctgcccgggcccgggctgaggctctgcaggaggcccttggcaaggctcatgctgccctgcaggggaaagagcagcatctcctcgagcaggcagaattgagccgcagtctggaggccagcactgcaaccctgcaagcctccctggatgcctgccaggcacacagtcggcagctggaggaggctctgaggatacaagaaggtgagatccaggaccaggatctccgataccaggaggatgtgcagcagctgcagcaggcacttgcccagagggatgaagagctgagacatcagcaggaacgggagcagctgctggagaagtctctggcccagagggtccaagagaatatgatccaagagaagcagaatctggggcaagagagagaagaggaggagataaggggccttcatcagagtgtaagggagctacagctgactctagcccaaaaggaacaggagattctggagctgagggagacccagcaaaggaacaacctggaagccttaccccacagccacaaaacctccccaatggaggaacaatctctaaaacttgattctttagagcccaggctgcagcgggagctggagcggctacaggcagccctgagacagacagaagccagggagattgagtggagggagaaggcccaggacttggcactctccctagcgcagaccaaggccagtgtcagcagtctgcaggaggtagccatgttcctacaagcctctgtcctggagcgggactcagaacagcaaaggctgcaggatgaactggagctcaccagacgggctctggagaaggagcggctacacagcccaggtgcaaccagcacagcagaactggggtccagaggggagcagggtgtgcagctgggagaggtctcaggagtggaggctgagcctagtcctgatggaatggagaagcagtcatggagacaaaggcttgaacacctgcagcaagcagtggcccggctggagattgacaggagcaggctgcagcgccacaatgtccagctgcggagtaccttggagcaggtggagcgagaacggaggaagctgaagagggaggccatgcgtgcggcccaggcagggtccctagagatcagcaaggccacggcttcttcacccacacagcaggatgggagaggacagaagaactcagatgccaagtgtgtggctgaactgcagaaagaggtggtcctgctgcaagctcagctgactttggagcggaagcagaagcaggactacatcacccgctcagcacagaccagccgtgagctagcaggcctgcaccacagcctctcacactcacttcttgccgtggcccaggcccctgaggccactgtcctggaggcagagacccgcaggctggatgagtccctgactcaaagtctgacatccccagggccagtcctgctacaccccagccccagcactacccaagccgcctccaggtagcagccacagccaggagcacacagacagaagactgtgtcatgggtcatggcccctccgcacacctacaggtttgccaaaggaaaagcctggctctgttaggcacccaggagccccaggtcggcgggtgttcccaggaagaggaagtaaatctgcaaccctggggaggaccccaactcacctgggaatgaggcaaattgcatttgcttgctccctatggaatcacccagaggggtgccttgccctggctgagggacatgtactgcctctcatctagaatttattttcctagcacttcaccacctccttcatcttctccttcaacaataaaccctgagatctttgcattcat

SEQ ID NO: 356775 - DNA, 8202 bp, Homo sapiens
agcagcggctgccgcagctcaatcgcggagcaactagccgggcgtctgcgggagccgagcgtggtgaggttcacaggtggctgttggtctttagtaagggtgctgtcttccctgtctgatccttagcaaaagtaggaaggtagagttgttggcagaaatcctgggataagagaatagtttcctggaagatctgtgcctccaaccagcagagagggattgagcttcattgaactcaacagagccaacatttcatagcaccatgttcaagaggaggttgaagtggcatggcaatggttagagaccctgctgggcgtgaacaccctctggctacctagggacctgtgggcctaccacctggtgccctcatggagacaagaagccctgggttgaacaacatgaagccccagtcactgcagctggtactggaagagcaggtgctggcactacagcagcagatggcagagaatcaggcagcctcctggcggaagctgaagaactcccaggaggcccagcagagacaagcaacccttgtgaggaagctgcaggccaaggtgctgcagtaccgaagctggtgccaagagctggagaagcggctagaagccactggaggaccaatcccccagaggtgggaaaatgtggaggagccaaacctggatgagctgctggtccgattggaggaggagcaacagaggtgtgagagtctagcagaggtgaacacccagcttcgactgcacatggaaaaagctgacgtggtgaataaagcccttagggaagatgtggaaaaactgacagtggactggagccgggcccgggatgagctaatgaggaaggagagccagtggcagatggagcaggagttcttcaagggctacctgaaaggggagcacggtcgccttctcagtctatggcgggaggttgtgacattccgacgccacttcctggaaatgaagtcagctactgacagagatctgatggagctaaaagctgagcatgtgaggctttcagggtctctgttgacctgttgtctgcgcttgactgtgggagcacagtctcgggaacccaacggatctggaagaatggatgggcgggagccggcccagctgctgctgctactagccaagacccaggagctggagaaggaagcccatgaaaggagccaggagttaatacagctgaagagtcaaggggatctggagaaggctgaacttcaggaccgggtgaccgagctctctgctctgttgacccagtctcagaagcaaaatgaagattatgaaaagatgataaaggctctgagagagacagtggagatcctggagacaaatcacacagaattaatggaacatgaagcatctcttagtaggaatgcgcaagaggagaagttgtctttacagcaggtgatcaaggatataacccaggtcatggtggaagaaggggacaatatagcccaaggctctggtcatgagaactctttggaattggactctagtatcttctcccagtttgattaccaggatgcagacaaggctcttactctggtgcgttcagtgctgactcggagacgccaggctgtgcaggacctaaggcagcagcttgcaggctgtcaagaggctgtgaacttgttgcaacagcagcatgatcagtgggaggaagagggcaaagccttgagacagcggctgcagaagctcactggggagcgggacactctggcagggcagactgtggacctccagggagaggtggactctctcagcaaggagcgagagctgctgcagaaggccagggaagagctgcggcagcagctggaggtgctagagcaggaggcatggcgcctgcgaagggtaaatgtggagcttcagctgcagggggactctgcccagggccagaaggaggaacagcaggaggagctgcacctggctgtccgggagagggagcgtcttcaggagatgctgatgggcctggaagccaaacagtcagaatcactcagtgaactgatcactcttcgggaagccctggagtcaagtcacctggaaggggagttactgaggcaagagcaaacggaagtgaccgcagcgctggctagggcagagcagtcaattgcagagctgtcgagttctgaaaacaccctgaagacagaagtagctgatcttcgggctgcagctgtcaagctcagtgccttaaatgaggctttggcgttagataaagttgggctgaaccagcagcttctccagttagaggaggagaaccagtctgtgtgcagcagaatggaggccgcagagcaggcgagaaatgctttgcaggtcgacctggcggaggcagagaagaggagggaagccctgtgggaaaagaacactcacctggaggctcagctgcagaaagctgaggaggctggggctgagctgcaggcagatctcagggacatccaagaagagaaggaagaaattcaaaagaaactaagtgagtcacgtcaccagcaggaggcagccacgactcagctggagcagctacatcaggaggcaaagcgacaggaagaagtgcttgccagggcagtccaggagaaggaggccctagtacgagagaaagcggctctagaggtgcggctgcaggccgtggagcgtgaccggcaggacctcgctgaacaactacaggggctcagctcagccaaggagctactggagagcagtctgtttgaagcccaacaacaaaattctgtgatagaggtcaccaaggggcagctggaggtccagattcaaactgtcactcaagccaaggaagtaatccaaggggaagtgaggtgcctgaagctggaactggacactgaacggagtcaggcagagcaggagcgggatgctgcagccagacagctggcccaggctgagcaagaagggaagactgccttggagcagcagaaggcagcccatgagaaagaggtgaaccagctccgggagaaatgggagaaggagcgctcctggcaccagcaggagctggcaaaggctctggagagcttagaaagggaaaaaatggagctggaaatgaggctaaaggagcagcagacagaaatggaggccatccaggcccagagggaagaagaacggacccaggcagagagtgccctatgccagatgcagctggaaacagagaaggagagagtatccctcctggagacactgctgcagacgcagaaggagctagcagatgccagccaacaactggaacgactgaggcaggacatgaaagtccagaaattaaaggagcaggagaccactgggatactacagacccagctccaggaggctcaacgggagctgaaggaggcagcccggcagcacagagatgaccttgctgccctccaagaagagagcagctccctgctgcaggataagatggacctgcagaagcaggtggaggacttgaagtctcagctggtggcccaggatgactcccagaggctggtggagcaggaggttcaggagaagctgagagagacccaggagtataaccgaattcagaaggagctggagagagagaaagccagcctgactctgtcactgatggaaaaggaacagagactccttgttttacaagaagctgactctattcgacaacaagagctgagtgccctgcgccaggacatgcaggaggcccagggagaacagaaagagctcagtgctcagatggaattactaaggcaagaggtgaaggaaaaggaggctgactttctggcccaggaagcacagctgctggaggagctggaggcgtctcatatcacggagcagcagctgcgagcctccttgtgggcccaggaagccaaggcagcccaactacagctgcgactgcgcagcacagagagccagctagaagcgctggccgcagagcagcagcccgggaaccaggcccaggcccaggcccagctggccagcctctactctgccctgcagcaggccctggggtctgtttgtgagagcaggcctgagctgagtggtgggggagactctgctccttccgtctggggccttgagccagaccagaatggagctaggagcctctttaagagagggcccctgctgactgctctctccgctgaggcagtagcatctgccctccacaagcttcatcaagacctgtggaagactcaacagacccgggatgttctgagggatcaggtccagaaactggaagagcgtctaactgatactgaggctgagaagagccaggtccacacagagttgcaggatctgcagagacagctctcccagaatcaggaagagaaatccaagtgggaaggaaagcagaactccctagaatctgagctgatggaactacatgaaactatggcatccttacagagtcgcctgcggagagcagagctacagcgaatggaagcccagggtgagcgagagttacttcaggcagccaaggagaacctgacagcccaggtggaacacctgcaagcagctgtcgtagaagccagggctcaggcaagtgctgctggcatcctggaagaagacctgagaacggctcgctcagcactgaagctgaaaaatgaggaagtagagagtgagcgtgagagagcccaggctctgcaagagcagggcgaactgaaggtggcccaagggaaggctctgcaagagaatttggccctcctgacccagaccctagctgaaagagaagaggaggtggagactctgcggggacaaatccaggaactggagaagcaacgggaaatgcagaaggctgctttggaattgctgtctctggacctgaagaagaggaaccaagaggtagatctgcagcaagaacagattcaggagctagagaagtgtaggtctgttttagagcatctgcccatggccgtccaggagcgagagcagaagctgactgtgcagagggagcagatcagagagctcgagaaggatcgggagactcagaggaacgtcttggagcatcagcttctagaacttgagaagaaagaccaaatgattgagtcccagagaggacaggttcaggacctgaaaaagcagttggttactctggaatgcctggccctggaactggaggaaaaccatcacaagatggagtgccagcaaaaactgatcaaggagctggagggccagagggaaacccagagagtggctttgacccaccttacgctggacctagaagaaaggagccaggagctgcaggcacaaagcagccagatccatgacctggagagccacagcaccgttctggcaagagagctgcaggagagggaccaggaggtgaagtctcagcgagaacagatcgaggagctgcagaggcagaaagagcatctgactcaggatctcgagaggagagaccaggagctgatgctgcagaaggagaggattcaggttctcgaggatcagaggacccggcagaccaagatcctggaggaggacctggaacagatcaagctgtccttgagagagcgaggccgggagctgaccactcagaggcagctgatgcaggaacgggcagaggaagggaagggcccaagtaaagcacagcgcgggagcctagagcacatgaagctgatcctgcgtgataaggagaaggaggtggaatgtcagcaggagcatatccatgaactccaggagctcaaagaccagctggagcagcagctccagggcctgcacaggaaggtaggtgagaccagcctcctcctgtcccagcgagagcaggaaatagtggtcctgcagcagcaactgcaggaagccagggaacaaggggagctgaaggagcagtcacttcagagtcaactggatgaggcccagagagccctagcccagagggaccaggaactggaggctctgcagcaagaacagcagcaggcccagggacaggaggagagggtgaaggaaaaggcagacgccctccagggagctctggagcaagcccatatgacactgaaggagcgtcatggagagcttcaggaccacaaggaacaggcacgaaggctggaggaagagctggcagtggagggacggcgggtccaggccctggaggaggtgctgggagacctaagggctgagtctcgggaacaggagaaagctctgttggccctccagcagcagtgtgctgagcaggcacaggagcatgaggtggagaccagggccctgcaggacagctggctgcaggcccaggcagtgctcaaggaacgggaccaggagctggaagctctgcgggcagaaagtcagtcctcccggcatcaggaggaggctgcccgggcccgggctgaggctctgcaggaggcccttggcaaggctcatgctgccctgcaggggaaagagcagcatctcctcgagcaggcagaattgagccgcagtctggaggccagcactgcaaccctgcaagcctccctggatgcctgccaggcacacagtcggcagctggaggaggctctgaggatacaagaaggtgagatccaggaccaggatctccgataccaggaggatgtgcagcagctgcagcaggcacttgcccagagggatgaagagctgagacatcagcaggaacgggagcagctgctggagaagtctctggcccagagggtccaagagaatatgatccaagagaagcagaatctggggcaagagagagaagaggaggagataaggggccttcatcagagtgtaagggagctacagctgactctagcccaaaaggaacaggagattctggagctgagggagacccagcaaaggaacaacctggaagccttaccccacagccacaaaacctccccaatggaggaacaatctctaaaacttgattctttagagcccaggctgcagcgggagctggagcggctacaggcagccctgagacagacagaagccagggagattgagtggagggagaaggcccaggacttggcactctccctagcgcagaccaaggccagtgtcagcagtctgcaggaggtagccatgttcctacaagcctctgtcctggagcgggactcagaacagcaaaggctgcaggatgaactggagctcaccagacgggctctggagaaggagcggctacacagcccaggtgcaaccagcacagcagaactggggtccagaggggagcagggtgtgcagctgggagaggtctcaggagtggaggctgagcctagtcctgatggaatggagaagcagtcatggagacaaaggcttgaacacctgcagcaagcagtggcccggctggagattgacaggagcaggctgcagcgccacaatgtccagctgcggagtaccttggagcaggtggagcgagaacggaggaagctgaagagggaggccatgcgtgcggcccaggcagggtccctagagatcagcaaggccacggcttcttcacccacacagcaggatgggagaggacagaagaactcagatgccaagtgtgtggctgaactgcagaaagagggcagagcacatggcaagtggcatgctgactcagacaccgggcactgagaaaagtgggaagccatggtcacagactctacattcccctctcctgttggcctccatcccttcctcaaccgtccgcagaacacctccttccagcaccttagctcctgcctccctctggacctattcagtcctcaagggtgccctgctaaaggctgggctgaaagctaagaggagaggtggcattcaatgtgtcctgtgtcctccctggggttgattaaggggtcgatgcccaatagagtccttcatcttggcgttcagcccagggtccagctgccaagggaaggcttggcaatcaagggtgatggagataagaatgaaaaggggcaccaccctgtgccaaagctggcatgttgtatatctgagagaggagctgcctattcacagtgtagggttgtcaagctggaggcagggagagaaaagcaagagctttttggttcctcttgaggatagaatctataggaaaatgtaagagggttaaaaataaatttcccatgcatccaaacttttttctttggtagactttcttgtcatctatttaaaatgaaacaagtgcatgtacgtggttaagacattttagctaggaatgatggtgcgtgcctgtagtcccagctacttgggaggctgaggcaggaggatcgcttgaacctggaaggtcaaggctgcagtgagccgagatcataccactgcactccagcctgagtgataaaagtgagaccctgtctca

SEQ ID NO: 356776 - DNA, 7504 bp, Homo sapiens
agcagcggctgccgcagctcaatcgcggagcaactagccgggcgtctgcgggagccgagcgtggtgaggttcacaggtggctgttggtctttagtaagggtgctgtcttccctgtctgatccttagcaaaagtaggaaggtagagttgttggcagaaatcctgggataagagaatagtttcctggaagatctgtgcctccaaccagcagagagggattgagcttcattgaactcaacagagccaacatttcatagcaccatgttcaagaggaggttgaagtggcatggcaatggttagagaccctgctgggcgtgaacaccctctggctacctagggacctgtgggcctaccacctggtgccctcatggagacaagaagccctgggttgaacaacatgaagccccagtcactgcagctggtactggaagagcaggtgctggcactacagcagcagatggcagagaatcaggcagcctcctggcggaagctgaagaactcccaggaggcccagcagagacaagcaacccttgtgaggaagctgcaggccaaggtgctgcagtaccgaagctggtgccaagagctggagaagcggctagaagccactggaggaccaatcccccagaggtgggaaaatgtggaggagccaaacctggatgagctgctggtccgattggaggaggagcaacagaggtgtgagagtctagcagaggtgaacacccagcttcgactgcacatggaaaaagctgacgtggtgaataaagcccttagggaagatgtggaaaaactgacagtggactggagccgggcccgggatgagctaatgaggaaggagagccagtggcagatggagcaggagttcttcaagggctacctgaaaggggagcacggtcgccttctcagtctatggcgggaggttgtgacattccgacgccacttcctggaaatgaagtcagctactgacagagatctgatggagctaaaagctgagcatgtgaggctttcagggtctctgttgacctgttgtctgcgcttgactgtgggagcacagtctcgggaacccaacggatctggaagaatggatgggcgggagccggcccagctgctgctgctactagccaagacccaggagctggagaaggaagcccatgaaaggagccaggagttaatacagctgaagagtcaaggggatctggagaaggctgaacttcaggaccgggtgaccgagctctctgctctgttgacccagtctcagaagcaaaatgaagattatgaaaagatgataaaggctctgagagagacagtggagatcctggagacaaatcacacagaattaatggaacatgaagcatctcttagtaggaatgcgcaagaggagaagttgtctttacagcaggtgatcaaggatataacccaggtcatggtggaagaaggggacaatatagcccaaggctctggtcatgagaactctttggaattggactctagtatcttctcccagtttgattaccaggatgcagacaaggctcttactctggtgcgttcagtgctgactcggagacgccaggctgtgcaggacctaaggcagcagcttgcaggctgtcaagaggctgtgaacttgttgcaacagcagcatgatcagtgggaggaagagggcaaagccttgagacagcggctgcagaagctcactggggagcgggacactctggcagggcagactgtggacctccagggagaggtggactctctcagcaaggagcgagagctgctgcagaaggccagggaagagctgcggcagcagctggaggtgctagagcaggaggcatggcgcctgcgaagggtaaatgtggagcttcagctgcagggggactctgcccagggccagaaggaggaacagcaggaggagctgcacctggctgtccgggagagggagcgtcttcaggagatgctgatgggcctggaagccaaacagtcagaatcactcagtgaactgatcactcttcgggaagccctggagtcaagtcacctggaaggggagttactgaggcaagagcaaacggaagtgaccgcagcgctggctagggcagagcagtcaattgcagagctgtcgagttctgaaaacaccctgaagacagaagtagctgatcttcgggctgcagctgtcaagctcagtgccttaaatgaggctttggcgttagataaagttgggctgaaccagcagcttctccagttagaggaggagaaccagtctgtgtgcagcagaatggaggccgcagagcaggcgagaaatgctttgcaggtcgacctggcggaggcagagaagaggagggaagccctgtgggaaaagaacactcacctggaggctcagctgcagaaagctgaggaggctggggctgagctgcaggcagatctcagggacatccaagaagagaaggaagaaattcaaaagaaactaagtgagtcacgtcaccagcaggaggcagccacgactcagctggagcagctacatcaggaggcaaagcgacaggaagaagtgcttgccagggcagtccaggagaaggaggccctagtacgagagaaagcggctctagaggtgcggctgcaggccgtggagcgtgaccggcaggacctcgctgaacaactacaggggctcagctcagccaaggagctactggagagcagtctgtttgaagcccaacaacaaaattctgtgatagaggtcaccaaggggcagctggaggtccagattcaaactgtcactcaagccaaggaagtaatccaaggggaagtgaggtgcctgaagctggaactggacactgaacggagtcaggcagagcaggagcgggatgctgcagccagacagctggcccaggctgagcaagaagggaagactgccttggagcagcagaaggcagcccatgagaaagaggtgaaccagctccgggagaaatgggagaaggagcgctcctggcaccagcaggagctggcaaaggctctggagagcttagaaagggaaaaaatggagctggaaatgaggctaaaggagcagcagacagaaatggaggccatccaggcccagagggaagaagaacggacccaggcagagagtgccctatgccagatgcagctggaaacagagaaggagagagtatccctcctggagacactgctgcagacgcagaaggagctagcagatgccagccaacaactggaacgactgaggcaggacatgaaagtccagaaattaaaggagcaggagaccactgggatactacagacccagctccaggaggctcaacgggagctgaaggaggcagcccggcagcacagagatgaccttgctgccctccaagaagagagcagctccctgctgcaggataagatggacctgcagaagcaggtggaggacttgaagtctcagctggtggcccaggatgactcccagaggctggtggagcaggaggttcaggagaagctgagagagacccaggagtataaccgaattcagaaggagctggagagagagaaagccagcctgactctgtcactgatggaaaaggaacagagactccttgttttacaagaagctgactctattcgacaacaagagctgagtgccctgcgccaggacatgcaggaggcccagggagaacagaaagagctcagtgctcagatggaattactaaggcaagaggtgaaggaaaaggaggctgactttctggcccaggaagcacagctgctggaggagctggaggcgtctcatatcacggagcagcagctgcgagcctccttgtgggcccaggaagccaaggcagcccaactacagctgcgactgcgcagcacagagagccagctagaagcgctggccgcagagcagcagcccgggaaccaggcccaggcccaggcccagctggccagcctctactctgccctgcagcaggccctggggtctgtttgtgagagcaggcctgagctgagtggtgggggagactctgctccttccgtctggggccttgagccagaccagaatggagctaggagcctctttaagagagggcccctgctgactgctctctccgctgaggcagtagcatctgccctccacaagcttcatcaagacctgtggaagactcaacagacccgggatgttctgagggatcaggtccagaaactggaagagcgtctaactgatactgaggctgagaagagccaggtccacacagagttgcaggatctgcagagacagctctcccagaatcaggaagagaaatccaagtgggaaggaaagcagaactccctagaatctgagctgatggaactacatgaaactatggcatccttacagagtcgcctgcggagagcagagctacagcgaatggaagcccagggtgagcgagagttacttcaggcagccaaggagaacctgacagcccaggtggaacacctgcaagcagctgtcgtagaagccagggctcaggcaagtgctgctggcatcctggaagaagacctgagaacggctcgctcagcactgaagctgaaaaatgaggaagtagagagtgagcgtgagagagcccaggctctgcaagagcagggcgaactgaaggtggcccaagggaaggctctgcaagagaatttggccctcctgacccagaccctagctgaaagagaagaggaggtggagactctgcggggacaaatccaggaactggagaagcaacgggaaatgcagaaggctgctttggaattgctgtctctggacctgaagaagaggaaccaagaggtagatctgcagcaagaacagattcaggagctagagaagtgtaggtctgttttagagcatctgcccatggccgtccaggagcgagagcagaagctgactgtgcagagggagcagatcagagagctcgagaaggatcgggagactcagaggaacgtcttggagcatcagcttctagaacttgagaagaaagaccaaatgattgagtcccagagaggacaggttcaggacctgaaaaagcagttggttactctggaatgcctggccctggaactggaggaaaaccatcacaagatggagtgccagcaaaaactgatcaaggagctggagggccagagggaaacccagagagtggctttgacccaccttacgctggacctagaagaaaggagccaggagctgcaggcacaaagcagccagatccatgacctggagagccacagcaccgttctggcaagagagctgcaggagagggaccaggaggtgaagtctcagcgagaacagatcgaggagctgcagaggcagaaagagcatctgactcaggatctcgagaggagagaccaggagctgatgctgcagaaggagaggattcaggttctcgaggatcagaggacccggcagaccaagatcctggaggaggacctggaacagatcaagctgtccttgagagagcgaggccgggagctgaccactcagaggcagctgatgcaggaacgggcagaggaagggaagggcccaagtaaagcacagcgcgggagcctagagcacatgaagctgatcctgcgtgataaggagaaggaggtggaatgtcagcaggagcatatccatgaactccaggagctcaaagaccagctggagcagcagctccagggcctgcacaggaaggtaggtgagaccagcctcctcctgtcccagcgagagcaggaaatagtggtcctgcagcagcaactgcaggaagccagggaacaaggggagctgaaggagcagtcacttcagagtcaactggatgaggcccagagagccctagcccagagggaccaggaactggaggctctgcagcaagaacagcagcaggcccagggacaggaggagagggtgaaggaaaaggcagacgccctccagggagctctggagcaagcccatatgacactgaaggagcgtcatggagagcttcaggaccacaaggaacaggcacgaaggctggaggaagagctggcagtggagggacggcgggtccaggccctggaggaggtgctgggagacctaagggctgagtctcgggaacaggagaaagctctgttggccctccagcagcagtgtgctgagcaggcacaggagcatgaggtggagaccagggccctgcaggacagctggctgcaggcccaggcagtgctcaaggaacgggaccaggagctggaagctctgcgggcagaaagtcagtcctcccggcatcaggaggaggctgcccgggcccgggctgaggctctgcaggaggcccttggcaaggctcatgctgccctgcaggggaaagagcagcatctcctcgagcaggcagaattgagccgcagtctggaggccagcactgcaaccctgcaagcctccctggatgcctgccaggcacacagtcggcagctggaggaggctctgaggatacaagaaggtgagatccaggaccaggatctccgataccaggaggatgtgcagcagctgcagcaggcacttgcccagagggatgaagagctgagacatcagcaggaacgggagcagctgctggagaagtctctggcccagagggtccaagagaatatgatccaagagaagcagaatctggggcaagagagagaagaggaggagataaggggccttcatcagagtgtaagggagctacagctgactctagcccaaaaggaacaggagattctggagctgagggagacccagcaaaggaacaacctggaagccttaccccacagccacaaaacctccccaatggaggaacaatctctaaaacttgattctttagagcccaggctgcagcgggagctggagcggctacaggcagccctgagacagacagaagccagggagattgagtggagggagaaggcccaggacttggcactctccctagcgcagaccaaggccagtgtcagcagtctgcaggaggtagccatgttcctacaagcctctgtcctggagcgggactcagaacagcaaaggctgcaggatgaactggagctcaccagacgggctctggagaaggagcggctacacagcccaggtgcaaccagcacagcagaactggggtccagaggggagcagggtgtgcagctgggagaggtctcaggagtggaggctgagcctagtcctgatggaatggagaagcaagccaggagcacacagacagaagactgtgtcatgggtcatggcccctccgcacacctacaggtttgccaaaggaaaagcctggctctgttaggcacccaggagccccaggtcggcgggtgttcccaggaagaggaagtaaatctgcaaccctggggaggaccccaactcacctgggaatgaggcaaattgcatttgcttgctccctatggaatcacccagaggggtgccttgccctggctgagggacatgtactgcctctcatctagaatttattttcctagcacttcaccacctccttcatcttctccttcaacaataaaccctgagatctttgcattcat

SEQ ID NO: 356777 - DNA, 1343 bp, Homo sapiens
agcagcggctgccgcagctcaatcgcggagcaactagccgggcgtctgcgggagccgagcgtggtgaggttcacaggtggctgttggtctttagtaagggtgctgtcttccctgtctgatccttagcaaaagtaggaaggtagagttgttggcagaaatcctgggataagagaatagtttcctggaagatctgtgcctccaaccagcagagagggattgagcttcattgaactcaacagagccaacatttcatagcaccatgttcaagaggaggttgaagtggcatggcaatggttagagaccctgctgggcgtgaacaccctctggctacctagggacctgtgggcctaccacctggtgccctcatggagacaagaagccctgggttgaacaacatgaagccccagtcactgcagctggtactggaagagcaggtgctggcactacagcagcagatggcagagaatcaggcagcctcctggcggaagctgaagaactcccaggaggcccagcagagacaagcaacccttgtgaggaagctgcaggccaaggtgctgcagtaccgaagctggtgccaagagctggagaagcggctagaagccactggaggaccaatcccccagaggtgggaaaatgtggaggagccaaacctggatgagctgctggtccgattggaggaggagcaacagaggtgtgagagtctagcagaggtgaacacccagcttcgactgcacatggaaaaagctgacgtggtgaataaagcccttagggaagatgtggaaaaactgacagtggactggagccgggcccgggatgagctaatgaggaaggagagccagtggcagatggagcaggagttcttcaagggctacctgaaaggggagcacggtcgccttctcagtctatggcgggaggttgtgacattccgacgccacttcctggaaatgaagtcagctactgacagagatctgatggagctaaaagctgagcatgtgaggctttcagggtctctgttgacctgttgtctgcgcttgactgtgggagcacagtctcgggaacccaacggatctggaagaatggatgggcgggagccggcccagctgctgctgctactagccaagacccaggagctggagaaggaagcccatgaaaggagccaggagttaatacagctgaagagtcaaggggatctggagaaggctgaacttcaggaccgggtgaccgagctctctgctctgttgacccagtctcagaagcaaaatgaagattatgaaaagatgataaaggctctgagagagacagtggagatcctgaagaaattgagaagtatgttgctgaaattg

SEQ ID NO: 356778 - DNA, 1595 bp, Homo sapiens
agcagcggctgccgcagctcaatcgcggagcaactagccgggcgtctgcgggagccgagcgtggtgaggttcacaggtggctgttggtctttagtaagggtgctgtcttccctgtctgatccttagcaaaagtaggaaggtagagttgttggcagaaatcctgggataagagaatagtttcctggaagatctgtgcctccaaccagcagagagggattgagcttcattgaactcaacagagccaacatttcatagcaccatgttcaagaggaggttgaagtggcatggcaatggttagagaccctgctgggcgtgaacaccctctggctacctagggacctgtgggcctaccacctggtgccctcatggagacaagaagccctgggttgaacaacatgaagccccagtcactgcagctggtactggaagagcaggtgctggcactacagcagcagatggcagagaatcaggcagcctcctggcggaagctgaagaactcccaggaggcccagcagagacaagcaacccttgtgaggaagctgcaggccaaggtgctgcagtaccgaagctggtgccaagagctggagaagcggctagaagccactggaggaccaatcccccagaggtgggaaaatgtggaggagccaaacctggatgagctgctggtccgattggaggaggagcaacagaggtgtgagagtctagcagaggtgaacacccagcttcgactgcacatggaaaaagctgacgtggtgaataaagcccttagggaagatgtggaaaaactgacagtggactggagccgggcccgggatgagctaatgaggaaggagagccagtggcagatggagcaggagttcttcaagggctacctgaaaggggagcacggtcgccttctcagtctatggcgggaggttgtgacattccgacgccacttcctggaaatgaagtcagctactgacagagatctgatggagctaaaagctgagcatgtgaggctttcagggtctctgttgacctgttgtctgcgcttgactgtgggagcacagtctcgggaacccaacggatctggaagaatggatgggcgggagccggcccagctgctgctgctactagccaagacccaggagctggagaaggaagcccatgaaaggagccaggagttaatacagctgaagagtcaaggggatctggagaaggctgaacttcaggaccggtgagatggcctggggtcccaggaagggttcgctgagagagagctgactcctttagagggttagggacaggcagggggaggtgccaggaacattcctaccatggagggggagaagatgtgcccaaggaaatctactttgaaacctgatgccacagttggggcttgtactgacctctgccctcagcctgtcttttagcccagtttctttcctgttgatttatggagctagctatgactccatcctccatcaacaccaaagtgcttgccattcccagaacagccaagctcttccccctccctgtctttgtacctgctgaatttagtctggaatgcctccctcccttctctctctgccttatcctctaagacatagttcaaa

SEQ ID NO: 356779 - DNA, 309 bp, Homo sapiens
agtggactggagccgggcccgggatgagctaatgaggaaggagagccagtggcagatggagcaggaggtaggaagaacggggactggaactgtgagaggaagcctgtgtattctggatgctgccctggtcagtactggaaggagttaacttcaggacttggatgaaaactgagctgttgctgttaaagtccctgaccatccttacctgcgcatgctggcagcctcagccttcttgggccttcagcttagacctgccactacccgcctagtctaggttctgctgggaggtagcatgacactcagagcaac

SEQ ID NO: 356780 - DNA, 1065 bp, Homo sapiens
gatgaaagtttgcagaatgacccagttgtgcagaagagacccactggctgctctcagtgaggccagggagagtcaaacagagcatcttggacaaagagagggcttgaaggccctttcaaagtgtcaagccagttggatgcacgggttgtgtggagtccaggggtacatccagaagcaatggcaggtgttatccattcattcaggttagacctctgagcagacggcagaaacgtcagccacaggtgagcataagctcaaacccccccattgaaggctacattcttgtcccacagggcagagcacatggcaagtggcatgctgactcagacaccgggcactgagaaaagtgggaagccatggtcacagactctacattcccctctcctgttggcctccatcccttcctcaaccgtccgcagaacacctccttccagcaccttagctcctgcctccctctggacctattcagtcctcaagggtgccctgctaaaggctgggctgaaagctaagaggagaggtggcattcaatgtgtcctgtgtcctccctggggttgattaaggggtcgatgcccaatagagtccttcatcttggcgttcagcccagggtccagctgccaagggaaggcttggcaatcaagggtgatggagataagaatgaaaaggggcaccaccctgtgccaaagctggcatgttgtatatctgagagaggagctgcctattcacagtgtagggttgtcaagctggaggcagggagagaaaagcaagagctttttggttcctcttgaggatagaatctataggaaaatgtaagagggttaaaaataaatttcccatgcatccaaacttttttctttggtagactttcttgtcatctatttaaaatgaaacaagtgcatgtacgtggttaagacattttagctaggaatgatggtgcgtgcctgtagtcccagctacttgggaggctgaggcaggaggatcgcttgaacctggaaggtcaaggctgcagtgagccgagatcataccactgcactccagcctgagtgataaaagtgagaccctgtctca

SEQ ID NO: 356781 - DNA, 7895 bp, Homo sapiens
agcagcggctgccgcagctcaatcgcggagcaactagccgggcgtctgcgggagccgagcgtggtgaggttcacaggtggctgttggtctttagtaagggtgctgtcttccctgtctgatccttagcaaaagtaggaaggtagagttgttggcagaaatcctgggataagagaatagtttcctggaagatctgtgcctccaaccagcagagagggattgagcttcattgaactcaacagagccaacatttcatagcaccatgttcaagaggaggttgaagtggcatggcaatggttagagaccctgctgggcgtgaacaccctctggctacctagggacctgtgggcctaccacctggtgccctcatggagacaagaagccctgggttgaacaacatgaagccccagtcactgcagctggtactggaagagcaggtgctggcactacagcagcagatggcagagaatcaggcagcctcctggcggaagctgaagaactcccaggaggcccagcagagacaagcaacccttgtgaggaagctgcaggccaaggtgctgcagtaccgaagctggtgccaagagctggagaagcggctagaagccactggaggaccaatcccccagaggtgggaaaatgtggaggagccaaacctggatgagctgctggtccgattggaggaggagcaacagaggtgtgagagtctagcagaggtgaacacccagcttcgactgcacatggaaaaagctgacgtggtgaataaagcccttagggaagatgtggaaaaactgacagtggactggagccgggcccgggatgagctaatgaggaaggagagccagtggcagatggagcaggagttcttcaagggctacctgaaaggggagcacggtcgccttctcagtctatggcgggaggttgtgacattccgacgccacttcctggaaatgaagtcagctactgacagagatctgatggagctaaaagctgagcatgtgaggctttcagggtctctgttgacctgttgtctgcgcttgactgtgggagcacagtctcgggaacccaacggatctggaagaatggatgggcgggagccggcccagctgctgctgctactagccaagacccaggagctggagaaggaagcccatgaaaggagccaggagttaatacagctgaagagtcaaggggatctggagaaggctgaacttcaggaccgggtgaccgagctctctgctctgttgacccagtctcagaagcaaaatgaagattatgaaaagatgataaaggctctgagagagacagtggagatcctggagacaaatcacacagaattaatggaacatgaagcatctcttagtaggaatgcgcaagaggagaagttgtctttacagcaggtgatcaaggatataacccaggtcatggtggaagaaggggacaatatagcccaaggctctggtcatgagaactctttggaattggactctagtatcttctcccagtttgattaccaggatgcagacaaggctcttactctggtgcgttcagtgctgactcggagacgccaggctgtgcaggacctaaggcagcagcttgcaggctgtcaagaggctgtgaacttgttgcaacagcagcatgatcagtgggaggaagagggcaaagccttgagacagcggctgcagaagctcactggggagcgggacactctggcagggcagactgtggacctccagggagaggtggactctctcagcaaggagcgagagctgctgcagaaggccagggaagagctgcggcagcagctggaggtgctagagcaggaggcatggcgcctgcgaagggtaaatgtggagcttcagctgcagggggactctgcccagggccagaaggaggaacagcaggaggagctgcacctggctgtccgggagagggagcgtcttcaggagatgctgatgggcctggaagccaaacagtcagaatcactcagtgaactgatcactcttcgggaagccctggagtcaagtcacctggaaggggagttactgaggcaagagcaaacggaagtgaccgcagcgctggctagggcagagcagtcaattgcagagctgtcgagttctgaaaacaccctgaagacagaagtagctgatcttcgggctgcagctgtcaagctcagtgccttaaatgaggctttggcgttagataaagttgggctgaaccagcagcttctccagttagaggaggagaaccagtctgtgtgcagcagaatggaggccgcagagcaggcgagaaatgctttgcaggtcgacctggcggaggcagagaagaggagggaagccctgtgggaaaagaacactcacctggaggctcagctgcagaaagctgaggaggctggggctgagctgcaggcagatctcagggacatccaagaagagaaggaagaaattcaaaagaaactaagtgagtcacgtcaccagcaggaggcagccacgactcagctggagcagctacatcaggaggcaaagcgacaggaagaagtgcttgccagggcagtccaggagaaggaggccctagtacgagagaaagcggctctagaggtgcggctgcaggccgtggagcgtgaccggcaggacctcgctgaacaactacaggggctcagctcagccaaggagctactggagagcagtctgtttgaagcccaacaacaaaattctgtgatagaggtcaccaaggggcagctggaggtccagattcaaactgtcactcaagccaaggaagtaatccaaggggaagtgaggtgcctgaagctggaactggacactgaacggagtcaggcagagcaggagcgggatgctgcagccagacagctggcccaggctgagcaagaagggaagactgccttggagcagcagaaggcagcccatgagaaagaggtgaaccagctccgggagaaatgggagaaggagcgctcctggcaccagcaggagctggcaaaggctctggagagcttagaaagggaaaaaatggagctggaaatgaggctaaaggagcagcagacagaaatggaggccatccaggcccagagggaagaagaacggacccaggcagagagtgccctatgccagatgcagctggaaacagagaaggagagagtatccctcctggagacactgctgcagacgcagaaggagctagcagatgccagccaacaactggaacgactgaggcaggacatgaaagtccagaaattaaaggagcaggagaccactgggatactacagacccagctccaggaggctcaacgggagctgaaggaggcagcccggcagcacagagatgaccttgctgccctccaagaagagagcagctccctgctgcaggataagatggacctgcagaagcaggtggaggacttgaagtctcagctggtggcccaggatgactcccagaggctggtggagcaggaggttcaggagaagctgagagagacccaggagtataaccgaattcagaaggagctggagagagagaaagccagcctgactctgtcactgatggaaaaggaacagagactccttgttttacaagaagctgactctattcgacaacaagagctgagtgccctgcgccaggacatgcaggaggcccagggagaacagaaagagctcagtgctcagatggaattactaaggcaagaggtgaaggaaaaggaggctgactttctggcccaggaagcacagctgctggaggagctggaggcgtctcatatcacggagcagcagctgcgagcctccttgtgggcccaggaagccaaggcagcccaactacagctgcgactgcgcagcacagagagccagctagaagcgctggccgcagagcagcagcccgggaaccaggcccaggcccaggcccagctggccagcctctactctgccctgcagcaggccctggggtctgtttgtgagagcaggcctgagctgagtggtgggggagactctgctccttccgtctggggccttgagccagaccagaatggagctaggagcctctttaagagagggcccctgctgactgctctctccgctgaggcagtagcatctgccctccacaagcttcatcaagacctgtggaagactcaacagacccgggatgttctgagggatcaggtccagaaactggaagagcgtctaactgatactgaggctgagaagagccaggtccacacagagttgcaggatctgcagagacagctctcccagaatcaggaagagaaatccaagtgggaaggaaagcagaactccctagaatctgagctgatggaactacatgaaactatggcatccttacagagtcgcctgcggagagcagagctacagcgaatggaagcccagggtgagcgagagttacttcaggcagccaaggagaacctgacagcccaggtggaacacctgcaagcagctgtcgtagaagccagggctcaggcaagtgctgctggcatcctggaagaagacctgagaacggctcgctcagcactgaagctgaaaaatgaggaagtagagagtgagcgtgagagagcccaggctctgcaagagcagggcgaactgaaggtggcccaagggaaggctctgcaagagaatttggccctcctgacccagaccctagctgaaagagaagaggaggtggagactctgcggggacaaatccaggaactggagaagcaacgggaaatgcagaaggctgctttggaattgctgtctctggacctgaagaagaggaaccaagaggtagatctgcagcaagaacagattcaggagctagagaagtgtaggtctgttttagagcatctgcccatggccgtccaggagcgagagcagaagctgactgtgcagagggagcagatcagagagctcgagaaggatcgggagactcagaggaacgtcttggagcatcagcttctagaacttgagaagaaagaccaaatgattgagtcccagagaggacaggttcaggacctgaaaaagcagttggttactctggaatgcctggccctggaactggaggaaaaccatcacaagatggagtgccagcaaaaactgatcaaggagctggagggccagagggaaacccagagagtggctttgacccaccttacgctggacctagaagaaaggagccaggagctgcaggcacaaagcagccagatccatgacctggagagccacagcaccgttctggcaagagagctgcaggagagggaccaggaggtgaagtctcagcgagaacagatcgaggagctgcagaggcagaaagagcatctgactcaggatctcgagaggagagaccaggagctgatgctgcagaaggagaggattcaggttctcgaggatcagaggacccggcagaccaagatcctggaggaggacctggaacagatcaagctgtccttgagagagcgaggccgggagctgaccactcagaggcagctgatgcaggaacgggcagaggaagggaagggcccaagtaaagcacagcgcgggagcctagagcacatgaagctgatcctgcgtgataaggagaaggaggtggaatgtcagcaggagcatatccatgaactccaggagctcaaagaccagctggagcagcagctccagggcctgcacaggaaggtaggtgagaccagcctcctcctgtcccagcgagagcaggaaatagtggtcctgcagcagcaactgcaggaagccagggaacaaggggagctgaaggagcagtcacttcagagtcaactggatgaggcccagagagccctagcccagagggaccaggaactggaggctctgcagcaagaacagcagcaggcccagggacaggaggagagggtgaaggaaaaggcagacgccctccagggagctctggagcaagcccatatgacactgaaggagcgtcatggagagcttcaggaccacaaggaacaggcacgaaggctggaggaagagctggcagtggagggacggcgggtccaggccctggaggaggtgctgggagacctaagggctgagtctcgggaacaggagaaagctctgttggccctccagcagcagtgtgctgagcaggcacaggagcatgaggtggagaccagggccctgcaggacagctggctgcaggcccaggcagtgctcaaggaacgggaccaggagctggaagctctgcgggcagaaagtcagtcctcccggcatcaggaggaggctgcccgggcccgggctgaggctctgcaggaggcccttggcaaggctcatgctgccctgcaggggaaagagcagcatctcctcgagcaggcagaattgagccgcagtctggaggccagcactgcaaccctgcaagcctccctggatgcctgccaggcacacagtcggcagctggaggaggctctgaggatacaagaaggtgagatccaggaccaggatctccgataccaggaggatgtgcagcagctgcagcaggcacttgcccagagggatgaagagctgagacatcagcaggaacgggagcagctgctggagaagtctctggcccagagggtccaagagaatatgatccaagagaagcagaatctggggcaagagagagaagaggaggagataaggggccttcatcagagtagcccaggctgcagcgggagctggagcggctacaggcagccctgagacagacagaagccagggagattgagtggagggagaaggcccaggacttggcactctccctagcgcagaccaaggccagtgtcagcagtctgcaggaggtagccatgttcctacaagcctctgtcctggagcgggactcagaacagcaaaggctgcaggatgaactggagctcaccagacgggctctggagaaggagcggctacacagcccaggtgcaaccagcacagcagaactggggtccagaggggagcagggtgtgcagctgggagaggtctcaggagtggaggctgagcctagtcctgatggaatggagaagcagtcatggagacaaaggcttgaacacctgcagcaagcagtggcccggctggagattgacaggagcaggctgcagcgccacaatgtccagctgcggagtaccttggagcaggtggagcgagaacggaggaagctgaagagggaggccatgcgtgcggcccaggcagggtccctagagatcagcaaggccacggcttcttcacccacacagcaggatgggagaggacagaagaactcagatgccaagtgtgtggctgaactgcagaaagaggtggtcctgctgcaagctcagctgactttggagcggaagcagaagcaggactacatcacccgctcagcacagaccagccgtgagctagcaggcctgcaccacagcctctcacactcacttcttgccgtggcccaggcccctgaggccactgtcctggaggcagagacccgcaggctggatgagtccctgactcaaagtctgacatccccagggccagtcctgctacaccccagccccagcactacccaagccgcctccaggtagcagccacagccaggagcacacagacagaagactgtgtcatgggtcatggcccctccgcacacctacaggtttgccaaaggaaaagcctggctctgttaggcacccaggagccccaggtcggcgggtgttcccaggaagaggaagtaaatctgcaaccctggggaggaccccaactcacctgggaatgaggcaaattgcatttgcttgctccctatggaatcacccagaggggtgccttgccctggctgagggacatgtactgcctctcatctagaatttattttcctagcacttcaccacctccttcatcttctccttcaacaataaaccctgagatctttgcattcat

SEQ ID NO: 356782 - DNA, 7529 bp, Homo sapiens
agcagcggctgccgcagctcaatcgcggagcaactagccgggcgtctgcgggagccgagcgtggtgaggttcacaggtggctgttggtctttagtaagggtgctgtcttccctgtctgatccttagcaaaagtaggaaggtagagttgttggcagaaatcctgggataagagaatagtttcctggaagatctgtgcctccaaccagcagagagggattgagcttcattgaactcaacagagccaacatttcatagcaccatgttcaagaggaggttgaagtggcatggcaatggttagagaccctgctgggcgtgaacaccctctggctacctagggacctgtgggcctaccacctggtgccctcatggagacaagaagccctgggttgaacaacatgaagccccagtcactgcagctggtactggaagagcaggtgctggcactacagcagcagatggcagagaatcaggcagcctcctggcggaagctgaagaactcccaggaggcccagcagagacaagcaacccttgtgaggaagctgcaggccaaggtgctgcagtaccgaagctggtgccaagagctggagaagcggctagaagccactggaggaccaatcccccagaggtgggaaaatgtggaggagccaaacctggatgagctgctggtccgattggaggaggagcaacagaggtgtgagagtctagcagaggtgaacacccagcttcgactgcacatggaaaaagctgacgtggtgaataaagcccttagggaagatgtggaaaaactgacagtggactggagccgggcccgggatgagctaatgaggaaggagagccagtggcagatggagcaggagttcttcaagggctacctgaaaggggagcacggtcgccttctcagtctatggcgggaggttgtgacattccgacgccacttcctggaaatgaagtcagctactgacagagatctgatggagctaaaagctgagcatgtgaggctttcagggtctctgttgacctgttgtctgcgcttgactgtgggagcacagtctcgggaacccaacggatctggaagaatggatgggcgggagccggcccagctgctgctgctactagccaagacccaggagctggagaaggaagcccatgaaaggagccaggagttaatacagctgaagagtcaaggggatctggagaaggctgaacttcaggaccgggtgaccgagctctctgctctgttgacccagtctcagaagcaaaatgaagattatgaaaagatgataaaggctctgagagagacagtggagatcctggagacaaatcacacagaattaatggaacatgaagcatctcttagtaggaatgcgcaagaggagaagttgtctttacagcaggtgatcaaggatataacccaggtcatggtggaagaaggggacaatatagcccaaggctctggtcatgagaactctttggaattggactctagtatcttctcccagtttgattaccaggatgcagacaaggctcttactctggtgcgttcagtgctgactcggagacgccaggctgtgcaggacctaaggcagcagcttgcaggctgtcaagaggctgtgaacttgttgcaacagcagcatgatcagtgggaggaagagggcaaagccttgagacagcggctgcagaagctcactggggagcgggacactctggcagggcagactgtggacctccagggagaggtggactctctcagcaaggagcgagagctgctgcagaaggccagggaagagctgcggcagcagctggaggtgctagagcaggaggcatggcgcctgcgaagggtaaatgtggagcttcagctgcagggggactctgcccagggccagaaggaggaacagcaggaggagctgcacctggctgtccgggagagggagcgtcttcaggagatgctgatgggcctggaagccaaacagtcagaatcactcagtgaactgatcactcttcgggaagccctggagtcaagtcacctggaaggggagttactgaggcaagagcaaacggaagtgaccgcagcgctggctagggcagagcagtcaattgcagagctgtcgagttctgaaaacaccctgaagacagaagtagctgatcttcgggctgcagctgtcaagctcagtgccttaaatgaggctttggcgttagataaagttgggctgaaccagcagcttctccagttagaggaggagaaccagtctgtgtgcagcagaatggaggccgcagagcaggcgagaaatgctttgcaggtcgacctggcggaggcagagaagaggagggaagccctgtgggaaaagaacactcacctggaggctcagctgcagaaagctgaggaggctggggctgagctgcaggcagatctcagggacatccaagaagagaaggaagaaattcaaaagaaactaagtgagtcacgtcaccagcaggaggcagccacgactcagctggagcagctacatcaggaggcaaagcgacaggaagaagtgcttgccagggcagtccaggagaaggaggccctagtacgagagaaagcggctctagaggtgcggctgcaggccgtggagcgtgaccggcaggacctcgctgaacaactacaggggctcagctcagccaaggagctactggagagcagtctgtttgaagcccaacaacaaaattctgtgatagaggtcaccaaggggcagctggaggtccagattcaaactgtcactcaagccaaggaagtaatccaaggggaagtgaggtgcctgaagctggaactggacactgaacggagtcaggcagagcaggagcgggatgctgcagccagacagctggcccaggctgagcaagaagggaagactgccttggagcagcagaaggcagcccatgagaaagaggtgaaccagctccgggagaaatgggagaaggagcgctcctggcaccagcaggagctggcaaaggctctggagagcttagaaagggaaaaaatggagctggaaatgaggctaaaggagcagcagacagaaatggaggccatccaggcccagagggaagaagaacggacccaggcagagagtgccctatgccagatgcagctggaaacagagaaggagagagtatccctcctggagacactgctgcagacgcagaaggagctagcagatgccagccaacaactggaacgactgaggcaggacatgaaagtccagaaattaaaggagcaggagaccactgggatactacagacccagctccaggaggctcaacgggagctgaaggaggcagcccggcagcacagagatgaccttgctgccctccaagaagagagcagctccctgctgcaggataagatggacctgcagaagcaggtggaggacttgaagtctcagctggtggcccaggatgactcccagaggctggtggagcaggaggttcaggagaagctgagagagacccaggagtataaccgaattcagaaggagctggagagagagaaagccagcctgactctgtcactgatggaaaaggaacagagactccttgttttacaagaagctgactctattcgacaacaagagctgagtgccctgcgccaggacatgcaggaggcccagggagaacagaaagagctcagtgctcagatggaattactaaggcaagaggtgaaggaaaaggaggctgactttctggcccaggaagcacagctgctggaggagctggaggcgtctcatatcacggagcagcagctgcgagcctccttgtgggcccaggaagccaaggcagcccaactacagctgcgactgcgcagcacagagagccagctagaagcgctggccgcagagcagcagcccgggaaccaggcccaggcccaggcccagctggccagcctctactctgccctgcagcaggccctggggtctgtttgtgagagcaggcctgagctgagtggtgggggagactctgctccttccgtctggggccttgagccagaccagaatggagctaggagcctctttaagagagggcccctgctgactgctctctccgctgaggcagtagcatctgccctccacaagcttcatcaagacctgtggaagactcaacagacccgggatgttctgagggatcaggtccagaaactggaagagcgtctaactgatactgaggctgagaagagccaggtccacacagagttgcaggatctgcagagacagctctcccagaatcaggaagagaaatccaagtgggaaggaaagcagaactccctagaatctgagctgatggaactacatgaaactatggcatccttacagagtcgcctgcggagagcagagctacagcgaatggaagcccagggtgagcgagagttacttcaggcagccaaggagaacctgacagcccaggtggaacacctgcaagcagctgtcgtagaagccagggctcaggcaagtgctgctggcatcctggaagaagacctgagaacggctcgctcagcactgaagctgaaaaatgaggaagtagagagtgagcgtgagagagcccaggctctgcaagagcagggcgaactgaaggtggcccaagggaaggctctgcaagagaatttggccctcctgacccagaccctagctgaaagagaagaggaggtggagactctgcggggacaaatccaggaactggagaagcaacgggaaatgcagaaggctgctttggaattgctgtctctggacctgaagaagaggaaccaagaggtagatctgcagcaagaacagattcaggagctagagaagtgtaggtctgttttagagcatctgcccatggccgtccaggagcgagagcagaagctgactgtgcagagggagcagatcagagagctcgagaaggatcgggagactcagaggaacgtcttggagcatcagcttctagaacttgagaagaaagaccaaatgattgagtcccagagaggacaggttcaggacctgaaaaagcagttggttactctggaatgcctggccctggaactggaggaaaaccatcacaagatggagtgccagcaaaaactgatcaaggagctggagggccagagggaaacccagagagtggctttgacccaccttacgctggacctagaagaaaggagccaggagctgcaggcacaaagcagccagatccatgacctggagagccacagcaccgttctggcaagagagctgcaggagagggaccaggaggtgaagtctcagcgagaacagatcgaggagctgcagaggcagaaagagcatctgactcaggatctcgagaggagagaccaggagctgatgctgcagaaggagaggattcaggttctcgaggatcagaggacccggcagaccaagatcctggaggaggacctggaacagatcaagctgtccttgagagagcgaggccgggagctgaccactcagaggcagctgatgcaggaacgggcagaggaagggaagggcccaagtaaagcacagcgcgggagcctagagcacatgaagctgatcctgcgtgataaggagaaggaggtggaatgtcagcaggagcatatccatgaactccaggagctcaaagaccagctggagcagcagctccagggcctgcacaggaaggtaggtgagaccagcctcctcctgtcccagcgagagcaggaaatagtggtcctgcagcagcaactgcaggaagccagggaacaaggggagctgaaggagcagtcacttcagagtcaactggatgaggcccagagagccctagcccagagggaccaggaactggaggctctgcagcaagaacagcagcaggcccagggacaggaggagagggtgaaggaaaaggcagacgccctccagggagctctggagcaagcccatatgacactgaaggagcgtcatggagagcttcaggaccacaaggaacaggcacgaaggctggaggaagagctggcagtggagggacggcgggtccaggccctggaggaggtgctgggagacctaagggctgagtctcgggaacaggagaaagctctgttggccctccagcagcagtgtgctgagcaggcacaggagcatgaggtggagaccagggccctgcaggacagctggctgcaggcccaggcagtgctcaaggaacgggaccaggagctggaagctctgcgggcagaaagtcagtcctcccggcatcaggaggaggctgcccgggcccgggctgaggctctgcaggaggcccttggcaaggctcatgctgccctgcaggggaaagagcagcatctcctcgagcaggcagaattgagccgcagtctggaggccagcactgcaaccctgcaagcctccctggatgcctgccaggcacacagtcggcagctggaggaggctctgaggatacaagaaggtgagatccaggaccaggatctccgataccaggaggatgtgcagcagctgcagcaggcacttgcccagagggatgaagagctgagacatcagcaggaacgggagcagctgctggagaagtctctggcccagagggtccaagagaatatgatccaagagaagcagaatctggggcaagagagagaagaggaggagataaggggccttcatcagagtgtaagggagctacagctgactctagcccaaaaggaacaggagattctggagctgagggagacccagcaaaggaacaacctggaagccttaccccacagccacaaaacctccccaatggaggaacaatctctaaaacttgattctttagagcccaggctgcagcgggagctggagcggctacaggcagccctgagacagacagaagccagggagattgagtggagggagaaggcccaggacttggcactctccctagcgcagaccaaggccagtgtcagcagtctgcaggaggtagccatgttcctacaagcctctgtcctggagcgggactcagaacagcaaaggctgcaggatgaactggagctcaccagacgggctctggagaaggagcggctacacagcccaggtgcaaccagcacagcagaactggggtccagaggggagcagggtgtgcagctgggagaggtctcaggagtggaggctgagcctagtcctgatggaatggagaagcagtcatggagacaaaggcttgaacacctgcagcaagcagtggcccggctggagattgacaggagcaggctgcagcgccacaatgtccagctgcggagtaccttggagcaggtggagcgagaacggaggaagctgaagagggaggccatgcgtgcggcccaggcagggtccctagagatcagcaaggccacggcttcttcacccacacagcaggatgggagaggacagaagaactcagatgccaagtgtgtggctgaactgcagaaagaggagtgttcttgaggaccctaattttttttggggggggaaaaaaaagatatattttttccttttttaaaaaaaaaccggggggtaaggggtgggccaaaa

SEQ ID NO: 356783 - DNA, 5908 bp, Homo sapiens
agcagcggctgccgcagctcaatcgcggagcaactagccgggcgtctgcgggagccgagcgtggtgaggttcacaggtggctgttggtctttagtaagggtgctgtcttccctgtctgatccttagcaaaagtaggaaggtagagttgttggcagaaatcctgggataagagaatagtttcctggaagatctgtgcctccaaccagcagagagggattgagcttcattgaactcaacagagccaacatttcatagcaccatgttcaagaggaggttgaagtggcatggcaatggttagagaccctgctgggcgtgaacaccctctggctacctagggacctgtgggcctaccacctggtgccctcatggagacaagaagccctgggttgaacaacatgaagccccagtcactgcagctggtactggaagagcaggtgctggcactacagcagcagatggcagagaatcaggcagcctcctggcggaagctgaagaactcccaggaggcccagcagagacaagcaacccttgtgaggaagctgcaggccaaggtgctgcagtaccgaagctggtgccaagagctggagaagcggctagaagccactggaggaccaatcccccagaggtgggaaaatgtggaggagccaaacctggatgagctgctggtccgattggaggaggagcaacagaggtgtgagagtctagcagaggtgaacacccagcttcgactgcacatggaaaaagctgacgtggtgaataaagcccttagggaagatgtggaaaaactgacagtggactggagccgggcccgggatgagctaatgaggaaggagagccagtggcagatggagcaggagttcttcaagggctacctgaaaggggagcacggtcgccttctcagtctatggcgggaggttgtgacattccgacgccacttcctggaaatgaagtcagctactgacagagatctgatggagctaaaagctgagcatgtgaggctttcagggtctctgttgacctgttgtctgcgcttgactgtgggagcacagtctcgggaacccaacggatctggaagaatggatgggcgggagccggcccagctgctgctgctactagccaagacccaggagctggagaaggaagcccatgaaaggagccaggagttaatacagctgaagagtcaaggggatctggagaaggctgaacttcaggaccgggtgaccgagctctctgctctgttgacccagtctcagaagcaaaatgaagattatgaaaagatgataaaggctctgagagagacagtggagatcctggagacaaatcacacagaattaatggaacatgaagcatctcttagtaggaatgcgcaagaggagaagttgtctttacagcaggtgatcaaggatataacccaggtcatggtggaagaaggggacaatatagcccaaggctctggtcatgagaactctttggaattggactctagtatcttctcccagtttgattaccaggatgcagacaaggctcttactctggtgcgttcagtgctgactcggagacgccaggctgtgcaggacctaaggcagcagcttgcaggctgtcaagaggctgtgaacttgttgcaacagcagcatgatcagtgggaggaagagggcaaagccttgagacagcggctgcagaagctcactggggagcgggacactctggcagggcagactgtggacctccagggagaggtggactctctcagcaaggagcgagagctgctgcagaaggccagggaagagctgcggcagcagctggaggtgctagagcaggaggcatggcgcctgcgaagggtaaatgtggagcttcagctgcagggggactctgcccagggccagaaggaggaacagcaggaggagctgcacctggctgtccgggagagggagcgtcttcaggagatgctgatgggcctggaagccaaacagtcagaatcactcagtgaactgatcactcttcgggaagccctggagtcaagtcacctggaaggggagttactgaggcaagagcaaacggaagtgaccgcagcgctggctagggcagagcagtcaattgcagagctgtcgagttctgaaaacaccctgaagacagaagtagctgatcttcgggctgcagctgtcaagctcagtgccttaaatgaggctttggcgttagataaagttgggctgaaccagcagcttctccagttagaggaggagaaccagtctgtgtgcagcagaatggaggccgcagagcaggcgagaaatgctttgcaggtcgacctggcggaggcagagaagaggagggaagccctgtgggaaaagaacactcacctggaggctcagctgcagaaagctgaggaggctggggctgagctgcaggcagatctcagggacatccaagaagagaaggaagaaattcaaaagaaactaagtgagtcacgtcaccagcaggaggcagccacgactcagctggagcagctacatcaggaggcaaagcgacaggaagaagtgcttgccagggcagtccaggagaaggaggccctagtacgagagaaagcggctctagaggtgcggctgcaggccgtggagcgtgaccggcaggacctcgctgaacaactacaggggctcagctcagccaaggagctactggagagcagtctgtttgaagcccaacaacaaaattctgtgatagaggtcaccaaggggcagctggaggtccagattcaaactgtcactcaagccaaggaagtaatccaaggggaagtgaggtgcctgaagctggaactggacactgaacggagtcaggcagagcaggagcgggatgctgcagccagacagctggcccaggctgagcaagaagggaagactgccttggagcagcagaaggcagcccatgagaaagaggtgaaccagctccgggagaaatgggagaaggagcgctcctggcaccagcaggagctggcaaaggctctggagagcttagaaagggaaaaaatggagctggaaatgaggctaaaggagcagcagacagaaatggaggccatccaggcccagagggaagaagaacggacccaggcagagagtgccctatgccagatgcagctggaaacagagaaggagagagtatccctcctggagacactgctgcagacgcagaaggagctagcagatgccagccaacaactggaacgactgaggcaggacatgaaagtccagaaattaaaggagcaggagaccactgggatactacagacccagctccaggaggctcaacgggagctgaaggaggcagcccggcagcacagagatgaccttgctgccctccaagaagagagcagctccctgctgcaggataagatggacctgcagaagcaggtggaggacttgaagtctcagctggtggcccaggatgactcccagaggctggtggagcaggaggttcaggagaagctgagagagacccaggagtataaccgaattcagaaggagctggagagagagaaagccagcctgactctgtcactgatggaaaaggaacagagactccttgttttacaagaagctgactctattcgacaacaagagctgagtgccctgcgccaggacatgcaggaggcccagggagaacagaaagagctcagtgctcagatggaattactaaggcaagaggtgaaggaaaaggaggctgactttctggcccaggaagcacagctgctggaggagctggaggcgtctcatatcacggagcagcagctgcgagcctccttgtgggcccaggaagccaaggcagcccaactacagctgcgactgcgcagcacagagagccagctagaagcgctggccgcagagcagcagcccgggaaccaggcccaggcccaggcccagctggccagcctctactctgccctgcagcaggccctggggtctgtttgtgagagcaggcctgagctgagtggtgggggagactctgctccttccgtctggggccttgagccagaccagaatggagctaggagcctctttaagagagggcccctgctgactgctctctccgctgaggcagtagcatctgccctccacaagcttcatcaagacctgtggaagactcaacagacccgggatgttctgagggatcaggtccagaaactggaagagcgtctaactgatactgaggctgagaagagccaggtccacacagagttgcaggatctgcagagacagctctcccagaatcaggaagagaaatccaagtgggaaggaaagcagaactccctagaatctgagctgatggaactacatgaaactatggcatccttacagagtcgcctgcggagagcagagctacagcgaatggaagcccagggtgagcgagagttacttcaggcagccaaggagaacctgacagcccaggtggaacacctgcaagcagctgtcgtagaagccagggctcaggcaagtgctgctggcatcctggaagaagacctgagaacggctcgctcagcactgaagctgaaaaatgaggaagtagagagtgagcgtgagagagcccaggctctgcaagagcagggcgaactgaaggtggcccaagggaaggctctgcaagagaatttggccctcctgacccagaccctagctgaaagagaagaggaggtggagactctgcggggacaaatccaggaactggagaagcaacgggaaatgcagaaggctgctttggaattgctgtctctggacctgaagaagaggaaccaagaggtagatctgcagcaagaacagattcaggagctagagaagtgtaggtctgttttagagcatctgcccatggccgtccaggagcgagagcagaagctgactgtgcagagggagcagatcagagagctcgagaaggatcgggagactcagaggaacgtcttggagcatcagcttctagaacttgagaagaaagaccaaatgattgagtcccagagaggacaggttcaggacctgaaaaagcagttggttactctggaatgcctggccctggaactggaggaaaaccatcacaagatggagtgccagcaaaaactgatcaaggagctggagggccagagggaaacccagagagtggctttgacccaccttacgctggacctagaagaaaggagccaggagctgcaggcacaaagcagccagatccatgacctggagagccacagcaccgttctggcaagagagctgcaggagagggaccaggaggtgaagtctcagcgagaacagatcgaggagctgcctccctctggacctattcagtcctcaagggtgccctgctaaaggctgggctgaaagctaagaggagaggtggcattcaatgtgtcctgtgtcctccctggggttgattaaggggtcgatgcccaatagagtccttcatcttggcgttcagcccagggtccagctgccaagggaaggcttggcaatcaagggtgatggagataagaatgaaaaggggcaccaccctgtgccaaagctggcatgttgtatatctgagagaggagctgcctattcacagtgtagggttgtcaagctggaggcagggagagaaaagcaagagctttttggttcctcttgaggatagaatctataggaaaatgtaagagggttaaaaataaatttcccatgcatccaaacttttttctttggtagactttcttgtcatctatttaaaatgaaacaagtgcatgtacgtggttaagacattttagctaggaatgatggtgcgtgcctgtagtcccagctacttgggaggctgaggcaggaggatcgcttgaacctggaaggtcaaggctgcagtgagccgagatcataccactgcactccagcctgagtgataaaagtgagaccctgtctca

SEQ ID NO: 356784 - DNA, 5065 bp, Homo sapiens
agcagcggctgccgcagctcaatcgcggagcaactagccgggcgtctgcgggagccgagcgtggtgaggttcacaggtggctgttggtctttagtaagggtgctgtcttccctgtctgatccttagcaaaagtaggaaggtagagttgttggcagaaatcctgggataagagaatagtttcctggaagatctgtgcctccaaccagcagagagggattgagcttcattgaactcaacagagccaacatttcatagcaccatgttcaagaggaggttgaagtggcatggcaatggttagagaccctgctgggcgtgaacaccctctggctacctagggacctgtgggcctaccacctggtgccctcatggagacaagaagccctgggttgaacaacatgaagccccagtcactgcagctggtactggaagagcaggtgctggcactacagcagcagatggcagagaatcaggcagcctcctggcggaagctgaagaactcccaggaggcccagcagagacaagcaacccttgtgaggaagctgcaggccaaggtgctgcagtaccgaagctggtgccaagagctggagaagcggctagaagccactggaggaccaatcccccagaggtgggaaaatgtggaggagccaaacctggatgagctgctggtccgattggaggaggagcaacagaggtgtgagagtctagcagaggtgaacacccagcttcgactgcacatggaaaaagctgacgtggtgaataaagcccttagggaagatgtggaaaaactgacagtggactggagccgggcccgggatgagctaatgaggaaggagagccagtggcagatggagcaggagttcttcaagggctacctgaaaggggagcacggtcgccttctcagtctatggcgggaggttgtgacattccgacgccacttcctggaaatgaagtcagctactgacagagatctgatggagctaaaagctgagcatgtgaggctttcagggtctctgttgacctgttgtctgcgcttgactgtgggagcacagtctcgggaacccaacggatctggaagaatggatgggcgggagccggcccagctgctgctgctactagccaagacccaggagctggagaaggaagcccatgaaaggagccaggagttaatacagctgaagagtcaaggggatctggagaaggctgaacttcaggaccgggtgaccgagctctctgctctgttgacccagtctcagaagcaaaatgaagattatgaaaagatgataaaggctctgagagagacagtggagatcctggagacaaatcacacagaattaatggaacatgaagcatctcttagtaggaatgcgcaagaggagaagttgtctttacagcaggtgatcaaggatataacccaggtcatggtggaagaaggggacaatatagcccaaggctctggtcatgagaactctttggaattggactctagtatcttctcccagtttgattaccaggatgcagacaaggctcttactctggtgcgttcagtgctgactcggagacgccaggctgtgcaggacctaaggcagcagcttgcaggctgtcaagaggctgtgaacttgttgcaacagcagcatgatcagtgggaggaagagggcaaagccttgagacagcggctgcagaagctcactggggagcgggacactctggcagggcagactgtggacctccagggagaggtggactctctcagcaaggagcgagagctgctgcagaaggccagggaagagctgcggcagcagctggaggtgctagagcaggaggcatggcgcctgcgaagggtaaatgtggagcttcagctgcagggggactctgcccagggccagaaggaggaacagcaggaggagctgcacctggctgtccgggagagggagcgtcttcaggagatgctgatgggcctggaagccaaacagtcagaatcactcagtgaactgatcactcttcgggaagccctggagtcaagtcacctggaaggggagttactgaggcaagagcaaacggaagtgaccgcagcgctggctagggcagagcagtcaattgcagagctgtcgagttctgaaaacaccctgaagacagaagtagctgatcttcgggctgcagctgtcaagctcagtgccttaaatgaggctttggcgttagataaagttgggctgaaccagcagcttctccagttagaggaggagaaccagtctgtgtgcagcagaatggaggccgcagagcaggcgagaaatgctttgcaggtcgacctggcggaggcagagaagaggagggaagccctgtgggaaaagaacactcacctggaggctcagctgcagaaagctgaggaggctggggctgagctgcaggcagatctcagggacatccaagaagagaaggaagaaattcaaaagaaactaagtgagtcacgtcaccagcaggaggcagccacgactcagctggagcagctacatcaggaggcaaagcgacaggaagaagtgcttgccagggcagtccaggagaaggaggccctagtacgagagaaagcggctctagaggtgcggctgcaggccgtggagcgtgaccggcaggacctcgctgaacaactacaggggctcagctcagccaaggagctactggagagcagtctgtttgaagcccaacaacaaaattctgtgatagaggtcaccaaggggcagctggaggtccagattcaaactgtcactcaagccaaggaagtaatccaaggggaagtgaggtgcctgaagctggaactggacactgaacggagtcaggcagagcaggagcgggatgctgcagccagacagctggcccaggctgagcaagaagggaagactgccttggagcagcagaaggcagcccatgagaaagaggtgaaccagctccgggagaaatgggagaaggagcgctcctggcaccagcaggagctggcaaaggctctggagagcttagaaagggaaaaaatggagctggaaatgaggctaaaggagcagcagacagaaatggaggccatccaggcccagagggaagaagaacggacccaggcagagagtgccctatgccagatgcagctggaaacagagaaggagagagtatccctcctggagacactgctgcagacgcagaaggagctagcagatgccagccaacaactggaacgactgaggcaggacatgaaagtccagaaattaaaggagcaggagaccactgggatactacagacccagctccaggaggctcaacgggagctgaaggaggcagcccggcagcacagagatgaccttgctgccctccaagaagagagcagctccctgctgcaggataagatggacctgcagaagcaggtggaggacttgaagtctcagctggtggcccaggatgactcccagaggctggtggagcaggaggttcaggagaagctgagagagacccaggagtataaccgaattcagaaggagctggagagagagaaagccagcctgactctgtcactgatggaaaaggaacagagactccttgttttacaagaagctgactctattcgacaacaagagctgagtgccctgcgccaggacatgcaggaggcccagggagaacagaaagagctcagtgctcagatggaattactaaggcaagaggtgaaggaaaaggaggctgactttctggcccaggaagcacagctgctggaggagctggaggcgtctcatatcacggagcagcagctgcgagcctccttgtgggcccaggaagccaaggcagcccaactacagctgcgactgcgcagcacagagagccagctagaagcgctggccgcagagcagcagcccgggaaccaggcccaggcccaggcccagctggccagcctctactctgccctgcagcaggccctggggtctgtttgtgagagcaggcctgagctgagtggtgggggagactctgctccttccgtctggggccttgagccagaccagaatggagctaggagcctctttaagagagggcccctgctgactgctctctccgctgaggcagtagcatctgccctccacaagcttcatcaagacctgtggaagactcaacagacccgggatgttctgagggatcaggtccagaaactggaagagcgtctaactgatactgaggctgagaagagccaggtccacacagagttgcaggatctgcagagacagctctcccagaatcaggaagagaaatccaagtgggaaggaaagcagaactccctagaatctgagctgatggaactacatgaaactatggcatccttacagagtcgcctgcggagagcagagctacagcgaatggaagcccagggtgagcgagagttacttcaggcagccaaggagaacctgacagcccaggtggaacacctgcaagcagctgtcgtagaagccagggctcaggcaagtgctgctggcatcctggaagaagacctgagaacggctcgctcagcactgaagctgaaaaatgaggaagtagagagtgagcgtgagagagcccaggctctgcaagagcagggcgaactgaaggtggcccaagggaaggctctgcaagagaatttggccctcctgacccagaccctagctgaaagagaagaggaggtggagactctgcggggacaaatccaggaactggagaagcaacgggaaatgcagaaggctgctttggaattgctgtctctggacctgaagaagaggaaccaagaggtagatctgcagcaagaacagattcaggagctagagaagtgtaggtctgttttagagcatctgcccatggccgtccaggagcgagagcagaagctgactgtgcagagggagcagatcagagagctcgagaaggatcgggagactcagaggaacgtcttggagcatcagcttctagaacttgaggaagctaggagacctgagcaagccaggagacctgagcaagccaggagacctgagcaagccaggagacctgagcaagccaggagacctgagcaagcggaactgag

SEQ ID NO: 356785 - DNA, 1456 bp, Homo sapiens
agcagcggctgccgcagctcaatcgcggagcaactagccgggcgtctgcgggagccgagcgtggtgaggttcacaggtggctgttggtctttagtaagggtgctgtcttccctgtctgatccttagcaaaagtaggaaggtagagttgttggcagaaatcctgggataagagaatagtttcctggaagatctgtgcctccaaccagcagagagggattgagcttcattgaactcaacagagccaacatttcatagcaccatgttcaagaggaggttgaagtggcatggcaatggttagagaccctgctgggcgtgaacaccctctggctacctagggacctgtgggcctaccacctggtgccctcatggagacaagaagccctgggttgaacaacatgaagccccagtcactgcagctggtactggaagagcaggtgctggcactacagcagcagatggcagagaatcaggcagcctcctggcggaagctgaagaactcccaggaggcccagcagagacaagcaacccttgtgaggaagctgcaggccaaggtgctgcagtaccgaagctggtgccaagagctggagaagcggctagaagccactggaggaccaatcccccagaggtgggaaaatgtggaggagccaaacctggatgagctgctggtccgattggaggaggagcaacagaggtgtgagagtctagcagaggtgaacacccagcttcgactgcacatggaaaaagctgacgtggtgaataaagcccttagggaagatgtggaaaaactgacagtggactggagccgggcccgggatgagctaatgaggaaggagagccagtggcagatggagcaggagttcttcaagggctacctgaaaggggagcacggtcgccttctcagtctatggcgggaggttgtgacattccgacgccacttcctggaaatgaagtcagctactgacagagatctgatggagctaaaagctgagcatgtgaggctttcagggtctctgttgacctgttgtctgcgcttgactgtgggagcacagtctcgggaacccaacggatctggaagaatggatgggcgggagccggcccagctgctgctgctactagccaagacccaggagctggagaaggaagcccatgaaaggagccaggagttaatacagctgaagagtcaaggggatctggagaaggctgaacttcaggaccgggtgaccgagctctctgctctgttgacccagtctcagaagcaaaatgaagattatgaaaagatgataaaggctctgagagagacagtggagatcctggtacatgatcctttgctctggaaaggagttgggcgtgggcttgtaggttccttgtgctttatggacagatagtgcaggataccagttacatattccatgatgaaatcctctaaagctaaaaaataaattttggctgaatctga

SEQ ID NO: 356786 - DNA, 452 bp, Homo sapiens
gacgaaatctggaagccacctggctttccctcttccatttcctgcctgactctatggtcttaactacaaatccatgaatacgtaaaagaactgcggaataggaggaagcctttgcagttacttcccttgcccttcatttccagctgaggaacatgaagcctacagagaggtgactccccaagctgctgtcacccaatgccagttctgtcaccactacactgtggcttcttcagctctaacagtgatagcattggtaatatctttttggaaagacaattcaaagaatatgggaggaaaaaaatgatggtgagtatgagagtttacagaaagagaagttttggactagaagattaagcagtggcttcttagaagagaaagaacttgagtagggccagaagtgttctgcctttgaagaggaatacggttcaacttttcatcaaagcccatgagat

SEQ ID NO: 356787 - DNA, 340 bp, Homo sapiens
gccacaataagggacatgaattttactccaacataatactcaacagcaagaattgacacattatttttctaaatcaagttatatccaactccaagatttcacttaccagttggcaaggaattaaatcttagttattagtgaggctgtctccctaagctacaagattggtcaaaggtcccaggggtcttatgcaatatggaacgcttggggaggccccgctaaaccaccctggctgatgctaagatgtcaacaaccgtggactagatgggcctctgaaacccagtgaccctgttgcttccatttcaaaattggacacaaaacaataaaaatgataatgata

SEQ ID NO: 356788 - DNA, 290 bp, Homo sapiens
ttgagggaccgtggggggtggcaccagagcccagggcacctgagggcctctctggatgcagctgctagcggtcataggacagcaaacactattcattggattctgacttaggcaggcaccctgccgagtgccttaaaggtgtaatctccgttactcttcacagtacattaaaaaaatagttggccgggtgcagtggctcatgcctgtaatcccagcactttgggaggcaaaggcaggcagatcacgaggtcagtagatcgagaccatcctggccaacatggtgaaatccc

SEQ ID NO: 356789 - DNA, 563 bp, Homo sapiens
gtttcctgctggctgagcgattcctgccaagagcttcaaagaagagggattattttatgcagttatggggtcacttctcccattgctgtctttgggaggcctggtaggttaaggaacagaagacattttgagagacgcttggtgccaatgaagtggctgaagaaatgtctggatacaggttttccaatttaccatttgtgtctggggatagtgggaggcagtcccatctatggcttggggaggctgtagccattcctcctctttcccttctaagagtgagaaacccatccatggccttctctagtcaatacagtggcctggtatgaattagacaaaggaatcccctttgggaggatacagccctatgccaggatgtatggcatggtgagcagaatgcaggctttcacttgcttctttggctaggtgtctttgtgcagcccccaaacacacaatgaacagtgactctgaatctgtcactttattttatatatatacatttttaaattttttatttgatttaatttattttttttgacagagtgagactttgtctcaaaaaaaaa

SEQ ID NO: 356790 - DNA, 721 bp, Homo sapiens
  misc_feature (721)..(721): n is a, c, g, or t
tgatctaaggccaccctctcggggagggagttggggaagctgggttggctgggttggtagctcctacctactgtgtggcaagaaggtatgggtcatgaacagaaccaaggagctgcgctgctacagatgttaccacttctgtggctgctaccccactcctgggccgtccctgaagctcctactccaatgtggccagatgacctgcaaaaccacacattcctgcacacagtgtactgccaggatgggagtcccagtgtgggactctctgaggcctacgacgaggaccagctttcctttttgccctttttcccgaacctatttcccagaaacaactttccgggggggttagccttcgcactgggccccggaaaatttttgtgggccctttggggaacctttgggggggcttccaaggggagaaccaaagggggaaacggaaatggctttccccatgggcaccattttgattttgaacaagagagttactggcgaagtgggattgaatccatgcaagatagggagggcagaacagaactgtgaacttcgggggacaacacaacttcgcctccggaggcttgtgttccgcccaaatggggaaaaaaggcgagggggagtttatttatacccccactttaaattttccggggactttggaacacaggtgtggtttatgccaaaccgcgggcccttggggaaaaaaggggcacccacccaccttttn

SEQ ID NO: 356791 - DNA, 1752 bp, Homo sapiens
tgatctaaggccaccctctcggggagggagttggggaagctgggttggctgggttggtagctcctacctactgtgtggcaagaaggtatgggtcatgaacagaaccaaggagctgcgctgctacagatgttaccacttctgtggctgctaccccactcctgggccgtccctgaagctcctactccaatgtggccagatgacctgcaaaaccacacattcctgcacacagtgtactgccaggatgggagtcccagtgtgggactctctgaggcctacgacgaggaccagcttttcttcttcgacttttcccagaacactcgggtgcctcgcctgcccgaatttgctgactgggctcaggaacagggagatgctcctgccattttatttgacaaagagttctgcgagtggatgatccagcaaatagggccaaaacttgatgggaaaatcccggtgtccagaggtcaggagttttctggggagtgaagggaggagggctgcattaacctcattgatctgtacactgaataattccccttgataccagctccccatctcaaatactttctggttctcttcatcaccttaatttttccaccagccttggtctgcaccctgtgttcttttggtgggccgaagtacctagcatgtagtaggcattcagaactatgtattgaatgtgatgaattcaacaggtaccaactgatacctactgaatattaacacttgtgctactatgcccagcaagatggatgggaagagtggaaatatctgatgacgtgactatgtcttagtgagaagacagtgcatggttagacatcaatgtgagctctagacaggaagtgctgaaggaagtcatggtggaggggtccagagtagcctggatctggctctgcttctacgtctagctgcagtccttgcctggaagaagacctcccttcagagcccagctcctcgctcatctctgtctcccaaagcctgacccactgtgttcttctctgccctcccctccatatgccatggcccctccaaacacagagataccatctaaactagtctctttttccccctacacttcaatccccccaccaggtttcctatcgctgaagtgttcacgctgaagcccctggagtttggcaagcccaacactttggtctgtttgtcagtaatctcttcccacccatgctgacagtgaactggcagcatcattccgtccctgtggaaggatttgggcctacttttgtctcagctgtcgatggactcagcttccaggccttttcttacttaaacttcacaccagaaccttctgacattttctcctgcattgtgactcacgaaattgaccgctacacagcaattgcctattgggtaccccggaacgcactgccctcagatctgctggagaatgtgctgtgtggcgtggcctttggcctgggtgtgctgggcatcatcgtgggcattgttctcatcatctacttccggaagccttgctcaggtgactgattcttccagaccagagtttgatgccagcagcttcggccatccaaacagaggatgctcagatttctcacatcctgcccaggatctcctcttagggtagaagaagtctctgggacatccctggggtgtgtgtgtagatttcccacctggggactctgctgtccctgggcttgcatcccagggatcccagagtggcctgcctatcacaaccacatcccttccccccacaaggcaataaatctcatttctttatat

SEQ ID NO: 356792 - DNA, 1391 bp, Homo sapiens
  misc_feature (1233)..(1233): n is a, c, g, or t
tgatctaaggccaccctctcggggagggagttggggaagctgggttggctgggttggtagctcctacctactgtgtggcaagaaggtatgggtcatgaacagaaccaaggagctgcgctgctacagatgttaccacttctgtggctgctaccccactcctgggccgtccctgaagctcctactccaatgtggccagatgacctgcaaaaccacacattcctgcacacagtgtactgccaggatgggagtcccagtgtgggactctctgaggcctacgacgaggaccagcttttcttcttcgacttttcccagaacactcgggtgcctcgcctgcccgaatttgctgactgggctcaggaacagggagatgctcctgccattttatttgacaaagagttctgcgagtggatgatccagcaaatagggccaaaacttgatgggaaaatcccggtgtccagagggtttcctatcgctgaagtgttcacgctgaagcccctggagtttggcaagcccaacactttggtctgtttgtcagtaatctcttcccacccatgctgacagtgaactggcagcatcattccgtccctgtggaaggatttgggcctacttttgtctcagctgtcgatggactcagcttccaggccttttcttacttaaacttcacaccagaaccttctgacattttctcctgcattgtgactcacgaaattgaccgctacacagcaattgcctattgggtaccccggaacgcactgccctcagatctgctggagaatgtgctgtgtggcgtggcctttggcctgggtgtgctgggcatcatcgtgggcattgttctcatcatctacttccggaagccttgctcaggtgactgattcttccagaccagagtttgatgccagcagcttcggccatccaaacagaggatgctcagatttctcacatcctgcccaggatctcctcttagggtagaagaagtctctgggacatccctggggtgtgtgtgtagatttcccacctggggactctgctgtccctgggcttgcatcccagggatcccagagtggcctgcctatcacaaccacatcccttccccccacaaggcaataaatctcatttctttatataagaaataaccaagatggccaacaggctttttctttcttacttcttcttagcaataacagtcaataaacggctggcaaaaaagttactaatttaaatttgcacggtgtncaaagaacctcatccctctaagaagctcccgaatatgccaatagatccggccactacggacaggagggcagagtaccaaggactctatttatataagagactacaagggaagtggaagtaatatgtgggtggtaaaatcccggtgcaggtggtgagcg

SEQ ID NO: 356793 - DNA, 1280 bp, Homo sapiens
tgatctaaggccaccctctcggggagggagttggggaagctgggttggctgggttggtagctcctacctactgtgtggcaagaaggtatgggtcatgaacagaaccaaggagctgcgctgctacagatgttaccacttctgtggctgctaccccactcctgggccgtccctgaagctcctactccaatgtggccagatgacctgcaaaaccacacattcctgcacacagtgtactgccaggatgggagtcccagtgtgggactctctgaggcctacgacgaggaccagcttttcttcttcgacttttcccagaacactcgggtgcctcgcctgcccgaatttgctgactgggctcaggaacagggagatgctcctgccattttatttgacaaagagttctgcgagtggatgatccagcaaatagggccaaaacttgatgggaaaatcccggtgtccagaggtcaggagttttctggggagtgaagggaggagggctgcattaacctcattgatctgtacactgaataattcccctccatatgccatggcccctccaaacacagagataccatctaaactagtctctttttccccctacacttcaatccccccaccaggtttcctatcgctgaagtgttcacgctgaagcccctggagtttggcaagcccaacactttggtctgtttgtcagtaatctcttcccacccatgctgacagtgaactggcagcatcattccgtccctgtggaaggatttgggcctacttttgtctcagctgtcgatggactcagcttccaggccttttcttacttaaacttcacaccagaaccttctgacattttctcctgcattgtgactcacgaaattgaccgctacacagcaattgcctattgggtaccccggaacgcactgccctcagatctgctggagaatgtgctgtgtggcgtggcctttggcctgggtgtgctgggcatcatcgtgggcattgttctcatcatctacttccggaagccttgctcaggtgactgattcttccagaccagagtttgatgccagcagcttcggccatccaaacagaggatgctcagatttctcacatcctgcccaggatctcctcttagggtagaagaagtctctgggacatccctggggtgtgtgtgtagatttcccacctggggactctgctgtccctgggcttgcatcccagggatcccagagtggcctgcctatcacaaccacatcccttccccccacaaggcaataaatctcatttctttatat

SEQ ID NO: 356794 - DNA, 1665 bp, Homo sapiens
agccactgcgcctagccccaccttgctgttttttaagttggaggagaaggctcccacctccctgaacctcaccctgtgtcctttgcagctcctactccaatgtggccagatgacctgcaaaaccacacattcctgcacacagtgtactgccaggatgggagtcccagtgtgggactctctgaggcctacgacgaggaccagcttttcttcttcgacttttcccagaacactcgggtgcctcgcctgcccgaatttgctgactgggctcaggaacagggagatgctcctgccattttatttgacaaagagttctgcgagtggatgatccagcaaatagggccaaaacttgatgggaaaatcccggtgtccagaggtcaggagttttctggggagtgaagggaggagggctgcattaacctcattgatctgtacactgaataattccccttgataccagctccccatctcaaatactttctggttctcttcatcaccttaatttttccaccagccttggtctgcaccctgtgttcttttggtgggccgaagtacctagcatgtagtaggcattcagaactatgtattgaatgtgatgaattcaacaggtaccaactgatacctactgaatattaacacttgtgctactatgcccagcaagatggatgggaagagtggaaatatctgatgacgtgactatgtcttagtgagaagacagtgcatggttagacatcaatgtgagctctagacaggaagtgctgaaggaagtcatggtggaggggtccagagtagcctggatctggctctgcttctacgtctagctgcagtccttgcctggaagaagacctcccttcagagcccagctcctcgctcatctctgtctcccaaagcctgacccactgtgttcttctctgccctcccctccatatgccatggcccctccaaacacagagataccatctaaactagtctctttttccccctacacttcaatccccccaccaggtttcctatcgctgaagtgttcacgctgaagcccctggagtttggcaagcccaacactttggtctgtttgtcagtaatctcttcccacccatgctgacagtgaactggcagcatcattccgtccctgtggaaggatttgggcctacttttgtctcagctgtcgatggactcagcttccaggccttttcttacttaaacttcacaccagaaccttctgacattttctcctgcattgtgactcacgaaattgaccgctacacagcaattgcctattgggtaccccggaacgcactgccctcagatctgctggagaatgtgctgtgtggcgtggcctttggcctgggtgtgctgggcatcatcgtgggcattgttctcatcatctacttccggaagccttgctcaggtgactgattcttccagaccagagtttgatgccagcagcttcggccatccaaacagaggatgctcagatttctcacatcctgcccaggatctcctcttagggtagaagaagtctctgggacatccctggggtgtgtgtgtagatttcccacctggggactctgctgtccctgggcttgcatcccagggatcccagagtggcctgcctatcacaaccacatcccttccccccacaaggcaataaatctcatttctttatat

SEQ ID NO: 356795 - DNA, 1070 bp, Homo sapiens
tgatctaaggccaccctctcggggagggagttggggaagctgggttggctgggttggtagctcctacctactgtgtggcaagaaggtatgggtcatgaacagaaccaaggagctgcgctgctacagatgttaccacttctgtggctgctaccccactcctgggccgtccctgaagctcctactccaatgtggccagatgacctgcaaaaccacacattcctgcacacagtgtactgccaggatgggagtcccagtgtgggactctctgaggcctacgacgaggaccagcttttcttcttcgacttttcccagaacactcgggtgcctcgcctgcccgaatttgctgactgggctcaggaacagggagatgctcctgccattttatttgacaaagagttctgcgagtggatgatccagcaaatagggccaaaacttgatgggctggagtttggcaagcccaacactttggtctgtttgtcagtaatctcttcccacccatgctgacagtgaactggcagcatcattccgtccctgtggaaggatttgggcctacttttgtctcagctgtcgatggactcagcttccaggccttttcttacttaaacttcacaccagaaccttctgacattttctcctgcattgtgactcacgaaattgaccgctacacagcaattgcctattgggtaccccggaacgcactgccctcagatctgctggagaatgtgctgtgtggcgtggcctttggcctgggtgtgctgggcatcatcgtgggcattgttctcatcatctacttccggaagccttgctcaggtgactgattcttccagaccagagtttgatgccagcagcttcggccatccaaacagaggatgctcagatttctcacatcctgcccaggatctcctcttagggtagaagaagtctctgggacatccctggggtgtgtgtgtagatttcccacctggggactctgctgtccctgggcttgcatcccagggatcccagagtggcctgcctatcacaaccacatcccttccccccacaaggcaataaatctcatttctttatat

SEQ ID NO: 356796 - DNA, 1128 bp, Homo sapiens
  misc_feature (92)..(92): n is a, c, g, or t
agagacttatctaggtactcgattcgtattggtcgcgcgggagtcgcagtagaggtaaagtggaagcatgggtcagtatgctcgattggccntacgagatgacttccgtggtcagttgactacgatgctctggattctcaccagtaaaacaatcagcccgagaggtaaaccagaagtcgtattctgacacaaatttccacgattgcggatggttctagagggtgctattactggagtctagtcaatcaggagtccgaagcgtagtctcgatatctaaattagcggccccgaggctttcttcttcgacttttcccagaacactcgggtgcctcgcctgcccgaatttgctgactgggctcaggaacagggagatgctcctgccattttatttgacaaagagttctgcgagtggatgatccagcaaatagggccaaaacttgatgggaaaatcccggtgtccagagggtttcctatcgctgaagtgttcacgctgaagcccctggagtttggcaagcccaacactttggtctgtttgtcagtaatctcttcccacccatgctgacagtgaactggcagcatcattccgtccctgtggaaggatttgggcctacttttgtctcagctgtcgatggactcagcttccaggccttttcttacttaaacttcacaccagaaccttctgacattttctcctgcattgtgactcacgaaattgaccgctacacagcaattgcctattgggtaccccggaacgcactgccctcagatctgctggagaatgtgctgtgtggcgtggcctttggcctgggtgtgctgggcatcatcgtgggcattgttctcatcatctacttccggaagccttgctcaggtgactgattcttccagaccagagtttgatgccagcagcttcggccatccaaacagaggatgctcagatttctcacatcctgcccaggatctcctcttagggtagaagaagtctctgggacatccctggggtgtgtgtgtagatttcccacctggggactctgctgtccctgggcttgcatcccagggatcccagagtggcctgcctatcacaaccacatcccttccccccacaaggcaataaatctcatttctttatat

SEQ ID NO: 356797 - DNA, 960 bp, Homo sapiens
cgcgccgggtgctgacctcctgcctcagcgccccctcccccactacccgcggctagcggggtagcctcgggtggccaggcttgtttcctcctcggtgggtgtaaggtgcggcttcgctggtcctggcctgaatccagcggaagcgcacgctgctgagctgtcagcggaggaaaatggggcctggacctggagatatgagggtctggagagaggggccccttccctggtgtcgtgtggtgcgaccactggagagggagtttctcgccctcgtcgcgcctgccgcgcggagagataagggtttcctatcgctgaagtgttcacgctgaagcccctggagtttggcaagcccaacactttggtctgtttgtcagtaatctcttcccacccatgctgacagtgaactggcagcatcattccgtccctgtggaaggatttgggcctacttttgtctcagctgtcgatggactcagcttccaggccttttcttacttaaacttcacaccagaaccttctgacattttctcctgcattgtgactcacgaaattgaccgctacacagcaattgcctattgggtaccccggaacgcactgccctcagatctgctggagaatgtgctgtgtggcgtggcctttggcctgggtgtgctgggcatcatcgtgggcattgttctcatcatctacttccggaagccttgctcaggtgactgattcttccagaccagagtttgatgccagcagcttcggccatccaaacagaggatgctcagatttctcacatcctgcccaggatctcctcttagggtagaagaagtctctgggacatccctggggtgtgtgtgtagatttcccacctggggactctgctgtccctgggcttgcatcccagggatcccagagtggcctgcctatcacaaccacatcccttccccccacaaggcaataaatctcatttctttatat

SEQ ID NO: 356798 - DNA, 793 bp, Homo sapiens
tgatctaaggccaccctctcggggagggagttggggaagctgggttggctgggttggtagctcctacctactgtgtggcaagaaggtatgggtcatgaacagaaccaaggagctgcgctgctacagatgttaccacttctgtggctgctaccccactcctgggccgtccctgaagctcctactccaatgtggccagatgacctgcaaaaccacacattcctgcacacagttgaactggcagcatcattccgtccctgtggaaggatttgggcctacttttgtctcagctgtcgatggactcagcttccaggccttttcttacttaaacttcacaccagaaccttctgacattttctcctgcattgtgactcacgaaattgaccgctacacagcaattgcctattgggtaccccggaacgcactgccctcagatctgctggagaatgtgctgtgtggcgtggcctttggcctgggtgtgctgggcatcatcgtgggcattgttctcatcatctacttccggaagccttgctcaggtgactgattcttccagaccagagtttgatgccagcagcttcggccatccaaacagaggatgctcagatttctcacatcctgcccaggatctcctcttagggtagaagaagtctctgggacatccctggggtgtgtgtgtagatttcccacctggggactctgctgtccctgggcttgcatcccagggatcccagagtggcctgcctatcacaaccacatcccttccccccacaaggcaataaatctcatttctttatat

SEQ ID NO: 356799 - DNA, 815 bp, Homo sapiens
tgatctaaggccaccctctcggggagggagttggggaagctgggttggctgggttggtagctcctacctactgtgtggcaagaaggtatgggtcatgaacagaaccaaggagctgcgctgctacagatgttaccacttctgtggctgctaccccactcctgggccgtccctgaagctcctactccaatgtggccagatgacctgcaaaaccacacattcctgcacacagtgtactgccaggatgggagtcccagtgtgggactctctgaggcctacgacgaggaccagcttttcttcttcgacttttcccagaacactcgggtgcctcgcctgcccgaatttgctgactgggctcaggaacagggagatgctcctgccattttatttgacaaagagttctgcgagtggatgatccagcaaatagggccaaaacttgatgggaaaatcccggtgtccagagggtttcctatcgctgaagtgttcacgctgaagcccctggagtttggcaagcccaacactttggtctgtttgtcagtaatctcttcccacccatgctgacagtgaactggcagcatcattccgtccctgtggaaggatttgggcctacttttgtctcagctgtcgatggactcagcttccaggccttttcttacttaaacttcacaccagaaccttctgacattttctcctgcattgtgactcacgaaattgaccgctacacagcaattgcctattgggtaaccccggaacgcaccggccctcattccggtttattcaaatgggggttacccgaagctcgaattccgtatccatgg

SEQ ID NO: 356800 - DNA, 467 bp, Homo sapiens
  misc_feature (18)..(18): n is a, c, g, or t
ttagtgtgaggtgcctanaggatccgatcacgtgcattgtgactcacgaaattgaccgctacacagcaattgcctattgggtaccccggaacgcactgccctcagatctgctggagaatgtgctgtgtggcgtggcctttggcctgggtgtgctgggcatcatcgtgggcattgttctcatcatctacttccggaagccttgctcaggtgactgattcttccagaccagagtttgatgccagcagcttcggccatccaaacagaggatgctcagatttctcacatcctgcccaggatctcctcttagggtagaagaagtctctgggacatccctggggtgtgtgtgtagatttcccacctggggactctgctgtccctgggcttgcatcccagggatcccagagtggcctgcctatcacaaccacatcccttccccccacaaggcaataaatctcatttctttatat

SEQ ID NO: 356801 - DNA, 259 bp, Homo sapiens
tgatctaaggccaccctctcggggagggagttggggaagctgggttggctgggttggtagctcctacctactgtgtggcaagaaggtatgggtcatgaacagaaccaaggagctgcgctgctacagatgttaccacttctgtggctgctaccccactcctgggccgtccctgaagctcctactccaatgtggccagatgacctgcaaaaccacacattcctgcacacagtgcgaaggggatcctcatagagtcggccag

SEQ ID NO: 356802 - DNA, 1124 bp, Homo sapiens
tgatctaaggccaccctctcggggagggagttggggaagctgggttggctgggttggtagctcctacctactgtgtggcaagaaggtatgggtcatgaacagaaccaaggagctgcgctgctacagatgttaccacttctgtggctgctaccccactcctgggccgtccctgaagctcctactccaatgtggccagatgacctgcaaaaccacacattcctgcacacagtgtactgccaggatgggagtcccagtgtgggactctctgaggcctacgacgaggaccagcttttcttcttcgacttttcccagaacactcgggtgcctcgcctgcccgaatttgctgactgggctcaggaacagggagatgctcctgccattttatttgacaaagagttctgcgagtggatgatccagcaaatagggccaaaacttgatgggaaaatcccggtgtccagagggtttcctatcgctgaagtgttcacgctgaagcccctggagtttggcaagcccaacactttggtctgtttgtcagtaatctcttcccacccatgctgacagtgaactggcagcatcattccgtccctgtggaaggatttgggcctacttttgtctcagctgtcgatggactcagcttccaggccttttcttacttaaacttcacaccagaaccttctgacattttctcctgcattgtgactcacgaaattgaccgctacacagcaattgcctattgggtaccccggaacgcactgccctcagatctgctggagaatgtgctgtgtggcgtggcctttggcctgggtgtgctgggcatcatcgtgggcattgttctcatcatctacttccggaagccttgctcaggtgactgattcttccagaccagagtttgatgccagcagcttcggccatccaaacagaggatgctcagatttctcacatcctgcccaggatctcctcttagggtagaagaagtctctgggacatccctggggtgtgtgtgtagatttcccacctggggactctgctgtccctgggcttgcatcccagggatcccagagtggcctgcctatcacaaccacatcccttccccccacaaggcaataaatctcatttctttatat

SEQ ID NO: 356803 - DNA, 1699 bp, Homo sapiens
tgatctaaggccaccctctcggggagggagttggggaagctgggttggctgggttggtagctcctacctactgtgtggcaagaaggtatgggtcatgaacagaaccaaggagctgcgctgctacagatgttaccacttctgtggctgctaccccactcctgggccgtccctgaagctcctactccaatgtggccagatgactgtgggactctctgaggcctacgacgaggaccagcttttcttcttcgacttttcccagaacactcgggtgcctcgcctgcccgaatttgctgactgggctcaggaacagggagatgctcctgccattttatttgacaaagagttctgcgagtggatgatccagcaaatagggccaaaacttgatgggaaaatcccggtgtccagaggtcaggagttttctggggagtgaagggaggagggctgcattaacctcattgatctgtacactgaataattccccttgataccagctccccatctcaaatactttctggttctcttcatcaccttaatttttccaccagccttggtctgcaccctgtgttcttttggtgggccgaagtacctagcatgtagtaggcattcagaactatgtattgaatgtgatgaattcaacaggtaccaactgatacctactgaatattaacacttgtgctactatgcccagcaagatggatgggaagagtggaaatatctgatgacgtgactatgtcttagtgagaagacagtgcatggttagacatcaatgtgagctctagacaggaagtgctgaaggaagtcatggtggaggggtccagagtagcctggatctggctctgcttctacgtctagctgcagtccttgcctggaagaagacctcccttcagagcccagctcctcgctcatctctgtctcccaaagcctgacccactgtgttcttctctgccctcccctccatatgccatggcccctccaaacacagagataccatctaaactagtctctttttccccctacacttcaatccccccaccaggtttcctatcgctgaagtgttcacgctgaagcccctggagtttggcaagcccaacactttggtctgtttgtcagtaatctcttcccacccatgctgacagtgaactggcagcatcattccgtccctgtggaaggatttgggcctacttttgtctcagctgtcgatggactcagcttccaggccttttcttacttaaacttcacaccagaaccttctgacattttctcctgcattgtgactcacgaaattgaccgctacacagcaattgcctattgggtaccccggaacgcactgccctcagatctgctggagaatgtgctgtgtggcgtggcctttggcctgggtgtgctgggcatcatcgtgggcattgttctcatcatctacttccggaagccttgctcaggtgactgattcttccagaccagagtttgatgccagcagcttcggccatccaaacagaggatgctcagatttctcacatcctgcccaggatctcctcttagggtagaagaagtctctgggacatccctggggtgtgtgtgtagatttcccacctggggactctgctgtccctgggcttgcatcccagggatcccagagtggcctgcctatcacaaccacatcccttccccccacaaggcaataaatctcatttctttatat

SEQ ID NO: 356804 - DNA, 1127 bp, Homo sapiens
gtttcctgctggctgagcgattcctgccaagagcttcaaagaagagggattattttatgcagttatggggtcacttctcccattgctgtctttgggaggcctggtaggttaaggaacagaagacattttgagagacgcttggtgccaatgaagtggctgaagaaatgtctggatacagctcctactccaatgtggccagatgacctgcaaaaccacacattcctgcacacagtgtactgccaggatgggagtcccagtgtgggactctctgaggcctacgacgaggaccagcttttcttcttcgacttttcccagaacactcgggtgcctcgcctgcccgaatttgctgactgggctcaggaacagggagatgctcctgccattttatttgacaaagagttctgcgagtggatgatccagcaaatagggccaaaacttgatgggaaaatcccggtgtccagagggtttcctatcgctgaagtgttcacgctgaagcccctggagtttggcaagcccaacactttggtctgtttgtcagtaatctcttcccacccatgctgacagtgaactggcagcatcattccgtccctgtggaaggatttgggcctacttttgtctcagctgtcgatggactcagcttccaggccttttcttacttaaacttcacaccagaaccttctgacattttctcctgcattgtgactcacgaaattgaccgctacacagcaattgcctattgggtaccccggaacgcactgccctcagatctgctggagaatgtgctgtgtggcgtggcctttggcctgggtgtgctgggcatcatcgtgggcattgttctcatcatctacttccggaagccttgctcaggtgactgattcttccagaccagagtttgatgccagcagcttcggccatccaaacagaggatgctcagatttctcacatcctgcccaggatctcctcttagggtagaagaagtctctgggacatccctggggtgtgtgtgtagatttcccacctggggactctgctgtccctgggcttgcatcccagggatcccagagtggcctgcctatcacaaccacatcccttccccccacaaggcaataaatctcatttctttatat

SEQ ID NO: 356805 - DNA, 1042 bp, Homo sapiens
ttgactgacatctccgccccacaagggccccttctcacctggatcctaaagccttccagggggcctccaaagttgccctcggcttggtacgggctcctactccaatgtggccagatgacctgcaaaaccacacattcctgcacacagtgtactgccaggatgggagtcccagtgtgggactctctgaggcctacgacgaggaccagcttttcttcttcgacttttcccagaacactcgggtgcctcgcctgcccgaatttgctgactgggctcaggaacagggagatgctcctgccattttatttgacaaagagttctgcgagtggatgatccagcaaatagggccaaaacttgatgggaaaatcccggtgtccagagggtttcctatcgctgaagtgttcacgctgaagcccctggagtttggcaagcccaacactttggtctgtttgtcagtaatctcttcccacccatgctgacagtgaactggcagcatcattccgtccctgtggaaggatttgggcctacttttgtctcagctgtcgatggactcagcttccaggccttttcttacttaaacttcacaccagaaccttctgacattttctcctgcattgtgactcacgaaattgaccgctacacagcaattgcctattgggtaccccggaacgcactgccctcagatctgctggagaatgtgctgtgtggcgtggcctttggcctgggtgtgctgggcatcatcgtgggcattgttctcatcatctacttccggaagccttgctcaggtgactgattcttccagaccagagtttgatgccagcagcttcggccatccaaacagaggatgctcagatttctcacatcctgcccaggatctcctcttagggtagaagaagtctctgggacatccctggggtgtgtgtgtagatttcccacctggggactctgctgtccctgggcttgcatcccagggatcccagagtggcctgcctatcacaaccacatcccttccccccacaaggcaataaatctcatttctttatat

SEQ ID NO: 356806 - DNA, 987 bp, Homo sapiens
tgatctaaggccaccctctcggggagggagttggggaagctgggttggctgggttggtagctcctacctactgtgtggcaagaaggtatgggtcatgaacagaaccaaggagctgcgctgctacagatgttaccacttctgtggctgctaccccactcctgggccgtccctgaagaacactcgggtgcctcgcctgcccgaatttgctgactgggctcaggaacagggagatgctcctgccattttatttgacaaagagttctgcgagtggatgatccagcaaatagggccaaaacttgatgggaaaatcccggtgtccagagggtttcctatcgctgaagtgttcacgctgaagcccctggagtttggcaagcccaacactttggtctgtttgtcagtaatctcttcccacccatgctgacagtgaactggcagcatcattccgtccctgtggaaggatttgggcctacttttgtctcagctgtcgatggactcagcttccaggccttttcttacttaaacttcacaccagaaccttctgacattttctcctgcattgtgactcacgaaattgaccgctacacagcaattgcctattgggtaccccggaacgcactgccctcagatctgctggagaatgtgctgtgtggcgtggcctttggcctgggtgtgctgggcatcatcgtgggcattgttctcatcatctacttccggaagccttgctcaggtgactgattcttccagaccagagtttgatgccagcagcttcggccatccaaacagaggatgctcagatttctcacatcctgcccaggatctcctcttagggtagaagaagtctctgggacatccctggggtgtgtgtgtagatttcccacctggggactctgctgtccctgggcttgcatcccagggatcccagagtggcctgcctatcacaaccacatcccttccccccacaaggcaataaatctcatttctttatat

SEQ ID NO: 356807 - DNA, 1023 bp, Homo sapiens
tgatctaaggccaccctctcggggagggagttggggaagctgggttggctgggttggtagctcctacctactgtgtggcaagaaggtatgggtcatgaacagaaccaaggagctgcgctgctacagatgttaccacttctgtggctgctaccccactcctgggccgtccctgaagctcctactccaatgtggccagatgacctgcaaaaccacacattcctgcacacagtgtactgccaggatgggagtcccagtgtgggactctctgaggcctacgacgaggaccagcttttcttcttcgacttttcccagaacactcgggtgcctcgcctgcccgaatttgctgactgggctcaggaacagggagatgctcctgccattttatttgacaaagagttctgcgagtggatgatccagcaaatagggccaaaacttgatgggaaaatcccggtgtccagagtgaactggcagcatcattccgtccctgtggaaggatttgggcctacttttgtctcagctgtcgatggactcagcttccaggccttttcttacttaaacttcacaccagaaccttctgacattttctcctgcattgtgactcacgaaattgaccgctacacagcaattgcctattgggtaccccggaacgcactgccctcagatctgctggagaatgtgctgtgtggcgtggcctttggcctgggtgtgctgggcatcatcgtgggcattgttctcatcatctacttccggaagccttgctcaggtgactgattcttccagaccagagtttgatgccagcagcttcggccatccaaacagaggatgctcagatttctcacatcctgcccaggatctcctcttagggtagaagaagtctctgggacatccctggggtgtgtgtgtagatttcccacctggggactctgctgtccctgggcttgcatcccagggatcccagagtggcctgcctatcacaaccacatcccttccccccacaaggcaataaatctcatttctttatat

SEQ ID NO: 356808 - DNA, 839 bp, Homo sapiens
tgatctaaggccaccctctcggggagggagttggggaagctgggttggctgggttggtagctcctacctactgtgtggcaagaaggtatgggtcatgaacagaaccaaggagctgcgctgctacagatgttaccacttctgtggctgctaccccactcctgggccgtccctgaagggtttcctatcgctgaagtgttcacgctgaagcccctggagtttggcaagcccaacactttggtctgtttgtcagtaatctcttcccacccatgctgacagtgaactggcagcatcattccgtccctgtggaaggatttgggcctacttttgtctcagctgtcgatggactcagcttccaggccttttcttacttaaacttcacaccagaaccttctgacattttctcctgcattgtgactcacgaaattgaccgctacacagcaattgcctattgggtaccccggaacgcactgccctcagatctgctggagaatgtgctgtgtggcgtggcctttggcctgggtgtgctgggcatcatcgtgggcattgttctcatcatctacttccggaagccttgctcaggtgactgattcttccagaccagagtttgatgccagcagcttcggccatccaaacagaggatgctcagatttctcacatcctgcccaggatctcctcttagggtagaagaagtctctgggacatccctggggtgtgtgtgtagatttcccacctggggactctgctgtccctgggcttgcatcccagggatcccagagtggcctgcctatcacaaccacatcccttccccccacaaggcaataaatctcatttctttatat

SEQ ID NO: 356809 - DNA, 757 bp, Homo sapiens
catcttgctcccatcaggactactgttttttaaccaacaagaggtcaattatagaatccgctgatgggagcaagatggcgcatcttctcccatggtttcctatcgctgaagtgttcacgctgaagcccctggagtttggcaagcccaacactttggtctgtttgtcagtaatctcttcccacccatgctgacagtgaactggcagcatcattccgtccctgtggaaggatttgggcctacttttgtctcagctgtcgatggactcagcttccaggccttttcttacttaaacttcacaccagaaccttctgacattttctcctgcattgtgactcacgaaattgaccgctacacagcaattgcctattgggtaccccggaacgcactgccctcagatctgctggagaatgtgctgtgtggcgtggcctttggcctgggtgtgctgggcatcatcgtgggcattgttctcatcatctacttccggaagccttgctcaggtgactgattcttccagaccagagtttgatgccagcagcttcggccatccaaacagaggatgctcagatttctcacatcctgcccaggatctcctcttagggtagaagaagtctctgggacatccctggggtgtgtgtgtagatttcccacctggggactctgctgtccctgggcttgcatcccagggatcccagagtggcctgcctatcacaaccacatcccttccccccacaaggcaataaatctcatttctttatat

SEQ ID NO: 356810 - DNA, 1963 bp, Homo sapiens
tgatctaaggccaccctctcggggagggagttggggaagctgggttggctgggttggtagctcctacctactgtgtggcaagaaggtatgggtcatgaacagaaccaaggagctgcgctgctacagatgttaccacttctgtggctgctaccccactcctgggccgtccctgaagctcctactccaatgtggccagatgacctgcaaaaccacacattcctgcacacagtgtactgccaggatgggagtcccagtgtgggactctctgaggcctacgacgaggaccagcttttcttcttcgacttttcccagaacactcgggtgcctcgcctgcccgaatttgctgactgggctcaggaacagggagatgctcctgccattttatttgacaaagagttctgcgagtggatgatccagcaaatagggccaaaacttgatgggaaaatcccggtgtccagaggtcaggagttttctggggagtgaagggaggagggctgcattaacctcattgatctgtacactgaataattccccttgataccagctccccatctcaaatactttctggttctcttcatcaccttaatttttccaccagccttggtctgcaccctgtgttcttttggtgggccgaagtacctagcatgtagtaggcattcagaactatgtattgaatgtgatgaattcaacaggtaccaactgatacctactgaatattaacacttgtgctactatgcccagcaagatggatgggaagagtggaaatatctgatgacgtgactatgtcttagtgagaagacagtgcatggttagacatcaatgtgagctctagacaggaagtgctgaaggaagtcatggtggaggggtccagagtagcctggatctggctctgcttctacgtctagctgcagtccttgcctggaagaagacctcccttcagagcccagctcctcgctcatctctgtctcccaaagcctgacccactgtgttcttctctgccctcccctccatatgccatggcccctccaaacacagagataccatctaaactagtctctttttccccctacacttcaatccccccaccaggtttcctatcgctgaagtgttcacgctgaagcccctggagtttggcaagcccaacactttggtctgtttgtcagtaatctcttcccacccatgctgacagtgaactggcagcatcattccgtccctgtggaaggatttgggcctacttttgtctcagctgtcgatggactcagcttccaggccttttcttacttaaacttcacaccagaaccttctgacattttctcctgcattgtgactcacgaaattgaccgctacacagcaattgcctattggggtgaggctttctccctggaattctggtccttttgggggcaaaaagggatagatccatgggaggaggcttctttctccactggtaccttgtttagtccattcctaccctaagcccatcccagtctcccatgtcatcccagacacccacgtcatttccctgggtgggaggctccctaactaggtccccaggctgagccactcatttcctccagtaccccggaacgcactgccctcagatctgctggagaatgtgctgtgtggcgtggcctttggcctgggtgtgctgggcatcatcgtgggcattgttctcatcatctacttccggaagccttgctcaggtgactgattcttccagaccagagtttgatgccagcagcttcggccatccaaacagaggatgctcagatttctcacatcctgcccaggatctcctcttagggtagaagaagtctctgggacatccctggggtgtgtgtgtagatttcccacctggggactctgctgtccctgggcttgcatcccagggatcccagagtggcctgcctatcacaaccacatcccttccccccacaaggcaataaatctcatttctttatat

SEQ ID NO: 356811 - DNA, 769 bp, Homo sapiens
tgatctaaggccaccctctcggggagggagttggggaagctgggttggctgggttggtagctcctacctactgtgtggcaagaaggtatgggtcatgaacagaaccaaggagctgcgctgctacagatgttaccacttctgtggctgctaccccactcctgggccgtccctgaagctcctactccaatgtggccagatgacctgcaaaaccacacattcctgcacacagtgtactgccaggatgggagtcccagtgtgggactctctgaggcctacgacgaggaccagcttttcttcttcgacttttcccagaacactcgggtgcctcgcctgcccgaatttgctgactgggctcaggaacagggagatgctcctgccattttatttgacaaagagttctgcgagtggatgatccagcaaatagggccaaaacttgatgggaaaatcccggtgtccagagggtttcctatcgctgaagtgttcacgctgaagcccctggagtttggcaagcccaacactttggtctgtttgtcagtaatctcttcccacccatgctgacagtgaactggcagcatcattccgtccctgtggaaggatttgggcctacttttgtctcagctgtcgatggactcagcttccaggccttttcttacctttgaccggtcacaaggaatgccttatggtaccccggacgcactgtccttagaatcggtggagtgtgctctgtggcgggggctttggcccgggtgagcctggcatcattggggct

SEQ ID NO: 356812 - DNA, 1089 bp, Homo sapiens
tgtggtacttggtattttcatctggcagaatctagcacttaataaatcaaaaaatggatgaatgaaacaagtaaagtttctataagttacaaactgcaccatcatccacttaatatcatacctattatacttacaacattcaattaaccacacattacatactgtaacctttatctccgtgaacagcatgttcactcattcatttattaaataaaacaattcacacaaagcatccataagagtgtccagcacacagtgagtactcactaaatgtcaccttttattgggatgctgttgccattgttagtcattcgttcttgttcctggtttggttcgtctcagagaatgtttacaagggattcacaaattagttctaataccaaattaattgaaacatatttagaaatataaattgctagccaaaaaataaaaagcctgtaatatacttcaaagtcagaattaaaggtgacatttgggttttccattagttcggatcatctataaatgtattatttataggtaatccatgccaaccagtattaaacgttccttagaattgtgtatctttagtctctaaatctttctaaactcagagacccactccctgttacaggctcctgtttctacctctaccccacagcatcttgtaccattagactaagatcttatccttaagccgtggggtaaactaattctttagggaaaaacttggaaaattaacatggtatgaagtttatatgctactaacaccataaatgccagctggcatatgtacagcccttgcagttcaaaaaactgataagtgttattttatataaccctcaaaacaaagcaaaaaaagctaaacatcattcttattctataaatttatgcccaaagaattatttgaaaaagagaaaatcattgcttttctgccactatatctactgacctgctatatctttgcttgtgccttgccagaatgaattatccatgcaaacctttgaatttatgtactgtatccatctcctcttacctatttgaagacatggttctagccttttttttttttagacggaatctcgctctgtcacccaggctggagtgcag

SEQ ID NO: 356813 - DNA, 394 bp, Homo sapiens
ggagtgcagtggtgcaatcgtggctcactgcaagctctgcctcccaggttcaagtgatcctcctgcctcagtctcctgagtagctgggactataggcgcatgccaccacacctggctaatttttgtatttttagtagagacgggtttcaccatattggtcaggctggtgttgagctcctgaccttgtgatccacccacctctgcctcccaaagtgctgggattacaagagtgagccactgcacctggcctacactgcatttttgacatcctcttaattaaaagctcagtgactaatgtggtatttctaaaattatgcaacttgccatctctaaccactgctttttggggctgtatctatgttcattgagtagactagttttggcttgaatattt

SEQ ID NO: 356814 - DNA, 1335 bp, Homo sapiens
gcgggaggaggcggaggcggcggagtggcgagaggcgagaggcggcggaggcggcggagctggggggggtgggaggggggggagagtgagtgagtggcagagtgagtttacccctatgagactgtgagaggcccggggcctacctcaaaggagcggggtcgcgaagctagctagcagcggcccccctccaggtccccgggcccggcggcgcggcggcggcttggttgtgaagaggcggggaagcgggtgtccggtccccgccatggagggcatggacgtagacctggacccggagctgatgcagaagttcagctgcctgggcaccaccgacaaggacgtgctcatctccgagttccagaggctgctcggcttccagctcaatcctgccggttgcgccttcttcctggacatgaccaactggaacctacaagcagcaattggcgcctattatgactttgagagcccaaacatcagtgtgccctctatgtcctttgttgaagatgtcaccataggagaaggggagtcaatacctccggatactcagtttgtaaaaacatggcggatccagaattctggggcagaggcctggcctccaggggtttgtcttaaatatgtcgggggagaccaatttggacatgtgaacatggtgatggtgagatcgctagagccccaagagattgcagatgtcagcgtccagatgtgcagccccagcagagcaggaatgtatcagggacagtggcggatgtgcactgctacaggactctactatggagatgtcatctgggtgattctcagtgtggaggtgggtggacttttaggagtaacgcagcagctgtcatcttttgaaacggagttcaacacacagccgcatcgtaaggtagaaggaaacttcaacccttttgcctctccccaaaagaaccgacaatcagatgaaaacaacttaaaagaccctgggggctccgagttcgactcgatcagcaaaaacacatgggctcctgctcctgacacatgggctcctgctcctgaccaaactgagcaagaccagaatagactgtcacagaactctgtaaatctgtctcccagcagtcacgcaaacaacttatcagtagtgacttacagtaaggggctccatgggccttaccccttcggccagtcttaaacgggtgtcagcaagaagaaaaattaacaaaagacagaaggcctgactttggggggttagggcaaggggttcctctggattgcagaccacatcgcacagacccctggctctgaccccctctcatcccggaagaagaggaagaagcagaacagactagttttgagtaaactcagtat

SEQ ID NO: 356815 - DNA, 1137 bp, Homo sapiens
gcgggaggaggcggaggcggcggagtggcgagaggcgagaggcggcggaggcggcggagctggggggggtgggaggggggggagagtgagtgagtggcagagtgagtttacccctatgagactgtgagaggcccggggcctacctcaaaggagcggggtcgcgaagctagctagcagcggcccccctccaggtccccgggcccggcggcgcggcggcggcttggttgtgaagaggcggggaagcgggtgtccggtccccgccatggagggcatggacgtagacctggacccggagctgatgcagaagttcagctgcctgggcaccaccgacaaggacgtgctcatctccgagttccagaggctgctcggcttccagctcaatcctgccggttgcgccttcttcctggacatgaccaactggaacctacaagcagcaattggcgcctattatgactttgagagcccaaacatcagtgtgccctctatgtcctttgttgaagatgtcaccataggagaaggggagtcaatacctccggatactcagtttgtaaaaacatggcggatccagaattctgatgtcatctgggtgattctcagtgtggaggtgggtggacttttaggagtaacgcagcagctgtcatcttttgaaacggagttcaacacacagccgcatcgtaaggtagaaggaaacttcaacccttttgcctctccccaaaagaaccgacaatcagatgaaaacaacttaaaagaccctgggggctccgagttcgactcgatcagcaaaaacacatgggctcctgctcctgacacatgggctcctgctcctgaccaaactgagcaagaccagaatagactgtcacagaactctgtaaatctgtctcccagcagtcacgcaaacaacttatcagtagtgacttacagtaaggggctccatgggccttaccccttcggccagtcttaaacgggtgtcagcaagaagaaaaattaacaaaagacagaaggcctgactttggggggttagggcaaggggttcctctggattgcagaccacatcgcacagacccctggctctgaccccctctcatcccggaagaagaggaagaagcagaacagactagttttgagtaaactcagtat

SEQ ID NO: 356816 - DNA, 1304 bp, Homo sapiens
aagtatggctaggtacgaggcctgggtggtggtgagtttacccctatgagactgtgagaggcccggggcctacctcaaaggagcggggtcgcgaagctagctagcagcggcccccctccaggtccccgggcccggcggcgcggcggcggcttggttgtgaagaggcggggaagcgggtgtccggtccccgccatggagggcatggacgtagacctggacccggagctgatgcagaagttcagctgcctgggcaccaccgacaaggacgtgctcatctccgagttccagaggctgctcggcttccagctcaatcctgccggttgcgccttcttcctggacatgaccaactggaacctacaagcagcaattggcgcctattatgactttgagagcccaaacatcagtgtgccctctatgtcctttgttgaagatgtcaccataggagaaggggagtcaatacctccggatactcagtttgtaaaaacatggcggatccagaattctggggcagaggcctggcctccaggggtttgtcttaaatatgtcgggggagaccaatttggacatgtgaacatggtgatggtgagatcgctagagccccaagagattgcagatgtcagcgtccagatgtgcagccccagcagagcaggaatgtatcagggacagtggcggatgtgcactgctacaggactctactatggagatgtcatctgggtgattctcagtgtggaggtgggtggacttttaggagtaacgcagcagctgtcatcttttgaaacggagttcaacacacagccgcatcgtaaggtagaaggaaacttcaacccttttgcctctccccaaaagaaccgacaatcagatgaaaacaacttaaaagaccctgggggctccgagttcgactcgatcagcaaaaacacatgggctcctgctcctgacacatgggctcctgctcctgaccaaactgagcaagaccagaatagactgtcacagaactctgtaaatctgtctcccagcagtcacgcaaacaacttatcagtagtgacttacagtaagtgtacataagtgatacaaaaggagcactaggcggaagaagcactgaccaggactgacccaggaaatgaggaagaggagggtcctcatggtgttatccgataatgccatcagtatacaccaagagagcatattatttctcagccatacaacaaacttgcttgtctttttattaacctgtgtgaaccttcttatttatttaaatcaaatcacaaataaaagcaaaataaagacaggtatgtgaaaatcctgtg

SEQ ID NO: 356817 - DNA, 1440 bp, Homo sapiens
aagtatggctaggtacgaggcctgggtggtggtgagtttacccctatgagactgtgagaggcccggggcctacctcaaaggagcggggtcgcgaagctagctagcagcggcccccctccaggtccccgggcccggcggcgcggcggcggcttggttgtgaagaggcggggaagcgggtgtccggtccccgccatggagggcatggacgtagacctggacccggagctgatgcagaagttcagctgcctgggcaccaccgacaaggacgtgctcatctccgagttccagaggctgctcggcttccagctcaatcctgccggttgcgccttcttcctggacatgaccaactggaacctacaagcagcaattggcgcctattatgactttgagagcccaaacatcagtgtgccctctatgtcctttgttgaagatgtcaccataggagaaggggagtcaatacctccggatactcagtttgtaaaaacatggcggatccagaattctggggcagaggcctggcctccaggggtttgtcttaaatatgtcgggggagaccaatttggacatgtgaacatggtgatggtgagatcgctagagccccaagagattgcagatgtcagcgtccagatgtgcagccccagcagagcaggaatgtatcagggacagtggcggatgtgcactgctacaggactctactatggagatgtcatctgggtgattctcagtgtggaggtgggtggacttttaggagtaacgcagcagctgtcatcttttgaaacggagttcaacacacagccgcatcgtaaggtagaaggaaacttcaacccttttgcctctccccaaaagaaccgacaatcagatgaaaacaacttaaaagaccctgggggctccgagttcgactcgatcagcaaaaacacatgggctcctgctcctgacacatgggctcctgctcctgaccaaactgagcaagaccagaatagactgtcacagaactctgtaaatctgtctcccagcagtcacgcaaacaacttatcagtagtgacttacagtaagtcatcctgtagagcattttgtatctggagctagcaggagtcagtctgcttctgttacatcagaaatcagctctttttctcacctgctgctatctatgttgactaaggcatagaagagttcttttctctccatccagtgtacataagtgatacaaaaggagcactaggcggaagaagcactgaccaggactgacccaggaaatgaggaagaggagggtcctcatggtgttatccgataatgccatcagtatacaccaagagagcatattatttctcagccatacaacaaacttgcttgtctttttattaacctgtgtgaaccttcttatttatttaaatcaaatcacaaataaaagcaaaataaagacaggtatgtgaaaatcctgtg

SEQ ID NO: 356818 - DNA, 750 bp, Homo sapiens
  misc_feature (27)..(27): n is a, c, g, or t
gcctcctgaaaccatgagaagcttcancgttgcctcactggcttccccatctgaccccaccaggtaccacactgtcacccagtgtccttgatctcctcttgttcccctttctgcttgtagcagcctcacttggcgaatgtatcagggacagtggcggatgtgcactgctacaggactctactatggagatgtcatctgggtgattctcagtgtggaggtgggtggacttttaggagtaacgcagcagctgtcatcttttgaaacggagttcaacacacagccgcatcgtaaggtagaaggaaacttcaacccttttgcctctccccaaaagaaccgacaatcagatgaaaacaacttaaaagaccctgggggctccgagttcgactcgatcagcaaaaacacatgggctcctgctcctgacacatgggctcctgctcctgaccaaactgagcaagaccagaatagactgtcacagaactctgtaaatctgtctcccagcagtcacgcaaacaacttatcagtagtgacttacagtaaggggctccatgggccttaccccttcggccagtcttaaacgggtgtcagcaagaagaaaaattaacaaaagacagaaggcctgactttggggggttagggcaaggggttcctctggattgcagaccacatcgcacagacccctggctctgaccccctctcatcccggaagaagaggaagaagcagaacagactagttttgagtaaactcagtat

SEQ ID NO: 356819 - DNA, 379 bp, Homo sapiens
aagtatggctaggtacgaggcctgggtggtggtgagtttacccctatgagactgtgagaggcccggggcctacctcaaaggagcggggtcgcgaagctagctagcagcggcccccctccaggtccccgggcccggcggcgcggcggcggcttggttgtgaagaggcggggaagcgggtgtccggtccccgccatggagggcatggacgtagacctggacccggagctgatgcagaagttcagctgcctgggcaccaccgacaaggacgtgctcatctccgagttccagaggctgctcggcttccagctcaatcctgccggttgcgcgtgtgctagatgattttcttgatttgcggattctttttcatctcttccgcgga

SEQ ID NO: 356820 - DNA, 481 bp, Homo sapiens
atattgatacagagtcgtctttattttttgaacttcatagaagtgaatataaagggatgggaaaagaacttgagaaagaacaattatttcccccatttttcttctagtgcattaaaatagttagctttctacctttctcttcagtatgattctagagaagataattttgcttctttcattcaacacattttattatgttccagtcactttattaggtacaagggaggaatggtcacaagattgatgaaggtttctgctttcatggagcttaatatgaaatgcagtgtccacacttataagggttaaaaaggagatcatcattaaggtttgtcttctgtattgctatttggatattccttactgtctccagactatttctataattgtatatacttactaagtcccctgggactgttggacttttgatttttgtgatgcttgctaccatctcaaaattgtaacatgacagggttttttttgt

SEQ ID NO: 356821 - DNA, 1036 bp, Homo sapiens
gtgtaacctctcctgtttttgtacatgtgtttattcctgaactgttttgggctactcattgttaaccaggttgctgctctacttttcccactgctggctaaggaagattcaactttttcaggaacctacaagcagcaattggcgcctattatgactttgagagcccaaacatcagtgtgccctctatgtcctttgttgaagatgtcaccataggagaaggggagtcaatacctccggatactcagtttgtaaaaacatggcggatccagaattctggggcagaggcctggcctccaggggtttgtcttaaatatgtcgggggagaccaatttggacatgtgaacatggtgatggtgagatcgctagagccccaagagattgcagatgtcagcgtccagatgtgcagccccagcagagcaggaatgtatcagggacagtggcggatgtgcactgctacaggactctactatggagatgtcatctgggtgattctcagtgtggaggtgggtggacttttaggagtaacgcagcagctgtcatcttttgaaacggagttcaacacacagccgcatcgtaaggtagaaggaaacttcaacccttttgcctctccccaaaagaaccgacaatcagatgaaaacaacttaaaagaccctgggggctccgagttcgactcgatcagcaaaaacacatgggctcctgctcctgacacatgggctcctgctcctgaccaaactgagcaagaccagaatagactgtcacagaactctgtaaatctgtctcccagcagtcacgcaaacaacttatcagtagtgacttacagtaaggggctccatgggccttaccccttcggccagtcttaaacgggtgtcagcaagaagaaaaattaacaaaagacagaaggcctgactttggggggttagggcaaggggttcctctggattgcagaccacatcgcacagacccctggctctgaccccctctcatcccggaagaagaggaagaagcagaacagactagttttgagtaaactcagtat

SEQ ID NO: 356822 - DNA, 1265 bp, Homo sapiens
aagtatggctaggtacgaggcctgggtggtggtgagtttacccctatgagactgtgagaggcccggggcctacctcaaaggagcggggtcgcgaagctagctagcagcggcccccctccaggtccccgggcccggcggcgcggcggcggcttggttgtgaagaggcggggaagcgggtgtccggtccccgccatggagggcatggacgtagacctggacccggagctgatgcagaagttcagctgcctgggcaccaccgacaaggacgtgctcatctccgagttccagaggctgctcggcttccagctcaatcctgccggttgcgccttcttcctggacatgaccaactggaacctacaagcagcaattggcgcctattatgactttgagagcccaaacatcagtgtgccctctatgtcctttgttgaagatgtcaccataggagaaggggagtcaatacctccggatactcagtttgtaaaaacatggcggatccagaattctggggcagaggcctggcctccaggggtttgtcttaaatatgtcgggggagaccaatttggacatgtgaacatggtgatggtgagatcgctagagccccaagagattgcagatgtcagcgtccagatgtgcagccccagcagagcaggaatgtatcagggacagtggcggatgtgcactgctacaggactctactatggagatgtcatctgggtgattctcagtgtggaggtgggtggacttttaggagtaacgcagcagctgtcatcttttgaaacggagttcaacacacagccgcatcgtaaggtagaaggaaacttcaacccttttgcctctccccaaaagaaccgacaatcagatgaaaacaacttaaaagaccctgggggctccgagttcgactcgatcagcaaaaacacatgggctcctgctcctgacacatgggctcctgctcctgaccaaactgagcaagaccagaatagactgtcacagaactctgtaaatctgtctcccagcagtcacgcaaacaacttatcagtagtgacttacagtaaggggctccatgggccttaccccttcggccagtcttaaacgggtgtcagcaagaagaaaaattaacaaaagacagaaggcctgactttggggggttagggcaaggggttcctctggattgcagaccacatcgcacagacccctggctctgaccccctctcatcccggaagaagaggaagaagcagaacagactagttttgagtaaactcagtat

SEQ ID NO: 356823 - DNA, 1457 bp, Homo sapiens
gcgggaggaggcggaggcggcggagtggcgagaggcgagaggcggcggaggcggcggagctggggggggtgggaggggggggagagtgagtgagtggcagagtgagtttacccctatgagactgtgagaggcccggggcctacctcaaaggagcggggtcgcgaagctagctagcagcggcccccctccaggtccccgggcccggcggcgcggcggcggcttggttgtgaagaggcggggaagcgggtgtccggtccccgccatggagggcatggacgtagacctggacccggagctgatgcagaagttcagctgcctgggcaccaccgacaaggacgtgctcatctccgagttccagaggctgctcggcttccagctcaatcctgccggttgcgccttcttcctggacatgaccaactggaacctacaagcagcaattggcgcctattatgactttgagagcccaaacatcagtgtgccctctatgtcctttgttgaagatgtcaccataggagaaggggagtcaatacctccggatactcagtttgtaaaaacatggcggatccagaattctgtcactttattaggtacaagggaggaatggtcacaagattgatgaaggtttctgctttcatggagcttaatatgaaatgcagtgtccacacttataagggttaaaaaggagatcatcattaaggggcagaggcctggcctccaggggtttgtcttaaatatgtcgggggagaccaatttggacatgtgaacatggtgatggtgagatcgctagagccccaagagattgcagatgtcagcgtccagatgtgcagccccagcagagcaggaatgtatcagggacagtggcggatgtgcactgctacaggactctactatggagatgtcatctgggtgattctcagtgtggaggtgggtggacttttaggagtaacgcagcagctgtcatcttttgaaacggagttcaacacacagccgcatcgtaaggtagaaggaaacttcaacccttttgcctctccccaaaagaaccgacaatcagatgaaaacaacttaaaagaccctgggggctccgagttcgactcgatcagcaaaaacacatgggctcctgctcctgacacatgggctcctgctcctgaccaaactgagcaagaccagaatagactgtcacagaactctgtaaatctgtctcccagcagtcacgcaaacaacttatcagtagtgacttacagtaaggggctccatgggccttaccccttcggccagtcttaaacgggtgtcagcaagaagaaaaattaacaaaagacagaaggcctgactttggggggttagggcaaggggttcctctggattgcagaccacatcgcacagacccctggctctgaccccctctcatcccggaagaagaggaagaagcagaacagactagttttgagtaaactcagtat

SEQ ID NO: 356824 - DNA, 980 bp, Homo sapiens
gcgggaggaggcggaggcggcggagtggcgagaggcgagaggcggcggaggcggcggagctggggggggtgggaggggggggagagtgagtgagtggcagagtgagtttacccctatgagactgtgagaggcccggggcctacctcaaaggagcggggtcgcgaagctagctagcagcggcccccctccaggtccccgggcccggcggcgcggcggcggcttggttgtgaagaggcggggaagcgggtgtccggtccccgccatggagggcatggacgtagacctggacccggagctgatgcagaagttcagctgcctgggcaccaccgacaaggacgtgctcatctccgagttccagaggctgctcggcttccagctcaatcctgccggttgcgccttcttcctggacatgaccaactggaacctacaagcagcaattggcgcctattatgactttgagagcccaaacatcagtgtgccctctatgtcctttgttgaagatgtcaccataggagaaggggagtcaatacctccggatactcagtttgtaaaaacatggcggatccagaattctgtcactttattaggtacaagggaggaatggtcacaagattgatgaaggtttctgctttcatggagcttaatatgaaatgcagtgtccacacttataagggttaaaaaggagatcatcattaaggggcagaggcctggcctccaggggtttgtcttaaatatgtcgggggagaccaatttggacatgtgaacatggtgatggtgagatcgctagagccccaagagattgcagatgtcagcgtccagatgtgcagccccagcagagcaggaatgtatcagggacagtggcggatgtgcactgctacaggactctactatggaggtgagtatgtccttgtgcagcccagggtaaaggaactaaggtaacatcttataacatccccagtgttgctcacagagcctgtcaa

SEQ ID NO: 356825 - DNA, 1886 bp, Homo sapiens
gcacgaggcaggccgaagtccgcagccccggctcggctcccgctgcttgcacctcccggatggtgctgactgctccctaagcggcggcggcggcgagtcgtgaggacgcgccgcggaggctgttcggggtcgaggcttcccgtcgccggcacttcctcttgcggcgcccgtgcgcggccggcccggcaggcgggatggcggccgcggctccagggaacggccgcgcatcggcgccccggctgcttctgctctttctggttccgctgctgtgggccccggctgcggtccgggccggcccagatgaagaccttagccaccggaacaaagaaccgccggcgccggcccagcagctgcagccgcagcctgtggctgtgcagggccccgagccggcccgggtcgagaaaatatttacaccagcagctccagttcataccaataaagaagatcctgctacccaaactaatttgggatttatccatgcatttgtcgctgccatatcagttattattgtatctgaattgggtgataagacattttttatagcagccatcatggcaatgcgctataaccgcctgaccgtgctggctggtgcaatgcttgccttgggactaatgacatgcttgtcagttttgtttggctatgccaccacagtcatccccagggtctatacatactatgtttcaactgtattatttgccatttttggcattagaatgcttcgggaaggcttaaagatgagccctgatgagggtcaagaggaactggaagaagttcaagctgaattaaagaagaaagatgaagaatttcaacgaaccaaacttttaaatggaccgggagatgttgaaacgggtacaagcataacagtacctcagaaaaagtggttgcattttatttcacccatttttgttcaagctcttacattaacattcttagcagaatggggtgatcgctctcaactaactacaattgtattggcagctagagaggacccctatggtgtagccgtgggtggaactgtggggcactgcctgtgcacgggattggcagtaattggaggaagaatgatagcacagaaaatctctgtcagaactgtgacaatcataggaggcatcgtttttttggcgtttgcattttctgcactatttataagccctgattctggtttttaacaagctgtttgttcatctatatttagtttaaaataggtagtattatctttctgtacatagtgtacattacaactaaaagtgatggaaaaatactgtattttgtagcactgattttgtgagtttgacccattattatgtctgagatataatcattgattctatttgtaacaaggagttttaaaagaaacctgacttctaagtgtgggtttttcttctctccaacataattatgttaatatggtcctcatttttcttttggtgcagaaccgttgtgcagtggggtctaccatgcaattttctttcagcactgacccctttttaaggaatacaaattttctccttcatcacttaggtgttttaagatgtttaccttaaagtttttcttggggaaagaatgaattaatttctatttcttaaaacatttccctgagccagtaaacagtagtttaatcattggtcttttcaaaactaggtgtttaaaaaaagagacatatatgatattgctgttatatcaataacatggcacaacaagaactgtctgccaggtcattcttcctcttttttttttaattgggtaggacacccaatataaaaacagtcaatatttgacaatgtggaattaccaaattaaaagagaatactatgaatgtattcatattttttctatatcaaccaacccttggttcccatatttaattaaaaggagggttgcccagt

SEQ ID NO: 356826 - DNA, 2638 bp, Homo sapiens
  misc_feature (1)..(5): n is a, c, g, or t
  misc_feature (8)..(9): n is a, c, g, or t
  misc_feature (788)..(788): n is a, c, g, or t
  misc_feature (865)..(865): n is a, c, g, or t
nnnnncgnntagctgggaccacttgtgcttgctaggatgcctggctaatttttaatttttttgtagagatgaggtcccactgtgttgcctaggctagtctcaaactgccaggctcaagcaatcctcttgcttcagcctcccaaagtgttgggattacaggcatgagccactgcacctggcctagcggatttctgaagcattaatctgttctgttactttccagctaaaaaccaacaagtgtctgaggacacagtttaaactccaagatgatagggtcctccctcacctgggctcccacctaccctcatgacctccttttgtgaaatgctgaagggctctgcagctggttgtctggtactgctggcctttgctttctatttagcatgttccttctcccacaaaacaaaatcacattctcactatgccctgttcattcttcaggactatcttctgggaaacttttactacatacccctctccccctaatctgagtgtctgctttgctcaggtagcatgtgttcactggataaatccttgattcctggcactgaggcagggtttctgttcccaggaagcagaggcatactattctgtgaaggattgactgagtttctcctaataccaagcagtatctgagggaacagatgtctagcttaaaatcctccctagcacttgtcatagcagtgctacgtattgcctgtgaaggaagtttaataactgctgaaaggctcgattagctttatttcatcaggatttgtttgactttacaaattgatttgggttatttnaacttttaggtctagtcttaagtataactggtacatattccttcaagcagccattacacctttcataaatttattanacacctgcatttttataactattatgctttttaattgttggccaccatttttagtgcttctgaattgttatggttctcaagcagcagttgtcaccttggttttgaattaatgctgtgacgcttgcttccaggacccctatggtgtagccgtgggtggaactgtggggcactgcctgtgcacgggattggcagtaattggaggaagaatgatagcacagaaaatctctgtcagaactggtaagtcttgaaaattacaaatcagataacattttagaatcactgagagattaaagggtgttagctttgattatttaaatttctgctgctgaagtatacttggtttttctaattacctaccatctcttataataagaggtattaatcctggtattgcaaatacggacttttttcacctgtgtagaagttagcaaaatacaaagtcatttttatcgaattcatagtagcttcttgttaacatattatcttagtaaaacaattgtcatttggaagtatgagaagtttttggctctaaaaatgtgtcttacaagactggaatcatgtggagaccatatgtactgattctgctgaatatgtcctgtgaagccacagttaggtctagagatggaagaatcgtctctttgctagtcagaagacctgaacattttcttttataactggattttaagatgagttatagttctactgttgcttgccagcactgtctggatttaatacaatcctgtcatttctcaaaacagtgctggagaaaacctgattcttagtgttcacagtcaagcatgttaagtattgttccttgttatgtaaaaggggttgaagtgattctaatttgttttcaaggttagtttaatagattggaagaataattggccgcctcatcggctcccttttcattttgtacagtatcaaggtataggaattttactgtatttgactttttttctctctcttccagtgacaatcataggaggcatcgtttttttggcgtttgcattttctgcactatttataagccctgattctggtttttaacaagctgtttgttcatctatatttagtttaaaataggtagtattatctttctgtacatagtgtacattacaactaaaagtgatggaaaaatactgtattttgtagcactgattttgtgagtttgacccattattatgtctgagatataatcattgattctatttgtaacaaggagttttaaaagaaacctgacttctaagtgtgggtttttcttctctccaacataattatgttaatatggtcctcatttttcttttggtgcagaaccgttgtgcagtggggtctaccatgcaattttctttcagcactgacccctttttaaggaatacaaattttctccttcatcacttaggtgttttaagatgtttaccttaaagtttttcttggggaaagaatgaattaatttctatttcttaaaacatttccctgagccagtaaacagtagtttaatcattggtcttttcaaaactaggtgtttaaaaaaagagacatatatgatattgctgttatatcaataacatggcacaacaagaactgtctgccaggtcattcttcctcttttttttttaattgggtaggacacccaatataaaaacagtcaatatttgacaatgtggaattaccaaattaaaagagaatactatgaatgtattcatattttttctatattgaataaacaatgtaacatagataacaatataaataaaagtggtatgaccagtg

SEQ ID NO: 356827 - DNA, 261 bp, Homo sapiens
tttgtttctgtttttttgcagggacatcagtttttttcttggtagcaagctgtagattttgtttcaaggaaagcatcttcatcttctctagtttcatcatgtatagatggagattccgatgcaggtatctgtatcaatttcaatacagtcacatttgtgtttatttgaactctagaactagaaaaggaattacttttttctttgattttctttttcttccttctcttgaggatcatgaaagtataaaagaatactttctaa

SEQ ID NO: 356828 - DNA, 1978 bp, Homo sapiens
acggggccgggaggagtcggggctgggccgcgccgaggcagctggctgactccagtttagccgccgccggagaggacgggcgccgagccggggctgcggacttcggcctgcccctcacctcactcccgctgcttgcacctcccggatggtgctgactgctccctaagcggcggcggcggcgagtcgtgaggacgcgccgcggaggctgttcggggtcgaggcttcccgtcgccggcacttcctcttgcggcgcccgtgcgcggccggcccggcaggcgggatggcggccgcggctccagggaacggccgcgcatcggcgccccggctgcttctgctctttctggttccgctgctgtgggccccggctgcggtccgggccggcccagatgaagaccttagccaccggaacaaagaaccgccggcgccggcccagcagctgcagccgcagcctgtggctgtgcagggccccgagccggcccgggtcgagaaaatatttacaccagcagctccagttcataccaataaagaagatcctgctacccaaactaatttgggatttatccatgcatttgtcgctgccatatcagttattattgtatctgaattgggtgataagacattttttatagcagccatcatggcaatgcgctataaccgcctgaccgtgctggctggtgcaatgcttgccttgggactaatgacatgcttgtcagttttgtttggctatgccaccacagtcatccccagggtctatacatactatgtttcaactgtattatttgccatttttggcattagaatgcttcgggaaggcttaaagatgagccctgatgagggtcaagaggaactggaagaagttcaagctgaattaaagaagaaagatgaagaatttcaacgaaccaaacttttaaatggaccgggagatgttgaaacgggtacaagcataacagtacctcagaaaaagtggttgcattttatttcacccatttttgttcaagctcttacattaacattcttagcagaatggggtgatcgctctcaactaactacaattgtattggcagctagagaggacccctatggtgtagccgtgggtggaactgtggggcactgcctgtgcacgggattggcagtaattggaggaagaatgatagcacagaaaatctctgtcagaactgtgacaatcataggaggcatcgtttttttggcgtttgcattttctgcactatttataagccctgattctggtttttaacaagctgtttgttcatctatatttagtttaaaataggtagtattatctttctgtacatagtgtacattacaactaaaagtgatggaaaaatactgtattttgtagcactgattttgtgagtttgacccattattatgtctgagatataatcattgattctatttgtaacaaggagttttaaaagaaacctgacttctaagtgtgggtttttcttctctccaacataattatgttaatatggtcctcatttttcttttggtgcagaaccgttgtgcagtggggtctaccatgcaattttctttcagcactgacccctttttaaggaatacaaattttctccttcatcacttaggtgttttaagatgtttaccttaaagtttttcttggggaaagaatgaattaatttctatttcttaaaacatttccctgagccagtaaacagtagtttaatcattggtcttttcaaaactaggtgtttaaaaaaagagacatatatgatattgctgttatatcaataacatggcacaacaagaactgtctgccaggtcattcttcctcttttttttttaattgggtaggacacccaatataaaaacagtcaatatttgacaatgtggaattaccaaattaaaagagaatactatgaatgtattcatattttttctatattgaataaacaatgtaacatagataacaatataaataaaagtggtatgaccagtg

SEQ ID NO: 356829 - DNA, 2714 bp, Homo sapiens
acggggccgggaggagtcggggctgggccgcgccgaggcagctggctgactccagtttagccgccgccggagaggacgggcgccgagccggggctgcggacttcggcctgcccctcacctcactcccgctgcttgcacctcccggatggtgctgactgctccctaagcggcggcggcggcgagtcgtgaggacgcgccgcggaggctgttcggggtcgaggcttcccgtcgccggcacttcctcttgcggcgcccgtgcgcggccggcccggcaggcgggatggcggccgcggctccagggaacggccgcgcatcggcgccccggctgcttctgctctttctggttccgctgctgtgggccccggctgcggtccgggccggcccagatgaagaccttagccaccggaacaaagaaccgccggcgccggcccagcagctgcagccgcagcctgtggctgtgcagggccccgagccggcccgggtcgagaaaatatttacaccagcagctccagttcataccaataaagaagatcctgctacccaaactaatttgggatttatccatgcatttgtcgctgccatatcagttattattgtatctgaattgggtgataagacattttttatagcagccatcatggcaatgcgctataaccgcctgaccgtgctggctggtgcaatgcttgccttgggactaatgacatgcttgtcagttttgtttggctatgccaccacagtcatccccagggtctatacatactatgtttcaactgtattatttgccatttttggcattagaatgcttcgggaaggcttaaagatgagccctgatgagggtcaagaggaactggaagaagttcaagctgaattaaagaagaaagatgaagaatttcaacgaaccaaacttttaaatggaccgggagatgttgaaacgggtacaagcataacagtacctcagaaaaagtggttgcattttatttcacccatttttgttcaagctcttacattaacattcttagcagaatggggtgatcgctctcaactaactacaattgtattggcagctagagaggacccctatggtgtagccgtgggtggaactgtggggcactgcctgtgcacgggattggcagtaattggaggaagaatgatagcacagaaaatctctgtcagaactggtaagtcttgaaaattacaaatcagataacattttagaatcactgagagattaaagggtgttagctttgattatttaaatttctgctgctgaagtatacttggtttttctaattacctaccatctcttataataagaggtattaatcctggtattgcaaatacggacttttttcacctgtgtagaagttagcaaaatacaaagtcatttttatcgaattcatagtagcttcttgttaacatattatcttagtaaaacaattgtcatttggaagtatgagaagtttttggctctaaaaatgtgtcttacaagactggaatcatgtggagaccatatgtactgattctgctgaatatgtcctgtgaagccacagttaggtctagagatggaagaatcgtctctttgctagtcagaagacctgaacattttcttttataactggattttaagatgagttatagttctactgttgcttgccagcactgtctggatttaatacaatcctgtcatttctcaaaacagtgctggagaaaacctgattcttagtgttcacagtcaagcatgttaagtattgttccttgttatgtaaaaggggttgaagtgattctaatttgttttcaaggttagtttaatagattggaagaataattggccgcctcatcggctcccttttcattttgtacagtatcaaggtataggaattttactgtatttgactttttttctctctcttccagtgacaatcataggaggcatcgtttttttggcgtttgcattttctgcactatttataagccctgattctggtttttaacaagctgtttgttcatctatatttagtttaaaataggtagtattatctttctgtacatagtgtacattacaactaaaagtgatggaaaaatactgtattttgtagcactgattttgtgagtttgacccattattatgtctgagatataatcattgattctatttgtaacaaggagttttaaaagaaacctgacttctaagtgtgggtttttcttctctccaacataattatgttaatatggtcctcatttttcttttggtgcagaaccgttgtgcagtggggtctaccatgcaattttctttcagcactgacccctttttaaggaatacaaattttctccttcatcacttaggtgttttaagatgtttaccttaaagtttttcttggggaaagaatgaattaatttctatttcttaaaacatttccctgagccagtaaacagtagtttaatcattggtcttttcaaaactaggtgtttaaaaaaagagacatatatgatattgctgttatatcaataacatggcacaacaagaactgtctgccaggtcattcttcctcttttttttttaattgggtaggacacccaatataaaaacagtcaatatttgacaatgtggaattaccaaattaaaagagaatactatgaatgtattcatattttttctatattgaataaacaatgtaacatagataacaatataaataaaagtggtatgaccagtg

SEQ ID NO: 356830 - DNA, 2893 bp, Homo sapiens
acggggccgggaggagtcggggctgggccgcgccgaggcagctggctgactccagtttagccgccgccggagaggacgggcgccgagccggggctgcggacttcggcctgcccctcacctcactcccgctgcttgcacctcccggatggtgctgactgctccctaagcggcggcggcggcgagtcgtgaggacgcgccgcggaggctgttcggggtcgaggcttcccgtcgccggcacttcctcttgcggcgcccgtgcgcggccggcccggcaggcgggatggcggccgcggctccagggaacggccgcgcatcggcgccccggctgcttctgctctttctggttccgctgctgtgggccccggctgcggtccgggccggcccagatgaagaccttagccaccggaacaaagaaccgccggcgccggcccagcagctgcagccgcagcctgtggctgtgcagggccccgagccggcccgggtcgagaaaatatttacaccagcagctccagttcataccaataaagaagatcctgctacccaaactaatttgggatttatccatgcatttgtcgctgccatatcagttattattgtatctgaattgggtgataagacattttttatagcagccatcatggcaatgcgctataaccgcctgaccgtgctggctggtgcaatgcttgccttgggactaatgacatgcttgtcagttttgtttggctatgccaccacagtcatccccagggtctatacatactatgtttcaactgtattatttgccatttttggcattagaatgcttcgggaaggcttaaagatgagccctgatgagggtcaagaggaactggaagaagttcaagctgaattaaagaagaaagatgaagaatttcaacgaaccaaacttttaaatggaccgggagatgttgaaacgggtacaagcataacagtacctcagaaaaagtggttgcattttatttcacccatttttgttcaagctcttacattaacattcttagcagaatggggtgatcgctctcaactaactacaattgtattggcagctagagaggtgagtgatatttgagaggagactgtttaaaatgaaacgtaattattattactttgttccagaaaacactggacacactgaagtgggccacagcattccttcatatgcaagactgttttacatctgataattcagctgctctctaaaattggccttctcccagttcctgctacctgcaggacccctatggtgtagccgtgggtggaactgtggggcactgcctgtgcacgggattggcagtaattggaggaagaatgatagcacagaaaatctctgtcagaactggtaagtcttgaaaattacaaatcagataacattttagaatcactgagagattaaagggtgttagctttgattatttaaatttctgctgctgaagtatacttggtttttctaattacctaccatctcttataataagaggtattaatcctggtattgcaaatacggacttttttcacctgtgtagaagttagcaaaatacaaagtcatttttatcgaattcatagtagcttcttgttaacatattatcttagtaaaacaattgtcatttggaagtatgagaagtttttggctctaaaaatgtgtcttacaagactggaatcatgtggagaccatatgtactgattctgctgaatatgtcctgtgaagccacagttaggtctagagatggaagaatcgtctctttgctagtcagaagacctgaacattttcttttataactggattttaagatgagttatagttctactgttgcttgccagcactgtctggatttaatacaatcctgtcatttctcaaaacagtgctggagaaaacctgattcttagtgttcacagtcaagcatgttaagtattgttccttgttatgtaaaaggggttgaagtgattctaatttgttttcaaggttagtttaatagattggaagaataattggccgcctcatcggctcccttttcattttgtacagtatcaaggtataggaattttactgtatttgactttttttctctctcttccagtgacaatcataggaggcatcgtttttttggcgtttgcattttctgcactatttataagccctgattctggtttttaacaagctgtttgttcatctatatttagtttaaaataggtagtattatctttctgtacatagtgtacattacaactaaaagtgatggaaaaatactgtattttgtagcactgattttgtgagtttgacccattattatgtctgagatataatcattgattctatttgtaacaaggagttttaaaagaaacctgacttctaagtgtgggtttttcttctctccaacataattatgttaatatggtcctcatttttcttttggtgcagaaccgttgtgcagtggggtctaccatgcaattttctttcagcactgacccctttttaaggaatacaaattttctccttcatcacttaggtgttttaagatgtttaccttaaagtttttcttggggaaagaatgaattaatttctatttcttaaaacatttccctgagccagtaaacagtagtttaatcattggtcttttcaaaactaggtgtttaaaaaaagagacatatatgatattgctgttatatcaataacatggcacaacaagaactgtctgccaggtcattcttcctcttttttttttaattgggtaggacacccaatataaaaacagtcaatatttgacaatgtggaattaccaaattaaaagagaatactatgaatgtattcatattttttctatattgaataaacaatgtaacatagataacaatataaataaaagtggtatgaccagtg

SEQ ID NO: 356831 - DNA, 2167 bp, Homo sapiens
acggggccgggaggagtcggggctgggccgcgccgaggcagctggctgactccagtttagccgccgccggagaggacgggcgccgagccggggctgcggacttcggcctgcccctcacctcactcccgctgcttgcacctcccggatggtgctgactgctccctaagcggcggcggcggcgagtcgtgaggacgcgccgcggaggctgttcggggtcgaggcttcccgtcgccggcacttcctcttgcggcgcccgtgcgcggccggcccggcaggcgggatggcggccgcggctccagggaacggccgcgcatcggcgccccggctgcttctgctctttctggttccgctgctgtgggccccggctgcggtccgggccggcccagatgaagaccttagccaccggaacaaagaaccgccggcgccggcccagcagctgcagccgcagcctgtggctgtgcagggccccgagccggcccgggtcgagaaaatatttacaccagcagctccagttcataccaataaagaagatcctgctacccaaactaatttgggatttatccatgcatttgtcgctgccatatcagttattattgtatctgaattgggtgataagacattttttatagcagccatcatggcaatgcgctataaccgcctgaccgtgctggctggtgcaatgcttgccttgggactaatgacatgcttgtcagttttgtttggctatgccaccacagtcatccccagggtctatacatactatgtttcaactgtattatttgccatttttggcattagaatgcttcgggaaggcttaaagatgagccctgatgagggtcaagaggaactggaagaagttcaagctgaattaaagaagaaagatgaagaatttcaacgaaccaaacttttaaatggaccgggagatgttgaaacgggtacaagcataacagtacctcagaaaaagtggttgcattttatttcacccatttttgttcaagctcttacattaacattcttagcagaatggggtgatcgctctcaactaactacaattgtattggcagctagagaggacccctatggtgtagccgtgggtggaactgtggggcactgcctgtgcacgggattggcagtaattggaggaagaatgatagcacagaaaatctctgtcagaactgtgacaatcataggaggcatcgtttttttggcgtttgcattttctgcactatttataagccctgattctggtttttaacaagctgtttgttcatctatatttagtttaaaataggtagtattatctttctgtacatagtgtacattacaactaaaagtgatggaaaaatactgtattttgtagcactgattttgtgagtttgacccattattatgtctgagatataatcattgattctatttgtaacaaggagttttaaaagaaacctgacttctaagtgtgggtttttcttctctccaacataattatgttaatatggtcctcatttttcttttggtgcagaaccgttgtgcagtggggtctaccatgcaattttctttcagcactgacccctttttaaggaatacaaattttctccttcatcacttaggtgttttaagatgtttaccttaaagtttttcttggggaaagaatgaattaatttctatttcttaaaacatttccctgagccagtaaacagtagtttaatcattggtcttttcaaaactaggtgtttaaaaaaagagacatatatgatattgctgttatatcaataacatggcacaacaagaactgtctgccaggtcattcttcctcttttttttttaattgggtaggacacccaatataaaaacagtcaatatttgacaatgtggaattaccaaattaaaagagaatactatgaatgtattcatattttttctatatctattaatgggaaattaaagccgaaatgtttgaacccaatagagattgaaccaaattatttgacgaatagaaaggacacgaccgagaacatgtcccacgcagcgcatcggagcgacaaagaaacaagggaacaacgagcacgggggcgccaagatactggcgcggcggcgcggcggacaacaaaggcgcgaaagatggacgagggcgacgcggggcccacaaaggaccgcaccagagcaagca

SEQ ID NO: 356832 - DNA, 1861 bp, Homo sapiens
acggggccgggaggagtcggggctgggccgcgccgaggcagctggctgactccagtttagccgccgccggagaggacgggcgccgagccggggctgcggacttcggcctgcccctcacctcactcccgctgcttgcacctcccggatggtgctgactgctccctaagcggcggcggcggcgagtcgtgaggacgcgccgcggaggctgttcggggtcgaggcttcccgtcgccggcacttcctcttgcggcgcccgtgcgcggccggcccggcaggcgggatggcggccgcggctccagggaacggccgcgcatcggcgccccggctgcttctgctctttctggttccgctgctgtgggccccggctgcgaaaatatttacaccagcagctccagttcataccaataaagaagatcctgctacccaaactaatttgggatttatccatgcatttgtcgctgccatatcagttattattgtatctgaattgggtgataagacattttttatagcagccatcatggcaatgcgctataaccgcctgaccgtgctggctggtgcaatgcttgccttgggactaatgacatgcttgtcagttttgtttggctatgccaccacagtcatccccagggtctatacatactatgtttcaactgtattatttgccatttttggcattagaatgcttcgggaaggcttaaagatgagccctgatgagggtcaagaggaactggaagaagttcaagctgaattaaagaagaaagatgaagaatttcaacgaaccaaacttttaaatggaccgggagatgttgaaacgggtacaagcataacagtacctcagaaaaagtggttgcattttatttcacccatttttgttcaagctcttacattaacattcttagcagaatggggtgatcgctctcaactaactacaattgtattggcagctagagaggacccctatggtgtagccgtgggtggaactgtggggcactgcctgtgcacgggattggcagtaattggaggaagaatgatagcacagaaaatctctgtcagaactgtgacaatcataggaggcatcgtttttttggcgtttgcattttctgcactatttataagccctgattctggtttttaacaagctgtttgttcatctatatttagtttaaaataggtagtattatctttctgtacatagtgtacattacaactaaaagtgatggaaaaatactgtattttgtagcactgattttgtgagtttgacccattattatgtctgagatataatcattgattctatttgtaacaaggagttttaaaagaaacctgacttctaagtgtgggtttttcttctctccaacataattatgttaatatggtcctcatttttcttttggtgcagaaccgttgtgcagtggggtctaccatgcaattttctttcagcactgacccctttttaaggaatacaaattttctccttcatcacttaggtgttttaagatgtttaccttaaagtttttcttggggaaagaatgaattaatttctatttcttaaaacatttccctgagccagtaaacagtagtttaatcattggtcttttcaaaactaggtgtttaaaaaaagagacatatatgatattgctgttatatcaataacatggcacaacaagaactgtctgccaggtcattcttcctcttttttttttaattgggtaggacacccaatataaaaacagtcaatatttgacaatgtggaattaccaaattaaaagagaatactatgaatgtattcatattttttctatattgaataaacaatgtaacatagataacaatataaataaaagtggtatgaccagtg

SEQ ID NO: 356833 - DNA, 1416 bp, Homo sapiens
acggggccgggaggagtcggggctgggccgcgccgaggcagctggctgactccagtttagccgccgccggagaggacgggcgccgagccggggctgcggacttcggcctgcccctcacctcactcccgctgcttgcacctcccggatggtgctgactgctccctaagcggcggcggcggcgagtcgtgaggacgcgccgcggaggctgttcggggtcgaggcttcccgtcgccggcacttcctcttgcggcgcccgtgcgcggccggcccggcaggcgggatggcggccgcggctccagggaacggccgcgcatcggcgccccggctgcttctgctctttctggttccgctgctgtgggccccggctgcggtccgggccggcccagatgaagaccttagccaccggaacaaagaaccgccggcgccggcccagcagctgcagccgcagcctgtggctgtgcagggccccgagccggcccgggtcgagaaaatatttacaccagcagctccagttcataccaataaagaagatcctgctacccaaactaatttgggatttatccatgcatttgtcgctgccatatcagttattattgtatctgaattgggtgataagacattttttatagcagccatcatggcaatgcgctataaccgcctgaccgtgctggctggtgcaatgcttgccttgggactaatgacatgcttgtcagttttgtttggctatgccaccacagtcatccccagggtctatacatactatgtttcaactgtattatttgccatttttggcattagaatgcttcgggaaggcttaaagatgagccctgatgagggtcaagaggaactggaagaagttcaagctgaattaaagaagaaagatgaagaatttcaacgaaccaaacttttaaatggaccgggagatgttgaaacgggtacaagcataacagtacctcagaaaaagtggttgcattttatttcacccatttttgttcaagctcttacattaacattcttagcagaatggggtgatcgctctcaactaactacaattgtattggcagctagagaggacccctatggtgtagccgtgggtggaactgtggggcactgcctgtgcacgggattggcagtaattggaggaagaatgatagcacagaaaatctctgtcagaactgtgacaatcataggaggcatcgtttttttggcgtttgcattttctgcactatttataagccctgattctggtttttaacaagctgtttgttcatctatatttagtttaaaataggtagtattatctttctgtacatagtgtacattacaactaaaagtgatggaatataaaccattatctattataacaaggatttttaaagaaacctacttgtaagttggtttttctttttccacata

SEQ ID NO: 356834 - DNA, 1971 bp, Homo sapiens
caaaaaaaaaaaaaaaaagggaattttaatgcatggatatagcaggtctgtactctgttcttaaaattgttttggagaattatatgtaaatctgcattatacatgtttagtatcctcaatctaaaatccacagtgctccaaaatctgaaacttgagcactgacatacatgaaatgctcaatggaacattttggatttctggattaggggtactcagctatgatataaatattccaaaatctaaaaaaatccaaaattccaactacttctggtcccatacatttcaggtaagggatactcaaattgtagcaaccatcgtcagaggttaccgtcgttactgatggctttcagagtgattagacagtaaataagtgtaatgaccatgacaagaaaattttcaaaaaaactaaatcttatttacgtgcaaaataaaataattttgaataatgattttaagaagtaactgattttttttttccagaaaatatttacaccagcagctccagttcataccaataaagaagatcctgctacccaaactaatttgggatttatccatgcatttgtcgctgccatatcagttattattgtatctgaattgggtgataagacattttttatagcagccatcatggcaatgcgctataaccgcctgaccgtgctggctggtgcaatgcttgccttgggactaatgacatgcttgtcagttttgtttggctatgccaccacagtcatccccagggtctatacatactatgtttcaactgtattatttgccatttttggcattagaatgcttcgggaaggcttaaagatgagccctgatgagggtcaagaggaactggaagaagttcaagctgaattaaagaagaaagatgaagaatttcaacgaaccaaacttttaaatggaccgggagatgttgaaacgggtacaagcataacagtacctcagaaaaagtggttgcattttatttcacccatttttgttcaagctcttacattaacattcttagcagaatggggtgatcgctctcaactaactacaattgtattggcagctagagaggacccctatggtgtagccgtgggtggaactgtggggcactgcctgtgcacgggattggcagtaattggaggaagaatgatagcacagaaaatctctgtcagaactgtgacaatcataggaggcatcgtttttttggcgtttgcattttctgcactatttataagccctgattctggtttttaacaagctgtttgttcatctatatttagtttaaaataggtagtattatctttctgtacatagtgtacattacaactaaaagtgatggaaaaatactgtattttgtagcactgattttgtgagtttgacccattattatgtctgagatataatcattgattctatttgtaacaaggagttttaaaagaaacctgacttctaagtgtgggtttttcttctctccaacataattatgttaatatggtcctcatttttcttttggtgcagaaccgttgtgcagtggggtctaccatgcaattttctttcagcactgacccctttttaaggaatacaaattttctccttcatcacttaggtgttttaagatgtttaccttaaagtttttcttggggaaagaatgaattaatttctatttcttaaaacatttccctgagccagtaaacagtagtttaatcattggtcttttcaaaactaggtgtttaaaaaaagagacatatatgatattgctgttatatcaataacatggcacaacaagaactgtctgccaggtcattcttcctcttttttttttaattgggtaggacacccaatataaaaacagtcaatatttgacaatgtggaattaccaaattaaaagagaatactatgaatgtattcatattttttctatattgaataaacaatgtaacatagataacaatataaataaaagtggtatgaccagtg

SEQ ID NO: 356835 - DNA, 1681 bp, Homo sapiens
acggggccgggaggagtcggggctgggccgcgccgaggcagctggctgactccagtttagccgccgccggagaggacgggcgccgagccggggctgcggacttcggcctgcccctcacctcactcccgctgcttgcacctcccggatggtgctgactgctccctaagcggcggcggcggcgagtcgtgaggacgcgccgcggaggctgttcggggtcgaggcttcccgtcgccggcacttcctcttgcggcgcccgtgcgcggccggcccggcaggcgggatggcggccgcggctccagggaacggccgcgcatcggcgccccggctgcttctgctctttctggttccgctgctgtgggccccggctgcggtccgggccggcccagatgaagaccttagccaccggaacaaagaaccgccggcgccggcccagcagctgcagccgcagcctgtggctgtgcagggccccgagccggcccgggtcgagaaaatatttacaccagcagctccagttcataccaataaagaagatcctgctacccaaactaatttgggatttatccatgcatttgtcgctgccatatcagttattattgtatctgaattgggtgataagacattttttatagcagccatcatggcaatgcgctataaccgcctgaccgtgctggctggtgcaatgcttgccttgggactaatgacatgcttgtcagttttgtttggctatgccaccacagtcatccccagggtctatacatactatgtttcaactgtattatttgccatttttggcattagaatgcttcgggaaggcttaaagatgagccctgatgagggtcaagaggaactggaagaagttcaagctgaattaaagaagaaagatgaagaatttcaacgaaccaaacttttaaatggaccgggagatgttgaaacgggtacaagcataacagtacctcagaaaaagtggttgcattttatttcacccatttttgttcaagctcttacattaacattcttagcagaatggggtgatcgctctcaactaactacaattgtattggcagctagagaggtgagtgatatttgagaggagactgtttaaaatgaaacgtaattattattactttgttccagaaaacactggacacactgaagtgggccacagcattccttcatatgcaagactgttttacatctgataattcagctgctctctaaaattggccttctcccagttcctgctacctgcaggacccctatggtgtagccgtgggtggaactgtggggcactgcctgtgcacgggattggcagtaattggaggaagaatgatagcacagaaaatctctgtcagaactggtagtttctctccctggctcatcttgcatgcttgctctgatggaaaaggtcacctggaaaggaactgaggatagccttcagccagcaagaaaccaaggccctcagtccaactgcccatgaggaactgaagtgtgccagcaaccactaagtgaggtggaaacagatgccacctcagttgaactttgagatgactgtggctcccaccaacaccttgattacagcctcatgaaagaatctgaagtagagggtccagctaaactgtgcctggactcttgactcaccaaactaggagataacaagtgtgttgttttatatcactaaatt

SEQ ID NO: 356836 - DNA, 2094 bp, Homo sapiens
acggggccgggaggagtcggggctgggccgcgccgaggcagctggctgactccagtttagccgccgccggagaggacgggcgccgagccggggctgcggacttcggcctgcccctcacctcactcccgctgcttgcacctcccggatggtgctgactgctccctaagcggcggcggcggcgagtcgtgaggacgcgccgcggaggctgttcggggtcgaggcttcccgtcgccggcacttcctcttgcggcgcccgtgcgcggccggcccggcaggcgggatggcggccgcggctccagggaacggccgcgcatcggcgccccggctgcttctgctctttctggttccgctgctgtgggccccggctgcggtccgggccggcccagatgaagaccttagccaccggaacaaagaaccgccggcgccggcccagcagctgcagccgcagcctgtggctgtgcagggccccgagccggcccgggtcgagaaaatatttacaccagcagctccagttcataccaataaagaagatcctgctacccaaactaatttgggatttatccatgcatttgtcgctgccatatcagttattattgtatctgaattgggtgataagacattttttatagcagccatcatggcaatgcgctataaccgcctgaccgtgctggctggtgcaatgcttgccttgggactaatgacatgcttgtcagagacaggatttcgccatgttgaccagtggtctcaagctcctgggctcaagtaatccgcccgactcggtctcccaaagtgctgggattacaggcatgagccaccgtgcctggccagattttgtttggctatgccaccacagtcatccccagggtctatacatactatgtttcaactgtattatttgccatttttggcattagaatgcttcgggaaggcttaaagatgagccctgatgagggtcaagaggaactggaagaagttcaagctgaattaaagaagaaagatgaagaatttcaacgaaccaaacttttaaatggaccgggagatgttgaaacgggtacaagcataacagtacctcagaaaaagtggttgcattttatttcacccatttttgttcaagctcttacattaacattcttagcagaatggggtgatcgctctcaactaactacaattgtattggcagctagagaggacccctatggtgtagccgtgggtggaactgtggggcactgcctgtgcacgggattggcagtaattggaggaagaatgatagcacagaaaatctctgtcagaactgtgacaatcataggaggcatcgtttttttggcgtttgcattttctgcactatttataagccctgattctggtttttaacaagctgtttgttcatctatatttagtttaaaataggtagtattatctttctgtacatagtgtacattacaactaaaagtgatggaaaaatactgtattttgtagcactgattttgtgagtttgacccattattatgtctgagatataatcattgattctatttgtaacaaggagttttaaaagaaacctgacttctaagtgtgggtttttcttctctccaacataattatgttaatatggtcctcatttttcttttggtgcagaaccgttgtgcagtggggtctaccatgcaattttctttcagcactgacccctttttaaggaatacaaattttctccttcatcacttaggtgttttaagatgtttaccttaaagtttttcttggggaaagaatgaattaatttctatttcttaaaacatttccctgagccagtaaacagtagtttaatcattggtcttttcaaaactaggtgtttaaaaaaagagacatatatgatattgctgttatatcaataacatggcacaacaagaactgtctgccaggtcattcttcctcttttttttttaattgggtaggacacccaatataaaaacagtcaatatttgacaatgtggaattaccaaattaaaagagaatactatgaatgtattcatattttttctatattgaataaacaatgtaacatagataacaatataaataaaagtggtatgaccagtg

SEQ ID NO: 356837 - DNA, 1857 bp, Homo sapiens
gaatgtttgagcctgttgtaacattattttaatataataagaaatttttagatttttttcataaaacgtacttattttaaatagttacaagggagcagagtttaaatcttgctatgtgagacttttgtcatgattcttcactagaagtttgtgatttaaagatttgtgatgaagaaattccactatgcaagtggcatggcttcccagttataaaatctcagctcttgagagggcctcagagctaacttctaccccaggtactgtgccttgcacaacataaggcaagccagcctctgactgaacatgcctggaaaggagttcaatatcttacttaacatctctcaggaagatgtgccatcttcaactggaccattggcttctgagtaagctgtgttaggcctgggctagacctaatggtttattattggtggagagaaagatctggaaatacttgaggttattacatactagattagcttctaatgtgaaccatttttcttttaacagtgataaattattatttccgaagttaactgttcccttggtcgtgatacacactcgattaacaaacatactgttgtattttttccagttttgtttggctatgccaccacagtcatccccagggtctatacatactatgtttcaactgtattatttgccatttttggcattagaatgcttcgggaaggcttaaagatgagccctgatgagggtcaagaggaactggaagaagttcaagctgaattaaagaagaaagatgaagaatttcaacgaaccaaacttttaaatggaccgggagatgttgaaacgggtacaagcataacagtacctcagaaaaagtggttgcattttatttcacccatttttgttcaagctcttacattaacattcttagcagaatggggtgatcgctctcaactaactacaattgtattggcagctagagaggacccctatggtgtagccgtgggtggaactgtggggcactgcctgtgcacgggattggcagtaattggaggaagaatgatagcacagaaaatctctgtcagaactgtgacaatcataggaggcatcgtttttttggcgtttgcattttctgcactatttataagccctgattctggtttttaacaagctgtttgttcatctatatttagtttaaaataggtagtattatctttctgtacatagtgtacattacaactaaaagtgatggaaaaatactgtattttgtagcactgattttgtgagtttgacccattattatgtctgagatataatcattgattctatttgtaacaaggagttttaaaagaaacctgacttctaagtgtgggtttttcttctctccaacataattatgttaatatggtcctcatttttcttttggtgcagaaccgttgtgcagtggggtctaccatgcaattttctttcagcactgacccctttttaaggaatacaaattttctccttcatcacttaggtgttttaagatgtttaccttaaagtttttcttggggaaagaatgaattaatttctatttcttaaaacatttccctgagccagtaaacagtagtttaatcattggtcttttcaaaactaggtgtttaaaaaaagagacatatatgatattgctgttatatcaataacatggcacaacaagaactgtctgccaggtcattcttcctcttttttttttaattgggtaggacacccaatataaaaacagtcaatatttgacaatgtggaattaccaaattaaaagagaatactatgaatgtattcatattttttctatattgaataaacaatgtaacatagataacaatataaataaaagtggtatgaccagtg

SEQ ID NO: 356838 - DNA, 2573 bp, Homo sapiens
gaatgtttgagcctgttgtaacattattttaatataataagaaatttttagatttttttcataaaacgtacttattttaaatagttacaagggagcagagtttaaatcttgctatgtgagacttttgtcatgattcttcactagaagtttgtgatttaaagatttgtgatgaagaaattccactatgcaagtggcatggcttcccagttataaaatctcagctcttgagagggcctcagagctaacttctaccccaggtactgtgccttgcacaacataaggcaagccagcctctgactgaacatgcctggaaaggagttcaatatcttacttaacatctctcaggaagatgtgccatcttcaactggaccattggcttctgagtaagctgtgttaggcctgggctagacctaatggtttattattggtggagagaaagatctggaaatacttgaggttattacatactagattagcttctaatgtgaaccatttttcttttaacagtgataaattattatttccgaagttaactgttcccttggtcgtgatacacactcgattaacaaacatactgttgtattttttccagttttgtttggctatgccaccacagtcatccccagggtctatacatactatgtttcaactgtattatttgccatttttggcattagaatgcttcgggaaggcttaaagatgagccctgatgagggtcaagaggaactggaagaagttcaagctgaattaaagaagaaagatgaagaatttcaacgaaccaaacttttaaatggaccgggagatgttgaaacggaaaacactggacacactgaagtgggccacagcattccttcatatgcaagactgttttacatctgataattcagctgctctctaaaattggccttctcccagttcctgctacctgcaggacccctatggtgtagccgtgggtggaactgtggggcactgcctgtgcacgggattggcagtaattggaggaagaatgatagcacagaaaatctctgtcagaactggtaagtcttgaaaattacaaatcagataacattttagaatcactgagagattaaagggtgttagctttgattatttaaatttctgctgctgaagtatacttggtttttctaattacctaccatctcttataataagaggtattaatcctggtattgcaaatacggacttttttcacctgtgtagaagttagcaaaatacaaagtcatttttatcgaattcatagtagcttcttgttaacatattatcttagtaaaacaattgtcatttggaagtatgagaagtttttggctctaaaaatgtgtcttacaagactggaatcatgtggagaccatatgtactgattctgctgaatatgtcctgtgaagccacagttaggtctagagatggaagaatcgtctctttgctagtcagaagacctgaacattttcttttataactggattttaagatgagttatagttctactgttgcttgccagcactgtctggatttaatacaatcctgtcatttctcaaaacagtgctggagaaaacctgattcttagtgttcacagtcaagcatgttaagtattgttccttgttatgtaaaaggggttgaagtgattctaatttgttttcaaggttagtttaatagattggaagaataattggccgcctcatcggctcccttttcattttgtacagtatcaaggtataggaattttactgtatttgactttttttctctctcttccagtgacaatcataggaggcatcgtttttttggcgtttgcattttctgcactatttataagccctgattctggtttttaacaagctgtttgttcatctatatttagtttaaaataggtagtattatctttctgtacatagtgtacattacaactaaaagtgatggaaaaatactgtattttgtagcactgattttgtgagtttgacccattattatgtctgagatataatcattgattctatttgtaacaaggagttttaaaagaaacctgacttctaagtgtgggtttttcttctctccaacataattatgttaatatggtcctcatttttcttttggtgcagaaccgttgtgcagtggggtctaccatgcaattttctttcagcactgacccctttttaaggaatacaaattttctccttcatcacttaggtgttttaagatgtttaccttaaagtttttcttggggaaagaatgaattaatttctatttcttaaaacatttccctgagccagtaaacagtagtttaatcattggtcttttcaaaactaggtgtttaaaaaaagagacatatatgatattgctgttatatcaataacatggcacaacaagaactgtctgccaggtcattcttcctcttttttttttaattgggtaggacacccaatataaaaacagtcaatatttgacaatgtggaattaccaaattaaaagagaatactatgaatgtattcatattttttctatattgaataaacaatgtaacatagataacaatataaataaaagtggtatgaccagtg

SEQ ID NO: 356839 - DNA, 1393 bp, Homo sapiens
acggggccgggaggagtcggggctgggccgcgccgaggcagctggctgactccagtttagccgccgccggagaggacgggcgccgagccggggctgcggacttcggcctgcccctcacctcactcccgctgcttgcacctcccggatggtgctgactgctccctaagcggcggcggcggcgagtcgtgaggacgcgccgcggaggctgttcggggtcgaggcttcccgtcgccggcacttcctcttgcggcgcccgtgcgcggccggcccggcaggcgggatggcggccgcggctccagggaacggccgcgcatcggcgccccggctgcttctgctctttctggttccgctgctgtgggccccggctgcggtccgggccggcccagatgaagaccttagccaccggaacaaagaaccgccggcgccggcccagcagctgcagccgcagcctgtggctgtgcagggccccgagccggcccgggtcgaggacccctatggtgtagccgtgggtggaactgtggggcactgcctgtgcacgggattggcagtaattggaggaagaatgatagcacagaaaatctctgtcagaactgtgacaatcataggaggcatcgtttttttggcgtttgcattttctgcactatttataagccctgattctggtttttaacaagctgtttgttcatctatatttagtttaaaataggtagtattatctttctgtacatagtgtacattacaactaaaagtgatggaaaaatactgtattttgtagcactgattttgtgagtttgacccattattatgtctgagatataatcattgattctatttgtaacaaggagttttaaaagaaacctgacttctaagtgtgggtttttcttctctccaacataattatgttaatatggtcctcatttttcttttggtgcagaaccgttgtgcagtggggtctaccatgcaattttctttcagcactgacccctttttaaggaatacaaattttctccttcatcacttaggtgttttaagatgtttaccttaaagtttttcttggggaaagaatgaattaatttctatttcttaaaacatttccctgagccagtaaacagtagtttaatcattggtcttttcaaaactaggtgtttaaaaaaagagacatatatgatattgctgttatatcaataacatggcacaacaagaactgtctgccaggtcattcttcctcttttttttttaattgggtaggacacccaatataaaaacagtcaatatttgacaatgtggaattaccaaattaaaagagaatactatgaatgtattcatattttttctatattgaataaacaatgtaacatagataacaatataaataaaagtggtatgaccagtg

SEQ ID NO: 356840 - DNA, 2127 bp, Homo sapiens
cataaatgtagtttttttggagcatatttcatagaatttaaacacttagaaaagtcaagtgatttgtgtgctattttgatttgcttcctgtgcttactttcatttgtttattatttattttagtttcaacgaaccaaacttttaaatggaccgggagatgttgaaacgggtacaagcataacagtacctcagaaaaagtggttgcattttatttcacccatttttgttcaagctcttacattaacattcttagcagaatggggtgatcgctctcaactaactacaattgtattggcagctagagaggtgagtgatatttgagaggagactgtttaaaatgaaacgtaattattattactttgttccagaaaacactggacacactgaagtgggccacagcattccttcatatgcaagactgttttacatctgataattcagctgctctctaaaattggccttctcccagttcctgctacctgcaggacccctatggtgtagccgtgggtggaactgtggggcactgcctgtgcacgggattggcagtaattggaggaagaatgatagcacagaaaatctctgtcagaactggtaagtcttgaaaattacaaatcagataacattttagaatcactgagagattaaagggtgttagctttgattatttaaatttctgctgctgaagtatacttggtttttctaattacctaccatctcttataataagaggtattaatcctggtattgcaaatacggacttttttcacctgtgtagaagttagcaaaatacaaagtcatttttatcgaattcatagtagcttcttgttaacatattatcttagtaaaacaattgtcatttggaagtatgagaagtttttggctctaaaaatgtgtcttacaagactggaatcatgtggagaccatatgtactgattctgctgaatatgtcctgtgaagccacagttaggtctagagatggaagaatcgtctctttgctagtcagaagacctgaacattttcttttataactggattttaagatgagttatagttctactgttgcttgccagcactgtctggatttaatacaatcctgtcatttctcaaaacagtgctggagaaaacctgattcttagtgttcacagtcaagcatgttaagtattgttccttgttatgtaaaaggggttgaagtgattctaatttgttttcaaggttagtttaatagattggaagaataattggccgcctcatcggctcccttttcattttgtacagtatcaaggtataggaattttactgtatttgactttttttctctctcttccagtgacaatcataggaggcatcgtttttttggcgtttgcattttctgcactatttataagccctgattctggtttttaacaagctgtttgttcatctatatttagtttaaaataggtagtattatctttctgtacatagtgtacattacaactaaaagtgatggaaaaatactgtattttgtagcactgattttgtgagtttgacccattattatgtctgagatataatcattgattctatttgtaacaaggagttttaaaagaaacctgacttctaagtgtgggtttttcttctctccaacataattatgttaatatggtcctcatttttcttttggtgcagaaccgttgtgcagtggggtctaccatgcaattttctttcagcactgacccctttttaaggaatacaaattttctccttcatcacttaggtgttttaagatgtttaccttaaagtttttcttggggaaagaatgaattaatttctatttcttaaaacatttccctgagccagtaaacagtagtttaatcattggtcttttcaaaactaggtgtttaaaaaaagagacatatatgatattgctgttatatcaataacatggcacaacaagaactgtctgccaggtcattcttcctcttttttttttaattgggtaggacacccaatataaaaacagtcaatatttgacaatgtggaattaccaaattaaaagagaatactatgaatgtattcatattttttctatattgaataaacaatgtaacatagataacaatataaataaaagtggtatgaccagtg

SEQ ID NO: 356841 - DNA, 1837 bp, Homo sapiens
gaatgtttgagcctgttgtaacattattttaatataataagaaatttttagatttttttcataaaacgtacttattttaaatagttacaagggagcagagtttaaatcttgctatgtgagacttttgtcatgattcttcactagaagtttgtgatttaaagatttgtgatgaagaaattccactatgcaagtggcatggcttcccagttataaaatctcagctcttgagagggcctcagagctaacttctaccccaggtactgtgccttgcacaacataaggcaagccagcctctgactgaacatgcctggaaaggagttcaatatcttacttaacatctctcaggaagatgtgccatcttcaactggaccattggcttctgagtaagctgtgttaggcctgggctagacctaatggtttattattggtggagagaaagatctggaaatacttgaggttattacatactagattagcttctaatgtgaaccatttttcttttaacagtgataaattattatttccgaagttaactgttcccttggtcgtgatacacactcgattaacaaacatactgttgtattttttccagttttgtttggctatgccaccacagtcatccccagggtctatacatactatgtttcaactgtattatttgccatttttggcattagaatgcttcgggaaggcttaaagatgagccctgatgagggtcaagaggaactggaagaagttcaagctgaattaaagaagaaagatgaagaatttcaacgaaccaaacttttaaatggaccgggagatgttgaaacggaaaacactggacacactgaagtgggccacagcattccttcatatgcaagactgttttacatctgataattcagctgctctctaaaattggccttctcccagttcctgctacctgcaggacccctatggtgtagccgtgggtggaactgtggggcactgcctgtgcacgggattggcagtaattggaggaagaatgatagcacagaaaatctctgtcagaactgtgacaatcataggaggcatcgtttttttggcgtttgcattttctgcactatttataagccctgattctggtttttaacaagctgtttgttcatctatatttagtttaaaataggtagtattatctttctgtacatagtgtacattacaactaaaagtgatggaaaaatactgtattttgtagcactgattttgtgagtttgacccattattatgtctgagatataatcattgattctatttgtaacaaggagttttaaaagaaacctgacttctaagtgtgggtttttcttctctccaacataattatgttaatatggtcctcatttttcttttggtgcagaaccgttgtgcagtggggtctaccatgcaattttctttcagcactgacccctttttaaggaatacaaattttctccttcatcacttaggtgttttaagatgtttaccttaaagtttttcttggggaaagaatgaattaatttctatttcttaaaacatttccctgagccagtaaacagtagtttaatcattggtcttttcaaaactaggtgtttaaaaaaagagacatatatgatattgctgttatatcaataacatggcacaacaagaactgtctgccaggtcattcttcctcttttttttttaattgggtaggacacccaatataaaaacagtcaatatttgacaatgtggaattaccaaattaaaagagaatactatgaatgtattcatattttttctatattgaataaacaatgtaacatagataacaatataaataaaagtggtatgaccagtg

SEQ ID NO: 356842 - DNA, 1902 bp, Homo sapiens
  misc_feature (1)..(5): n is a, c, g, or t
  misc_feature (8)..(9): n is a, c, g, or t
  misc_feature (788)..(788): n is a, c, g, or t
  misc_feature (865)..(865): n is a, c, g, or t
nnnnncgnntagctgggaccacttgtgcttgctaggatgcctggctaatttttaatttttttgtagagatgaggtcccactgtgttgcctaggctagtctcaaactgccaggctcaagcaatcctcttgcttcagcctcccaaagtgttgggattacaggcatgagccactgcacctggcctagcggatttctgaagcattaatctgttctgttactttccagctaaaaaccaacaagtgtctgaggacacagtttaaactccaagatgatagggtcctccctcacctgggctcccacctaccctcatgacctccttttgtgaaatgctgaagggctctgcagctggttgtctggtactgctggcctttgctttctatttagcatgttccttctcccacaaaacaaaatcacattctcactatgccctgttcattcttcaggactatcttctgggaaacttttactacatacccctctccccctaatctgagtgtctgctttgctcaggtagcatgtgttcactggataaatccttgattcctggcactgaggcagggtttctgttcccaggaagcagaggcatactattctgtgaaggattgactgagtttctcctaataccaagcagtatctgagggaacagatgtctagcttaaaatcctccctagcacttgtcatagcagtgctacgtattgcctgtgaaggaagtttaataactgctgaaaggctcgattagctttatttcatcaggatttgtttgactttacaaattgatttgggttatttnaacttttaggtctagtcttaagtataactggtacatattccttcaagcagccattacacctttcataaatttattanacacctgcatttttataactattatgctttttaattgttggccaccatttttagtgcttctgaattgttatggttctcaagcagcagttgtcaccttggttttgaattaatgctgtgacgcttgcttccaggacccctatggtgtagccgtgggtggaactgtggggcactgcctgtgcacgggattggcagtaattggaggaagaatgatagcacagaaaatctctgtcagaactgtgacaatcataggaggcatcgtttttttggcgtttgcattttctgcactatttataagccctgattctggtttttaacaagctgtttgttcatctatatttagtttaaaataggtagtattatctttctgtacatagtgtacattacaactaaaagtgatggaaaaatactgtattttgtagcactgattttgtgagtttgacccattattatgtctgagatataatcattgattctatttgtaacaaggagttttaaaagaaacctgacttctaagtgtgggtttttcttctctccaacataattatgttaatatggtcctcatttttcttttggtgcagaaccgttgtgcagtggggtctaccatgcaattttctttcagcactgacccctttttaaggaatacaaattttctccttcatcacttaggtgttttaagatgtttaccttaaagtttttcttggggaaagaatgaattaatttctatttcttaaaacatttccctgagccagtaaacagtagtttaatcattggtcttttcaaaactaggtgtttaaaaaaagagacatatatgatattgctgttatatcaataacatggcacaacaagaactgtctgccaggtcattcttcctcttttttttttaattgggtaggacacccaatataaaaacagtcaatatttgacaatgtggaattaccaaattaaaagagaatactatgaatgtattcatattttttctatattgaataaacaatgtaacatagataacaatataaataaaagtggtatgaccagtg

SEQ ID NO: 356843 - DNA, 1602 bp, Homo sapiens
acggggccgggaggagtcggggctgggccgcgccgaggcagctggctgactccagtttagccgccgccggagaggacgggcgccgagccggggctgcggacttcggcctgcccctcacctcactcccgctgcttgcacctcccggatggtgctgactgctccctaagcggcggcggcggcgagtcgtgaggacgcgccgcggaggctgttcggggtcgaggcttcccgtcgccggcacttcctcttgcggcgcccgtgcgcggccggcccggcaggcgggatggcggccgcggctccagggaacggccgcgcatcggcgccccggctgcttctgctctttctggttccgctgctgtgggccccggctgcggtccgggccggcccagatgaagaccttagccaccggaacaaagaaccgccggcgccggcccagcagctgcagccgcagcctgtggctgtgcagggccccgagccggcccgggtcgaggtgagcgggccgggatggggcgagcgaggctgcagggccggctgcgccgagtaccaggctccaggcctttgaaagcgccgcactccgccggcctcggctgggggaggggagcccggcccctgctcccggggtggagggcggtcggctgcgctgttttccggtgaggcctggtcttgcccgctcctttagggaaagggagagggagagtccaagaggagcccgctataaacgttgatctccggagggccaagatgctgctccgggatgggcgttttattgatcagatgtgtcttagagtagctagaaagactcatccctaccaaaaagtttttaacagaaggctgctaggaggctttttgtattccctgaggatcatcacatcggccatttcattgttgaaatagcttatgccaaactgcttacccaaattcaacttggcactgcctgtgctttttgccaaatatggattatgaaccatgactctcactttttaaaaatgtgctttggctagcaggaagtagcctttaggaacgcagaggaattagtctccggcagtacagcgtgctgcagcgatgtgggatgccaaaactacatttataagtaaaacagaatcctgtattttgtccttccctgaatagatactagaaatcaactttttaatctgttaatagaattagtccttagtcacttggcagcgttttaacatttctcccttctcccagtcgtgggctttgtcgtcatttccagtatctgctccctgaatcccggccagtgtggcactcaaacccccactcccacccaggccacatccagcccatctccacgtaactaatcttcccgaacattgaattctgccatcttgtcagaagtcgtcggtgagttgcctccactaatttcagtccagcctttttaggagagtgatgttcaggtttcttctgatctggctccagctcacctccaggctttttagccaccgctttcttgctcatatgctaaagggatatgctcatctgcaaaaaagaatgtgcttcaagagccctttgggacaggctttgtgctctcttgccagttcctccctaacacaagaccttttcaaagaaaaaaaaaaaaagacc

SEQ ID NO: 356844 - DNA, 880 bp, Homo sapiens
acggggccgggaggagtcggggctgggccgcgccgaggcagctggctgactccagtttagccgccgccggagaggacgggcgccgagccggggctgcggacttcggcctgcccctcacctcactcccgctgcttgcacctcccggatggtgctgactgctccctaagcggcggcggcggcgagtcgtgaggacgcgccgcggaggctgttcggggtcgaggcttcccgtcgccggcacttcctcttgcggcgcccgtgcgcggccggcccggcaggcgggatggcggccgcggctccagggaacggccgcgcatcggcgccccggctgcttctgctctttctggttccgctgctgtgggccccggctgcggtccgggccggcccagatgaagaccttagccaccggaacaaagaaccgccggcgccggcccagcagctgcagccgcagcctgtggctgtgcagggccccgagccggcccgggtcgagtcgtgggctttgtcgtcatttccagtatctgctccctgaatcccggccagtgtggcactcaaacccccactcccacccaggccacatccagcccatctccacgtaactaatcttcccgaacattgaattctgccatcttgtcagaagtcgtcggtgagttgcctccactaatttcagtccagcctttttaggagagtgatgttcaggtttcttctgatctggctccagctcacctccaggctttttagccaccgctttcttgctcatatgctaaagggatatgctcatctgcaaaaaagaatgtgcttcaagagccctttgggacaggctttgtgctctcttgccagttcctccctaacacaagaccttttcaaagaaaaaaaaaaaaagacc

SEQ ID NO: 356845 - DNA, 220 bp, Homo sapiens
atagataacaatataaataaaagtggtatgaccagtgcttgtttttccttgtgtgtcatataaaattatcagtattgataggccaatttctaaagctgatgtaaaaacactaacatattaaatatttgagatatgcctaaagtagctaaacaggagccaggcattgttcgaaagcattgtcacccttacagttctgtgaggtagtaggtactaatataag

SEQ ID NO: 356846 - DNA, 1892 bp, Homo sapiens
gcacgaggcaggccgaagtccgcagccccggctcggctcccgctgcttgcacctcccggatggtgctgactgctccctaagcggcggcggcggcgagtcgtgaggacgcgccgcggaggctgttcggggtcgaggcttcccgtcgccggcacttcctcttgcggcgcccgtgcgcggccggcccggcaggcgggatggcggccgcggctccagggaacggccgcgcatcggcgccccggctgcttctgctctttctggttccgctgctgtgggccccggctgcggtccgggccggcccagatgaagaccttagccaccggaacaaagaaccgccggcgccggcccagcagctgcagccgcagcctgtggctgtgcagggccccgagccggcccgggtcgagaaaatatttacaccagcagctccagttcataccaataaagaagatcctgctacccaaactaatttgggatttatccatgcatttgtcgctgccatatcagttattattgtatctgaattgggtgataagacattttttatagcagccatcatggcaatgcgctataaccgcctgaccgtgctggctggtgcaatgcttgccttgggactaatgacatgcttgtcagttttgtttggctatgccaccacagtcatccccagggtctatacatactatgtttcaactgtattatttgccatttttggcattagaatgcttcgggaaggcttaaagatgagccctgatgagggtcaagaggaactggaagaagttcaagctgaattaaagaagaaagatgaagaatttcaacgaaccaaacttttaaatggaccgggagatgttgaaacgggtacaagcataacagtacctcagaaaaagtggttgcattttatttcacccatttttgttcaagctcttacattaacattcttagcagaatggggtgatcgctctcaactaactacaattgtattggcagctagagaggacccctatggtgtagccgtgggtggaactgtggggcactgcctgtgcacgggattggcagtaattggaggaagaatgatagcacagaaaatctctgtcagaactgtgacaatcataggaggcatcgtttttttggcgtttgcattttctgcactatttataagccctgattctggtttttaacaagctgtttgttcatctatatttagtttaaaataggtagtattatctttctgtacatagtgtacattacaactaaaagtgatggaaaaatactgtattttgtagcactgattttgtgagtttgacccattattatgtctgagatataatcattgattctatttgtaacaaggagttttaaaagaaacctgacttctaagtgtgggtttttcttctctccaacataattatgttaatatggtcctcatttttcttttggtgcagaaccgttgtgcagtggggtctaccatgcaattttctttcagcactgacccctttttaaggaatacaaattttctccttcatcacttaggtgttttaagatgtttaccttaaagtttttcttggggaaagaatgaattaatttctatttcttaaaacatttccctgagccagtaaacagtagtttaatcattggtcttttcaaaactaggtgtttaaaaaaagagacatatatgatattgctgttatatcaataacatggcacaacaagaactgtctgccaggtcattcttcctcttttttttttaattgggtaggacacccaatataaaaacagtcaatatttgacaatgtggaattaccaaattaaaagagaatactatgaatgtattcatattttttctatattgaataaacaatgtaacatagataacaatataaataaaagtggtatgaccagtg

SEQ ID NO: 356847 - DNA, 2092 bp, Homo sapiens
acggggccgggaggagtcggggctgggccgcgccgaggcagctggctgactccagtttagccgccgccggagaggacgggcgccgagccggggctgcggacttcggcctgcccctcacctcactcccgctgcttgcacctcccggatggtgctgactgctccctaagcggcggcggcggcgagtcgtgaggacgcgccgcggaggctgttcggggtcgaggcttcccgtcgccggcacttcctcttgcggcgcccgtgcgcggccggcccggcaggcgggatggcggccgcggctccagggaacggccgcgcatcggcgccccggctgcttctgctctttctggttccgctgctgtgggccccggctgcggtccgggccggcccagatgaagaccttagccaccggaacaaagaaccgccggcgccggcccagcagctgcagccgcagcctgtggctgtgcagggccccgagccggcccgggtcgagaaaatatttacaccagcagctccagttcataccaataaagaagatcctgctacccaaactaatttgggatttatccatgcatttgtcgctgccatatcagttattattgtatctgaattgggtgataagacattttttatagcagccatcatggcaatgcgctataaccgcctgaccgtgctggctggtgcaatgcttgccttgggactaatgacatgcttgtcagttttgtttggctatgccaccacagtcatccccagggtctatacatactatgtttcaactgtattatttgccatttttggcattagaatgcttcgggaaggcttaaagatgagccctgatgagggtcaagaggaactggaagaagttcaagctgaattaaagaagaaagatgaagaatttcaacgaaccaaacttttaaatggaccgggagatgttgaaacgggtacaagcataacagtacctcagaaaaagtggttgcattttatttcacccatttttgttcaagctcttacattaacattcttagcagaatggggtgatcgctctcaactaactacaattgtattggcagctagagaggacccctatggtgtagccgtgggtggaactgtggggcactgcctgtgcacgggattggcagtaattggaggaagaatgatagcacagaaaatctctgtcagaactgtgacaatcataggaggcatcgtttttttggcgtttgcattttctgcactatttataagccctgattctggtttttaacaagctgtttgttcatctatatttagtttaaaataggtagtattatctttctgtacatagtgtacattacaactaaaagtgatggaaaaatactgtattttgtagcactgattttgtgagtttgacccattattatgtctgagatataatcattgattctatttgtaacaaggagttttaaaagaaacctgacttctaagtgtgggtttttcttctctccaacataattatgttaatatggtcctcatttttcttttggtgcagaaccgttgtgcagtggggtctaccatgcaattttctttcagcactgacccctttttaaggaatacaaattttctccttcatcacttaggtgttttaagatgtttaccttaaagtttttcttggggaaagaatgaattaatttctatttcttaaaacatttccctgagccagtaaacagtagtttaatcattggtcttttcaaaactaggtgtttaaaaaaagagacatatatgatattgctgttatatcaataacatggcacaacaagaactgtctgccaggtcattcttcctcttttttttttaattgggtaggacacccaatataaaaacagtcaatatttgacaatgtggaattaccaaattaaaagagaatactatgaatgtattcatattttttctatattgaataaacaatgtaacatagataacaatataaataaaagtggtatgaccagtgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaag

SEQ ID NO: 356848 - DNA, 2157 bp, Homo sapiens
acggggccgggaggagtcggggctgggccgcgccgaggcagctggctgactccagtttagccgccgccggagaggacgggcgccgagccggggctgcggacttcggcctgcccctcacctcactcccgctgcttgcacctcccggatggtgctgactgctccctaagcggcggcggcggcgagtcgtgaggacgcgccgcggaggctgttcggggtcgaggcttcccgtcgccggcacttcctcttgcggcgcccgtgcgcggccggcccggcaggcgggatggcggccgcggctccagggaacggccgcgcatcggcgccccggctgcttctgctctttctggttccgctgctgtgggccccggctgcggtccgggccggcccagatgaagaccttagccaccggaacaaagaaccgccggcgccggcccagcagctgcagccgcagcctgtggctgtgcagggccccgagccggcccgggtcgagaaaatatttacaccagcagctccagttcataccaataaagaagatcctgctacccaaactaatttgggatttatccatgcatttgtcgctgccatatcagttattattgtatctgaattgggtgataagacattttttatagcagccatcatggcaatgcgctataaccgcctgaccgtgctggctggtgcaatgcttgccttgggactaatgacatgcttgtcagttttgtttggctatgccaccacagtcatccccagggtctatacatactatgtttcaactgtattatttgccatttttggcattagaatgcttcgggaaggcttaaagatgagccctgatgagggtcaagaggaactggaagaagttcaagctgaattaaagaagaaagatgaagaatttcaacgaaccaaacttttaaatggaccgggagatgttgaaacgggtacaagcataacagtacctcagaaaaagtggttgcattttatttcacccatttttgttcaagctcttacattaacattcttagcagaatggggtgatcgctctcaactaactacaattgtattggcagctagagaggtgagtgatatttgagaggagactgtttaaaatgaaacgtaattattattactttgttccagaaaacactggacacactgaagtgggccacagcattccttcatatgcaagactgttttacatctgataattcagctgctctctaaaattggccttctcccagttcctgctacctgcaggacccctatggtgtagccgtgggtggaactgtggggcactgcctgtgcacgggattggcagtaattggaggaagaatgatagcacagaaaatctctgtcagaactgtgacaatcataggaggcatcgtttttttggcgtttgcattttctgcactatttataagccctgattctggtttttaacaagctgtttgttcatctatatttagtttaaaataggtagtattatctttctgtacatagtgtacattacaactaaaagtgatggaaaaatactgtattttgtagcactgattttgtgagtttgacccattattatgtctgagatataatcattgattctatttgtaacaaggagttttaaaagaaacctgacttctaagtgtgggtttttcttctctccaacataattatgttaatatggtcctcatttttcttttggtgcagaaccgttgtgcagtggggtctaccatgcaattttctttcagcactgacccctttttaaggaatacaaattttctccttcatcacttaggtgttttaagatgtttaccttaaagtttttcttggggaaagaatgaattaatttctatttcttaaaacatttccctgagccagtaaacagtagtttaatcattggtcttttcaaaactaggtgtttaaaaaaagagacatatatgatattgctgttatatcaataacatggcacaacaagaactgtctgccaggtcattcttcctcttttttttttaattgggtaggacacccaatataaaaacagtcaatatttgacaatgtggaattaccaaattaaaagagaatactatgaatgtattcatattttttctatattgaataaacaatgtaacatagataacaatataaataaaagtggtatgaccagtg

SEQ ID NO: 356849 - DNA, 2081 bp, Homo sapiens
acggggccgggaggagtcggggctgggccgcgccgaggcagctggctgactccagtttagccgccgccggagaggacgggcgccgagccggggctgcggacttcggcctgcccctcacctcactcccgctgcttgcacctcccggatggtgctgactgctccctaagcggcggcggcggcgagtcgtgaggacgcgccgcggaggctgttcggggtcgaggcttcccgtcgccggcacttcctcttgcggcgcccgtgcgcggccggcccggcaggcgggatggcggccgcggctccagggaacggccgcgcatcggcgccccggctgcttctgctctttctggttccgctgctgtgggccccggctgcggtccgggccggcccagatgaagaccttagccaccggaacaaagaaccgccggcgccggcccagcagctgcagccgcagcctgtggctgtgcagggccccgagccggcccgggtcgagggacatcagtttttttcttggtagcaagctgtagattttgtttcaaggaaagcatcttcatcttctctagtttcatcatgtatagatggagattccgatgcagaaaatatttacaccagcagctccagttcataccaataaagaagatcctgctacccaaactaatttgggatttatccatgcatttgtcgctgccatatcagttattattgtatctgaattgggtgataagacattttttatagcagccatcatggcaatgcgctataaccgcctgaccgtgctggctggtgcaatgcttgccttgggactaatgacatgcttgtcagttttgtttggctatgccaccacagtcatccccagggtctatacatactatgtttcaactgtattatttgccatttttggcattagaatgcttcgggaaggcttaaagatgagccctgatgagggtcaagaggaactggaagaagttcaagctgaattaaagaagaaagatgaagaatttcaacgaaccaaacttttaaatggaccgggagatgttgaaacgggtacaagcataacagtacctcagaaaaagtggttgcattttatttcacccatttttgttcaagctcttacattaacattcttagcagaatggggtgatcgctctcaactaactacaattgtattggcagctagagaggacccctatggtgtagccgtgggtggaactgtggggcactgcctgtgcacgggattggcagtaattggaggaagaatgatagcacagaaaatctctgtcagaactgtgacaatcataggaggcatcgtttttttggcgtttgcattttctgcactatttataagccctgattctggtttttaacaagctgtttgttcatctatatttagtttaaaataggtagtattatctttctgtacatagtgtacattacaactaaaagtgatggaaaaatactgtattttgtagcactgattttgtgagtttgacccattattatgtctgagatataatcattgattctatttgtaacaaggagttttaaaagaaacctgacttctaagtgtgggtttttcttctctccaacataattatgttaatatggtcctcatttttcttttggtgcagaaccgttgtgcagtggggtctaccatgcaattttctttcagcactgacccctttttaaggaatacaaattttctccttcatcacttaggtgttttaagatgtttaccttaaagtttttcttggggaaagaatgaattaatttctatttcttaaaacatttccctgagccagtaaacagtagtttaatcattggtcttttcaaaactaggtgtttaaaaaaagagacatatatgatattgctgttatatcaataacatggcacaacaagaactgtctgccaggtcattcttcctcttttttttttaattgggtaggacacccaatataaaaacagtcaatatttgacaatgtggaattaccaaattaaaagagaatactatgaatgtattcatattttttctatattgaataaacaatgtaacatagataacaatataaataaaagtggtatgaccagtg

SEQ ID NO: 356850 - DNA, 1502 bp, Homo sapiens
acggggccgggaggagtcggggctgggccgcgccgaggcagctggctgactccagtttagccgccgccggagaggacgggcgccgagccggggctgcggacttcggcctgcccctcacctcactcccgctgcttgcacctcccggatggtgctgactgctccctaagcggcggcggcggcgagtcgtgaggacgcgccgcggaggctgttcggggtcgaggcttcccgtcgccggcacttcctcttgcggcgcccgtgcgcggccggcccggcaggcgggatggcggccgcggctccagggaacggccgcgcatcggcgccccggctgcttctgctctttctggttccgctgctgtgggccccggctgcggtccgggccggcccagatgaagaccttagccaccggaacaaagaaccgccggcgccggcccagcagctgcagccgcagcctgtggctgtgcagggccccgagccggcccgggtcgagaaaatatttacaccagcagctccagttcataccaataaagaagatcctgctacccaaactaatttgggatttatccatgcatttgtcgctgccatatcagttattattgtatctgaattgggtgataagacattttttatagcagccatcatggcaatgcgctataaccgcctgaccgtgctggctggtgcaatgcttgccttgggactaatgacatgcttgtcagttttgtttggctatgccaccacagtcatccccagggtctatacatactatgtttcaactgtattatttgccatttttggcattagaatgcttcgggaaggcttaaagatgagccctgatgagggtcaagaggaactggaagaagttcaagctgaattaaagaagaaagatgaagaatttcaacgaaccaaacttttaaatggaccgggagatgttgaaacgggtacaagcataacagtacctcagaaaaagtggttgcattttatttcacccatttttgttcaagctcttacattaacattcttagcagaatggggtgatcgctctcaactaactacaattgtattggcagctagagaggacccctatggtgtagccgtgggtggaactgtggggcactgcctgtgcacgggattggcagtaattggaggaagaatgatagcacagaaaatctctgtcagaactggtagtttctctccctggctcatcttgcatgcttgctctgatggaaaaggtcacctggaaaggaactgaggatagccttcagccagcaagaaaccaaggccctcagtccaactgcccatgaggaactgaagtgtgccagcaaccactaagtgaggtggaaacagatgccacctcagttgaactttgagatgactgtggctcccaccaacaccttgattacagcctcatgaaagaatctgaagtagagggtccagctaaactgtgcctggactcttgactcaccaaactaggagataacaagtgtgttgttttatatcactaaatt

SEQ ID NO: 356851 - DNA, 1609 bp, Homo sapiens
acggggccgggaggagtcggggctgggccgcgccgaggcagctggctgactccagtttagccgccgccggagaggacgggcgccgagccggggctgcggacttcggcctgcccctcacctcactcccgctgcttgcacctcccggatggtgctgactgctccctaagcggcggcggcggcgagtcgtgaggacgcgccgcggaggctgttcggggtcgaggcttcccgtcgccggcacttcctcttgcggcgcccgtgcgcggccggcccggcaggcgggatggcggccgcggctccagggaacggccgcgcatcggcgccccggctgcttctgctctttctggttccgctgctgtgggccccggctgcggtccgggccggcccagatgaagaccttagccaccggaacaaagaaccgccggcgccggcccagcagctgcagccgcagcctgtggctgtgcagggccccgagccggcccgggtcgagaaaatatttacaccagcagctccagttcataccaataaagaagatcctgctacccaaactaatttgggatttatccatgcatttgtcgctgccatatcagttattattgtatctgaattgggtgataagacattttttatagcagccatcatggcaatgcgctataaccgcctgaccgtgctggctggtgcaatgcttgccttgggactaatgacatgcttgtcagttttgtttggctatgccaccacagtcatccccagggtctatacatactatgtttcaactgtattatttgccatttttggcattagaatgcttcgggaaggcttaaagatgagccctgatgagggtcaagaggaactggaagaagttcaagctgaattaaagaagaaagatgaagaatttcaacgaaccaaacttttaaatggaccgggagatgttgaaacgggtacaagcataacagtacctcagaaaaagtggttgcattttatttcacccatttttgttcaagctcttacattaacattcttagcagaatggggtgatcgctctcaactaactacaattgtattggcagctagagaggtgagtgatatttgagaggagactgtttaaaatgaaacgtaattattattactttgttccagaaaacactggacacactgaagtgggccacagcattccttcatatgcaagactgttttacatctgataattcagctgctctctaaaattggccttctcccagttcctgctacctgcaggtgaaattcttgtaaccaagctcagttgggctctttttactcatccttttccctttggttttgccaaaatgatgccgtggtacttgtcatcttagcttggttttcttatcatagaactttcttttttatagttgttgagaatataaatcagtataatattattgaaggccattttggtgtttaatacctaaagccttaaaaatgtgtagctagccgggcttggtggtatgcacctgtagtcccagctactcaggagggttgaggtgggaggattgcttgagcctgggaggttgaggctccagtgagctgtgttcgcgccactgcactccagccttggtgacagggagacccagtctga

SEQ ID NO: 356852 - DNA, 1496 bp, Homo sapiens
acggggccgggaggagtcggggctgggccgcgccgaggcagctggctgactccagtttagccgccgccggagaggacgggcgccgagccggggctgcggacttcggcctgcccctcacctcactcccgctgcttgcacctcccggatggtgctgactgctccctaagcggcggcggcggcgagtcgtgaggacgcgccgcggaggctgttcggggtcgaggcttcccgtcgccggcacttcctcttgcggcgcccgtgcgcggccggcccggcaggcgggatggcggccgcggctccagggaacggccgcgcatcggcgccccggctgcttctgctctttctggttccgctgctgtgggccccggctgcggtccgggccggcccagatgaagaccttagccaccggaacaaagaaccgccggctgcgccgagtaccaggctccaggcctttgaaagcgccgcactccgccggcctcggctgggggaggggagcccggcccctgctcccggggtggagggcggtcggctgcgctgttttccggtgaggcctggtcttgcccgctcctttagggaaagggagagggagagtccaagaggagcccgctataaacgttgatctccggagggccaagatgctgctccgggatgggcgttttattgatcagatgtgtcttagagtagctagaaagactcatccctaccaaaaagtttttaacagaaggctgctaggaggctttttgtattccctgaggatcatcacatcggccatttcattgttgaaatagcttatgccaaactgcttacccaaattcaacttggcactgcctgtgctttttgccaaatatggattatgaaccatgactctcactttttaaaaatgtgctttggctagcaggaagtagcctttaggaacgcagaggaattagtctccggcagtacagcgtgctgcagcgatgtgggatgccaaaactacatttataagtaaaacagaatcctgtattttgtccttccctgaatagatactagaaatcaactttttaatctgttaatagaattagtccttagtcacttggcagcgttttaacatttctcccttctcccagtcgtgggctttgtcgtcatttccagtatctgctccctgaatcccggccagtgtggcactcaaacccccactcccacccaggccacatccagcccatctccacgtaactaatcttcccgaacattgaattctgccatcttgtcagaagtcgtcggtgagttgcctccactaatttcagtccagcctttttaggagagtgatgttcaggtttcttctgatctggctccagctcacctccaggctttttagccaccgctttcttgctcatatgctaaagggatatgctcatctgcaaaaaagaatgtgcttcaagagccctttgggacaggctttgtgctctcttgccagttcctccctaacacaagaccttttcaaagaaaaaaaaaaaaagacc

SEQ ID NO: 356853 - DNA, 529 bp, Homo sapiens
gctcccaggcctttggactccaggacttattccagtgcccctctgtgatctcaggctttcggccttggactgagaattgcaccgtcagttttcctggttctgagatcttcagacttggactgagttacactaccagcaccccagggtctccagcttgcaaatggcctttcatgaaacttagtatccataaccataatgtaaaggtcatgtactgacattgtggagatcttctaaaattcagtgaaataaaagacgaaactaccattaattttaccatccagactgcaccaaaatgttaacaatactgttttctctcctattaataaacctgtacttatattttataaaattgggagcatatttcatacttttataacttgtgtttttcatgtatatcatgaacattttccaagattgttaaatactctgaaaacatgatttttaatagtaatattaaatatttgtaatattccttttgatagtccactatttatcctacatgatctataacataagtataaataaaaac

SEQ ID NO: 356854 - DNA, 2848 bp, Homo sapiens
ttgaaattaccattatagctaattattttattacaatgttttcagaattagatctaggtgacataaaatacacaaaagcataaagccatctgaatagtacagtcaacaagcaacaaccagtacaatcagcaataatagagaacttttaactttgtatgtcacagagaatgtatatacctttttaataaaaagcctgaataaaccaataactattaaagaaatcacaaagctgattaaaaatctactattaaaagtgtcatcaggattagattgttttacactttgtcctagctaacttttaacaaacaaataattctaatgctatttaaattattccagaccacaggaaaaaaattgaaaactcacatattcatatttttttaaagctagcacaacttcaataacaaaacttgataaagatagcatcagaaggacaaaatacaattttactttggaatgaaaatgcaataattctaaattaaatactggtaaataaaatccactcatgtagcaaatcattatttcacaatgaccaagtagtatttgttccagaaatacaagtttggttccacatcaaatgcctaccattctaattcattacatcaacaaattaaagagaaaaaaaatcatacaattttatcaatagatgctgaaaaggcattttataaaattcaggaaccacttctagcaataacactataaaacaggaatagcggaaactcttaaacatgttaatgactacctactaataaccaaaagtaaatgtcatactaatagggaatactattccctattaatattttgcattcttacttccatgaaaattaagaacaagacagtcacgtctgtcatcactcttcaacattgttttgaaaaatccagctaatgtaacagtaatcagtataaacattaagaggaaataaaatgatctatatgttcaggtgaaataatttcatatctagaaaacccaaaatattatattcttaaaaatctactgtaatttcaatgattaaataagctcattagacagaagataaaaatacaaaatctataggttgtctatattgtcaaaaatagctaattacaaatgagaagaaaaaaaccaattcacaatgtcaaaatatgaaataaaactgtaaaaatacttagaaataaattcagttagctatgatatacttacgtgaagaatattccaataacaagaccaaaagatttcaatgatgtacgaagactcttgagtgctaagatttaatattactaaagagccctctaaacaaaaatgcaggattttaattgtgatgtcagccatcataattagaattttattaaaattctgcatttcattttttcacatgaaaaaatgaatgtctaggacatattatataaagaaaaaaaaaactaatgaagtgggacttgctttatcggattctaaaacttacgatgaagccactataattaaatcatgatattggctcagaaatttgaaaatgggtaacattttaaataaatgtcacaatcaggtatccaatgtgaacaaaatgttatagctggatccccatcttacaccatatacaaaaataaatttcagatggatcaaacatttaaacattaaaaataataaagttattagaagaaaatgtaggtgaatatttgtatgactttgggtgggggcatccatgtgataaaaaaaggaaaccaaaatctataaaagagataagggtctacctaaaaagtttaaaaattttaaaggaaaatatatcatcaataaagtcaagatgaaaacgtcataacacattagagctacaaatgattaatatgcactatgtagtaagaatttctacaaatttataatgaaaaacatcaatagatacatgagcaaagggtaagaacaggcaaatcagagaaaaatccaaacagaaacaaggacagcaacaacaacaaacctctttgaactcagacaaaaggcaattaaactaacaagcaatacaatgcaatttttagcctttcatattttcaagcattaaagagtgctggagaggacgctggaacgggcgctttcattttggatagtaatcttgtaatatttctgaaacatatgcctacatagtatttctgggaatccaacctatataaataaaagcaccagtatgtattacagcagtgttattttgaaaaaaaataaaaaaaggaaataaaagacgatcaataacgaaatggttgaatgcctttttggtacatcaacaagtactgtgtattcagctgttagagtaagggagggagggggagagcaagagtgcaagagagtaagagtgagggccagagagagccagagagagcaagaaagactgaagctactgataagaagagatatcatctacatgtcaagtgagaaaagcatgtggcttgccatttttacagaaactactagaacatactttctgcatgaagatggggaaaataggtggaaggatgtacttcgcatcctcaacacttgttttctgggaagaaacaagaatgtaaaggtcatgtactgacattgtggagatcttctaaaattcagtgaaataaaagacgaaactaccattaattttaccatccagactgcaccaaaatgttaacaatactgttttctctcctattaataaacctgtacttatattttataaaattgggagcatatttcatacttttataacttgtgtttttcatgtatatcatgaacattttccaagattgttaaatactctgaaaacatgatttttaatagtaatattaaatatttgtaatattccttttgatagtccactatttatcctacatgatctataacataagtataaataaaaac

SEQ ID NO: 356855 - DNA, 3224 bp, Homo sapiens
ttgaaattaccattatagctaattattttattacaatgttttcagaattagatctaggtgacataaaatacacaaaagcataaagccatctgaatagtacagtcaacaagcaacaaccagtacaatcagcaataatagagaacttttaactttgtatgtcacagagaatgtatatacctttttaataaaaagcctgaataaaccaataactattaaagaaatcacaaagctgattaaaaatctactattaaaagtgtcatcaggattagattgttttacactttgtcctagctaacttttaacaaacaaataattctaatgctatttaaattattccagaccacaggaaaaaaattgaaaactcacatattcatatttttttaaagctagcacaacttcaataacaaaacttgataaagatagcatcagaaggacaaaatacaattttactttggaatgaaaatgcaataattctaaattaaatactggtaaataaaatccactcatgtagcaaatcattatttcacaatgaccaagtagtatttgttccagaaatacaagtttggttccacatcaaatgcctaccattctaattcattacatcaacaaattaaagagaaaaaaaatcatacaattttatcaatagatgctgaaaaggcattttataaaattcaggaaccacttctagcaataacactataaaacaggaatagcggaaactcttaaacatgttaatgactacctactaataaccaaaagtaaatgtcatactaatagggaatactattccctattaatattttgcattcttacttccatgaaaattaagaacaagacagtcacgtctgtcatcactcttcaacattgttttgaaaaatccagctaatgtaacagtaatcagtataaacattaagaggaaataaaatgatctatatgttcaggtgaaataatttcatatctagaaaacccaaaatattatattcttaaaaatctactgtaatttcaatgattaaataagctcattagacagaagataaaaatacaaaatctataggttgtctatattgtcaaaaatagctaattacaaatgagaagaaaaaaaccaattcacaatgtcaaaatatgaaataaaactgtaaaaatacttagaaataaattcagttagctatgatatacttacgtgaagaatattccaataacaagaccaaaagatttcaatgatgtacgaagactcttgagtgctaagatttaatattactaaagagccctctaaacaaaaatgcaggattttaattgtgatgtcagccatcataattagaattttattaaaattctgcatttcattttttcacatgaaaaaatgaatgtctaggacatattatataaagaaaaaaaaaactaatgaagtgggacttgctttatcggattctaaaacttacgatgaagccactataattaaatcatgatattggctcagaaatttgaaaatgggtaacattttaaataaatgtcacaatcaggtatccaatgtgaacaaaatgttatagctggatccccatcttacaccatatacaaaaataaatttcagatggatcaaacatttaaacattaaaaataataaagttattagaagaaaatgtaggtgaatatttgtatgactttgggtgggggcatccatgtgataaaaaaaggaaaccaaaatctataaaagagataagggtctacctaaaaagtttaaaaattttaaaggaaaatatatcatcaataaagtcaagatgaaaacgtcataacacattagagctacaaatgattaatatgcactatgtagtaagaatttctacaaatttataatgaaaaacatcaatagatacatgagcaaagggtaagaacaggcaaatcagagaaaaatccaaacagaaacaaggacagcaacaacaacaaacctctttgaactcagacaaaaggcaattaaactaacaagcaatacaatgcaatttttagcctttcatattttcaagcattaaagagtgctggagaggacgctggaacgggcgctttcattttggatagtaatcttgtaatatttctgaaacatatgcctacatagtatttctgggaatccaacctatataaataaaagcaccagtatgtattacagcagtgttattttgaaaaaaaataaaaaaaggaaataaaagacgatcaataacgaaatggttgaatgcctttttggtacatcaacaagtactgtgtattcagctgttagagtaagggagggagggggagagcaagagtgcaagagagtaagagtgagggccagagagagccagagagagcaagaaagactgaagctactgataagaagagatatcatctacatgtcaagtgagaaaagcatgtggcttgccatttttacagaaactactagaacatactttctgcatgaagatggggaaaataggtggaaggatgtacttcgcatcctcaacacttgttttctgggaagaaacaaggtaaggaaaggaaggggtaaggacggggtgtgggtttacaccattaatttttcttaatctatttttgcattgttccaatggttgcaaacactttttaattttctattagcacccaatttaactgttaagttacagaacaaggcaatatcaaaagtagcaaagtacacttgaggcaaaattgtgaaactagtcaaggtaagatttgttggcacaataaaatttatccactttcctgaatttctgacacctaaactcttctctgcgttcacaactacgagaacacaaaataattcacatctaacagatccacaacttctctaaagagcacaaagaatttaaggagttttcaccaaaccatagacataaatgtgaatatcatcatcaaacttaatgaagtaaacagatggcttcgccaccacttgatgtataaaaatgccagttctcttggacccgtcatctttggcatgctccacctgcttgcccacgagactgtcgaccacctctccaggctcctgttctgctgtagggaaatagtagttggaatctggaataatgcgtaagtcaccatctttgtagtcatcaagcagcgtgtacatatagagaacaggatctttctcgtaggtgatgtaaaaccaagtatccatcacaggagctcgcgccaggaccatacccttccattcatccttggtaccatgttcaccttcaaacaca

SEQ ID NO: 356856 - DNA, 3183 bp, Homo sapiens
ctgggccttttcttcttttatcccctgtccccgcccccctacacctcttacaaatttagcccaggagctttctatccccaccgacttgaagggtttatcggtcttaagagcgaaatcctggcggagtgcagtccctcggggctagcatccacgttccgcctgcgccctgcccgggctgttccgagggatccccgcaagggcactgccccagctttcactcttggagtcggggaaataaggtgtccacaaaggatgcaagcaagtcattgtcagtgcagacccgaagggcgcgtccggagtgcaggtatgaaagacgggcgcatgcgcgcagtccggggccgggcttcgcagcccgggctccgctctagccccgcagcgtctcggtggccggtctcgtcctccgcccgccgcgcgggggcgccgctctagccccgcgccatctcggtggccgtccgcccactccgcggcgttcggggaaatggctgcgagaccctagaggcctgcggcctgcggagcttactccacgggaacagcctctagataatctgagttgttgaaaatacgaagcctgttactcgtgaacagtggctgacaacagtgttgttgtgagcctggctgtctgcttggacccagaggtttcgtctgccagggtttttggttgtatttaggatttcagggaaaagtgtccaagctttcagtgttggagcaggtatggacgacaaaggcgacccgagcaatgaggaggcacctaaggccatcaaacccaccagcaaagagttcaggaaaacatggggttttcgaaggaccactatcgccaagcgagagggcgcaggggacgcggaggctgacccactggagccgccacccccacagcagcagctgggcctgtccctgcggcgcagtgggaggcagcccaagcgcactgagcgcgtggagcagttcctgaccattgcgcggcgccgcggcaggaggagcatgcctgtctccctggaggattctggtgagcccacgtcctgccccgccacagacgccgagacagcctccgagggcagcgtggaaagcgcttctgagaccagaagcggcccccagtctgcttccacagctgtgaaggaacgaccagcctcttctgaaaaggtgaaaggaggggatgaccacgatgacacctccgatagtgacagcgatggcctgaccttgaaagagcttcagaatcgccttcgcaggaagcgggaacaggagcccactgagaggcccctgaaagggatccagagtcgcctgcggaagaagcgccgggaggagggtcccgccgagactgtgggctccgaggccagtgacactgtggagggcgtcctgcccagtaagcaggagcccgagaacgatcagggggttgtgtcccaggctgggaaagatgacagagagagtaagttggagggaaaggcggctcaggacatcaaagatgaggagcctggagacttgggccgaccgaagcctgaatgtgagggttacgaccccaacgccctgtattgcatttgccgccagcctcacaacaacaggtttatgatttgctgtgaccgctgtgaagaatggtttcatggcgattgtgtgggcatttctgaggctcgagggaggcttttggaaaggaatggggaagactatatctgcccaaactgcaccattctgcaagtgcaggatgagactcattcagaaacggcagatcagcaggaagctaaatggagacctggagatgctgatggcaccgattgtacaagtataggaacaatagagcagaagtctagcgaagaccaagggataaagggtagaattgagaaagctgcaaatccaagtggcaagaagaaactcaagatcttccagcctgtgatagaggcgcctggtgcctcaaaatgtattggccccgggtgctgtcacgtggcgcagcccgactcggtgtactgcagtaatgactgtatcctcaaacacgccgcagcgacaatgaagtttctaagctcaggtaaagaacagaagccaaagcctaaagaaaagatgaagatgaagccagagaagcccagtcttccgaaatgcggtgctcaggcaggtattaaaatctcttctgtgcacaagagaccagctccagaaaaaaaagagaccacagtgaagaaggcagtggtggtccctgcgcggagtgaagcactcgggaaggaagcagcttgtgagagcagcacgccgtcgtgggcgagcgatcacaattacaatgcagtaaagccagaaaagactgctgctccctcgccgtcactgttgtataaatgtatgtatcacctaggggttggcctcctggacccctcccgttctttctggatagccatcccctgggcctgtccaggactgggagttgcagctttgtgttaagctgatcacagacaccggctgcaccatcagcgggaagcagagcccatgtccaggatgcctcctgctgccctgtgtccatccctagtctgtcaggacttcctgtcactgttttccaaagctgtaaacctcactggtgaacgttcaccttaatgattgattctttaatctctgttttcactctcaggctctggtaagtattcgtattctcttcatcccagtctgattgcatagccacactgcccggcacgccacatccacccctgtctgcacatgagttgttctgacaacagcgctgtatacgcttcagtttttccacattgtccacggccagcacatgaaagcatcacttcttttttatgttgtgggaatctttgcaagttagtgttgcatctgattttcaggtgtacatttatttttgactgggcagataggggatttttttttttccatgtccgattcacacgctacacacccacatgaacacattcgaacttcgaaggccacacactcctgcttcataggccccacggtaagtgagttcacacctagaacactgtcctgaccgcaggacgcgtgccttggacttggtattctacatgtgactggctttcttgccctcgtctcttgaatgtttagactcttaagatcatatcctgccccaaatttcaaattaatgaaatgaagatatttcaaacagatctttgaaacctcagattctgtggtgcaattttaatgttttcttgtttctcagttttctgctataaaactattttcaattcagaa

SEQ ID NO: 356857 - DNA, 337 bp, Homo sapiens
ggggagcgggagggcaggcgcaccggaggccgcccctcagcacctctcgcgacagcaagagagcgcgagagcgcgagccgatgaccaatgaagcgcccccgcgagggggcggggcggacggcctcccggaagcgcggaacctcagcttccgtacttgcgcagaactcccctcgcggcgaccacgcactacgggttggcgccagagtcaaaaggcgtcggccctctggcaagatggctgctgcggaggcgttggagcgcggaaatctggaaccgggatggcgacgtctacactgagtcggaggcgaaggtcccagcttttttcctgtcgtttgcgtga

SEQ ID NO: 356858 - DNA, 274 bp, Homo sapiens
tcgtaagtggtgaaggagtagacacactggggtgaaggggcaggagaatagatacgcttgggggtgaagttgggttgtggtgaagtttgggagaggcgtggcttaggcccttacctgggatagggttggggtgagttgggagctggttgaagacctcgagctcagatagaatgaaatggcagtgtacggggggcataagacttcaggacacaccctgctgtcttgtgagaagagttggtaaccacccggtggagtttgtagagcgtagacttgc

SEQ ID NO: 356859 - DNA, 7657 bp, Homo sapiens
  misc_feature (1993)..(1993): n is a, c, g, or t
  misc_feature (2028)..(2028): n is a, c, g, or t
  misc_feature (4196)..(4196): n is a, c, g, or t
  misc_feature (5421)..(5421): n is a, c, g, or t
tggcgaattcggcacgaggggaaatggctgcgagaccctagaggctgcggctgcggagcttactccacgggaacagcctctagataatctgagttgttgaaaatacgaagcctgttactcgtgaacagtggctgacaacagtgttgttgtgagcctggctgtctgcttggacccagaggtttcgtctgccagggtttttggttgtatttaggatttcagggaaaagtgtccaagctttcagtgttggagcaggtatggacgacaaaggcgacccgagcaatgaggaggcacctaaggccatcaaacccaccagcaaagagttcaggaaaacatggggttttcgaaggaccactatcgccaagcgagagggcgcaggggacgcggaggctgacccactggagccgccacccccacagcagcagctgggcctgtccctgcggcgcagtgggaggcagcccaagcgcactgagcgcgtggagcagttcctgaccattgcgcggcgccgcggcaggaggagcatgcctgtctccctggaggattctggtgagcccacgtcctgccccgccacagacgccgagacagcctccgagggcagcgtggaaagcgcttctgagaccagaagcggcccccagtctgcttccacagctgtgaaggaacgaccagcctcttctgaaaaggtgaaaggaggggatgaccacgatgacacctccgatagtgacagcgatggcctgaccttgaaagagcttcagaatcgccttcgcaggaagcgggaacaggagcccactgagaggcccctgaaagggatccagagtcgcctgcggaagaagcgccgggaggagggtcccgccgagactgtgggctccgaggccagtgacactgtggagggcgtcctgcccagtaagcaggagcccgagaacgatcagggggttgtgtcccaggctgggaaagatgacagagagagtaagttggagggaaaggcggctcaggacatcaaagatgaggagcctggagacttgggccgaccgaagcctgaatgtgagggttacgaccccaacgccctgtattgcatttgccgccagcctcacaacaacaggtttatgatttgctgtgaccgctgtgaagaatggtttcatggcgattgtgtgggcatttctgaggctcgagggaggcttttggaaaggaatggggaagactatatctgcccaaactgcaccattctgcaagtgcaggatgagactcattcagaaacggcagatcagcaggaagctaaatggagacctggagatgctgatggcaccgattgtacaagtataggaacaatagagcagaagtctagcgaagaccaagggataaagggtagaattgagaaagctgcaaatccaagtggcaagaagaaactcaagatcttccagcctggtcccgggcctgtccccacccagctgcctgtcctctggcaggtattggaaattgctgtgtctagaagcatctctgccttcacactcttgcactgcattagctgcaaggtgatagaggcgcctggtgcctcaaaatgtattggccccgggtgctgtcacgtggcgcagcccgactcggtgtactgcagtaatgactgtatcctcaaacacgccgcagcgacaatgaagtttctaagctcaggtaaagaacagaagccaaagcctaaagaaaagatgaagatgaagccagagaagcccagtcttccgaaatgcggtgctcaggcaggtattaaaatctcttctgtgcacaagagaccagctccagaaaaaaaagagaccacagtgaagaaggcagtggtggtccctgcgcggagtgaagcactcgggaaggaagcagcttgtgagagcagcacgccgtcgtgggcgagcgatcacaattacaatgcagtaaagccagaaaagactgctgctccctcgccgtcactgttgtataaatccacgaaggaagacaggaggtccgaggagaaagcggcagccanggcagcctcaaagaaaacagcccctccaggctccncggtgggcaagcagcctgcacctagaaacctcgtgccaaagaagtcttcttttgctaatgtggcagcagccacaccagccattaaaaagccaccctcaggtttcaagggcaccatccccaagaggccatggctctccgctaccccatcgagtggtgcttcagctgccaggcaggccggaccggcacctgcagcggcgacggctgcctccaagaagttccctggctccgctgctttggtgggagccgtaaggaagccagtggtaccttctgttccaatggcctcgccagccccaggacgccttggggctatgagtgctgcaccatcgcagccaaattcacaaattcggcaaaatatcagacgctccttaaaagagattttgtggaaaagagtcaatgacagcgatgacttaatcatgacagaaaacgaagtaggaaaaattgccctccatattgagaaggagatgtttaacttgtttcaagttacagataatcgctacaagagtaaatatcgcagcatcatgttcaacctgaaggaccctaaaaatcagggactcttccatcgtgttctgcgtgaggaaatctctttggcgaaacttgtgagactgaagccagaagaacttgtatctaaagagctttccacgtggaaagagaggccagcgagatctgtgatggagtccagaactaaactgcacaatgaaagcaagaagacggcccccaggcaggaggccatccccgatctggaggactctccgccagtgtcggattcagaggaacagcaagagtcagcacgtgctgtccctgagaagagcacagcgccgcttctcgacgtcttcagcagcatgttgaaagacaccaccagtcagcaccgcgcacacctcttcgatctcaactgtaaaatttgcacaggccaggttccctccgcagaagatgagccagctccgaaaaaacaaaaattgtcagcttctgttaagaaagaagacttaaaatcaaagcatgacagctctgcacctgacccagctccggattcagctgatgaggtgatgccggaggctgtgcctgaagttgcctctgagccaggcctagaaagtgcttctcatccaaatgtggacagaacgtatttccctgggcctccaggagatggccatcccgagccctccccgctggaagacctgtccccctgcccagcctcctgtgggagcggggtggtcaccaccgtcacagtgtccggccgggaccccaggaccgctccaagcagttcatgcacagccgtggcctccgcagcatcccgcccagacagcacccacatggtggaagccagacaggatgtgccgaagcctgtcttgacttctgtgatggtgcccaagtccatactagctaagccatcctcatctcctgacccaagatacctgtcagttcctccgtcaccaaatatcagcacttcagaatcacgttcccctccagagggagacacgaccctctttttgtctcgactcagcaccatttggaaaggatttattaacatgcagagtgtggcaaaatttgtcactaaggcgtatcctgtctctgggtgttttgattacctcagtgaggatttgcctgacacaattcacattggtgggaggatcgcaccgaagacagtttgggattatgttggcaaactcaagtcttctgtgtctaaggagctctgtctgatccgcttccaccccgccacagaggaagaggaggtcgcctatatctctctctactcctatttcagcagccgtggccgctttggtgttgtagctaataacaacaggcacgtcaaggacctctacctgatcccgctgagcgcccaggaccctgttccatccaaactcttgccctttgagggaccaggtaagcgccggctttctgggtggaggtgaggcccacctgcacctgcacccctcctcccactgacatgccctgctgagtcctgaccagcccagggctctctgggagcaggagttaggagcacagacgcagcggttagcaataggattcatctttgagggcgtaggactgtggcacgagaagtacccctgattcacagcataaattgtcttaggagagttttttagagagggaaaaacccacagcctgcaaccagctcatcttggcctcaggtcagagaagactcagtgcccagnagcccaaggctcagccagaaagggaggtgacactcccagcggccctgctctttcctctagacagactcgggagccagcacacaccgggaagtggctccatcagggatcacttctctaacagggatggatttccaggagacttaacaataatgacatagaaaactatttctagaaataattattttaaaatctgcagctcaaattgtaataggttcattcatctttggcaagctattttgtgtttgcacgttccttggaaagtactgtatttaaacgattatttacaaatagcctaaaatacatctttgtcaagggttgagggtgattccaggggccacgtgctctgttagtgaccagctctttcatagccccttagaagaagctgatgtgacttcagttaggggttagtatctgatgcccaactgaagtgtctccgtggccatgcagtccccagaggattggtgttctctcaaagcgggtgtgtggatcacacagtgtcctctgaagtgcttcgtcataaaggcaggtgctgtctggaccctgtgcctcagtgccctctgtccctgtcaccaggcctcggcgggtgttcctgccatagctgtgcagggtgttcccacccacacccctcatgccgcaccctagctagctggggtcctgtaggggccactccacatcttgggcgggacttctgtcgccccaggcacagcccacgttcctactggagcccattcttcacagctggagtgggctcagcctatgcctgtgttgtggaattatatgtccataaagggattggttggtatcagtaatttcagggttaaatatttgctggcgtggtgcattaaattattttagtgccagataaatttttaaaagcaaagtgctttagtgtgtcccctcaaatcctacttgggataaagagatgccacctaatgggtggcagaaaggaccctggtagaggttcttggtgttgcttgtgaagagctctggccagctccacgtgaccagggagaggaaaagcccggccctcctggaggtgaagaccgagaagctggcctctccgcacctgtgaagacccactggtcagttgcaagtgcgacagtgtgtgcactcagtgcagacactgcagcacctcagcacctccctaccggggtggaaagagcactttttctttacagaaacatgattcttagatagcgagcctcccctttttaaaacaattgangcgatatttcatcctttcttgagcttctctccctgctcatctccaaacttggagctgtcaggtgagcacaggttgtagggtgttgagcgagccccggcgcatgccgggcaccgggttccccacactgggcagtgacggggcccagggaggccaccagaggagcggcgcctccattctccccacagcaagggctggctgtgcaggtgcagccccggggcagagggaaaggacaggtctcccagcacctcccggatggcaccgggacaaggagggctgggctggggtcactcaccttgtctgctgagtgcgatggcaccaaccacccacactgtcagctccgcgaccagctgggggaacgtcacactcgcccaccaaggcacttgctgaggccacgacgccgcctgacggggacacacaaaagccccagggactttgatccacgataaagagcagaggcgtctgggtaaagtaacacagggcaagggactttagaaaagtaacagctagtgaaacctttccatacacttcagaaatgttttaacttaagacttcagtataatgttaacttctcctgatgtccttgttgacatgaatgcgtgtgcgtgaaatctcacacacttccatggtcactaaacagccttcaccccgggccaggccatcgggtactcggcccgcttcacgtactgattacttgacttggcgttttctagatataaacatgtacatgtgtgtcctggctttgtggtgtaaatgtgtagtgcgtgtgcatgtgcgcgcgtgtgtgtgtgtaaggctaggtcctggcacgtttcccctgtctcagcggaccctgtcctcacggagatagcccagaagcccttggacagcacaggccacacctgagggtgctgatggtggtgactccacagagctgtggtcaggggtgagcgtgtgctgcgcagcttggagtcacgcccccagaagtgctgggtgagggtctgcaggacccagctccattccacagcctcagttctctgcggcacatgcagcacaggcctgaaggagacctggcgccccagccttgagctgcccgtctgcatcagggcactgatgtgggagcatcttcccctggggatgttaaggagaaggtcctgttgggggtagagattcacgcagaaaagagtgactgactcgtccatgtgcctcagtttataccacacaattgcaggtgtccatgcctcccacacatggggacctagtgggttttgacagcgtggtgtccagtcctagccccctcagtgcttgctgttcacacttaagcaagtgaaggcctgaaggtgcccagctgtgccctcaggggaaacttaagtcacccgccctgtcagcacttggcccttgtcgggcagtgagagtggagctgcccccgcagcaccctcaggagccatgcagttcacagcagtagctggatctccctgaggacatttgtccttgcatatcttaatgatttgtccacagaaacaccgggttgtcttcctctgcccctctgccccgcagtgggggcactctctgtaactcagcatcacggtggggggcagctgggaggcctggttccaggtgaccttctccacctagatgttcaccccactcagttccagctttaccaacagggccccccgcagggacttggggtcgcagagtcccggcctgtctcagggccttgttcatggaagggagatgagtcaggttgaaagctcatcgtgtagggttctgtgcagggcccttacaggactggaccgcagccaagatgcctgcctgttaaccatgcccagcccccgtcatttccgcgtgaagccgcaggcctcggagccttggtctgaaatgcctgtggagtaacctcggtccataaacatgggtgcacagtctgttctccccaagtacagggcaggaggaaacaccgccctctgtagctgctcgaatggaaagggctcttttctctgaggtctttatacattagaaagctcttctgggaagaatgtttgaatccatagtgtctttctgtattcacttttaattgctttctaaattagctgagaaattctgacttgaaatattgtcaggtaagcatttcttcagttttcatgtgtgtatgtaacagtagctttgcatggaaattgtaatcagagtcaaatacagtattgaatggaatgtactgccttctcctcctaaatcaataaacatctttcatggaaaaaaaaac

SEQ ID NO: 356860 - DNA, 2441 bp, Homo sapiens
tggcgaattcggcacgaggggaaatggctgcgagaccctagaggctgcggctgcggagcttactccacgggaacagcctctagataatctgagttgttgaaaatacgaagcctgttactcgtgaacagtggctgacaacagtgttgttgtgagcctggctgtctgcttggacccagaggtttcgtctgccagggtttttggttgtatttaggatttcagggaaaagtgtccaagctttcagtgttggagcaggtatggacgacaaaggcgacccgagcaatgaggaggcacctaaggccatcaaacccaccagcaaagagttcaggaaaacatggggttttcgaaggaccactatcgccaagcgagagggcgcaggggacgcggaggctgacccactggagccgccacccccacagcagcagctgggcctgtccctgcggcgcagtgggaggcagcccaagcgcactgagcgcgtggagcagttcctgaccattgcgcggcgccgcggcaggaggagcatgcctgtctccctggaggattctggtgagcccacgtcctgccccgccacagacgccgagacagcctccgagggcagcgtggaaagcgcttctgagaccagaagcggcccccagtctgcttccacagctgtgaaggaacgaccagcctcttctgaaaaggtgaaaggaggggatgaccacgatgacacctccgatagtgacagcgatggcctgaccttgaaagagcttcagaatcgccttcgcaggaagcgggaacaggagcccactgagaggcccctgaaagggatccagagtcgcctgcggaagaagcgccgggaggagggtcccgccgagactgtgggctccgaggccagtgacactgtggagggcgtcctgcccagtaagcaggagcccgagaacgatcagggggttgtgtcccaggctgggaaagatgacagagagagtaagttggagggaaaggcggctcaggacatcaaagatgaggagcctggagacttgggccgaccgaagcctgaatgtgagggttacgaccccaacgccctgtattgcatttgccgccagcctcacaacaacaggtttatgatttgctgtgaccgctgtgaagaatggtttcatggcgattgtgtgggcatttctgaggctcgagggaggcttttggaaaggaatggggaagactatatctgcccaaactgcaccattctgcaagtgcaggatgagactcattcagaaacggcagatcagcaggaagctaaatggagacctggagatgctgatggcaccgattgtacaagtataggaacaatagagcagaagtctagcgaagaccaagggataaagggtagaattgagaaagctgcaaatccaagtggcaagaagaaactcaagatcttccagcctgtgatagaggcgcctggtgcctcaaaatgtattggccccgggtgctgtcacgtggcgcagcccgactcggtgtactgcagtaatgactgtatcctcaaacacgccgcagcgacaatgaagtttctaagctcaggtaaagaacagaagccaaagcctaaagaaaagatgaagatgaagccagagaagcccagtcttccgaaatgcggtgctcaggcaggtattaaaatctcttctgtgcacaagagaccagctccagaaaaaaaagagaccacagtgaagaaggcagtggtggtccctgcgcggagtgaagcactcgggaaggaagcagcttgtgagagcagcacgccgtcgtgggcgagcgatcacaattacaatgcagtaaagccagaaaagactgctgctccctcgccgtcactgttgtataaatgctctggtaagtattcgtattctcttcatcccagtctgattgcatagccacactgcccggcacgccacatccacccctgtctgcacatgagttgttctgacaacagcgctgtatacgcttcagtttttccacattgtccacggccagcacatgaaagcatcacttcttttttatgttgtgggaatctttgcaagttagtgttgcatctgattttcaggtgtacatttatttttgactgggcagataggggatttttttttttccatgtccgattcacacgctacacacccacatgaacacattcgaacttcgaaggccacacactcctgcttcataggccccacggtaagtgagttcacacctagaacactgtcctgaccgcaggacgcgtgccttggacttggtattctacatgtgactggctttcttgccctcgtctcttgaatgtttagactcttaagatcatatcctgccccaaatttcaaattaatgaaatgaagatatttcaaacagatctttgaaacctcagattctgtggtgcaattttaatgttttcttgtttctcagttttctgctataaaactattttcaattcagaa

SEQ ID NO: 356861 - DNA, 2707 bp, Homo sapiens
tggcgaattcggcacgaggggaaatggctgcgagaccctagaggctgcggctgcggagcttactccacgggaacagcctctagataatctgagttgttgaaaatacgaagcctgttactcgtgaacagtggctgacaacagtgttgttgtgagcctggctgtctgcttggacccagaggtttcgtctgccagggtttttggttgtatttaggatttcagggaaaagtgtccaagctttcagtgttggagcaggtatggacgacaaaggcgacccgagcaatgaggaggcacctaaggccatcaaacccaccagcaaagagttcaggaaaacatggggttttcgaaggaccactatcgccaagcgagagggcgcaggggacgcggaggctgacccactggagccgccacccccacagcagcagctgggcctgtccctgcggcgcagtgggaggcagcccaagcgcactgagcgcgtggagcagttcctgaccattgcgcggcgccgcggcaggaggagcatgcctgtctccctggaggattctggtgagcccacgtcctgccccgccacagacgccgagacagcctccgagggcagcgtggaaagcgcttctgagaccagaagcggcccccagtctgcttccacagctgtgaaggaacgaccagcctcttctgaaaaggtgaaaggaggggatgaccacgatgacacctccgatagtgacagcgatggcctgaccttgaaagagcttcagaatcgccttcgcaggaagcgggaacaggagcccactgagaggcccctgaaagggatccagagtcgcctgcggaagaagcgccgggaggagggtcccgccgagactgtgggctccgaggccagtgacactgtggagggcgtcctgcccagtaagcaggagcccgagaacgatcagggggttgtgtcccaggctgggaaagatgacagagagagtaagttggagggaaaggcggctcaggacatcaaagatgaggagcctggagacttgggccgaccgaagcctgaatgtgagggttacgaccccaacgccctgtattgcatttgccgccagcctcacaacaacaggtttatgatttgctgtgaccgctgtgaagaatggtttcatggcgattgtgtgggcatttctgaggctcgagggaggcttttggaaaggaatggggaagactatatctgcccaaactgcaccattctgcaagtgcaggatgagactcattcagaaacggcagatcagcaggaagctaaatggagacctggagatgctgatggcaccgattgtacaagtataggaacaatagagcagaagtctagcgaagaccaagggataaagggtagaattgagaaagctgcaaatccaagtggcaagaagaaactcaagatcttccagcctgtgatagaggcgcctggtgcctcaaaatgtattggccccgggtgctgtcacgtggcgcagcccgactcggtgtactgcagtaatgactgtatcctcaaacacgccgcagcgacaatgaagtttctaagctcaggtaaagaacagaagccaaagcctaaagaaaagatgaagatgaagccagagaagcccagtcttccgaaatgcggtgctcaggcaggtattaaaatctcttctgtgcacaagagaccagctccagaaaaaaaagagaccacagtgaagaaggcagtggtggtccctgcgcggagtgaagcactcgggaaggaagcagcttgtgagagcagcacgccgtcgtgggcgagcgatcacaattacaatgcagtaaagccagaaaagactgctgctccctcgccgtcactgttgtataaatgtatgtatcacctaggggttggcctcctggacccctcccgttctttctggatagccatcccctgggcctgtccaggactgggagttgcagctttgtgttaagctgatcacagcgggaagcagagcccatgtccaggatgcctcctgctgccctgtgtccatccctagtctgtcaggacttcctgtcactgttttccaaagctgtaaacctcactggtgaacgttcaccttaatgattgattctttaatctctgttttcactctcaggctctggtaagtattcgtattctcttcatcccagtctgattgcatagccacactgcccggcacgccacatccacccctgtctgcacatgagttgttctgacaacagcgctgtatacgcttcagtttttccacattgtccacggccagcacatgaaagcatcacttcttttttatgttgtgggaatctttgcaagttagtgttgcatctgattttcaggtgtacatttatttttgactgggcagataggggatttttttttttccatgtccgattcacacgctacacacccacatgaacacattcgaacttcgaaggccacacactcctgcttcataggccccacggtaagtgagttcacacctagaacactgtcctgaccgcaggacgcgtgccttggacttggtattctacatgtgactggctttcttgccctcgtctcttgaatgtttagactcttaagatcatatcctgccccaaatttcaaattaatgaaatgaagatatttcaaacagatctttgaaacctcagattctgtggtgcaattttaatgttttcttgtttctcagttttctgctataaaactattttcaattcagaa

SEQ ID NO: 356862 - DNA, 4817 bp, Homo sapiens
  misc_feature (1885)..(1885): n is a, c, g, or t
  misc_feature (1920)..(1920): n is a, c, g, or t
  misc_feature (4088)..(4088): n is a, c, g, or t
tggcgaattcggcacgaggggaaatggctgcgagaccctagaggctgcggctgcggagcttactccacgggaacagcctctagataatctgagttgttgaaaatacgaagcctgttactcgtgaacagtggctgacaacagtgttgttgtgagcctggctgtctgcttggacccagaggtttcgtctgccagggtttttggttgtatttaggatttcagggaaaagtgtccaagctttcagtgttggagcaggtatggacgacaaaggcgacccgagcaatgaggaggcacctaaggccatcaaacccaccagcaaagagttcaggaaaacatggggttttcgaaggaccactatcgccaagcgagagggcgcaggggacgcggaggctgacccactggagccgccacccccacagcagcagctgggcctgtccctgcggcgcagtgggaggcagcccaagcgcactgagcgcgtggagcagttcctgaccattgcgcggcgccgcggcaggaggagcatgcctgtctccctggaggattctggtgagcccacgtcctgccccgccacagacgccgagacagcctccgagggcagcgtggaaagcgcttctgagaccagaagcggcccccagtctgcttccacagctgtgaaggaacgaccagcctcttctgaaaaggtgaaaggaggggatgaccacgatgacacctccgatagtgacagcgatggcctgaccttgaaagagcttcagaatcgccttcgcaggaagcgggaacaggagcccactgagaggcccctgaaagggatccagagtcgcctgcggaagaagcgccgggaggagggtcccgccgagactgtgggctccgaggccagtgacactgtggagggcgtcctgcccagtaagcaggagcccgagaacgatcagggggttgtgtcccaggctgggaaagatgacagagagagtaagttggagggaaaggcggctcaggacatcaaagatgaggagcctggagacttgggccgaccgaagcctgaatgtgagggttacgaccccaacgccctgtattgcatttgccgccagcctcacaacaacaggtttatgatttgctgtgaccgctgtgaagaatggtttcatggcgattgtgtgggcatttctgaggctcgagggaggcttttggaaaggaatggggaagactatatctgcccaaactgcaccattctgcaagtgcaggatgagactcattcagaaacggcagatcagcaggaagctaaatggagacctggagatgctgatggcaccgattgtacaagtataggaacaatagagcagaagtctagcgaagaccaagggataaagggtagaattgagaaagctgcaaatccaagtggcaagaagaaactcaagatcttccagcctgtgatagaggcgcctggtgcctcaaaatgtattggccccgggtgctgtcacgtggcgcagcccgactcggtgtactgcagtaatgactgtatcctcaaacacgccgcagcgacaatgaagtttctaagctcaggtaaagaacagaagccaaagcctaaagaaaagatgaagatgaagccagagaagcccagtcttccgaaatgcggtgctcaggcaggtattaaaatctcttctgtgcacaagagaccagctccagaaaaaaaagagaccacagtgaagaaggcagtggtggtccctgcgcggagtgaagcactcgggaaggaagcagcttgtgagagcagcacgccgtcgtgggcgagcgatcacaattacaatgcagtaaagccagaaaagactgctgctccctcgccgtcactgttgtataaatccacgaaggaagacaggaggtccgaggagaaagcggcagccanggcagcctcaaagaaaacagcccctccaggctccncggtgggcaagcagcctgcacctagaaacctcgtgccaaagaagtcttcttttgctaatgtggcagcagccacaccagccattaaaaagccaccctcaggtttcaagggcaccatccccaagaggccatggctctccgctaccccatcgagtggtgcttcagctgccaggcaggccggaccggcacctgcagcggcgacggctgcctccaagaagttccctggctccgctgctttggtgggagccgtaaggaagccagtggtaccttctgttccaatggcctcgccagccccaggacgccttggggctatgagtgctgcaccatcgcagccaaattcacaaattcggcaaaatatcagacgctccttaaaagagattttgtggaaaagagtcaatgacagcgatgacttaatcatgacagaaaacgaagtaggaaaaattgccctccatattgagaaggagatgtttaacttgtttcaagttacagataatcgctacaagagtaaatatcgcagcatcatgttcaacctgaaggaccctaaaaatcagggactcttccatcgtgttctgcgtgaggaaatctctttggcgaaacttgtgagactgaagccagaagaacttgtatctaaagagctttccacgtggaaagagaggccagcgagatctgtgatggagtccagaactaaactgcacaatgaaagcaagaagacggcccccaggcaggaggccatccccgatctggaggactctccgccagtgtcggattcagaggaacagcaagagtcagcacgtgctgtccctgagaagagcacagcgccgcttctcgacgtcttcagcagcatgttgaaagacaccaccagtcagcaccgcgcacacctcttcgatctcaactgtaaaatttgcacaggccaggttccctccgcagaagatgagccagctccgaaaaaacaaaaattgtcagcttctgttaagaaagaagacttaaaatcaaagcatgacagctctgcacctgacccagctccggattcagctgatgaggtgatgccggaggctgtgcctgaagttgcctctgagccaggcctagaaagtgcttctcatccaaatgtggacagaacgtatttccctgggcctccaggagatggccatcccgagccctccccgctggaagacctgtccccctgcccagcctcctgtgggagcggggtggtcaccaccgtcacagtgtccggccgggaccccaggaccgctccaagcagttcatgcacagccgtggcctccgcagcatcccgcccagacagcacccacatggtggaagccagacaggatgtgccgaagcctgtcttgacttctgtgatggtgcccaagtccatactagctaagccatcctcatctcctgacccaagatacctgtcagttcctccgtcaccaaatatcagcacttcagaatcacgttcccctccagagggagacacgaccctctttttgtctcgactcagcaccatttggaaaggatttattaacatgcagagtgtggcaaaatttgtcactaaggcgtatcctgtctctgggtgttttgattacctcagtgaggatttgcctgacacaattcacattggtgggaggatcgcaccgaagacagtttgggattatgttggcaaactcaagtcttctgtgtctaaggagctctgtctgatccgcttccaccccgccacagaggaagaggaggtcgcctatatctctctctactcctatttcagcagccgtggccgctttggtgttgtagctaataacaacaggcacgtcaaggacctctacctgatcccgctgagcgcccaggaccctgttccatccaaactcttgccctttgagggaccaggtaagcgccggctttctgggtggaggtgaggcccacctgcacctgcacccctcctcccactgacatgccctgctgagtcctgaccagcccagggctctctgggagcaggagttaggagcacagacgcagcggttagcaataggattcatctttgagggcgtaggactgtggcacgagaagtacccctgattcacagcataaattgtcttaggagagttttttagagagggaaaaacccacagcctgcaaccagctcatcttggcctcaggtcagagaagactcagtgcccagnagcccaaggctcagccagaaagggaggtgacactcccagcggccctgctctttcctctagacagactcgggagccagcacacaccgggaagtggctccatcagggatcacttctctaacagggatggatttccaggagacttaacaataatgacatagaaaactatttctagaaataattattttaaaatctgcagctcaaattgtaataggttcattcatctttggcaagctattttgtgtttgcacgttccttggaaagtactgtatttaaacgattatttacaaatagcctaaaatacatctttgtcaagggttgagggtgattccaggggccacgtgctctgttagtgaccagctctttcatagccccttagaagaagctgatgtgacttcagttaggggttagtatctgatgcccaactgaagtgtctctgtagctgctcgaatggaaagggctcttttctctgaggtctttatacattagaaagctcttctgggaagaatgtttgaatccatagtgtctttctgtattcacttttaattgctttctaaattagctgagaaattctgacttgaaatattgtcaggtaagcatttcttcagttttcatgtgtgtatgtaacagtagctttgcatggaaattgtaatcagagtcaaatacagtattgaatggaatgtactgccttctcctcctaaatcaataaacatctttcatggaaaaaaaaac

SEQ ID NO: 356863 - DNA, 3847 bp, Homo sapiens
  misc_feature (1885)..(1885): n is a, c, g, or t
  misc_feature (1920)..(1920): n is a, c, g, or t
tggcgaattcggcacgaggggaaatggctgcgagaccctagaggctgcggctgcggagcttactccacgggaacagcctctagataatctgagttgttgaaaatacgaagcctgttactcgtgaacagtggctgacaacagtgttgttgtgagcctggctgtctgcttggacccagaggtttcgtctgccagggtttttggttgtatttaggatttcagggaaaagtgtccaagctttcagtgttggagcaggtatggacgacaaaggcgacccgagcaatgaggaggcacctaaggccatcaaacccaccagcaaagagttcaggaaaacatggggttttcgaaggaccactatcgccaagcgagagggcgcaggggacgcggaggctgacccactggagccgccacccccacagcagcagctgggcctgtccctgcggcgcagtgggaggcagcccaagcgcactgagcgcgtggagcagttcctgaccattgcgcggcgccgcggcaggaggagcatgcctgtctccctggaggattctggtgagcccacgtcctgccccgccacagacgccgagacagcctccgagggcagcgtggaaagcgcttctgagaccagaagcggcccccagtctgcttccacagctgtgaaggaacgaccagcctcttctgaaaaggtgaaaggaggggatgaccacgatgacacctccgatagtgacagcgatggcctgaccttgaaagagcttcagaatcgccttcgcaggaagcgggaacaggagcccactgagaggcccctgaaagggatccagagtcgcctgcggaagaagcgccgggaggagggtcccgccgagactgtgggctccgaggccagtgacactgtggagggcgtcctgcccagtaagcaggagcccgagaacgatcagggggttgtgtcccaggctgggaaagatgacagagagagtaagttggagggaaaggcggctcaggacatcaaagatgaggagcctggagacttgggccgaccgaagcctgaatgtgagggttacgaccccaacgccctgtattgcatttgccgccagcctcacaacaacaggtttatgatttgctgtgaccgctgtgaagaatggtttcatggcgattgtgtgggcatttctgaggctcgagggaggcttttggaaaggaatggggaagactatatctgcccaaactgcaccattctgcaagtgcaggatgagactcattcagaaacggcagatcagcaggaagctaaatggagacctggagatgctgatggcaccgattgtacaagtataggaacaatagagcagaagtctagcgaagaccaagggataaagggtagaattgagaaagctgcaaatccaagtggcaagaagaaactcaagatcttccagcctgtgatagaggcgcctggtgcctcaaaatgtattggccccgggtgctgtcacgtggcgcagcccgactcggtgtactgcagtaatgactgtatcctcaaacacgccgcagcgacaatgaagtttctaagctcaggtaaagaacagaagccaaagcctaaagaaaagatgaagatgaagccagagaagcccagtcttccgaaatgcggtgctcaggcaggtattaaaatctcttctgtgcacaagagaccagctccagaaaaaaaagagaccacagtgaagaaggcagtggtggtccctgcgcggagtgaagcactcgggaaggaagcagcttgtgagagcagcacgccgtcgtgggcgagcgatcacaattacaatgcagtaaagccagaaaagactgctgctccctcgccgtcactgttgtataaatccacgaaggaagacaggaggtccgaggagaaagcggcagccanggcagcctcaaagaaaacagcccctccaggctccncggtgggcaagcagcctgcacctagaaacctcgtgccaaagaagtcttcttttgctaatgtggcagcagccacaccagccattaaaaagccaccctcaggtttcaagggcaccatccccaagaggccatggctctccgctaccccatcgagtggtgcttcagctgccaggcaggccggaccggcacctgcagcggcgacggctgcctccaagaagttccctggctccgctgctttggtgggagccgtaaggaagccagtggtaccttctgttccaatggcctcgccagccccaggacgccttggggctatgagtgctgcaccatcgcagccaaattcacaaattcggcaaaatatcagacgctccttaaaagagattttgtggaaaagagtcaatgacagcgatgacttaatcatgacagaaaacgaagtaggaaaaattgccctccatattgagaaggagatgtttaacttgtttcaagttacagataatcgctacaagagtaaatatcgcagcatcatgttcaacctgaaggaccctaaaaatcagggactcttccatcgtgttctgcgtgaggaaatctctttggcgaaacttgtgagactgaagccagaagaacttgtatctaaagagctttccacgtggaaagagaggccagcgagatctgtgatggagtccagaactaaactgcacaatgaaagcaagaagacggcccccaggcaggaggccatccccgatctggaggactctccgccagtgtcggattcagaggaacagcaagagtcagcacgtgctgtccctgagaagagcacagcgccgcttctcgacgtcttcagcagcatgttgaaagacaccaccagtcagcaccgcgcacacctcttcgatctcaactgtaaaatttgcacaggccaggttccctccgcagaagatgagccagctccgaaaaaacaaaaattgtcagcttctgttaagaaagaagacttaaaatcaaagcatgacagctctgcacctgacccagctccggattcagctgatgaggtgatgccggaggctgtgcctgaagttgcctctgagccaggcctagaaagtgcttctcatccaaatgtggacagaacgtatttccctgggcctccaggagatggccatcccgagccctccccgctggaagacctgtccccctgcccagcctcctgtgggagcggggtggtcaccaccgtcacagtgtccggccgggaccccaggaccgctccaagcagttcatgcacagccgtggcctccgcagcatcccgcccagacagcacccacatggtggaagccagacaggatgtgccgaagcctgtcttgacttctgtgatggtgcccaagtccatactagctaagccatcctcatctcctgacccaagatacctgtcagttcctccgtcaccaaatatcagcacttcagaatcacgttcccctccagagggagacacgaccctctttttgtctcgactcagcaccatttggaaaggatttattaacatgcagagtgtggcaaaatttgtcactaaggcgtatcctgtctctgggtgttttgattacctcagtgaggatttgcctgacacaattcacattggtgggaggatcgcaccgaagacagtttgggattatgttggcaaactcaagtcttctgtgtctaaggagctctgtctgatccgcttccaccccgccacagaggaagaggaggtcgcctatatctctctctactcctatttcagcagccgtggccgctttggtgttgtagctaataacaacaggcacgtcaaggacctctacctgatcccgctgagcgcccaggaccctgttccatccaaactcttgccctttgagggaccagtcgtgagtcacacgtcctaatattgttggttagtctacactggaaagcctgg

SEQ ID NO: 356864 - DNA, 3025 bp, Homo sapiens
  misc_feature (1885)..(1885): n is a, c, g, or t
  misc_feature (1920)..(1920): n is a, c, g, or t
  misc_feature (2813)..(2814): n is a, c, g, or t
tggcgaattcggcacgaggggaaatggctgcgagaccctagaggctgcggctgcggagcttactccacgggaacagcctctagataatctgagttgttgaaaatacgaagcctgttactcgtgaacagtggctgacaacagtgttgttgtgagcctggctgtctgcttggacccagaggtttcgtctgccagggtttttggttgtatttaggatttcagggaaaagtgtccaagctttcagtgttggagcaggtatggacgacaaaggcgacccgagcaatgaggaggcacctaaggccatcaaacccaccagcaaagagttcaggaaaacatggggttttcgaaggaccactatcgccaagcgagagggcgcaggggacgcggaggctgacccactggagccgccacccccacagcagcagctgggcctgtccctgcggcgcagtgggaggcagcccaagcgcactgagcgcgtggagcagttcctgaccattgcgcggcgccgcggcaggaggagcatgcctgtctccctggaggattctggtgagcccacgtcctgccccgccacagacgccgagacagcctccgagggcagcgtggaaagcgcttctgagaccagaagcggcccccagtctgcttccacagctgtgaaggaacgaccagcctcttctgaaaaggtgaaaggaggggatgaccacgatgacacctccgatagtgacagcgatggcctgaccttgaaagagcttcagaatcgccttcgcaggaagcgggaacaggagcccactgagaggcccctgaaagggatccagagtcgcctgcggaagaagcgccgggaggagggtcccgccgagactgtgggctccgaggccagtgacactgtggagggcgtcctgcccagtaagcaggagcccgagaacgatcagggggttgtgtcccaggctgggaaagatgacagagagagtaagttggagggaaaggcggctcaggacatcaaagatgaggagcctggagacttgggccgaccgaagcctgaatgtgagggttacgaccccaacgccctgtattgcatttgccgccagcctcacaacaacaggtttatgatttgctgtgaccgctgtgaagaatggtttcatggcgattgtgtgggcatttctgaggctcgagggaggcttttggaaaggaatggggaagactatatctgcccaaactgcaccattctgcaagtgcaggatgagactcattcagaaacggcagatcagcaggaagctaaatggagacctggagatgctgatggcaccgattgtacaagtataggaacaatagagcagaagtctagcgaagaccaagggataaagggtagaattgagaaagctgcaaatccaagtggcaagaagaaactcaagatcttccagcctgtgatagaggcgcctggtgcctcaaaatgtattggccccgggtgctgtcacgtggcgcagcccgactcggtgtactgcagtaatgactgtatcctcaaacacgccgcagcgacaatgaagtttctaagctcaggtaaagaacagaagccaaagcctaaagaaaagatgaagatgaagccagagaagcccagtcttccgaaatgcggtgctcaggcaggtattaaaatctcttctgtgcacaagagaccagctccagaaaaaaaagagaccacagtgaagaaggcagtggtggtccctgcgcggagtgaagcactcgggaaggaagcagcttgtgagagcagcacgccgtcgtgggcgagcgatcacaattacaatgcagtaaagccagaaaagactgctgctccctcgccgtcactgttgtataaatccacgaaggaagacaggaggtccgaggagaaagcggcagccanggcagcctcaaagaaaacagcccctccaggctccncggtgggcaagcagcctgcacctagaaacctcgtgccaaagaagtcttcttttgctaatgtggcagcagccacaccagccattaaaaagccaccctcaggtttcaagggcaccatccccaagaggccatggctctccgctaccccatcgagtggtgcttcagctgccaggcaggccggaccggcacctgcagcggcgacggctgcctccaagaagttccctggctccgctgctttggtgggagccgtaaggaagccagtggtaccttctgttccaatggcctcgccagccccaggacgccttggggctatgagtgctgcaccatcgcagccaaattcacaaattcggcaaaatatcagacgctccttaaaagagattttgtggaaaagagtcaatgacagcgatgacttaatcatgacagaaaacgaagtaggaaaaattgccctccatattgagaaggagatgtttaacttgtttcaagttacagataatcgctacaagagtaaatatcgcagcatcatgttcaacctgaaggaccctaaaaatcaggtgtgtgcctggtgtcggtgcattggagtattcctgttctgttcgctgggtgctaaagggatcaaccaatattttgagatgttcgtgtcctttccaggaaagctaagacgtttctttctcctctgtgatccttctgccgcccacgtattgttgcactggcgttgagcgtcctggaaaccccttcccttccctgccttaactagggtcgcgtccgcttcctggcttccctgaagtccaccttttatcaccacattagtctcctgtaaatgttgctgtgatggtccaagccagtcgcgtcagtgggctccatagtaacgtcccgtccttcatcaaagagttgaatanngacaagtgtcttatgtagttccttttttttattctgttcagagtcaatgacagcgatgacttaatcatgacagaaaacgaagtaggaaaaatggccctccatattgagaaggagatgtttaacttgtttcaagttacagataatcgctacaagagtaaatatcgcagcatcatgttcaacctgaaggaccctaaaaatcaggtgtgtgcct

SEQ ID NO: 356865 - DNA, 1593 bp, Homo sapiens
tagcactgttcagggagttttcttgattattttcaaatgattatttagcctttgaatgacttaatttttaaggctggtccttttgaaccctcggcgttgggcacagcctcgcgcgcaggcctttcctctcatttggctcatttggttcattgccgcactcctcctgtcatcttggcagcctgtccagtggctgctgctcctgtcatcttggcaacttggcacctcatcagggttgcaggtgactctgtgccagccgcccttcacggagcacaagtggttgaagttctcagttttgcacggggaaactgcgggcccaccgcgggcccaccgaatacgcaagtgtgttgaactgctgccaagcaggcgcaggatgggtgcagggtcttcagatggcctcaggaagacattgggtccccgccttcatctctcagtgaaatgaagtgaaggtatgatttcttacctttttaatgatttggggttttactgattatccaggcaggtattaaaatctcttctgtgcacaagagaccagctccagaaaaaaaagagaccacagtgaagaaggcagtggtggtccctgcgcggagtgaagcactcgggaaggaagcagcttgtgagagcagcacgccgtcgtgggcgagcgatcacaattacaatgcagtaaagccagaaaagactgctgctccctcgccgtcactgttgtataaatgtatgtatcacctaggggttggcctcctggacccctcccgttctttctggatagccatcccctgggcctgtccaggactgggagttgcagctttgtgttaagctgatcacagacaccggctgcaccatcagcgggaagcagagcccatgtccaggatgcctcctgctgccctgtgtccatccctagtctgtcaggacttcctgtcactgttttccaaagctgtaaacctcactggtgaacgttcaccttaatgattgattctttaatctctgttttcactctcaggctctggtaagtattcgtattctcttcatcccagtctgattgcatagccacactgcccggcacgccacatccacccctgtctgcacatgagttgttctgacaacagcgctgtatacgcttcagtttttccacattgtccacggccagcacatgaaagcatcacttcttttttatgttgtgggaatctttgcaagttagtgttgcatctgattttcaggtgtacatttatttttgactgggcagataggggatttttttttttccatgtccgattcacacgctacacacccacatgaacacattcgaacttcgaaggccacacactcctgcttcataggccccacggtaagtgagttcacacctagaacactgtcctgaccgcaggacgcgtgccttggacttggtattctacatgtgactggctttcttgccctcgtctcttgaatgtttagactcttaagatcatatcctgccccaaatttcaaattaatgaaatgaagatatttcaaacagatctttgaaacctcagattctgtggtgcaattttaatgttttcttgtttctcagttttctgctataaaactattttcaattcagaa

SEQ ID NO: 356866 - DNA, 5990 bp, Homo sapiens
  misc_feature (326)..(326): n is a, c, g, or t
  misc_feature (361)..(361): n is a, c, g, or t
  misc_feature (2529)..(2529): n is a, c, g, or t
  misc_feature (3754)..(3754): n is a, c, g, or t
caagcctttaataactagagtttgctggttgaaggtaaaagatagaataataaagcattcttctttctgaaataaaatgtagtcaccgtcataaatgctgctggcggtcctcccttacactcctctgaacactaacattttacaaatccttttctctatgtgtatcctattcagtaatgccaggtgggcacttacaggtttaagggtaagtctgctttttagagtcaggtgacagcaccctgtggtgtcctcccttactcagcgcctgtgttcttctttgtagccacgaaggaagacaggaggtccgaggagaaagcggcagccanggcagcctcaaagaaaacagcccctccaggctccncggtgggcaagcagcctgcacctagaaacctcgtgccaaagaagtcttcttttgctaatgtggcagcagccacaccagccattaaaaagccaccctcaggtttcaagggcaccatccccaagaggccatggctctccgctaccccatcgagtggtgcttcagctgccaggcaggccggaccggcacctgcagcggcgacggctgcctccaagaagttccctggctccgctgctttggtgggagccgtaaggaagccagtggtaccttctgttccaatggcctcgccagccccaggacgccttggggctatgagtgctgcaccatcgcagccaaattcacaaattcggcaaaatatcagacgctccttaaaagagattttgtggaaaagagtcaatgacagcgatgacttaatcatgacagaaaacgaagtaggaaaaattgccctccatattgagaaggagatgtttaacttgtttcaagttacagataatcgctacaagagtaaatatcgcagcatcatgttcaacctgaaggaccctaaaaatcagggactcttccatcgtgttctgcgtgaggaaatctctttggcgaaacttgtgagactgaagccagaagaacttgtatctaaagagctttccacgtggaaagagaggccagcgagatctgtgatggagtccagaactaaactgcacaatgaaagcaagaagacggcccccaggcaggaggccatccccgatctggaggactctccgccagtgtcggattcagaggaacagcaagagtcagcacgtgctgtccctgagaagagcacagcgccgcttctcgacgtcttcagcagcatgttgaaagacaccaccagtcagcaccgcgcacacctcttcgatctcaactgtaaaatttgcacaggccaggttccctccgcagaagatgagccagctccgaaaaaacaaaaattgtcagcttctgttaagaaagaagacttaaaatcaaagcatgacagctctgcacctgacccagctccggattcagctgatgaggtgatgccggaggctgtgcctgaagttgcctctgagccaggcctagaaagtgcttctcatccaaatgtggacagaacgtatttccctgggcctccaggagatggccatcccgagccctccccgctggaagacctgtccccctgcccagcctcctgtgggagcggggtggtcaccaccgtcacagtgtccggccgggaccccaggaccgctccaagcagttcatgcacagccgtggcctccgcagcatcccgcccagacagcacccacatggtggaagccagacaggatgtgccgaagcctgtcttgacttctgtgatggtgcccaagtccatactagctaagccatcctcatctcctgacccaagatacctgtcagttcctccgtcaccaaatatcagcacttcagaatcacgttcccctccagagggagacacgaccctctttttgtctcgactcagcaccatttggaaaggatttattaacatgcagagtgtggcaaaatttgtcactaaggcgtatcctgtctctgggtgttttgattacctcagtgaggatttgcctgacacaattcacattggtgggaggatcgcaccgaagacagtttgggattatgttggcaaactcaagtcttctgtgtctaaggagctctgtctgatccgcttccaccccgccacagaggaagaggaggtcgcctatatctctctctactcctatttcagcagccgtggccgctttggtgttgtagctaataacaacaggcacgtcaaggacctctacctgatcccgctgagcgcccaggaccctgttccatccaaactcttgccctttgagggaccaggtaagcgccggctttctgggtggaggtgaggcccacctgcacctgcacccctcctcccactgacatgccctgctgagtcctgaccagcccagggctctctgggagcaggagttaggagcacagacgcagcggttagcaataggattcatctttgagggcgtaggactgtggcacgagaagtacccctgattcacagcataaattgtcttaggagagttttttagagagggaaaaacccacagcctgcaaccagctcatcttggcctcaggtcagagaagactcagtgcccagnagcccaaggctcagccagaaagggaggtgacactcccagcggccctgctctttcctctagacagactcgggagccagcacacaccgggaagtggctccatcagggatcacttctctaacagggatggatttccaggagacttaacaataatgacatagaaaactatttctagaaataattattttaaaatctgcagctcaaattgtaataggttcattcatctttggcaagctattttgtgtttgcacgttccttggaaagtactgtatttaaacgattatttacaaatagcctaaaatacatctttgtcaagggttgagggtgattccaggggccacgtgctctgttagtgaccagctctttcatagccccttagaagaagctgatgtgacttcagttaggggttagtatctgatgcccaactgaagtgtctccgtggccatgcagtccccagaggattggtgttctctcaaagcgggtgtgtggatcacacagtgtcctctgaagtgcttcgtcataaaggcaggtgctgtctggaccctgtgcctcagtgccctctgtccctgtcaccaggcctcggcgggtgttcctgccatagctgtgcagggtgttcccacccacacccctcatgccgcaccctagctagctggggtcctgtaggggccactccacatcttgggcgggacttctgtcgccccaggcacagcccacgttcctactggagcccattcttcacagctggagtgggctcagcctatgcctgtgttgtggaattatatgtccataaagggattggttggtatcagtaatttcagggttaaatatttgctggcgtggtgcattaaattattttagtgccagataaatttttaaaagcaaagtgctttagtgtgtcccctcaaatcctacttgggataaagagatgccacctaatgggtggcagaaaggaccctggtagaggttcttggtgttgcttgtgaagagctctggccagctccacgtgaccagggagaggaaaagcccggccctcctggaggtgaagaccgagaagctggcctctccgcacctgtgaagacccactggtcagttgcaagtgcgacagtgtgtgcactcagtgcagacactgcagcacctcagcacctccctaccggggtggaaagagcactttttctttacagaaacatgattcttagatagcgagcctcccctttttaaaacaattgangcgatatttcatcctttcttgagcttctctccctgctcatctccaaacttggagctgtcaggtgagcacaggttgtagggtgttgagcgagccccggcgcatgccgggcaccgggttccccacactgggcagtgacggggcccagggaggccaccagaggagcggcgcctccattctccccacagcaagggctggctgtgcaggtgcagccccggggcagagggaaaggacaggtctcccagcacctcccggatggcaccgggacaaggagggctgggctggggtcactcaccttgtctgctgagtgcgatggcaccaaccacccacactgtcagctccgcgaccagctgggggaacgtcacactcgcccaccaaggcacttgctgaggccacgacgccgcctgacggggacacacaaaagccccagggactttgatccacgataaagagcagaggcgtctgggtaaagtaacacagggcaagggactttagaaaagtaacagctagtgaaacctttccatacacttcagaaatgttttaacttaagacttcagtataatgttaacttctcctgatgtccttgttgacatgaatgcgtgtgcgtgaaatctcacacacttccatggtcactaaacagccttcaccccgggccaggccatcgggtactcggcccgcttcacgtactgattacttgacttggcgttttctagatataaacatgtacatgtgtgtcctggctttgtggtgtaaatgtgtagtgcgtgtgcatgtgcgcgcgtgtgtgtgtgtaaggctaggtcctggcacgtttcccctgtctcagcggaccctgtcctcacggagatagcccagaagcccttggacagcacaggccacacctgagggtgctgatggtggtgactccacagagctgtggtcaggggtgagcgtgtgctgcgcagcttggagtcacgcccccagaagtgctgggtgagggtctgcaggacccagctccattccacagcctcagttctctgcggcacatgcagcacaggcctgaaggagacctggcgccccagccttgagctgcccgtctgcatcagggcactgatgtgggagcatcttcccctggggatgttaaggagaaggtcctgttgggggtagagattcacgcagaaaagagtgactgactcgtccatgtgcctcagtttataccacacaattgcaggtgtccatgcctcccacacatggggacctagtgggttttgacagcgtggtgtccagtcctagccccctcagtgcttgctgttcacacttaagcaagtgaaggcctgaaggtgcccagctgtgccctcaggggaaacttaagtcacccgccctgtcagcacttggcccttgtcgggcagtgagagtggagctgcccccgcagcaccctcaggagccatgcagttcacagcagtagctggatctccctgaggacatttgtccttgcatatcttaatgatttgtccacagaaacaccgggttgtcttcctctgcccctctgccccgcagtgggggcactctctgtaactcagcatcacggtggggggcagctgggaggcctggttccaggtgaccttctccacctagatgttcaccccactcagttccagctttaccaacagggccccccgcagggacttggggtcgcagagtcccggcctgtctcagggccttgttcatggaagggagatgagtcaggttgaaagctcatcgtgtagggttctgtgcagggcccttacaggactggaccgcagccaagatgcctgcctgttaaccatgcccagcccccgtcatttccgcgtgaagccgcaggcctcggagccttggtctgaaatgcctgtggagtaacctcggtccataaacatgggtgcacagtctgttctccccaagtacagggcaggaggaaacaccgccctctgtagctgctcgaatggaaagggctcttttctctgaggtctttatacattagaaagctcttctgggaagaatgtttgaatccatagtgtctttctgtattcacttttaattgctttctaaattagctgagaaattctgacttgaaatattgtcaggtaagcatttcttcagttttcatgtgtgtatgtaacagtagctttgcatggaaattgtaatcagagtcaaatacagtattgaatggaatgtactgccttctcctcctaaatcaataaacatctttcatggaaaaaaaaac

SEQ ID NO: 356867 - DNA, 1004 bp, Homo sapiens
cctgggtccgtatttccggatcttgtgagagcagcacgccgtcgtgggcgagcgatcacaattacaatgcagtaaagccagaaaagactgctgctccctcgccgtcactgttgtataaatgtatgtatcacctaggggttggcctcctggacccctcccgttctttctggatagccatcccctgggcctgtccaggactgggagttgcagctttgtgttaagctgatcacagacaccggctgcaccatcagcgggaagcagagcccatgtccaggatgcctcctgctgccctgtgtccatccctagtctgtcaggacttcctgtcactgttttccaaagctgtaaacctcactggtgaacgttcaccttaatgattgattctttaatctctgttttcactctcaggctctggtaagtattcgtattctcttcatcccagtctgattgcatagccacactgcccggcacgccacatccacccctgtctgcacatgagttgttctgacaacagcgctgtatacgcttcagtttttccacattgtccacggccagcacatgaaagcatcacttcttttttatgttgtgggaatctttgcaagttagtgttgcatctgattttcaggtgtacatttatttttgactgggcagataggggatttttttttttccatgtccgattcacacgctacacacccacatgaacacattcgaacttcgaaggccacacactcctgcttcataggccccacggtaagtgagttcacacctagaacactgtcctgaccgcaggacgcgtgccttggacttggtattctacatgtgactggctttcttgccctcgtctcttgaatgtttagactcttaagatcatatcctgccccaaatttcaaattaatgaaatgaagatatttcaaacagatctttgaaacctcagattctgtggtgcaattttaatgttttcttgtttctcagttttctgctataaaactattttcaattcagaa

SEQ ID NO: 356868 - DNA, 966 bp, Homo sapiens
  misc_feature (554)..(554): n is a, c, g, or t
  misc_feature (558)..(558): n is a, c, g, or t
gcttgatgtggttttcactgggagagttggtgacttacgactaatactcaccctgccacccagcccctcccttagcctgactggccagccaggccctctcccaggcatggtgtgggtctcctgtagcccccgagccccctccactctgtcctgggccagcctctcctttttggctcctccaagtgggcagtaattggctgggctccagctgggagcctgggttatggttgacacacatttcccacatgaacacattcgaacttcgaaggccacacactcctgcttcataggccccacggtaagtgagttcacacctagaacactgtcctgaccgcaggacgcgtgccttggacttggtattctacatgtgactggctttcttgccctcgtctcttgaatgtttagactcttaagatcatatcctgccccaaatttcaaattaatgaaatgaagatatttcaaacagatctttgaaacctcagattctgtggtgcaattttaatgttttcttgtttctcagttttctgctataaaactattttcaattcagaaantaangccttctgtctatagtgcattttgtgctttttttaaaaagcaccgaaaggttaaatagtctcaattcaaagatgatcacagagtgccccactttcccgtcgtcagactttgagcagattccctaagggaaggcactcatgcaggcaagcagacctatgctaggtctggtgtgccttacaaaaaagacactttttttttttttttttttttttttttgagacaagagtcttgctctgtcacccaggctggagtgcagtggcatgatctcggctcactgcaagctccacctccgggttcaaatgattctcctacctcagcctcccaagtagctgggattacaggcccgtgccaccatgcctggctaatttttgtatttttagtagagacggggtttcaccatgttggtca

SEQ ID NO: 356869 - DNA, 412 bp, Homo sapiens
cagggtttttggttgtatttaggatttcagggaaaagtgtccaagctttcagtgttggagcaggtaaggtatcaacactgttagtagcaacaaaattttaacttaataagtctgtatttgctatttataaagtggcatttgtaaagaaactgatagtagaatgtagtattcgtattcatttgaaatacattcagccatttgtatcagcagtctctatagcagcagattctgcatctgtggattcaaccagctgcagattggaaatatttgggggacaaacaataaataataatctgacaataaaaaataataaaaatgttataaaacagtgtagtacagcaactgtttctatgatgtaatctagagatgatctaaatatttgagaggttttgcataggtcatgtgcaaatag

SEQ ID NO: 356870 - DNA, 521 bp, Homo sapiens
gggcggcagtccaggggtctcctcacactcctgccccctgcagggcatgacgggcagtgacagtgtgaatgccttacctggctttttcatagcttgaatcaacaaaatgtttattcatattaaaagtactgttagtatctcattttgaaactgtggccttggtactataaatggtgattttacaaaacacacacttaactgcttaaaattggcaagtacattgtttgaagtcatctgttttgttctgcaggtgatagaggcgcctggtgcctcaaaatgtattggccccgggtgctgtcacgtggcgcagcccgactcggtgtactgcagtaatgactgtatcctcaaacacgccgcagcgacaatgaagtttctaagctcaggtaaagaacagaagccaaagcctaaagaaaagatgaagatgaagccagagaagcccagtcttccgaaatgcggtgctcaggtgagtggaccaggaccagccgcccaggcagtggacgcacaggcgtgagagcgtttgt

SEQ ID NO: 356871 - DNA, 478 bp, Homo sapiens
tgttcaaaaagtttaatatacacaagtgtcttatgtagttccttttttttattctgttcagagtcaatgacagcgatgacttaatcatgacagaaaacgaagtaggaaaaattgccctccatattgagaaggagatgtttaacttgtttcaagttacagataatcgctacaagagtaaatatcgcagcatcatgttcaacctgaaggaccctaaaaatcaggtgtgtgcctggtgtcggtgcattggagtattcctgttctgttcgctgggtgctaaagggatcaaccaatattttgagatgttcgtgtcctttccaggaaagctaagacgtttctttctcctctgtgatccttctgccgcccacgtattgttgcactggcgttgagcgtcctggaaaccccttcccttccctgccttaactagggtcgcgtccgcttcctggcttccctgaagtccaccttttatcaccacattagt

SEQ ID NO: 356872 - DNA, 2978 bp, Homo sapiens
ggggagcgggagggcaggcgcaccggaggccgcccctcagcacctctcgcgacagcaagagagcgcgagagcgcgagccgatgaccaatgaagcgcccccgcgagggggcggggcggacggcctcccggaagcgcggaacctcagcttccgtacttgcgcagaactcccctcgcggcgaccacgcactacgggttggcgccagagtcaaaaggcgtcggccctctggcaagatggctgctgcggaggcgttggagcgcggaaatctggaaccgggatggcgacgtctacactgagtcggaggcgaaggagcttactccacgggaacagcctctagataatctgagttgttgaaaatacgaagcctgttactcgtgaacagtggctgacaacagtgttgttgtgagcctggctgtctgcttggacccagaggtttcgtctgccagggtttttggttgtatttaggatttcagggaaaagtgtccaagctttcagtgttggagcaggtatggacgacaaaggcgacccgagcaatgaggaggcacctaaggccatcaaacccaccagcaaagagttcaggaaaacatggggttttcgaaggaccactatcgccaagcgagagggcgcaggggacgcggaggctgacccactggagccgccacccccacagcagcagctgggcctgtccctgcggcgcagtgggaggcagcccaagcgcactgagcgcgtggagcagttcctgaccattgcgcggcgccgcggcaggaggagcatgcctgtctccctggaggattctggtgagcccacgtcctgccccgccacagacgccgagacagcctccgagggcagcgtggaaagcgcttctgagaccagaagcggcccccagtctgcttccacagctgtgaaggaacgaccagcctcttctgaaaaggtgaaaggaggggatgaccacgatgacacctccgatagtgacagcgatggcctgaccttgaaagagcttcagaatcgccttcgcaggaagcgggaacaggagcccactgagaggcccctgaaagggatccagagtcgcctgcggaagaagcgccgggaggagggtcccgccgagactgtgggctccgaggccagtgacactgtggagggcgtcctgcccagtaagcaggagcccgagaacgatcagggggttgtgtcccaggctgggaaagatgacagagagagtaagttggagggaaaggcggctcaggacatcaaagatgaggagcctggagacttgggccgaccgaagcctgaatgtgagggttacgaccccaacgccctgtattgcatttgccgccagcctcacaacaacaggtttatgatttgctgtgaccgctgtgaagaatggtttcatggcgattgtgtgggcatttctgaggctcgagggaggcttttggaaaggaatggggaagactatatctgcccaaactgcaccattctgcaagtgcaggatgagactcattcagaaacggcagatcagcaggaagctaaatggagacctggagatgctgatggcaccgattgtacaagtataggaacaatagagcagaagtctagcgaagaccaagggataaagggtagaattgagaaagctgcaaatccaagtggcaagaagaaactcaagatcttccagcctgtgatagaggcgcctggtgcctcaaaatgtattggccccgggtgctgtcacgtggcgcagcccgactcggtgtactgcagtaatgactgtatcctcaaacacgccgcagcgacaatgaagtttctaagctcaggtaaagaacagaagccaaagcctaaagaaaagatgaagatgaagccagagaagcccagtcttccgaaatgcggtgctcaggcaggtattaaaatctcttctgtgcacaagagaccagctccagaaaaaaaagagaccacagtgaagaaggcagtggtggtccctgcgcggagtgaagcactcgggaaggaagcagcttgtgagagcagcacgccgtcgtgggcgagcgatcacaattacaatgcagtaaagccagaaaagactgctgctccctcgccgtcactgttgtataaatgtatgtatcacctaggggttggcctcctggacccctcccgttctttctggatagccatcccctgggcctgtccaggactgggagttgcagctttgtgttaagctgatcacagacaccggctgcaccatcagcgggaagcagagcccatgtccaggatgcctcctgctgccctgtgtccatccctagtctgtcaggacttcctgtcactgttttccaaagctgtaaacctcactggtgaacgttcaccttaatgattgattctttaatctctgttttcactctcaggctctggtaagtattcgtattctcttcatcccagtctgattgcatagccacactgcccggcacgccacatccacccctgtctgcacatgagttgttctgacaacagcgctgtatacgcttcagtttttccacattgtccacggccagcacatgaaagcatcacttcttttttatgttgtgggaatctttgcaagttagtgttgcatctgattttcaggtgtacatttatttttgactgggcagataggggatttttttttttccatgtccgattcacacgctacacacccacatgaacacattcgaacttcgaaggccacacactcctgcttcataggccccacggtaagtgagttcacacctagaacactgtcctgaccgcaggacgcgtgccttggacttggtattctacatgtgactggctttcttgccctcgtctcttgaatgtttagactcttaagatcatatcctgccccaaatttcaaattaatgaaatgaagatatttcaaacagatctttgaaacctcagattctgtggtgcaattttaatgttttcttgtttctcagttttctgctataaaactattttcaattcagaa

SEQ ID NO: 356873 - DNA, 1147 bp, Homo sapiens
  misc_feature (902)..(902): n is a, c, g, or t
ggggagcgggagggcaggcgcaccggaggccgcccctcagcacctctcgcgacagcaagagagcgcgagagcgcgagccgatgaccaatgaagcgcccccgcgagggggcggggcggacggcctcccggaagcgcggaacctcagcttccgtacttgcgcagaactcccctcgcggcgaccacgcactacgggttggcgccagagtcaaaaggcgtcggccctctggcaagatggctgctgcggaggcgttggagcgcggaaatctggaaccgggatggcgacgtctacactgagtcggaggcgaaggagcttactccacgggaacagcctctagataatctgagttgttgaaaatacgaagcctgttactcgtgaacagtggctgacaacagtgttgttgtgagcctggctgtctgcttggacccagaggtttcgtctgccagggtttttggttgtatttaggatttcagggaaaagtgtccaagctttcagtgttggagcaggtatggacgacaaaggcgacccgagcaatgaggaggcacctaaggccatcaaacccaccagcaaagagttcaggaaaacatggggttttcgaaggaccactatcgccaagcgagagggcgcaggggacgcggaggctgacccactggagccgccacccccacagcagcagctgggcctgtccctgcggcgcagtgggaggcagcccaagcgcactgagcgcgtggagcagttcctgaccattgcgcggcgccgcggcaggaggagcatgcctgtctccctggaggattctggtgagcccacgtcctgccccgccacagacgccgagacagcctccgagggcagcgtggaaagcgcttctgagaccagaagcggcccccagtctgcttccacaggtganaggaggggatgacacgatgacactctggacctccgttctttctgtagcatccctgggctgtcagactgggttgagttggtgaggtgtccagacacggtgcatcaggggaaggagcctgtcggagcccgggcgggcacccaggggggagcgtcggtcagggaccggtggggccaggggttacgggccgggggtgtttcccgggggaggggggcccgcgggtgtaggggtttttgccctatgggggt

SEQ ID NO: 356874 - DNA, 3140 bp, Homo sapiens
  misc_feature (2728)..(2728): n is a, c, g, or t
  misc_feature (2732)..(2732): n is a, c, g, or t
tggcgaattcggcacgaggggaaatggctgcgagaccctagaggctgcggctgcggagcttactccacgggaacagcctctagataatctgagttgttgaaaatacgaagcctgttactcgtgaacagtggctgacaacagtgttgttgtgagcctggctgtctgcttggacccagaggtttcgtctgccagggtttttggttgtatttaggatttcagggaaaagtgtccaagctttcagtgttggagcaggtatggacgacaaaggcgacccgagcaatgaggaggcacctaaggccatcaaacccaccagcaaagagttcaggaaaacatggggttttcgaaggaccactatcgccaagcgagagggcgcaggggacgcggaggctgacccactggagccgccacccccacagcagcagctgggcctgtccctgcggcgcagtgggaggcagcccaagcgcactgagcgcgtggagcagttcctgaccattgcgcggcgccgcggcaggaggagcatgcctgtctccctggaggattctggtgagcccacgtcctgccccgccacagacgccgagacagcctccgagggcagcgtggaaagcgcttctgagaccagaagcggcccccagtctgcttccacagctgtgaaggaacgaccagcctcttctgaaaaggtgaaaggaggggatgaccacgatgacacctccgatagtgacagcgatggcctgaccttgaaagagcttcagaatcgccttcgcaggaagcgggaacaggagcccactgagaggcccctgaaagggatccagagtcgcctgcggaagaagcgccgggaggagggtcccgccgagactgtgggctccgaggccagtgacactgtggagggcgtcctgcccagtaagcaggagcccgagaacgatcagggggttgtgtcccaggctgggaaagatgacagagagagtaagttggagggaaaggcggctcaggacatcaaagatgaggagcctggagacttgggccgaccgaagcctgaatgtgagggttacgaccccaacgccctgtattgcatttgccgccagcctcacaacaacaggtttatgatttgctgtgaccgctgtgaagaatggtttcatggcgattgtgtgggcatttctgaggctcgagggaggcttttggaaaggaatggggaagactatatctgcccaaactgcaccattctgcaagtgcaggatgagactcattcagaaacggcagatcagcaggaagctaaatggagacctggagatgctgatggcaccgattgtacaagtataggaacaatagagcagaagtctagcgaagaccaagggataaagggtagaattgagaaagctgcaaatccaagtggcaagaagaaactcaagatcttccagcctgtgatagaggcgcctggtgcctcaaaatgtattggccccgggtgctgtcacgtggcgcagcccgactcggtgtactgcagtaatgactgtatcctcaaacacgccgcagcgacaatgaagtttctaagctcaggtaaagaacagaagccaaagcctaaagaaaagatgaagatgaagccagagaagcccagtcttccgaaatgcggtgctcaggcaggtattaaaatctcttctgtgcacaagagaccagctccagaaaaaaaagagaccacagtgaagaaggcagtggtggtccctgcgcggagtgaagcactcgggaaggaagcagcttgtgagagcagcacgccgtcgtgggcgagcgatcacaattacaatgcagtaaagccagaaaagactgctgctccctcgccgtcactgttgtataaatgtatgtatcacctaggggttggcctcctggacccctcccgttctttctggatagccatcccctgggcctgtccaggactgggagttgcagctttgtgttaagctgatcacagacaccggctgcaccatcagcgggaagcagagcccatgtccaggatgcctcctgctgccctgtgtccatccctagtctgtcaggacttcctgtcactgttttccaaagctgtaaacctcactggtgaacgttcaccttaatgattgattctttaatctctgttttcactctcaggctctggtaagtattcgtattctcttcatcccagtctgattgcatagccacactgcccggcacgccacatccacccctgtctgcacatgagttgttctgacaacagcgctgtatacgcttcagtttttccacattgtccacggccagcacatgaaagcatcacttcttttttatgttgtgggaatctttgcaagttagtgttgcatctgattttcaggtgtacatttatttttgactgggcagataggggatttttttttttccatgtccgattcacacgctacacacccacatgaacacattcgaacttcgaaggccacacactcctgcttcataggccccacggtaagtgagttcacacctagaacactgtcctgaccgcaggacgcgtgccttggacttggtattctacatgtgactggctttcttgccctcgtctcttgaatgtttagactcttaagatcatatcctgccccaaatttcaaattaatgaaatgaagatatttcaaacagatctttgaaacctcagattctgtggtgcaattttaatgttttcttgtttctcagttttctgctataaaactattttcaattcagaaantaangccttctgtctatagtgcattttgtgctttttttaaaaagcaccgaaaggttaaatagtctcaattcaaagatgatcacagagtgccccactttcccgtcgtcagactttgagcagattccctaagggaaggcactcatgcaggcaagcagacctatgctaggtctggtgtgccttacaaaaaagacactttttttttttttttttttttttttttgagacaagagtcttgctctgtcacccaggctggagtgcagtggcatgatctcggctcactgcaagctccacctccgggttcaaatgattctcctacctcagcctcccaagtagctgggattacaggcccgtgccaccatgcctggctaatttttgtatttttagtagagacggggtttcaccatgttggtca

SEQ ID NO: 356875 - DNA, 2668 bp, Homo sapiens
tggcgaattcggcacgaggggaaatggctgcgagaccctagaggctgcggctgcggagcttactccacgggaacagcctctagataatctgagttgttgaaaatacgaagcctgttactcgtgaacagtggctgacaacagtgttgttgtgagcctggctgtctgcttggacccagaggtttcgtctgccagggtttttggttgtatttaggatttcagggaaaagtgtccaagctttcagtgttggagcaggtatggacgacaaaggcgacccgagcaatgaggaggcacctaaggccatcaaacccaccagcaaagagttcaggaaaacatggggttttcgaaggaccactatcgccaagcgagagggcgcaggggacgcggaggctgacccactggagccgccacccccacagcagcagctgggcctgtccctgcggcgcagtgggaggcagcccaagcgcactgagcgcgtggagcagttcctgaccattgcgcggcgccgcggcaggaggagcatgcctgtctccctggaggattctggtgagcccacgtcctgccccgccacagacgccgagacagcctccgagggcagcgtggaaagcgcttctgagaccagaagcggcccccagtctgcttccacagctgtgaaggaacgaccagcctcttctgaaaaggtgaaaggaggggatgaccacgatgacacctccgatagtgacagcgatggcctgaccttgaaagagcttcagaatcgccttcgcaggaagcgggaacaggagcccactgagaggcccctgaaagggatccagagtcgcctgcggaagaagcgccgggaggagggtcccgccgagactgtgggctccgaggccagtgacactgtggagggcgtcctgcccagtaagcaggagcccgagaacgatcagggggttgtgtcccaggctgggaaagatgacagagagagtaagttggagggaaaggcggctcaggacatcaaagatgaggagcctggagacttgggccgaccgaagcctgaatgtgagggttacgaccccaacgccctgtattgcatttgccgccagcctcacaacaacaggtttatgatttgctgtgaccgctgtgaagaatggtttcatggcgattgtgtgggcatttctgaggctcgagggaggcttttggaaaggaatggggaagactatatctgcccaaactgcaccattctgcaagtgcaggatgagactcattcagaaacggcagatcagcaggaagctaaatggagacctggagatgctgatggcaccgattgtacaagtataggaacaatagagcagaagtctagcgaagaccaagggataaagggtagaattgagaaagctgcaaatccaagtggcaagaagaaactcaagatcttccagcctgtgatagaggcgcctggtgcctcaaaatgtattggccccgggtgctgtcacgtggcgcagcccgactcggtgtactgcagtaatgactgtatcctcaaacacgccgcagcgacaatgaagtttctaagctcaggtaaagaacagaagccaaagcctaaagaaaagatgaagatgaagccagagaagcccagtcttccgaaatgcggtgctcaggcaggtattaaaatctcttctgtgcacaagagaccagctccagaaaaaaaagagaccacagtgaagaaggcagtggtggtccctgcgcggagtgaagcactcgggaaggaagcagcttgtgagagcagcacgccgtcgtgggcgagcgatcacaattacaatgcagtaaagccagaaaagactgctgctccctcgccgtcactgttgtataaatgtatgtatcacctaggggttggcctcctggacccctcccgttctttctggatagccatcccctgggcctgtccaggactgggagttgcagctttgtgttaagctgatcacagacaccggctgcaccatcagcgggaagcagagcccatgtccaggatgcctcctgctgccctgtgtccatccctagtctgtcaggacttcctgtcactgttttccaaagctgtaaacctcactggtgaacgttcaccttaatgattgattctttaatctctgttttcactctcaggctctggtaagtattcgtattctcttcatcccagtctgattgcatagccacactgcccggcacgccacatccacccctgtctgcacatgagttgttctgacaacagcgctgtatacgcttcagtttttccacattgtccacggccagcacatgaaagcatcacttcttttttatgttgtgggaatctttgcaagttagtgttttccatgtccgattcacacgctacacacccacatgaacacattcgaacttcgaaggccacacactcctgcttcataggccccacggtaagtgagttcacacctagaacactgtcctgaccgcaggacgcgtgccttggacttggtattctacatgtgactggctttcttgccctcgtctcttgaatgtttagactcttaagatcatatcctgccccaaatttcaaattaatgaaatgaagatatttcaaacagatctttgaaacctcagattctgtggtgcaattttaatgttttcttgtttctcagttttctgctataaaactattttcaattcagaa

SEQ ID NO: 356876 - DNA, 2060 bp, Homo sapiens
ggggagcgggagggcaggcgcaccggaggccgcccctcagcacctctcgcgacagcaagagagcgcgagagcgcgagccgatgaccaatgaagcgcccccgcgagggggcggggcggacggcctcccggaagcgcggaacctcagcttccgtacttgcgcagaactcccctcgcggcgaccacgcactacgggttggcgccagagtcaaaaggcgtcggccctctggcaagatggctgctgcggaggcgttggagcgcggaaatctggaaccgggatggcgacgtctacactgagtcggaggcgaaggagcttactccacgggaacagcctctagataatctgagttgttgaaaatacgaagcctgaatgtgagggttacgaccccaacgccctgtattgcatttgccgccagcctcacaacaacaggtttatgatttgctgtgaccgctgtgaagaatggtttcatggcgattgtgtgggcatttctgaggctcgagggaggcttttggaaaggaatggggaagactatatctgcccaaactgcaccattctgcaagtgcaggatgagactcattcagaaacggcagatcagcaggaagctaaatggagacctggagatgctgatggcaccgattgtacaagtataggaacaatagagcagaagtctagcgaagaccaagggataaagggtagaattgagaaagctgcaaatccaagtggcaagaagaaactcaagatcttccagcctgtgatagaggcgcctggtgcctcaaaatgtattggccccgggtgctgtcacgtggcgcagcccgactcggtgtactgcagtaatgactgtatcctcaaacacgccgcagcgacaatgaagtttctaagctcaggtaaagaacagaagccaaagcctaaagaaaagatgaagatgaagccagagaagcccagtcttccgaaatgcggtgctcaggcaggtattaaaatctcttctgtgcacaagagaccagctccagaaaaaaaagagaccacagtgaagaaggcagtggtggtccctgcgcggagtgaagcactcgggaaggaagcagcttgtgagagcagcacgccgtcgtgggcgagcgatcacaattacaatgcagtaaagccagaaaagactgctgctccctcgccgtcactgttgtataaatgtatgtatcacctaggggttggcctcctggacccctcccgttctttctggatagccatcccctgggcctgtccaggactgggagttgcagctttgtgttaagctgatcacagacaccggctgcaccatcagcgggaagcagagcccatgtccaggatgcctcctgctgccctgtgtccatccctagtctgtcaggacttcctgtcactgttttccaaagctgtaaacctcactggtgaacgttcaccttaatgattgattctttaatctctgttttcactctcaggctctggtaagtattcgtattctcttcatcccagtctgattgcatagccacactgcccggcacgccacatccacccctgtctgcacatgagttgttctgacaacagcgctgtatacgcttcagtttttccacattgtccacggccagcacatgaaagcatcacttcttttttatgttgtgggaatctttgcaagttagtgttgcatctgattttcaggtgtacatttatttttgactgggcagataggggatttttttttttccatgtccgattcacacgctacacacccacatgaacacattcgaacttcgaaggccacacactcctgcttcataggccccacggtaagtgagttcacacctagaacactgtcctgaccgcaggacgcgtgccttggacttggtattctacatgtgactggctttcttgccctcgtctcttgaatgtttagactcttaagatcatatcctgccccaaatttcaaattaatgaaatgaagatatttcaaacagatctttgaaacctcagattctgtggtgcaattttaatgttttcttgtttctcagttttctgctataaaactattttcaattcagaa

SEQ ID NO: 356877 - DNA, 4237 bp, Homo sapiens
  misc_feature (1885)..(1885): n is a, c, g, or t
  misc_feature (1920)..(1920): n is a, c, g, or t
tggcgaattcggcacgaggggaaatggctgcgagaccctagaggctgcggctgcggagcttactccacgggaacagcctctagataatctgagttgttgaaaatacgaagcctgttactcgtgaacagtggctgacaacagtgttgttgtgagcctggctgtctgcttggacccagaggtttcgtctgccagggtttttggttgtatttaggatttcagggaaaagtgtccaagctttcagtgttggagcaggtatggacgacaaaggcgacccgagcaatgaggaggcacctaaggccatcaaacccaccagcaaagagttcaggaaaacatggggttttcgaaggaccactatcgccaagcgagagggcgcaggggacgcggaggctgacccactggagccgccacccccacagcagcagctgggcctgtccctgcggcgcagtgggaggcagcccaagcgcactgagcgcgtggagcagttcctgaccattgcgcggcgccgcggcaggaggagcatgcctgtctccctggaggattctggtgagcccacgtcctgccccgccacagacgccgagacagcctccgagggcagcgtggaaagcgcttctgagaccagaagcggcccccagtctgcttccacagctgtgaaggaacgaccagcctcttctgaaaaggtgaaaggaggggatgaccacgatgacacctccgatagtgacagcgatggcctgaccttgaaagagcttcagaatcgccttcgcaggaagcgggaacaggagcccactgagaggcccctgaaagggatccagagtcgcctgcggaagaagcgccgggaggagggtcccgccgagactgtgggctccgaggccagtgacactgtggagggcgtcctgcccagtaagcaggagcccgagaacgatcagggggttgtgtcccaggctgggaaagatgacagagagagtaagttggagggaaaggcggctcaggacatcaaagatgaggagcctggagacttgggccgaccgaagcctgaatgtgagggttacgaccccaacgccctgtattgcatttgccgccagcctcacaacaacaggtttatgatttgctgtgaccgctgtgaagaatggtttcatggcgattgtgtgggcatttctgaggctcgagggaggcttttggaaaggaatggggaagactatatctgcccaaactgcaccattctgcaagtgcaggatgagactcattcagaaacggcagatcagcaggaagctaaatggagacctggagatgctgatggcaccgattgtacaagtataggaacaatagagcagaagtctagcgaagaccaagggataaagggtagaattgagaaagctgcaaatccaagtggcaagaagaaactcaagatcttccagcctgtgatagaggcgcctggtgcctcaaaatgtattggccccgggtgctgtcacgtggcgcagcccgactcggtgtactgcagtaatgactgtatcctcaaacacgccgcagcgacaatgaagtttctaagctcaggtaaagaacagaagccaaagcctaaagaaaagatgaagatgaagccagagaagcccagtcttccgaaatgcggtgctcaggcaggtattaaaatctcttctgtgcacaagagaccagctccagaaaaaaaagagaccacagtgaagaaggcagtggtggtccctgcgcggagtgaagcactcgggaaggaagcagcttgtgagagcagcacgccgtcgtgggcgagcgatcacaattacaatgcagtaaagccagaaaagactgctgctccctcgccgtcactgttgtataaatccacgaaggaagacaggaggtccgaggagaaagcggcagccanggcagcctcaaagaaaacagcccctccaggctccncggtgggcaagcagcctgcacctagaaacctcgtgccaaagaagtcttcttttgctaatgtggcagcagccacaccagccattaaaaagccaccctcaggtttcaagggcaccatccccaagaggccatggctctccgctaccccatcgagtggtgcttcagctgccaggcaggccggaccggcacctgcagcggcgacggctgcctccaagaagttccctggctccgctgctttggtgggagccgtaaggaagccagtggtaccttctgttccaatggcctcgccagccccaggacgccttggggctatgagtgctgcaccatcgcagccaaattcacaaattcggcaaaatatcagacgctccttaaaagagattttgtggaaaagagtcaatgacagcgatgacttaatcatgacagaaaacgaagtaggaaaaattgccctccatattgagaaggagatgtttaacttgtttcaagttacagataatcgctacaagagtaaatatcgcagcatcatgttcaacctgaaggaccctaaaaatcagggactcttccatcgtgttctgcgtgaggaaatctctttggcgaaacttgtgagactgaagccagaagaacttgtatctaaagagctttccacgtggaaagagaggccagcgagatctgtgatggagtccagaactaaactgcacaatgaaagcaagaagacggcccccaggcaggaggccatccccgatctggaggactctccgccagtgtcggattcagaggaacagcaagagtcagcacgtgctgtccctgagaagagcacagcgccgcttctcgacgtcttcagcagcatgttgaaagacaccaccagtcagcaccgcgcacacctcttcgatctcaactgtaaaatttgcacaggccaggttccctccgcagaagatgagccagctccgaaaaaacaaaaattgtcagcttctgttaagaaagaagacttaaaatcaaagcatgacagctctgcacctgacccagctccggattcagctgatgaggtgatgccggaggctgtgcctgaagttgcctctgagccaggcctagaaagtgcttctcatccaaatgtggacagaacgtatttccctgggcctccaggagatggccatcccgagccctccccgctggaagacctgtccccctgcccagcctcctgtgggagcggggtggtcaccaccgtcacagtgtccggccgggaccccaggaccgctccaagcagttcatgcacagccgtggcctccgcagcatcccgcccagacagcacccacatggtggaagccagacaggatgtgccgaagcctgtcttgacttctgtgatggtgcccaagtccatactagctaagccatcctcatctcctgacccaagatacctgtcagttcctccgtcaccaaatatcagcacttcagaatcacgttcccctccagagggagacacgaccctctttttgtctcgactcagcaccatttggaaaggatttattaacatgcagagtgtggcaaaatttgtcactaaggcgtatcctgtctctgggtgttttgattacctcagtgaggatttgcctgacacaattcacattggtgggaggatcgcaccgaagacagtttgggattatgttggcaaactcaagtcttctgtgtctaaggagctctgtctgatccgcttccaccccgccacagaggaagaggaggtcgcctatatctctctctactcctatttcagcagccgtggccgctttggtgttgtagctaataacaacaggcacgtcaaggacctctacctgatcccgctgagcgcccaggaccctgttccatccaaactcttgccctttgagggaccaggtcttgagtcaccacgtccgaatataattcttgggttagtaatctgccaaaaaatcaaacgtcccgcaaacagtggagagttagacaagatggacgaaaagcggacccgacttcaaccggaagaagcggacgttccggcctatccaaaagtagccacagtcccgcagtcggaaaagaagccctccaagtatccactctgctctgcagacgcggctgtcagcaccacacctcctgggtcgccgccgcctccgccccctcttccagaaccaccggtgctaaaagtgctgtcatccctcaaacctgcagcccccagcccagccacagcagccacaacagcagcggcagcctccacggcagcttcctccaccgcttcgtctgcttccaaaacagcatcaccgctggagcacatcctgcagactctctttggaaagaagaaatcatt

SEQ ID NO: 356878 - DNA, 1146 bp, Homo sapiens
cttcccgctgatggtgcagccggtgactgtgatcagcttaacacaaagctgcaactcccagtcctgcagaggcacaagagaccagctccagaaaaaaaagagaccacagtgaagaaggcagtggtggtccctgcgcggagtgaagcactcgggaaggaagcagcttgtgagagcagcacgccgtcgtgggcgagcgatcacaattacaatgcagtaaagccagaaaagactgctgctccctcgccgtcactgttgtataaatgtatgtatcacctaggggttggcctcctggacccctcccgttctttctggatagccatcccctgggcctgtccaggactgggagttgcagctttgtgttaagctgatcacagacaccggctgcaccatcagcgggaagcagagcccatgtccaggatgcctcctgctgccctgtgtccatccctagtctgtcaggacttcctgtcactgttttccaaagctgtaaacctcactggtgaacgttcaccttaatgattgattctttaatctctgttttcactctcaggctctggtaagtattcgtattctcttcatcccagtctgattgcatagccacactgcccggcacgccacatccacccctgtctgcacatgagttgttctgacaacagcgctgtatacgcttcagtttttccacattgtccacggccagcacatgaaagcatcacttcttttttatgttgtgggaatctttgcaagttagtgttgcatctgattttcaggtgtacatttatttttgactgggcagataggggatttttttttttccatgtccgattcacacgctacacacccacatgaacacattcgaacttcgaaggccacacactcctgcttcataggccccacggtaagtgagttcacacctagaacactgtcctgaccgcaggacgcgtgccttggacttggtattctacatgtgactggctttcttgccctcgtctcttgaatgtttagactcttaagatcatatcctgccccaaatttcaaattaatgaaatgaagatatttcaaacagatctttgaaacctcagattctgtggtgcaattttaatgttttcttgtttctcagttttctgctataaaactattttcaattcagaa

SEQ ID NO: 356879 - DNA, 1948 bp, Homo sapiens
tggcgaattcggcacgaggggaaatggctgcgagaccctagaggctgcggctgcggagcttactccacgggaacagcctctagataatctgagttgttgaaaatacgaagcctgttactcgtgaacagtggctgacaacagtgttgttgtgagcctggctgtctgcttggacccagaggtttcgtctgccagggtttttggttgtatttaggatttcagggaaaagtgtccaagctttcagtgttggagcaggtatggacgacaaaggcgacccgagcaatgaggaggcacctaaggccatcaaacccaccagcaaagagttcaggaaaacatggggttttcgaaggaccactatcgccaagcgagagggcgcaggggacgcggaggctgacccactggagccgccacccccacagcagcagctgggcctgtccctgcggcgcagtgggaggcagcccaagcgcactgagcgcgtggagcagttcctgaccattgcgcggcgccgcggcaggaggagcatgcctgtctccctggaggattctggtgagcccacgtcctgccccgccacagacgccgagacagcctccgagggcagcgtggaaagcgcttctgagaccagaagcggcccccagtctgcttccacagctgtgaaggaacgaccagcctcttctgaaaaggtgaaaggaggggatgaccacgatgacacctccgatagtgacagcgatggcctgaccttgaaagagcttcagaatcgccttcgcaggaagcgggaacaggagcccactgagaggcccctgaaagggatccagagtcgcctgcggaagaagcgccgggaggagggtcccgccgagactgtgggctccgaggccagtgacactgtggagggcgtcctgcccagtaagcaggagcccgagaacgatcagggggttgtgtcccaggctgggaaagatgacagagagagtaagttggagggaaaggcggctcaggacatcaaagatgaggagcctggagacttgggccgaccgaagcctgaatgtgagggttacgaccccaacgccctgtattgcatttgccgccagcctcacaacaacaggtttatgatttgctgtgaccgctgtgaagaatggtttcatggcgattgtgtgggcatttctgaggctcgagggaggcttttggaaaggaatggggaagactatatctgcccaaactgcaccattctgcaagtgcaggatgagactcattcagaaacggcagatcagcaggaagctaaatggagacctggagatgctgatggcaccgattgtacaagtataggaacaatagagcagaagtctagcgaagaccaagggataaagggtagaattgagaaagctgcaaatccaagtggcaagaagaaactcaagatcttccagcctgtgatagaggcgcctggtgcctcaaaatgtattggccccgggtgctgtcacgtggcgcagcccgactcggtgtactgcagtaatgactgtatcctcaaacacgccgcagcgacaatgaagtttctaagctcaggtaaagaacagaagccaaagcctaaagaaaagatgaagatgaagccagagaagcccagtcttccgaaatgcggtgctcaggtgagtggaccaggaccagccgcccaggcagtggacgcacaggcgtgagagcgtttgtcgcagaactgttggtttgtagaccgtgtgggggtggcaggtgtaggggggcgcacacgtggtgtcgccttgacctttgtcttccaccttcccaccagttttcccttctctgcccgttagctgaggggttaattaacacaagtgcagtaaagcaaatgctgacaatggcagtgtacggggggcataagacttcaggacacaccctgctgtcttgtgagaagagttggtaaccacccggtggagtttgtagagcgtagacttgc

SEQ ID NO: 356880 - DNA, 1302 bp, Homo sapiens
tggcgaattcggcacgagggggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatggggttacaaagtgagagccttgtatacacttcaatacttaaaaagtacccgtactcagtactcagccggcagcataatgaaaagtgggactagacacggtgtccatatggagaggaaaaatatacatagaatatttttaacaaaatgtattcattgtataaatggaatccttctgtaactttggtaactgcatacttgttgtttggtaatgaaccagaggaggtataatactctagaattgtgtaacattaaagtgtaaacttttgtgttt

SEQ ID NO: 356881 - DNA, 569 bp, Homo sapiens
caagcttcgccttgcacccagaagagcccgtgttcctggcacagaccaatggcaactacctggcccttttctccactgtgtggccctaccggatgagcagacggcggcgctatgaagggcacaaggtggagggctactcagtgggctgcgagtgctccccaggcggtgacttgctggtgacgggcagcgccgatggccgggtcctgatgtacagcttccgcacagccagccgagcatgcacactgcaggggcacacacaggcctgtgtcggcaccacctaccaccccatgctgccctctgcccttcccactcagatctagatcctgctttcatttctggctagtgaagtagacttttgtgtttttgaggtttattagcaggtctgctcaggaaccaaactaatgagtagctttatattgggccaccccaatatatggctttgggggctgaaaaagcagatgtagaccccctccctcggatccttattggtgtgccctttagcactccgcagactctgcggggtgaacaggagtgatgataaaatttttcattctaacatattgaggctt

SEQ ID NO: 356882 - DNA, 187 bp, Homo sapiens
cgagctcggtacccccgcccagccacgggccgcccccgggtggtgatcgtggcagaggtggccctggtggcatgcggggaggaagaggtggcctcatggatcgtggtggtcccggtggaatgttcagaggtggccgtggtggagacagaggtggctgctactcggggggggatcctactagagtcac

SEQ ID NO: 356883 - DNA, 246 bp, Homo sapiens
tttattatatatatttgttcattcgttttaactattaagttttttttagtacgcacacacggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggta

SEQ ID NO: 356884 - DNA, 3817 bp, Homo sapiens
gggcctactctgccgccgccgccgcccgcccgctccagccgccgccgccgccgccaccgccctccaggctccgggacccggcccgcgccaccgcccccgtgcgcgccccgccgccgccgccttcgccttcgccttttgtttcctccgctccggcgcccccgccccggctcgcgctttgcaggggacgcagcgcgcgcccccagcgggcccgggaaaagccgcggcgcgcgcgcgcgcctgcgcggcggacccctccttctcctccccgcgtgcgcgtgcccttcttggctgcgcgccggcgccgcctggcgggcgggaggggaggtggcaggcgcgtttgcaggaggggcgcacctcttcgctcgcgcacccccccggaaggtagaccgggaaggggaggcgggcgggcggagaggagagagtggcgcgcagtccagcgagggcgggggttggctatgtggggggtggtgcaccccgcagtctagacagtctgatccgggctgggggcgtgtacactcggcgcacctgcgagactacagagcctcgggccggcacgtgtggggagtgtggacacgtctgctgcgccccgcttctcgctgctgaggggaagggagggggcgggcaggtgcagcggccgggctagtgggagggggcggcggccatggagcgggtgaacgacgcttcgtgcggcccgtctggctgctacacataccaggtgagcagacacagcacggagatgctgcacaacctgaaccagcagcgcaaaaacggcgggcgcttctgcgacgtgctcttgcgggtaggcgacgagagcttcccagcgcaccgcgccgtgctggccgcctgcagcgagtactttgagtcggtgttcagcgcccagttgggcgacggcggagctgcggacgggggtccggctgatgtagggggcgcgacggcagcaccaggcggcggggccgggggcagccgggagctggagatgcacactatcagctccaaggtatttggggacattctggacttcgcctacacttcccgcatcgtggtgcgcttggagagctttcccgaactcatgacggccgccaagttcctgctgatgaggtcggttatcgagatctgccaggaagtcatcaaacagtccaacgtacagatcctggtaccccctgcccgcgccgatataatgctctttcgcccccctgggacctcggacttgggcttccctttggacatgaccaacggggcagccttggcagccaacagcaatggcatcgccggcagcatgcagccagaggaggaggcagctcgggcggctggtgcagccattgcaggccaagcctctttgcctgtgttacctggggtggaccgcttgcccatggtggctggacccctatccccccaactgctgacttccccattccccagtgtggcatccagtgcccctcccctgactggcaagcgaggccggggccgcccaaggaaggccaacctgctggactcaatgtttgggtccccagggggcctgagggaggcaggcatccttccatgcggtctatgtggtaaggtgttcactgatgccaaccggctccggcagcacgaggcccagcacggtgtcaccagcctccagctgggctacatcgaccttcctcctccgaggctgggtgagaatgggctacccatctctgaagaccccgacggcccccgaaagaggagccggaccaggaagcaggtggcttgtgagatctgcggcaagatcttccgtgatgtgtatcatcttaaccggcacaagctgtcccactctggggagaagccctactcctgccctgtgtgtgggttgcggttcaagagaaaagaccgcatgtcctaccatgtgcggtcccatgatgggtccgtgggcaagccttacatctgccagagctgtgggaaaggcttctccaggcctgatcacttgaacggacatatcaagcaggtgcacacttctgagcggcctcacaagtgtcagacctgcaatgcttcttttgccacccgagaccgtctgcgctcccacctggcctgtcatgaagacaaggtgccctgccaggtgtgtgggaagtacttgcgggcagcatacatggcagaccacctgaagaagcacagcgaggggcccagcaacttctgcagtatctgtaaccgaggtttctcctctgcctcctacttaaaggtccatgttaaaacccaccacggtgttccccttccccaggtctccaggcaccaggagcccatcctgaatgggggagcagcgttccactgcgccaggacctatggcaacaaagaaggccagaaatgctcacatcaggatccgattgagagctctgactcctatggtgacctctcagatgccagcgacctgaagacgccagagaagcagagtgccaatggctctttctcctgcgacatggcagtccccaaaaacaaaatggagtctgatggggagaagaagtacccatgccctgaatgtgggagcttcttccgctctaagtcctacttgaacaaacacatccagaaggtgcatgtccgggctctcgggggccccctgggggacctgggccctgcccttggctcacctttctctcctcagcagaacatgtctctcctcgagtcctttgggtttcagattgttcagtcggcatttgcgtcatctttagtagatcctgaggttgaccagcagcccatggggcctgaagggaaatgaggcagctgctgtgtccccacggaaacaaccatctggggactgctgggaaatgctgtgaatgcggagggaagtgatgtttgggttctgtagctgagagatttttattcatttttaactgccccccaaccccactccaactccttctccaccacccattctcccaatggtctttagaaatagattttcatctgatattctgcagaaatatcaatgagacttggtatgggacaggggcagaaaacactacataggcctccaaggcaaaaccagtcccagtttctttaatgggaagaagctggaattcctggtgctcaattcttagtgaccccaatcctatacccaaatctatgatattctgggacctcagtgattttggtcccctcccacttctctagttcgtcatcctcccttcccatatccttcaaaagaaccacactagggtctccacctacttatacaatgcggatgcccaactgtttttaaggaagccagaagcatcccatggaccatggggtgagtgtcctccaagagccccctgagctcagccctctgcctggagggctccagacctttctgagccctgcttggaggcgagcattttcactgctaggacaagctcagctgttgaggacacccccaccccaaatttcagttcttacgtgattttaaccattcaacatgctgttgggttttaattctctaattattattattattgttattattttttaggaccagttgtagtgaattgctactgaaagctatcccaggtgatacagagctctttgtaaaccgcagtcacacattagggttagtattaaactttgtttagatgtaccataattaacttggctagttgattgtttgaagtctatggaagaaatagttttatgcaaaattttaaaaaatgccagtctggtcagggaagtagggggtttcaatgctgttgggaaccaggaaggtgggacagccggcaggtagggacattgtgtacctcagttgtgtcacatgtgagcaagcccaggttgaccttgtgatgtgaattgatctgatcagactgtattaaaaatgttagtacattactctatctgc

SEQ ID NO: 356885 - DNA, 3752 bp, Homo sapiens
gggcctactctgccgccgccgccgcccgcccgctccagccgccgccgccgccgccaccgccctccaggctccgggacccggcccgcgccaccgcccccgtgcgcgccccgccgccgccgccttcgccttcgccttttgtttcctccgctccggcgcccccgccccggctcgcgctttgcaggggacgcagcgcgcgcccccagcgggcccgggaaaagccgcggcgcgcgcgcgcgcctgcgcggcggacccctccttctcctccccgcgtgcgcgtgcccttcttggctgcgcgccggcgccgcctggcgggcgggaggggaggtggcaggcgcgtttgcaggaggggcgcacctcttcgctcgcgcacccccccggaaggtagaccgggaaggggaggcgggcgggcggagaggagagagtggcgcgcagtccagcgagggcgggggttggctatgtggggggtggtgcaccccgcagtctagacagtctgatccgggctgggggcgtgtacactcggcgcacctgcgagactacagagcctcgggccggcacgtgtggggagtgtggacacgtctgctgcgccccgcttctcgctgctgaggggaagggagggggcgggcaggtgcagcggccgggctagtgggagggggcggcggccatggagcgggtgaacgacgcttcgtgcggcccgtctggctgctacacataccaggtgagcagacacagcacggagatgctgcacaacctgaaccagcagcgcaaaaacggcgggcgcttctgcgacgtgctcttgcgggtaggcgacgagagcttcccagcgcaccgcgccgtgctggccgcctgcagcgagtactttgagtcggtgttcagcgcccagttgggcgacggcggagctgcggacgggggtccggctgatgtagggggcgcgacggcagcaccaggcggcggggccgggggcagccgggagctggagatgcacactatcagctccaaggtatttggggacattctggacttcgcctacacttcccgcatcgtggtgcgcttggagagctttcccgaactcatgacggccgccaagttcctgctgatgaggtcggttatcgagatctgccaggaagtcatcaaacagtccaacgtacagatcctggtaccccctgcccgcgccgatataatgctctttcgcccccctgggacctcggacttgggcttccctttggacatgaccaacggggcagccttggcagccaacagcaatggcatcgccggcagcatgcagccagaggaggaggcagctcgggcggctggtgcagccattgcaggccaagcctctttgcctgtgttacctggggtggaccgcttgcccatggtggctggacccctatccccccaactgctgacttccccattccccagtgtggcatccagtgcccctcccctgactggcaagcgaggccggggccgcccaaggaaggccaacctgctggactcaatgtttgggtccccagggggcctgagggaggcaggcatccttccatgcggtctatgtggtaaggtgttcactgatgccaaccggctccggcagcacgaggcccagcacggtgtcaccagcctccagctgggctacatcgaccttcctcctccgaggctgggtgagaatgggctacccatctctgaagaccccgacggcccccgaaagaggagccggaccaggaagcaggtggcttgtgagatctgcggcaagatcttccgtgatgtgtatcatcttaaccggcacaagctgtcccactctggggagaagccctactcctgccctgtgtgtgggttgcggttcaagagaaaagaccgcatgtcctaccatgtgcggtcccatgatgggtccgtgggcaagccttacatctgccagagctgtgggaaaggcttctccaggcctgatcacttgaacggacatatcaagcaggtgcacacttctgagcggcctcacaagtgtcagacctgcaatgcttcttttgccacccgagaccgtctgcgctcccacctggcctgtcatgaagacaaggtgccctgccaggtgtgtgggaagtacttgcgggcagcatacatggcagaccacctgaagaagcacagcgaggggcccagcaacttctgcagtatctgtaaccgaggtctccaggcaccaggagcccatcctgaatgggggagcagcgttccactgcgccaggacctatggcaacaaagaaggccagaaatgctcacatcaggatccgattgagagctctgactcctatggtgacctctcagatgccagcgacctgaagacgccagagaagcagagtgccaatggctctttctcctgcgacatggcagtccccaaaaacaaaatggagtctgatggggagaagaagtacccatgccctgaatgtgggagcttcttccgctctaagtcctacttgaacaaacacatccagaaggtgcatgtccgggctctcgggggccccctgggggacctgggccctgcccttggctcacctttctctcctcagcagaacatgtctctcctcgagtcctttgggtttcagattgttcagtcggcatttgcgtcatctttagtagatcctgaggttgaccagcagcccatggggcctgaagggaaatgaggcagctgctgtgtccccacggaaacaaccatctggggactgctgggaaatgctgtgaatgcggagggaagtgatgtttgggttctgtagctgagagatttttattcatttttaactgccccccaaccccactccaactccttctccaccacccattctcccaatggtctttagaaatagattttcatctgatattctgcagaaatatcaatgagacttggtatgggacaggggcagaaaacactacataggcctccaaggcaaaaccagtcccagtttctttaatgggaagaagctggaattcctggtgctcaattcttagtgaccccaatcctatacccaaatctatgatattctgggacctcagtgattttggtcccctcccacttctctagttcgtcatcctcccttcccatatccttcaaaagaaccacactagggtctccacctacttatacaatgcggatgcccaactgtttttaaggaagccagaagcatcccatggaccatggggtgagtgtcctccaagagccccctgagctcagccctctgcctggagggctccagacctttctgagccctgcttggaggcgagcattttcactgctaggacaagctcagctgttgaggacacccccaccccaaatttcagttcttacgtgattttaaccattcaacatgctgttgggttttaattctctaattattattattattgttattattttttaggaccagttgtagtgaattgctactgaaagctatcccaggtgatacagagctctttgtaaaccgcagtcacacattagggttagtattaaactttgtttagatgtaccataattaacttggctagttgattgtttgaagtctatggaagaaatagttttatgcaaaattttaaaaaatgccagtctggtcagggaagtagggggtttcaatgctgttgggaaccaggaaggtgggacagccggcaggtagggacattgtgtacctcagttgtgtcacatgtgagcaagcccaggttgaccttgtgatgtgaattgatctgatcagactgtattaaaaatgttagtacattactctatctgc

SEQ ID NO: 356886 - DNA, 1121 bp, Homo sapiens
gtggcgggagaggctgggggaggggattgctgagtttctaaggggctttagtctggacaatgaatcacatatcccctcctggaaaggctgcagtgaggcagctctgtttcattctactgccaccgcctctggtcctagaaaacactgagtttctggtggggagaattgagggagtggggaggcaaaatcagagacaaatgcccatttctcttcccccctccagagaaaaccagggcagagaggcctgggcctgtggagccagaactgggtggtgactttgtctttgtcatgctggggttggggagagggagtcctttccagcagtgagtgtgtgtgtgtgtgtacacacgtatgcatatgtgcctgtgtggtggggtctggccaagtttctaaagtccctcttggttctctcttttccaggcctgatcacttgaacggacatatcaagcaggtgcacacttctgagcggcctcacaagtgtcagacctgcaatgcttcttttgccacccgagaccgtctgcgctcccacctggcctgtcatgaagacaaggtgccctgccaggtgtgtgggaagtacttgcgggcagcatacatggcagaccacctgaagaagcacagcgaggggcccagcaacttctgcagtatctgtaaccgaggtaatctgcccactgtttcctcacttccagaggatgggcctgagcgtgtatgggaggcctaggggtgtctcaatcaccctgcctcagactccactctttgcacagccaccccctacttcccactgaatgataaacaccttcatcacccaactagctatttgctacctcttccttcccaagaagcttggggtgcttagaatgggaagtcccaggagaccagcaggtcaaaacagaaggagagaggttcttcccaagcttgggcccataactctcacctgctactcagatggcaggatggatgcattttgcagacaccactgaaccactgaggttggtgggggagttagtaggtcccaaagtgagagaaaaagaggttggtccggcttgagagcttttgctggttgattcactggcatatgaaattcagcagccagggaaggaggttgagtctgaaggcagtctgga

SEQ ID NO: 356887 - DNA, 2385 bp, Homo sapiens
tggcgaattcggcacgagggggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatgggcagcgctggagagcgaggtggcttcaataagcctggtggacccatggatgaaggaccagatcttgatctaggcccacctgtagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctggacaaggaaacaggaaagcccaaaggcgatgccacagtgtcctatgaagacccacccactgccaaggctgccgtggaatggtttgatgggaaagattttcaagggagcaaacttaaagtctcccttgctcggaagaagcctccaatgaacagtatgcggggtggtctgccaccccgtgagggcagaggcatgccaccaccactccgtggaggtccaggaggcccaggaggtcctgggggacccatgggtcgcatgggaggccgtggaggagatagaggaggcttccctccaagaggaccccggggttcccgagggaacccctctggaggaggaaacgtccagcaccgagctggagactggcagtgtcccaatccgggttgtggaaaccagaacttcgcctggagaacagagtgcaaccagtgtaaggccccaaagcctgaaggcttcctcccgccaccctttccgcccccgggtggtgatcgtggcagaggtggccctggtggcatgcggggaggaagaggtggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggtagtgtgcggagtttttttttcttccttcttttaaaaatggttgtttaagactttaacaatgggaaccccttgtgagcatgctcagtatcattgtggagaaccaagagggcctcttaactgtaacaatgttcatggttgtgatgttttttttttttttaaaataaaattccaaatgtttaat

SEQ ID NO: 356888 - DNA, 2385 bp, Homo sapiens
tggcgaattcggcacgagggggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatgggcagcgctggagagcgaggtggcttcaataagcctggtggacccatggatgaaggaccagatcttgatctaggcccacctgtagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctggacaaggaaacaggaaagcccaaaggcgatgccacagtgtcctatgaagacccacccactgccaaggctgccgtggaatggtttgatgggaaagattttcaagggagcaaacttaaagtctcccttgctcggaagaagcctccaatgaacagtatgcggggtggtctgccaccccgtgagggcagaggcatgccaccaccactccgtggaggtccaggaggcccaggaggtcctgggggacccatgggtcgcatgggaggccgtggaggagatagaggaggcttccctccaagaggaccccggggttcccgagggaacccctctggaggaggaaacgtccagcaccgagctggagactggcagtgtcccaatccgggttgtggaaaccagaacttcgcctggagaacagagtgcaaccagtgtaaggccccaaagcctgaaggcttcctcccgccaccctttccgcccccgggtggtgatcgtggcagaggtggccctggtggcatgcggggaggaagaggtggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggtagtgtgcggagtttttttttcttccttcttttaaaaatggttgtttaagactttaacaatgggaaccccttgtgagcatgctcagtatcattgtggagaaccaagagggcctcttaactgtaacaatgttcatggttgtgatgttttttttttttttttaaataaaattccaaatgtttat

SEQ ID NO: 356889 - DNA, 3354 bp, Homo sapiens
tggcgaattcggcacgagggggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatggggttacaaagtgagagccttgtatacacttcaatacttaaaaagtacccgtactcagtactcagccggcagcataatgaaaagtgggactagacacggtgtccatatggagaggaaaaatatacatagaatatttttaacaaaatgtattcattgtataaatggaatccttctgtaactttggtaactgcatacttgttgtttggtaatgaaccagaggaggtataatactctagaattgtgtaacattaaagtgtaaacttttgtgtttaaagagagagaacattttatggtgtgtacttttaaaaaggaaacaaagctgcatgcaacagcttgaaattgtatattcaggtattaaaggtgcaatactggttagaaaaaactcagggcctcccactggggagctgcctttatttaattttaaagaaaacaaaatctaacccaaaaagtccaattcatatttccctctcccctctttaagtaattttacatggccatagtcattattctaactgatatgtctataaagttgcacccccagtccgttgagccttggtatttgttgtaaattctcctttcacagcgattgttaaatctattcgtgccctgagatgtatggctttatgctgaagattggctggatgcgtcctctgatgtgtgttgtaggaatttaatgtggttgtctcctgcttttattatactgtgacttgttaggaaaccctgggcctcatttggctctcccttgggagaggttgagggtgcacctttatgaacatggaaaggtttatcacagcagttaacccccacttgctcctcccctctataccaagctcttctggtttttcacctgacggggtgggtgtttgggatctattttttcttgctaatttgccaagtattgcactattaataccagcccccgaaatgaaaggaaccaaccacactggtgtgtacaatcagacaagcaaggttgtatattgaggaaatttgagcaagctgccctgaagaaaggcatagtgacaagatgagagagatgcattgtttggagatgtgtttagccagtgcccttcttccccacgagcccccccaaggctcagagcggtactggcttttaaagggaaaggccttcatttcttcgtttatccccccagcagcgctggagagcgaggtggcttcaataagcctggtggacccatggatgaaggaccagatcttgatctaggcccacctgtagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctggacaaggaaacaggaaagcccaaaggcgatgccacagtgtcctatgaagacccacccactgccaaggctgccgtggaatggtttgatgggaaagattttcaagggagcaaacttaaagtctcccttgctcggaagaagcctccaatgaacagtatgcggggtggtctgccaccccgtgagggcagaggcatgccaccaccactccgtggaggtccaggaggcccaggaggtcctgggggacccatgggtcgcatgggaggccgtggaggagatagaggaggcttccctccaagaggaccccggggttcccgagggaacccctctggaggaggaaacgtccagcaccgagctggagactggcagtgtcccaatccgggttgtggaaaccagaacttcgcctggagaacagagtgcaaccagtgtaaggccccaaagcctgaaggcttcctcccgccaccctttccgcccccgggtggtgatcgtggcagaggtggccctggtggcatgcggggaggaagaggtggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggta

SEQ ID NO: 356890 - DNA, 3837 bp, Homo sapiens
tggcgaattcggcacgagggggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatggggttacaaagtgagagccttgtatacacttcaatacttaaaaagtacccgtactcagtactcagccggcagcataatgaaaagtgggactagacacggtgtccatatggagaggaaaaatatacatagaatatttttaacaaaatgtattcattgtataaatggaatccttctgtaactttggtaactgcatacttgttgtttggtaatgaaccagaggaggtataatactctagaattgtgtaacattaaagtgtaaacttttgtgtttaaagagagagaacattttatggtgtgtacttttaaaaaggaaacaaagctgcatgcaacagcttgaaattgtatattcaggtattaaaggtgcaatactggttagaaaaaactcagggcctcccactggggagctgcctttatttaattttaaagaaaacaaaatctaacccaaaaagtccaattcatatttccctctcccctctttaagtaattttacatggccatagtcattattctaactgatatgtctataaagttgcacccccagtccgttgagccttggtatttgttgtaaattctcctttcacagcgattgttaaatctattcgtgccctgagatgtatggctttatgctgaagattggctggatgcgtcctctgatgtgtgttgtaggaatttaatgtggttgtctcctgcttttattatactgtgacttgttaggaaaccctgggcctcatttggctctcccttgggagaggttgagggtgcacctttatgaacatggaaaggtttatcacagcagttaacccccacttgctcctcccctctataccaagctcttctggtttttcacctgacggggtgggtgtttgggatctattttttcttgctaatttgccaagtattgcactattaataccagcccccgaaatgaaaggaaccaaccacactggtgtgtacaatcagacaagcaaggttgtatattgaggaaatttgagcaagctgccctgaagaaaggcatagtgacaagatgagagagatgcattgtttggagatgtgtttagccagtgcccttcttccccacgagcccccccaaggctcagagcggtactggcttttaaagggaaaggccttcatttcttcgtttatccccccagcagcgctggagagcgaggtggcttcaataagcctggtggtaagtttttgagtattaccatagatagtgtttaaaaaaaaatgcagtcagtttttagaaaactataatttttttattagtttcataagtggtttaaaaatgatctatacaaaagagactaatgggtactgccggcattgtcttaggggttaataaggttaacctatggttacaaaacaaagggtaacttgaagtattgagtaactgcttctgtaatatgggggagaataaatttttaaatttggtttatttagaggaaaaattttgacttaaatttaacactgatttggcacataagcattgagagtgtatttggttaatggtttagaagcaaaccagcaaaggaatagcagtgcgggtcattttgagtttaatgaatccccatcaaatggtggtatagtagatagctatgtgtgtttgtaaggtttgtagcttgcaagacgtgcactaataatattttatatgatctttcctggttggcaggacccatggatgaaggaccagatcttgatctaggcccacctgtagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctggacaaggaaacaggaaagcccaaaggcgatgccacagtgtcctatgaagacccacccactgccaaggctgccgtggaatggtttgatgggaaagattttcaagggagcaaacttaaagtctcccttgctcggaagaagcctccaatgaacagtatgcggggtggtctgccaccccgtgagggcagaggcatgccaccaccactccgtggaggtccaggaggcccaggaggtcctgggggacccatgggtcgcatgggaggccgtggaggagatagaggaggcttccctccaagaggaccccggggttcccgagggaacccctctggaggaggaaacgtccagcaccgagctggagactggcagtgtcccaatccgggttgtggaaaccagaacttcgcctggagaacagagtgcaaccagtgtaaggccccaaagcctgaaggcttcctcccgccaccctttccgcccccgggtggtgatcgtggcagaggtggccctggtggcatgcggggaggaagaggtggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggta

SEQ ID NO: 356891 - DNA, 2453 bp, Homo sapiens
tggcgaattcggcacgagggggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatgggcagcgctggagagcgaggtggcttcaataagcctggtggacccatggatgaaggaccagatcttgatctaggcccacctgtagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctggacaaggaaacaggaaagcccaaaggcgatgccacagtgtcctatgaagacccacccactgccaaggctgccgtggaatggtttgatgggaaagattttcaagggagcaaacttaaagtctcccttgctcggaagaagcctccaatgaacagtatgcggggtggtctgccaccccgtgagggcagaggcatgccaccaccactccgtggaggtccaggaggcccaggaggtcctgggggacccatgggtcgcatgggaggccgtggaggagatagaggaggcttccctccaagaggaccccggggttcccgagggaacccctctggaggaggaaacgtccagcaccgagctggagactggcagtgtcccaatccgggttgtggaaaccagaacttcgcctggagaacagagtgcaaccagtgtaaggccccaaagcctgaaggcttcctcccgccaccctttccgcccccgggtggtgatcgtggcagaggtggccctggtggcatgcggggaggaagaggtggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggtagtgtgcggagtttttttttcttccttcttttaaaaatggttgtttaagactttaacaatgggaaccccttgtgagcatgctcagtatcattgtggagaaccaagagggcctcttaactgtaacaatgttcatggttgtgatgtttttttttttttttaaataaaattccaaatgtttataaaaaacagccctcagtcaacacgacacagaaacccacgcctcaagcagccccgccaacgaaactttgg

SEQ ID NO: 356892 - DNA, 2726 bp, Homo sapiens
tggcgaattcggcacgagggggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatgggcagcgctggagagcgaggtggcttcaataagcctggtggacccatggatgaaggaccagatcttgatctaggcccacctgtagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctggacaaggaaacaggaaagcccaaaggcgatgccacagtgtcctatgaagacccacccactgccaaggctgccgtggaatggtttgatgggaaagattttcaagggagcaaacttaaagtctcccttgctcggaagaagcctccaatgaacagtatgcggggtggtctgccaccccgtgagggcagaggcatgccaccaccactccgtggaggtccaggaggcccaggaggtcctgggggacccatgggtcgcatgggaggccgtggaggagatagaggaggcttccctccaagaggaccccggggttcccgagggaacccctctggaggaggaaacgtccagcaccgagctggagactggcagtgtcccaatccgggttgtggaaaccagaacttcgcctggagaacagagtgcaaccagtgtaaggccccaaagcctgaaggcttcctcccgccaccctttccgcccccgggtggtgatcgtggcagaggtggccctggtggcatgcggggaggaagaggtggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggtagtgtgcggagtttttttttcttccttcttttaaaaatggttgtttaagactttaacaatgggaaccccttgtgagcatgctcagtatcattgtggagaaccaagagggcctcttaactgtaacaatgttcatgggtggtgactgtcggcgaggcgttaaaattaaaatttcgcaatggttgataagaaaataacacacagagcaaaaaaaaaggaggggcccgaataaaaaatatcccacgggggccaaggataaggtaaacccggagttcggctgcacacgggggcccaccaaagacgaacgttataaggcgacgaccgagcccgagttacacacgcgcgcgcgggaaacacgggccgcgggggccatccgaggggcggccacacacgggggggaaaccaacgtgcacaaaccccccaggatatagagcccagcgaggaaaaaacacgaggaacgcggaccaccccgcacgagcacagccgaaaaggtccggacagtgaggaatagcgcggacgcaacac

SEQ ID NO: 356893 - DNA, 2480 bp, Homo sapiens
tggcgaattcggcacgagggggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatgggcagcgctggagagcgaggtggcttcaataagcctggtggacccatggatgaaggaccagatcttgatctaggcccacctgtagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctggacaaggaaacaggaaagcccaaaggcgatgccacagtgtcctatgaagacccacccactgccaaggctgccgtggaatggtttgatgggaaagattttcaagggagcaaacttaaagtctcccttgctcggaagaagcctccaatgaacagtatgcggggtggtctgccaccccgtgagggcagaggcatgccaccaccactccgtggaggtccaggaggcccaggaggtcctgggggacccatgggtcgcatgggaggccgtggaggagatagaggaggcttccctccaagaggaccccggggttcccgagggaacccctctggaggaggaaacgtccagcaccgagctggagactggcagtgtcccaatccgggttgtggaaaccagaacttcgcctggagaacagagtgcaaccagtgtaaggccccaaagcctgaaggcttcctcccgccaccctttccgcccccgggtggtgatcgtggcagaggtggccctggtggcatgcggggaggaagaggtggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggtaaaaaaaaaaaaaaaaaaaaaaaaaaaaaaatatttatattataatattaaaataaaatatataaaattttaaatctttttttaaaatataaaaattaataaataaaatggctaataaaataaaataattattaaagcgggctcatatttgtcccttttggggcaatttcccttatggggggttttaaaaataaagtggggccctgtttaaaaactcgaggaggggaaactcggggttccccatatggcgtggtatcccttttttcccggggggat

SEQ ID NO: 356894 - DNA, 2590 bp, Homo sapiens
  misc_feature (2393)..(2393): n is a, c, g, or t
tggcgaattcggcacgagggggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatgggcagcgctggagagcgaggtggcttcaataagcctggtggacccatggatgaaggaccagatcttgatctaggcccacctgtagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctggacaaggaaacaggaaagcccaaaggcgatgccacagtgtcctatgaagacccacccactgccaaggctgccgtggaatggtttgatgggaaagattttcaagggagcaaacttaaagtctcccttgctcggaagaagcctccaatgaacagtatgcggggtggtctgccaccccgtgagggcagaggcatgccaccaccactccgtggaggtccaggaggcccaggaggtcctgggggacccatgggtcgcatgggaggccgtggaggagatagaggaggcttccctccaagaggaccccggggttcccgagggaacccctctggaggaggaaacgtccagcaccgagctggagactggcagtgtcccaatccgggttgtggaaaccagaacttcgcctggagaacagagtgcaaccagtgtaaggccccaaagcctgaaggcttcctcccgccaccctttccgcccccgggtggtgatcgtggcagaggtggccctggtggcatgcggggaggaagaggtggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggtaaaaaaaaagtcatttactctaccatgtttgcaggcacactcattacagcgctaagctcgcactgatttttttacctgagtaggcctagaaataaacatgctagcttttattccaggtctaaccaaaaaaataaaccctcgttccacagaagctgtcatcaagtatttcctcacgcaagcaaccgcatncataatccttctaatagctatcctctataacaatatactctgcggacaatgaaccataaccaatactaccaatcaatactcatcattaataatcataatggctatagcaataaaactaggaatagccccctttcacttttgagtccagaattaacccaggcacccctctgcaacccggctgctttttgtacatggca

SEQ ID NO: 356895 - DNA, 2512 bp, Homo sapiens
  misc_feature (2341)..(2341): n is a, c, g, or t
tggcgaattcggcacgagggggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatgggcagcgctggagagcgaggtggcttcaataagcctggtggacccatggatgaaggaccagatcttgatctaggcccacctgtagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctggacaaggaaacaggaaagcccaaaggcgatgccacagtgtcctatgaagacccacccactgccaaggctgccgtggaatggtttgatgggaaagattttcaagggagcaaacttaaagtctcccttgctcggaagaagcctccaatgaacagtatgcggggtggtctgccaccccgtgagggcagaggcatgccaccaccactccgtggaggtccaggaggcccaggaggtcctgggggacccatgggtcgcatgggaggccgtggaggagatagaggaggcttccctccaagaggaccccggggttcccgagggaacccctctggaggaggaaacgtccagcaccgagctggagactggcagtgtcccaatccgggttgtggaaaccagaacttcgcctggagaacagagtgcaaccagtgtaaggccccaaagcctgaaggcttcctcccgccaccctttccgcccccgggtggtgatcgtggcagaggtggccctggtggcatgcggggaggaagaggtggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggtaaaaaaaaaaaaaaaaaaaaaaaaaaaataaaaaaaaaaaaaaaaaaaaaaaaaaaaaaaaaaaaaaaaaaaaaaaaaaaaaaaaaaaaaaaaaattccccccacattttcattcattttccaaattcccttcaatntggcccatttcaaattaataggcccgggttttaaaaacactgggactggaaaaaacactggggtacccaaataaacccgctttggggctcccttttcccgagctgggtaaattttaaataggccctgacaaatccgcttttccaaacgtgtggccccttttgcgcgggccc

SEQ ID NO: 356896 - DNA, 2244 bp, Homo sapiens
tggcgaattcggcacgagggggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatgggcagcgctggagagcgaggtggcttcaataagcctggtggacccatggatgaaggaccagatcttgatctaggcccacctgtagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctggacaaggaaacaggaaagcccaaaggcgatgccacagtgtcctatgaagacccacccactgccaaggctgccgtggaatggtttgatgggaaagattttcaagggagcaaacttaaagtctcccttgctcggaagaagcctccaatgaacagtatgcggggtggtctgccaccccgtgagggcagaggcatgccaccaccactccgtggaggtccaggaggcccaggaggtcctgggggacccatgggtcgcatgggaggccgtggaggagatagaggaggcttccctccaagaggaccccggggttcccgagggaacccctctggaggaggaaacgtccagcaccgagctggagactggcagtgtcccaatccttcaattggtgatttctgctgtgatgtaattgtatgcaggggttgtggaaaccagaacttcgcctggagaacagagtgcaaccagtgtaaggccccaaagcctgaaggcttcctcccgccaccctttccgcccccgggtggtgatcgtggcagaggtggccctggtggcatgcggggaggaagaggtggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggta

SEQ ID NO: 356897 - DNA, 2471 bp, Homo sapiens
tggcgaattcggcacgagggggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatgggcagcgctggagagcgaggtggcttcaataagcctggtggacccatggatgaaggaccagatcttgatctaggcccacctgtagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctggacaaggaaacaggaaagcccaaaggcgatgccacagtgtcctatgaagacccacccactgccaaggctgccgtggaatggtttgatgggaaagattttcaagggagcaaacttaaagtctcccttgctcggaagaagcctccaatgaacagtatgcggggtggtctgccaccccgtgagggcagaggcatgccaccaccactccgtggaggtccaggaggcccaggaggtcctgggggacccatgggtcgcatgggaggccgtggaggagatagaggaggcttccctccaagaggaccccggggttcccgagggaacccctctggaggaggaaacgtccagcaccgagctggagactggcagtgtcccaatccgggttgtggaaaccagaacttcgcctggagaacagagtgcaaccagtgtaaggccccaaagcctgaaggcttcctcccgccaccctttccgcccccgggtaggtgcaggtttcatgagtgtcccctcagcttcctggtgctaaacctcttttcttatttgtgggcttggtaaactgcagttgccctctgcttaacaactttgagttgtcgtgtcctcatttctaaattgtcagcccgatgccgagattgagtgaagtgtctggtttgttctgctgtgagagaaggaagcagagcagcttccacagtgtccacagggcctctgcagccacccactgactgctttcgccctgctattctcaccttaggggtgatcgtggcagaggtggccctggtggcatgcggggaggaagaggtggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggta

SEQ ID NO: 356898 - DNA, 2543 bp, Homo sapiens
tggcgaattcggcacgagggggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatgggcagcgctggagagcgaggtggcttcaataagcctggtggacccatggatgaaggaccagatcttgatctaggcccacctgtagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctggacaaggaaacaggaaagcccaaaggcgatgccacagtgtcctatgaagacccacccactgccaaggctgccgtggaatggtttgatgggaaagattttcaagggagcaaacttaaagtctcccttgctcggaagaagcctccaatgaacagtatgcggggtggtctgccaccccgtgagggcagaggcatgccaccaccactccgtggaggtccaggaggcccaggaggtcctgggggacccatgggtcgcatgggaggccgtggaggagatagaggaggcttccctccaagaggaccccggggttcccgagggaacccctctggaggaggaaacgtccagcaccgagctggagactggcagtgtcccaatccgtatgtacttgtcttggcaaattgataccctacgagtgaagccacccttccctcaccccatccccactctagagtggattgctctgtctagaggaacagaatgatgaccctgatggctggttagggacactagtcagccattcactggacgcttcagagccttctgaagattgatttgacctgtcctgtgggtgcaatgctgcctgaggctgtgccctaaagcatgggtgtacatagatcctcttgatagtgagtgtgtacctgttcacacaccacctttccttgtttatcttccttagttcaattggtgatttctgctgtgatgtaattgtatgcaggggttgtggaaaccagaacttcgcctggagaacagagtgcaaccagtgtaaggccccaaagcctgaaggcttcctcccgccaccctttccgcccccgggtggtgatcgtggcagaggtggccctggtggcatgcggggaggaagaggtggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggta

SEQ ID NO: 356899 - DNA, 2334 bp, Homo sapiens
tggcgaattcggcacgagggggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatgggcagcgctggagagcgaggtggcttcaataagcctggtggacccatggatgaaggaccagatcttgatctaggcccacctgtagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctggacaaggaaacaggaaagcccaaaggcgatgccacagtgtcctatgaagacccacccactgccaaggctgccgtggaatggtttgatgggaaagattttcaagggagcaaacttaaagtctcccttgctcggaagaagcctccaatgaacagtatgcggggtggtctgccaccccgtgagggcagaggcatgccaccaccactccgtggaggtccaggaggcccaggaggtcctgggggacccatgggtcgcatgggaggccgtggaggagatagaggaggcttccctccaagaggaccccggggttcccgagggaacccctctggaggaggaaacgtccagcaccgagctggagactggcagtgtcccaatccgggttgtggaaaccagaacttcgcctggagaacagagtgcaaccagtgtggtgatcgtggcagaggtggccctggtggcatgcggggaggaagaggtggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggtagtgtgcggagtttttttttcttccttcttttaaaaatggttgtttaagactttaacaatgggaaccccttgtgagcatgctcagtatcattgtggagaaccaagagggcctcttaactgtaacaatgttcatggttgtgatgttttttttttttttttaaataaaattccaaatgtttat

SEQ ID NO: 356900 - DNA, 2373 bp, Homo sapiens
tggcgaattcggcacgagggggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatgggcagcgctggagagcgaggtggcttcaataagcctggtggacccatggatgaaggaccagatcttgatctaggcccacctgtagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctggacaaggaaacaggaaagcccaaaggcgatgccacagtgtcctatgaagacccacccactgccaaggctgccgtggaatggtttgatgggaaagattttcaagggagcaaacttaaagtctcccttgctcggaagaagcctccaatgaacagtatgcggggtggtctgccaccccgtgagggcagaggcatgccaccaccactccgtggaggtccaggaggcccaggaggtcctgggggacccatgggtcgcatgggaggccgtggaggagatagaggaggcttccctccaagaggaccccggggttcccgagggaacccctctggaggaggaaacgtccagcaccgagctggagactggcagtgtcccaatccttcaattggtgatttctgctgtgatgtaattgtatgcaggggttgtggaaaccagaacttcgcctggagaacagagtgcaaccagtgtggtgatcgtggcagaggtggccctggtggcatgcggggaggaagaggtggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggtagtgtgcggagtttttttttcttccttcttttaaaaatggttgtttaagactttaacaatgggaaccccttgtgagcatgctcagtatcattgtggagaaccaagagggcctcttaactgtaacaatgttcatggttgtgatgttttttttttttttttaaataaaattccaaatgtttat

SEQ ID NO: 356901 - DNA, 2471 bp, Homo sapiens
tggcgaattcggcacgagggggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatgggcagcgctggagagcgaggtggcttcaataagcctggtggacccatggatgaaggaccagatcttgatctaggcccacctgtagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctggacaaggaaacaggaaagcccaaaggcgatgccacagtgtcctatgaagacccacccactgccaaggctgccgtggaatggtttgatgggaaagattttcaagggagcaaacttaaagtctcccttgctcggaagaagcctccaatgaacagtatgcggggtggtctgccaccccgtgagggcagaggcatgccaccaccactccgtggaggtccaggaggcccaggaggtcctgggggacccatgggtcgcatgggaggccgtggaggagatagaggaggcttccctccaagaggaccccggggttcccgagggaacccctctggaggaggaaacgtccagcaccgagctggagactggcagtgtcccaatccgtatgtacttgtcttggcaaattgataccctacgagtgaagccacccttccctcaccccatccccactctagagtggattgctctgtctagaggaacagaatgatgaccctgatggctggttagggacactagtcagccattcactggacgcttcagagccttctgaagattgatttgacctgtcctgtgggtgcaatgctgcctgaggctgtgccctaaagcatgggtgtacatagatcctcttgatagtgagtgtgtacctgttcacacaccacctttccttgtttatcttccttagttcaattggtgatttctgctgtgatgtaattgtatgcaggggttgtggaaaccagaacttcgcctggggtgatcgtggcagaggtggccctggtggcatgcggggaggaagaggtggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggta

SEQ ID NO: 356902 - DNA, 2833 bp, Homo sapiens
tggcgaattcggcacgagggggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatgggcagcgctggagagcgaggtggcttcaataagcctggtggacccatggatgaaggaccagatcttgatctaggcccacctgtagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctggacaaggaaacaggaaagcccaaaggcgatgccacagtgtcctatgaagacccacccactgccaaggctgccgtggaatggtttgatgggaaagattttcaagggagcaaacttaaagtctcccttgctcggaagaagcctccaatgaacagtatgcggggtggtctgccaccccgtgagggcagaggcatgccaccaccactccgtggaggtccaggaggcccaggaggtcctgggggacccatgggtcgcatgggaggccgtggaggagatagaggaggcttccctccaagaggaccccggggttcccgagggaacccctctggaggaggaaacgtccagcaccgagctggagactggcagtgtcccaatccgggttgtggaaaccagaacttcgcctggagaacagagtgcaaccagtgtaaggccccaaagcctgaaggcttcctcccgccaccctttccgcccccgggtaggtgcaggtttcatgagtgtcccctcagcttcctggtgctaaacctcttttcttatttgtgggcttggtaaactgcagttgccctctgcttaacaactttgagttgtcgtgtcctcatttctaaattgtcagcccgatgccgagattgagtgaagtgtctggtttgttctgctgtgagagaaggaagcagagcagcttccacagtgtccacagggcctctgcagccacccactgactgctttcgccctgctattctcaccttaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacactatgggcaaccgaggtggctttggtggaggaagacgaggtggccctggggggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggtagtgtgcggagtttttttttcttccttcttttaaaaatggttgtttaagactttaacaatgggaaccccttgtgagcatgctcagtatcattgtggagaaccaagagggcctcttaactgtaacaatgttcatggttgtgatgttttttttttttttttaaataaaattccaaatgtttat

SEQ ID NO: 356903 - DNA, 2156 bp, Homo sapiens
tggcgaattcggcacgagggggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatgggcagcgctggagagcgaggtggcttcaataagcctggtggacccatggatgaaggaccagatcttgatctaggcccacctgtagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctggacaaggaaacaggaaagcccaaaggcgatgccacagtgtcctatgaagacccacccactgccaaggctgccgtggaatggtttgatgggaaagattttcaagggagcaaacttaaagtctcccttgctcggaagaagcctccaatgaacagtatgcggggtggtctgccaccccgtgagggcagaggcatgccaccaccactccgtggaggtccaggaggcccaggaggtcctgggggacccatgggtcgcatgggaggccgtggaggagatagaggaggcttccctccaagaggaccccggggttcccgagggaacccctctggaggaggaaacgtccagcaccgagctggagactggcagtgtcccaatccgggttgtggaaaccagaacttcgcctggagaacagagtgcaaccagtgtggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggtagtgtgcggagtttttttttcttccttcttttaaaaatggttgtttaagactttaacaatgggaaccccttgtgagcatgctcagtatcattgtggagaaccaagagggcctcttaactgtaacaatgttcatggttgtgatgttttttttttttttttaaataaaattccaaatgtttat

SEQ ID NO: 356904 - DNA, 3293 bp, Homo sapiens
tggcgaattcggcacgagggggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatgggtgtggcatccagtgcccctcccctgactggcaagcgaggccggggccgcccaaggaaggccaacctgctggactcaatgtttgggtccccagggggcctgagggaggcaggcatccttccatgcggtctatgtggtaaggtgttcactgatgccaaccggctccggcagcacgaggcccagcacggtgtcaccagcctccagctgggctacatcgaccttcctcctccgaggctgggtgagaatgggctacccatctctgaagaccccgacggcccccgaaagaggagccggaccaggaagcaggtggcttgtgagatctgcggcaagatcttccgtgatgtgtatcatcttaaccggcacaagctgtcccactctggggagaagccctactcctgccctgtgtgtgggttgcggttcaagagaaaagaccgcatgtcctaccatgtgcggtcccatgatgggtccgtgggcaagccttacatctgccagagctgtgggaaaggcttctccaggcctgatcacttgaacggacatatcaagcaggtgcacacttctgagcggcctcacaagtgtcagacctgcaatgcttcttttgccacccgagaccgtctgcgctcccacctggcctgtcatgaagacaaggtgccctgccaggtgtgtgggaagtacttgcgggcagcatacatggcagaccacctgaagaagcacagcgaggggcccagcaacttctgcagtatctgtaaccgagaaggccagaaatgctcacatcaggatccgattgagagctctgactcctatggtgacctctcagatgccagcgacctgaagacgccagagaagcagagtgccaatggctctttctcctgcgacatggcagtccccaaaaacaaaatggagtctgatggggagaagaagtacccatgccctgaatgtgggagcttcttccgctctaagtcctacttgaacaaacacatccagaaggtgcatgtccgggctctcgggggccccctgggggacctgggccctgcccttggctcacctttctctcctcagcagaacatgtctctcctcgagtcctttgggtttcagattgttcagtcggcatttgcgtcatctttagtagatcctgaggttgaccagcagcccatggggcctgaagggaaatgaggcagctgctgtgtccccacggaaacaaccatctggggactgctgggaaatgctgtgaatgcggagggaagtgatgtttgggttctgtagctgagagatttttattcatttttaactgccccccaaccccactccaactccttctccaccacccattctcccaatggtctttagaaatagattttcatctgatattctgcagaaatatcaatgagacttggtatgggacaggggcagaaaacactacataggcctccaaggcaaaaccagtcccagtttctttaatgggaagaagctggaattcctggtgctcaattcttagtgaccccaatcctatacccaaatctatgatattctgggacctcagtgattttggtcccctcccacttctctagttcgtcatcctcccttcccatatccttcaaaagaaccacactagggtctccacctacttatacaatgcggatgcccaactgtttttaaggaagccagaagcatcccatggaccatggggtgagtgtcctccaagagccccctgagctcagccctctgcctggagggctccagacctttctgagccctgcttggaggcgagcattttcactgctaggacaagctcagctgttgaggacacccccaccccaaatttcagttcttacgtgattttaaccattcaacatgctgttgggttttaattctctaattattattattattgttattattttttaggaccagttgtagtgaattgctactgaaagctatcccaggtgatacagagctctttgtaaaccgcagtcacacattagggttagtattaaactttgtttagatgtaccataattaacttggctagttgattgtttgaagtctatggaagaaatagttttatgcaaaattttaaaaaatgccagtctggtcagggaagtagggggtttcaatgctgttgggaaccaggaaggtgggacagccggcaggtagggacattgtgtacctcagttgtgtcacatgtgagcaagcccaggttgaccttgtgatgtgaattgatctgatcagactgtattaaaaatgttagtacattactctatctgc

SEQ ID NO: 356905 - DNA, 2628 bp, Homo sapiens
tggcgaattcggcacgagggggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatgggtgtggcatccagtgcccctcccctgactggcaagcgaggccggggccgcccaaggaaggccaacctgctggactcaatgtttgggtccccagggggcctgagggaggcaggcatccttccatgcggtctatgtggtaaggtgttcactgatgccaaccggctccggcagcacgaggcccagcacggtgtcaccagcctccagctgggctacatcgaccttcctcctccgaggctgggtgagaatgggctacccatctctgaagaccccgacggcccccgaaagaggagccggaccaggaagcaggtggcttgtgagatctgcggcaagatcttccgtgatgtgtatcatcttaaccggcacaagctgtcccactctggggagaagccctactcctgccctgtgtgtgggttgcggttcaagagaaaagaccgcatgtcctaccatgtgcggtcccatgatgggtccgtgggcaagccttacatctgccagagctgtgggaaaggcttctccaggcctgatcacttgaacggacatatcaagcaggtgcacacttctgagcggcctcacaagtgtcaggtgtgggttgggagcagcagcggcctgccgcccctggaacctcttcctagcgacctgccatcatgggactttgcccagcctgctttgtggaggtcgtcccattcggttcctgacaccgccttttccctttctctaaaaaaatcattcccagcccttgaaaacctgggcccagcacactccagcaacactctcttctgcccagccccgccgggatatctgaggcagggctggaccaccccagagggcagcagggcctttacccagtggcctgttggctagcctgggcctccctggagagggttgacagtggaagggaacaggaggggcatttggcctgagacccctgcttttgggagaggctagcagggtggttcctgcccagcatgcccagctcctccctgggtgactcggagtctttcccatgtcagagcccccaaatgggggtagcaaggagcacctttctggaaccccctatagcatccaagtttctttctgggctctcttgccttttcccccctttcacagatggcacccctgggcatctgtccttgcctaggtgattttggaggttggtgccttcctgggaactagccaccagcttatctgcttcccttcccctggcatcacttcccataggcctggggtttctagactggggcctggccacccctttccccactccacgagtgagtcggcctccagagaagactggcacaattccaactagagtcaacccatgctgccctctgcccttcccactcagatctagatcctgctttcatttctggctagtgaagtagacttttgtgtttttgaggtttattagcaggtctgctcaggaaccaaactaatgagtagctttatattgggccaccccaatatatggctttgggggctgaaaaagcagatgtagaccccctccctcggatccttattggtgtgccctttagcactccgcagactctgcggggtgaacaggagtgatgataaaatttttcattctaacatattgaggctt

SEQ ID NO: 356906 - DNA, 2352 bp, Homo sapiens
tggcgaattcggcacgagggggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatggggttacaaagtgagagccttgtatacacttcaatacttaaaaagtacccgtactcagtactcagccggcagcataatgaaaagtgggactagacacggtgtccatatggagaggaaaaatatacatagaatatttttaacaaaatgtattcattgtataaatggaatccttctgtaactttggtaactgcatacttgttgtttggtaatgaaccagaggaggtataatactctagaattgtgtaacattaaagtgtaaacttttgtgtttaaagagagagaacattttatggtgtgtacttttaaaaaggaaacaaagctgcatgcaacagcttgaaattgtatattcaggtattaaaggtgcaatactggttagaaaaaactcagggcctcccactggggagctgcctttatttaattttaaagaaaacaaaatctaacccaaaaagtccaattcatatttccctctcccctctttaagtaattttacatggccatagtcattattctaactgatatgtctataaagttgcacccccagtccgttgagccttggtatttgttgtaaattctcctttcacagcgattgttaaatctattcgtgccctgagatgtatggctttatgctgaagattggctggatgcgtcctctgatgtgtgttgtaggaatttaatgtggttgtctcctgcttttattatactgtgacttgttaggaaaccctgggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggtagtgtgcggagtttttttttcttccttcttttaaaaatggttgtttaagactttaacaatgggaaccccttgtgagcatgctcagtatcattgtggagaaccaagagggcctcttaactgtaacaatgttcatggttgtgatgttttttttttttttttaaataaaattccaaatgtttat

SEQ ID NO: 356907 - DNA, 3431 bp, Homo sapiens
tggcgaattcggcacgagggggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatgggtgtggcatccagtgcccctcccctgactggcaagcgaggccggggccgcccaaggaaggccaacctgctggactcaatgtttgggtccccagggggcctgagggaggcaggcatccttccatgcggtctatgtggtaaggtgttcactgatgccaaccggctccggcagcacgaggcccagcacggtgtcaccagcctccagctgggctacatcgaccttcctcctccgaggctgggtgagaatgggctacccatctctgaagaccccgacggcccccgaaagaggagccggaccaggaagcaggtggcttgtgagatctgcggcaagatcttccgtgatgtgtatcatcttaaccggcacaagctgtcccactctggggagaagccctactcctgccctgtgtgtgggttgcggttcaagagaaaagaccgcatgtcctaccatgtgcggtcccatgatgggtccgtgggcaagccttacatctgccagagctgtgggaaaggcttctccaggcctgatcacttgaacggacatatcaagcaggtgcacacttctgagcggcctcacaagtgtcagacctgcaatgcttcttttgccacccgagaccgtctgcgctcccacctggcctgtcatgaagacaaggtgccctgccaggtgtgtgggaagtacttgcgggcagcatacatggcagaccacctgaagaagcacagcgaggggcccagcaacttctgcagtatctgtaaccgaggtttctcctctgcctcctacttaaaggtccatgttaaaacccaccacggtgttccccttccccaggtctccaggcaccaggagcccatcctgaatgggggagcagcgttccactgcgccaggacctatggcaacaaagaaggccagaaatgctcacatcaggatccgattgagagctctgactcctatggtgacctctcagatgccagcgacctgaagacgccagagaagcagagtgccaatggctctttctcctgcgacatggcagtccccaaaaacaaaatggagtctgatggggagaagaagtacccatgccctgaatgtgggagcttcttccgctctaagtcctacttgaacaaacacatccagaaggtgcatgtccgggctctcgggggccccctgggggacctgggccctgcccttggctcacctttctctcctcagcagaacatgtctctcctcgagtcctttgggtttcagattgttcagtcggcatttgcgtcatctttagtagatcctgaggttgaccagcagcccatggggcctgaagggaaatgaggcagctgctgtgtccccacggaaacaaccatctggggactgctgggaaatgctgtgaatgcggagggaagtgatgtttgggttctgtagctgagagatttttattcatttttaactgccccccaaccccactccaactccttctccaccacccattctcccaatggtctttagaaatagattttcatctgatattctgcagaaatatcaatgagacttggtatgggacaggggcagaaaacactacataggcctccaaggcaaaaccagtcccagtttctttaatgggaagaagctggaattcctggtgctcaattcttagtgaccccaatcctatacccaaatctatgatattctgggacctcagtgattttggtcccctcccacttctctagttcgtcatcctcccttcccatatccttcaaaagaaccacactagggtctccacctacttatacaatgcggatgcccaactgtttttaaggaagccagaagcatcccatggaccatggggtgagtgtcctccaagagccccctgagctcagccctctgcctggagggctccagacctttctgagccctgcttggaggcgagcattttcactgctaggacaagctcagctgttgaggacacccccaccccaaatttcagttcttacgtgattttaaccattcaacatgctgttgggttttaattctctaattattattattattgttattattttttaggaccagttgtagtgaattgctactgaaagctatcccaggtgatacagagctctttgtaaaccgcagtcacacattagggttagtattaaactttgtttagatgtaccataattaacttggctagttgattgtttgaagtctatggaagaaatagttttatgcaaaattttaaaaaatgccagtctggtcagggaagtagggggtttcaatgctgttgggaaccaggaaggtgggacagccggcaggtagggacattgtgtacctcagttgtgtcacatgtgagcaagcccaggttgaccttgtgatgtgaattgatctgatcagactgtattaaaaatgttagtacattactctatctgc

SEQ ID NO: 356908 - DNA, 2172 bp, Homo sapiens
tggcgaattcggcacgagggggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatggggttacaaagtgagagccttgtatacacttcaatacttaaaaagtacccgtactcagtactcagccggcagcataatgaaaagtgggactagacacggtgtccatatggagaggaaaaatatacatagaatatttttaacaaaatgtattcattgtataaatggaatccttctgtaactttggtaactgcatacttgttgtttggtaatgaaccagaggaggtataatactctagaattgtgtaacattaaagtgtaaacttttgtgtttaaagagagagaacattttatggtgtgtacttttaaaaaggaaacaaagctgcatgcaacagcttgaaattgtatattcaggtattaaaggtgcaatactggttagaaaaaactcagggcctcccactggggagctgcctttatttaattttaaagaaaacaaaatctaacccaaaaagtccaattcatatttccctctcccctctttaagtaattttacatggccatagtcattattctaactgatatgtctataaagttgcacccccagtccgttgagccttggtatttgttgtaaattctcctttcacagcgattgttaaatctattcgtgccctgagatgtatggctttatgctgaagattggctggatgcgtcctctgatgtgtgttgtaggaatttaatgtggttgtctcctgcttttattatactgtgacttgttaggaaaccctgggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggta

SEQ ID NO: 356909 - DNA, 1987 bp, Homo sapiens
tggcgaattcggcacgagggggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagaggacccatggatgaaggaccagatcttgatctaggcccacctgtagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctggacaaggaaacaggaaagcccaaaggcgatgccacagtgtcctatgaagacccacccactgccaaggctgccgtggaatggtttgatgggaaagattttcaagggagcaaacttaaagtctcccttgctcggaagaagcctccaatgaacagtatgcggggtggtctgccaccccgtgagggcagaggcatgccaccaccactccgtggaggtccaggaggcccaggaggtcctgggggacccatgggtcgcatgggaggccgtggaggagatagaggaggcttccctccaagaggaccccggggttcccgagggaacccctctggaggaggaaacgtccagcaccgagctggagactggcagtgtcccaatccgggttgtggaaaccagaacttcgcctggagaacagagtgcaaccagtgtaaggccccaaagcctgaaggcttcctcccgccaccctttccgcccccgggtggtgatcgtggcagaggtggccctggtggcatgcggggaggaagaggtggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggta

SEQ ID NO: 356910 - DNA, 2436 bp, Homo sapiens
tggcgaattcggcacgagggggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatgggtgtggcatccagtgcccctcccctgactggcaagcgaggccggggccgcccaaggaaggccaacctgctggactcaatgtttgggtccccagggggcctgagggaggcaggcatccttccatgcggtctatgtggtaaggtgttcactgatgccaaccggctccggcagcacgaggcccagcacggtgtcaccagcctccagctgggctacatcgaccttcctcctccgaggctgggtgagaatgggctacccatctctgaagaccccgacggcccccgaaagaggagccggaccaggaagcaggtggcttgtgagatctgcggcaagatcttccgtgatgtgtatcatcttaaccggcacaagctgtcccactctggggagaagccctactcctgccctgtgtgtgggttgcggttcaagagaaaagaccgcatgtcctaccatgtgcggtcccatgatgggtccgtgggcaagccttacatctgccagagctgtgggaaaggcttctccaggcctgatcacttgaacggacatatcaagcaggtgcacacttctgagcggcctcacaagtgtcagacctgcaatgcttcttttgccacccgagaccgtctgcgctcccacctggcctgtcatgaagacaaggtgccctgccaggtgtgtgggaagtacttgcgggcagcatacatggcagaccacctgaagaagcacagcgaggggcccagcaacttctgcagtatctgtaaccgagaaggccagaaatgctcacatcaggatccgattgagagctctgactcctatggtgacctctcagatgccagcgacctgaagacgccagagaagcagagtgccaatggctctttctcctgcgacatggcagtccccaaaaacaaaatggagtctgatggggagaagaagtacccatgccctgaatgtgggagcttcttccgctctaagtcctacttgaacaaacacatccagaaggtgcatgtccgggctctcgggggccccctgggggacctgggccctgcccttggctcacctttctctcctcagcagaacatgtctctcctcgagtcctttgggtttcagattgttcagtcggcatttgcgtcatctttagtagatcctgaggttgaccagcagcccatggggcctgaagggaaatgaggcagctgctgtgtccccacggaaacaaccatctggggactgctgggaaatgctgtgaatgcggagggaagtagggggtttcaatgctgttgggaaccaggaaggtgggacagccggcaggtagggacattgtgtacctcagttgtgtcacatgtgagcaagcccaggttgaccttgtgatgtgaattgatctgatcagactgtattaaaaatgttagtacattactctatctgc

SEQ ID NO: 356911 - DNA, 2557 bp, Homo sapiens
  misc_feature (2360)..(2360): n is a, c, g, or t
tggcgaattcggcacgagggggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatggggttacaaagtgagagccttgtatacacttcaatacttaaaaagtacccgtactcagtactcagccggcagcataatgaaaagtgggactagacacggtgtccatatggagaggaaaaatatacatagaatatttttaacaaaatgtattcattgtataaatggaatccttctgtaactttggtaactgcatacttgttgtttggtaatgaaccagaggaggtataatactctagaattgtgtaacattaaagtgtaaacttttgtgtttaaagagagagaacattttatggtgtgtacttttaaaaaggaaacaaagctgcatgcaacagcttgaaattgtatattcaggtattaaaggtgcaatactggttagaaaaaactcagggcctcccactggggagctgcctttatttaattttaaagaaaacaaaatctaacccaaaaagtccaattcatatttccctctcccctctttaagtaattttacatggccatagtcattattctaactgatatgtctataaagttgcacccccagtccgttgagccttggtatttgttgtaaattctcctttcacagcgattgttaaatctattcgtgccctgagatgtatggctttatgctgaagattggctggatgcgtcctctgatgtgtgttgtaggaatttaatgtggttgtctcctgcttttattatactgtgacttgttaggaaaccctgggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggtaaaaaaaaagtcatttactctaccatgtttgcaggcacactcattacagcgctaagctcgcactgatttttttacctgagtaggcctagaaataaacatgctagcttttattccaggtctaaccaaaaaaataaaccctcgttccacagaagctgtcatcaagtatttcctcacgcaagcaaccgcatncataatccttctaatagctatcctctataacaatatactctgcggacaatgaaccataaccaatactaccaatcaatactcatcattaataatcataatggctatagcaataaaactaggaatagccccctttcacttttgagtccagaattaacccaggcacccctctgcaacccggctgctttttgtacatggca

SEQ ID NO: 356912 - DNA, 2332 bp, Homo sapiens
tggcgaattcggcacgagggggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatggggtaagagcaaaccttttctccttttacctaattttgtttcatccataggattttcagtggaaagaagggactgaaagacataagaaattaatttctgcatttccatggacaatctgttgagctcaagccatcttctaaaacatggaaatgtcatctttgtggcatatattaagtggcagtttattttctttccctgccagtatacttcgttgggtcggggagaacaaagaatggttttgaaaccagagctttcagttcccttcatggtttccagaggtgagaagcctctgtgggtagtagatttgggatggaacacacacaacccttctaatgaccctaagttgttaactaactgcctttgaatggttgtcttgaaatacctggtgtatatactgcagaaaaggaatgcagctgttttccacagtgtttgtccccaacttctgtttgtactcagaatcgttgaacatatgaagattttggtcccataatccttaaactatagcctgaggtgcacctgattacatagagtttggatggagcaaagaaaaatccaatagcattttgcagagtaatgtatataattatgggctcacttcctactggagatgttgaaagtctaaatcggtttgaccattttgattgatggcacaatctggtttagaaaactttgtttagatcaatgacataaccctgctgcctctgcctgcccttcccctcccttctcccatccccttttccctatctggtgtctgtactttgatgaaggtgagctataatattggtggttaacataatccagaaggcttagttctgtgtgtgttctgtccctatataaactggtaaagaaaaaaaaaagttatgcagaatgttagatatttacatttgatacggtgtgccactattcaaggaaaaattaaatagcattttttaaaaaacagaatgaacttcaaaattaaagttgatttttaacttccatattagcaaatactcttcactactgaaagacagtactattttgcatattctgcataactttaagaaagtctttagtgaaatctttattggaagaaagtcatttgacaacaggcaaaaatttaatgattcggtatgaagtaaaatcaatcttctgatttggaaaatactctattataaaggtttcacttctttttggatgttttaaaatagacatagacacttgaaagtactatcatcacgtctcaaatcacctagaattcctagtatttttaaattgcaaatacaatttcaagtttatttaaatactccagaagttataatcct

SEQ ID NO: 356913 - DNA, 2057 bp, Homo sapiens
tggcgaattcggcacgagggggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatgggtgtggcatccagtgcccctcccctgactggcaagcgaggccggggccgcccaaggaaggccaacctgctggactcaatgtttgggtccccagggggcctgagggaggcaggcatccttccatgcggtctatgtggtaaggtgttcactgatgccaaccggctccggcagcacgaggcccagcacggtgtcaccagcctccagctgggctacatcgaccttcctcctccgaggctgggtgagaatgggctacccatctctgaagaccccgacggcccccgaaagaggagccggaccaggaagcaggtggcttgtgagatctgcggcaagatcttccgtgatgtgtatcatcttaaccggcacaagctgtcccactctggggagaagccctactcctgccctgtgtgtgggttgcggttcaagagaaaagaccgcatgtcctaccatgtgcggtcccatgatgggtccgtgggcaagccttacatctgccagagctgtgggaaaggcttctccaggcctgatcacttgaacggacatatcaagcaggtgcacacttctgagcggcctcacaagtgtcaggtgtgggttgggagcagcagcggcctgccgcccctggaacctcttcctagcgacctgccatcatgggactttgcccagcctgctttgtggaggtcgtcccattcggttcctgacaccgccttttccctttctctaaaaaaatcattcccagcccttgaaaacctgggcccagcacactccagcaacactcagatctagatcctgctttcatttctggctagtgaagtagacttttgtgtttttgaggtttattagcaggtctgctcaggaaccaaactaatgagtagctttatattgggccaccccaatatatggctttgggggctgaaaaagcagatgtagaccccctccctcggatccttattggtgtgccctttagcactccgcagactctgcggggtgaacaggagtgatgataaaatttttcattctaacatattgaggctt

SEQ ID NO: 356914 - DNA, 1986 bp, Homo sapiens
tggcgaattcggcacgagggggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatggggttacaaagtgagagccttgtatacacttcaatacttaaaaagtacccgtactcagtactcagccggcagcataatgaaaagtgggactagacacggtgtccatatggagaggaaaaatatacatagaatatttttaacaaaatgtattcattgtataaatggaatccttctgtaactttggtaactgcatacttgttgtttggtaatgaaccagaggaggtataatactctagaattgtgtaacattaaagtgtaaacttttgtgtttaaagagagagaacattttatggtgtgtacttttaaaaaggaaacaaagctgcatgcaacagcttgaaattgtatattcaggtattaaaggtgcaatactggttagaaaaaactcagggcctcccactggggagctgcctttatttaattttaaagaaaacaaaatctaacccaaaaagtccaattcatatttccctctcccctctttaagtaattttacatggccatagtcattattctaactgatatgtctataaagttgcacccccagtccgttgagccttggtatttgttgtaaattctcctttcacagcgattgttaaatctattcgtgccctgagatgtatggctttatgctgaagattggctggatgcgtcctctgatgtgtgttgtaggaatttaatgtggttgtctcctgcttttattatactgtgacttgttaggaaaccctgggcctcatttggctctcccttgggagacgtgcagcagccccatataacctgccaggtatcccccagataaccaatgacctcctcaatacagactcggtatcacgacgacgaacagggaccacgcacgcaatgcagagccacaccacccaatacgccacaccaggtacacacaacgcacaaaaacaccagcccacacccacgacacaaacaccaccccacagcgcaacacgac

SEQ ID NO: 356915 - DNA, 2151 bp, Homo sapiens
tggcgaattcggcacgagggggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatgggcagcgctggagagcgaggtggcttcaataagcctggtggacccatggatgaaggaccagatcttgatctaggcccacctgtagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctggacaaggaaacaggaaagcccaaaggcgatgccacagtgtcctatgaagacccacccactgccaaggctgccgtggaatggtttgatgggaaagattttcaagggagcaaacttaaagtctcccttgctcggaagaagcctccaatgaacagtatgcggggtggtctgccaccccgtgagggcagaggcatgccaccaccactccgtggaggtccaggaggcccaggaggtcctgggggacccatgggtcgcatgggaggccgtggaggagatagaggaggcttccctccaagaggaccccggggttcccgagggaacccctctggaggaggaaacgtccagcaccgagctggagactggcagtgtcccaatccgggttgtggaaaccagaacttcgcctggagaacagagtgcaaccagtgtaaggccccaaagcctgaaggcttcctcccgccaccctttccgcccccgggtggtgatcgtggcagaggtggccctggtggcatgcggggaggaagaggtggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggta

SEQ ID NO: 356916 - DNA, 2123 bp, Homo sapiens
tggcgaattcggcacgagggggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagaatgtcaccgggtgcgcatcaatgtacctccacacagagggcttctctgggccctctccaggtgacggggccatgggctatggctatgagaaacctctgcgaccattcccagatgatgtctgcgttgtccctgagaaatttgaaggagacatcaagcaggaaggggtcggtgcatttcgagaggggccgccctaccagcgccggggtgccctgcagctgtggcaatttctggtggccttgctggatgacccaacaaatgcccatttcattgcctggacgggccggggaatggagttcaagctcattgagcctgaggaggtcgccaggctctggggcatccagaagaaccggccagccatgaattacgacaagctgagccgctcgctccgatactattatgagaaaggcatcatgcagaaggtggctggtgagcgttacgtgtacaagtttgtgtgtgagcccgaggccctcttctctttggccttcccggacaatcagcgtccagctctcaaggctgagtttgaccggcctgtcagtgaggaggacacagtccctttgtcccacttggatgagagccccgcctacctcccagagctggctggccccgcccagccatttggccccaagggtggctactcttactagcccccagcggctgttccccctgccgcaggtgggtgctgccctgtgtacatataaatgaatctggtgttggggaaaccttcatctgaaacccacagatgtctctggggcagatccccactgtcctaccagttgccctagcccagactctgagctgctcaccggagtcattgggaaggaaaagtggagaaatggcaagtctagagtctcagaaactcccctgggggtttcacctgggccctggaggaattcagctcagcttcttcctaggtccaagccccccacaccttttccccaaccacagagaacaagagtttgttctgttctgggggacagagaaggcgcttcccaacttcatactggcaggagggtgaggaggttcactgagctccccagatctcccactgcggggagacagaagcctggactctgccccacgctgtggccctggagggtcccggtttgtcagttcttggtgctctgtgttcccagaggcaggcggaggttgaagaaaggaacctgggatgaggggtgctgggtataagcagagagggatgggttcctgctccaagggaccctttgcctttcttctgccctttcctaggcccaggcctgggtttgtatcccatt

SEQ ID NO: 356917 - DNA, 1354 bp, Homo sapiens
  misc_feature (856)..(856): n is a, c, g, or t
  misc_feature (859)..(859): n is a, c, g, or t
  misc_feature (871)..(871): n is a, c, g, or t
  misc_feature (877)..(877): n is a, c, g, or t
  misc_feature (892)..(892): n is a, c, g, or t
  misc_feature (895)..(895): n is a, c, g, or t
  misc_feature (898)..(898): n is a, c, g, or t
  misc_feature (905)..(905): n is a, c, g, or t
  misc_feature (911)..(911): n is a, c, g, or t
  misc_feature (919)..(919): n is a, c, g, or t
  misc_feature (931)..(931): n is a, c, g, or t
  misc_feature (934)..(934): n is a, c, g, or t
  misc_feature (952)..(952): n is a, c, g, or t
  misc_feature (961)..(961): n is a, c, g, or t
  misc_feature (967)..(967): n is a, c, g, or t
  misc_feature (977)..(977): n is a, c, g, or t
  misc_feature (988)..(989): n is a, c, g, or t
  misc_feature (997)..(997): n is a, c, g, or t
  misc_feature (1003)..(1003): n is a, c, g, or t
  misc_feature (1015)..(1015): n is a, c, g, or t
  misc_feature (1021)..(1021): n is a, c, g, or t
  misc_feature (1027)..(1027): n is a, c, g, or t
  misc_feature (1033)..(1033): n is a, c, g, or t
  misc_feature (1045)..(1045): n is a, c, g, or t
  misc_feature (1054)..(1054): n is a, c, g, or t
  misc_feature (1057)..(1057): n is a, c, g, or t
  misc_feature (1063)..(1063): n is a, c, g, or t
  misc_feature (1072)..(1072): n is a, c, g, or t
  misc_feature (1075)..(1075): n is a, c, g, or t
  misc_feature (1078)..(1078): n is a, c, g, or t
  misc_feature (1081)..(1081): n is a, c, g, or t
  misc_feature (1084)..(1085): n is a, c, g, or t
  misc_feature (1087)..(1087): n is a, c, g, or t
  misc_feature (1090)..(1090): n is a, c, g, or t
  misc_feature (1093)..(1093): n is a, c, g, or t
  misc_feature (1099)..(1099): n is a, c, g, or t
  misc_feature (1102)..(1102): n is a, c, g, or t
  misc_feature (1114)..(1114): n is a, c, g, or t
  misc_feature (1117)..(1117): n is a, c, g, or t
  misc_feature (1126)..(1126): n is a, c, g, or t
  misc_feature (1129)..(1129): n is a, c, g, or t
  misc_feature (1135)..(1135): n is a, c, g, or t
  misc_feature (1138)..(1138): n is a, c, g, or t
  misc_feature (1141)..(1142): n is a, c, g, or t
  misc_feature (1144)..(1144): n is a, c, g, or t
  misc_feature (1150)..(1150): n is a, c, g, or t
  misc_feature (1153)..(1154): n is a, c, g, or t
  misc_feature (1168)..(1168): n is a, c, g, or t
  misc_feature (1171)..(1171): n is a, c, g, or t
  misc_feature (1175)..(1175): n is a, c, g, or t
  misc_feature (1178)..(1178): n is a, c, g, or t
  misc_feature (1180)..(1180): n is a, c, g, or t
  misc_feature (1187)..(1189): n is a, c, g, or t
  misc_feature (1195)..(1195): n is a, c, g, or t
  misc_feature (1198)..(1198): n is a, c, g, or t
  misc_feature (1206)..(1207): n is a, c, g, or t
  misc_feature (1214)..(1214): n is a, c, g, or t
tggcgaattcggcacgagggggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagagnggncagatccagctntggcanttcctcctggagctnctntcngacagcnccaacnccagctgnatcacctggganggnaccaacggggagttcaanatgacggancccgangaggtggccnggcgctggggnnagcggaanagcaancccaacatgaantacganaagctnagccgngccctccgttantactatganaanaacatnatgaccaangtncanggnaanngntangcntacaanttngacttccacggnatngcccaggcnctncagccncanccnncngagtcntcnntgtacaagtacccntcngacntcncntacatgnnntcctancangcccaccnncagaagntgaactttgtggcgccccaccctccagccctccccgtgacatcttccagtttttttgctgccccaaacccatactggaattcaccaactgggggtatataccccaacactaggctccccaccagccatatgccttctcat

SEQ ID NO: 356918 - DNA, 1140 bp, Homo sapiens
tggcgaattcggcacgagggggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagattgccattgccccaaatggagccttacagttggcaagtccaggcacagatggagtacagggacttcagacattaaccatgacaaattcaggcagtactcagcaaggtacaactattcttcagtatgcacagacctctgatggacagcagatacttgtgcccagcaatcaggtggtcgtacaaactgcatcaggagatatgccaacatatcagatccgaactacaccttcagctacttctctgccacaaactgtggtgatgacatctcctgtgactctcacctctcaga

SEQ ID NO: 356919 - DNA, 792 bp, Homo sapiens
  misc_feature (762)..(762): n is a, c, g, or t
  misc_feature (768)..(768): n is a, c, g, or t
tggcgaattcggcacgagggggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcacncattangaggggtccgagctcgatcgttca

SEQ ID NO: 356920 - DNA, 845 bp, Homo sapiens
tggcgaattcggcacgagggggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgattgctacagtcaccaccacccaggcctcctatgcagctcagtctgcatatggcactcagcctgcttatccagcctatgggcagcagccagcagccctgcacctacaagaccgcaggatgcaacaagccctctgagactagtcaacctcaatctagcaacggggttacaccaaccc

SEQ ID NO: 356921 - DNA, 430 bp, Homo sapiens
agtttgggaaatcctatgtgagcatctactcataattgccttaagtgaagtaaaccaaaagtttgatagcattcttcttagtatgcttggtagttttcttagatttatgatgaatatccttgggcagtagtgatcaggtagttaagaaacccctatagatacatgataataattctcctgtcttgttgtctctgaaaggcccacctgtagatccagatgaagactctgacaacagtgcaatttatgtacaaggattaaatgacagtgtgactctagatgatctggcagacttctttaagcagtgtggggttgttaaggtcagtaaaagcataaccaggtcatctggcagaactttaaaccacagagcattttaaagagattgaattgatgttgagagttgttttctaaggttgcctttgcctgacttctt

SEQ ID NO: 356922 - DNA, 518 bp, Homo sapiens
tataggctaactatataaggttatttcagctgtgatgatccagcagttttgttgaacttaaaagagcctacctattaaggatgctttatcgtgatgtaaagaagatggtgccttggttagtgccttggaattgaggattttgtgattccaggagaaagtacatcaggcagtggtgtaaatgctggtccatggcttacagatgtgactctttcctcaggttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatggggtaagagcaaaccttttctccttttacctaattttgtttcatccataggattttcagtggaaagaagggactgaaagacataagaaattaatttctgcatttccatggacaatctgttga

SEQ ID NO: 356923 - DNA, 3014 bp, Homo sapiens
gggcctactctgccgccgccgccgcccgcccgctccagccgccgccgccgccgccaccgccctccaggctccgggacccggcccgcgccaccgcccccgtgcgcgccccgccgccgccgccttcgccttcgccttttgtttcctccgctccggcgcccccgccccggctcgcgctttgcaggggacgcagcgcgcgcccccagcgggcccgggaaaagccgcggcgcgcgcgcgcgcctgcgcggcggacccctccttctcctccccgcgtgcgcgtgcccttcttggctgcgcgccggcgccgcctggcgggcgggaggggaggtggcaggcgcgtttgcaggaggggcgcacctcttcgctcgcgcacccccccggaaggtagaccgggaaggggaggcgggcgggcggagaggagagagtggcgcgcagtccagcgagggcgggggttggctatgtggggggtggtgcaccccgcagtctagacagtctgatccgggctgggggcgtgtacactcggcgcacctgcgagactacagagcctcgggccggcacgtgtggggagtgtggacacgtctgctgcgccccgcttctcgctgctgaggggaagggagggggcgggcaggtgcagcggccgggctagtgggagggggcggcggccatggagcgggtgaacgacgcttcgtgcggcccgtctggctgctacacataccaggtgagcagacacagcacggagatgctgcacaacctgaaccagcagcgcaaaaacggcgggcgcttctgcgacgtgctcttgcgggtaggcgacgagagcttcccagcgcaccgcgccgtgctggccgcctgcagcgagtactttgagtcggtgttcagcgcccagttgggcgacggcggagctgcggacgggggtccggctgatgtagggggcgcgacggcagcaccaggcggcggggccgggggcagccgggagctggagatgcacactatcagctccaaggtatttggggacattctggacttcgcctacacttcccgcatcgtggtgcgcttggagagctttcccgaactcatgacggccgccaagttcctgctgatgaggtcggttatcgagatctgccaggaagtcatcaaacagtccaacgtacagatcctggtaccccctgcccgcgccgatataatgctctttcgcccccctgggacctcggacttgggcttccctttggacatgaccaacggggcagccttggcagccaacagcaatggcatcgccggcagcatgcagccagaggaggaggcagctcgggcggctggtgcagccattgcaggccaagcctctttgcctgtgttacctggggtggaccgcttgcccatggtggctggacccctatccccccaactgctgacttccccattccccagtgtggcatccagtgcccctcccctgactggcaagcgaggccggggccgcccaaggaaggccaacctgctggactcaatgtttgggtccccagggggcctgagggaggcaggcatccttccatgcggtctatgtggtaaggtgttcactgatgccaaccggctccggcagcacgaggcccagcacggtgtcaccagcctccagctgggctacatcgaccttcctcctccgaggctgggtgagaatgggctacccatctctgaagaccccgacggcccccgaaagaggagccggaccaggaagcaggtggcttgtgagatctgcggcaagatcttccgtgatgtgtatcatcttaaccggcacaagctgtcccactctggggagaagccctactcctgccctgtgtgtgggttgcggttcaagagaaaagaccgcatgtcctaccatgtgcggtcccatgatgggtccgtgggcaagccttacatctgccagagctgtgggaaaggcttctccaggcctgatcacttgaacggacatatcaagcaggtgcacacttctgagcggcctcacaagtgtcaggtgtgggttgggagcagcagcggcctgccgcccctggaacctcttcctagcgacctgccatcatgggactttgcccagcctgctttgtggaggtcgtcccattcggttcctgacaccgccttttccctttctctaaaaaaatcattcccagcccttgaaaacctgggcccagcacactccagcaacactctcttctgcccagccccgccgggatatctgaggcagggctggaccaccccagagggcagcagggcctttacccagtggcctgttggctagcctgggcctccctggagagggttgacagtggaagggaacaggaggggcatttggcctgagacccctgcttttgggagaggctagcagggtggttcctgcccagcatgcccagctcctccctgggtgactcggagtctttcccatgtcagagcccccaaatgggggtagcaaggagcacctttctggaaccccctatagcatccaagtttctttctgggctctcttgccttttcccccctttcacagatggcacccctgggcatctgtccttgcctaggtgattttggaggttggtgccttcctgggaactagccaccagcttatctgcttcccttcccctggcatcacttcccataggcctggggtttctagactggggcctggccacccctttccccactccacgagtgagtcggcctccagagaagactggcacaattccaactagagtcaacccatgctgccctctgcccttcccactcagatctagatcctgctttcatttctggctagtgaagtagacttttgtgtttttgaggtttattagcaggtctgctcaggaaccaaactaatgagtagctttatattgggccaccccaatatatggctttgggggctgaaaaagcagatgtagaccccctccctcggatccttattggtgtgccctttagcactccgcagactctgcggggtgaacaggagtgatgataaaatttttcattctaacatattgaggctt

SEQ ID NO: 356924 - DNA, 670 bp, Homo sapiens
  misc_feature (14)..(15): n is a, c, g, or t
  misc_feature (45)..(45): n is a, c, g, or t
  misc_feature (70)..(70): n is a, c, g, or t
  misc_feature (77)..(77): n is a, c, g, or t
  misc_feature (116)..(116): n is a, c, g, or t
  misc_feature (122)..(122): n is a, c, g, or t
  misc_feature (129)..(129): n is a, c, g, or t
  misc_feature (134)..(134): n is a, c, g, or t
  misc_feature (139)..(139): n is a, c, g, or t
  misc_feature (142)..(143): n is a, c, g, or t
  misc_feature (145)..(146): n is a, c, g, or t
  misc_feature (148)..(150): n is a, c, g, or t
  misc_feature (153)..(153): n is a, c, g, or t
ccagggggccgggnnaaaaaaggggttccccaaaaggccccgggnttccaaggacccttggggaagaaancttccanccccaagttgaagctggcaagtgtcccatccgggtttgnaaccanacttggnttggnaaacnagnncnncnnntgnaaggccccaaagcctgaaggcttcctcccgccaccctttccgcccccgggtggtgatcgtggcagaggtggccctggtggcatgcggggaggaagaggtggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggta

SEQ ID NO: 356925 - DNA, 376 bp, Homo sapiens
tgcgtcgctctagaggatccggcacacccgctaggacagcagagtagcttaggcaacgaaagcagctatgggcagcagcctcccactagttacccaccccaaactggatcctacagccaagctccaagtcaatatagccaacagagcagcagctacgggcagcagagtgagaaaccataccagtgtgacttcaaggactgtgaacgaaggttttctcgttcagaccagctcaaaagacaccaaaggagacatacaggtgtgaaaccattccagtgtaaaacttgtcagcgaaagttctcccggtccgaccacctgaagacccacaccaggactcatacaggtaaaacaagtgaaaagcccttcagctgtcggtggc

SEQ ID NO: 356926 - DNA, 3679 bp, Homo sapiens
gggcctactctgccgccgccgccgcccgcccgctccagccgccgccgccgccgccaccgccctccaggctccgggacccggcccgcgccaccgcccccgtgcgcgccccgccgccgccgccttcgccttcgccttttgtttcctccgctccggcgcccccgccccggctcgcgctttgcaggggacgcagcgcgcgcccccagcgggcccgggaaaagccgcggcgcgcgcgcgcgcctgcgcggcggacccctccttctcctccccgcgtgcgcgtgcccttcttggctgcgcgccggcgccgcctggcgggcgggaggggaggtggcaggcgcgtttgcaggaggggcgcacctcttcgctcgcgcacccccccggaaggtagaccgggaaggggaggcgggcgggcggagaggagagagtggcgcgcagtccagcgagggcgggggttggctatgtggggggtggtgcaccccgcagtctagacagtctgatccgggctgggggcgtgtacactcggcgcacctgcgagactacagagcctcgggccggcacgtgtggggagtgtggacacgtctgctgcgccccgcttctcgctgctgaggggaagggagggggcgggcaggtgcagcggccgggctagtgggagggggcggcggccatggagcgggtgaacgacgcttcgtgcggcccgtctggctgctacacataccaggtgagcagacacagcacggagatgctgcacaacctgaaccagcagcgcaaaaacggcgggcgcttctgcgacgtgctcttgcgggtaggcgacgagagcttcccagcgcaccgcgccgtgctggccgcctgcagcgagtactttgagtcggtgttcagcgcccagttgggcgacggcggagctgcggacgggggtccggctgatgtagggggcgcgacggcagcaccaggcggcggggccgggggcagccgggagctggagatgcacactatcagctccaaggtatttggggacattctggacttcgcctacacttcccgcatcgtggtgcgcttggagagctttcccgaactcatgacggccgccaagttcctgctgatgaggtcggttatcgagatctgccaggaagtcatcaaacagtccaacgtacagatcctggtaccccctgcccgcgccgatataatgctctttcgcccccctgggacctcggacttgggcttccctttggacatgaccaacggggcagccttggcagccaacagcaatggcatcgccggcagcatgcagccagaggaggaggcagctcgggcggctggtgcagccattgcaggccaagcctctttgcctgtgttacctggggtggaccgcttgcccatggtggctggacccctatccccccaactgctgacttccccattccccagtgtggcatccagtgcccctcccctgactggcaagcgaggccggggccgcccaaggaaggccaacctgctggactcaatgtttgggtccccagggggcctgagggaggcaggcatccttccatgcggtctatgtggtaaggtgttcactgatgccaaccggctccggcagcacgaggcccagcacggtgtcaccagcctccagctgggctacatcgaccttcctcctccgaggctgggtgagaatgggctacccatctctgaagaccccgacggcccccgaaagaggagccggaccaggaagcaggtggcttgtgagatctgcggcaagatcttccgtgatgtgtatcatcttaaccggcacaagctgtcccactctggggagaagccctactcctgccctgtgtgtgggttgcggttcaagagaaaagaccgcatgtcctaccatgtgcggtcccatgatgggtccgtgggcaagccttacatctgccagagctgtgggaaaggcttctccaggcctgatcacttgaacggacatatcaagcaggtgcacacttctgagcggcctcacaagtgtcagacctgcaatgcttcttttgccacccgagaccgtctgcgctcccacctggcctgtcatgaagacaaggtgccctgccaggtgtgtgggaagtacttgcgggcagcatacatggcagaccacctgaagaagcacagcgaggggcccagcaacttctgcagtatctgtaaccgagaaggccagaaatgctcacatcaggatccgattgagagctctgactcctatggtgacctctcagatgccagcgacctgaagacgccagagaagcagagtgccaatggctctttctcctgcgacatggcagtccccaaaaacaaaatggagtctgatggggagaagaagtacccatgccctgaatgtgggagcttcttccgctctaagtcctacttgaacaaacacatccagaaggtgcatgtccgggctctcgggggccccctgggggacctgggccctgcccttggctcacctttctctcctcagcagaacatgtctctcctcgagtcctttgggtttcagattgttcagtcggcatttgcgtcatctttagtagatcctgaggttgaccagcagcccatggggcctgaagggaaatgaggcagctgctgtgtccccacggaaacaaccatctggggactgctgggaaatgctgtgaatgcggagggaagtgatgtttgggttctgtagctgagagatttttattcatttttaactgccccccaaccccactccaactccttctccaccacccattctcccaatggtctttagaaatagattttcatctgatattctgcagaaatatcaatgagacttggtatgggacaggggcagaaaacactacataggcctccaaggcaaaaccagtcccagtttctttaatgggaagaagctggaattcctggtgctcaattcttagtgaccccaatcctatacccaaatctatgatattctgggacctcagtgattttggtcccctcccacttctctagttcgtcatcctcccttcccatatccttcaaaagaaccacactagggtctccacctacttatacaatgcggatgcccaactgtttttaaggaagccagaagcatcccatggaccatggggtgagtgtcctccaagagccccctgagctcagccctctgcctggagggctccagacctttctgagccctgcttggaggcgagcattttcactgctaggacaagctcagctgttgaggacacccccaccccaaatttcagttcttacgtgattttaaccattcaacatgctgttgggttttaattctctaattattattattattgttattattttttaggaccagttgtagtgaattgctactgaaagctatcccaggtgatacagagctctttgtaaaccgcagtcacacattagggttagtattaaactttgtttagatgtaccataattaacttggctagttgattgtttgaagtctatggaagaaatagttttatgcaaaattttaaaaaatgccagtctggtcagggaagtagggggtttcaatgctgttgggaaccaggaaggtgggacagccggcaggtagggacattgtgtacctcagttgtgtcacatgtgagcaagcccaggttgaccttgtgatgtgaattgatctgatcagactgtattaaaaatgttagtacattactctatctgc

SEQ ID NO: 356927 - DNA, 2205 bp, Homo sapiens
tggcgaattcggcacgagggggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatgggcagcgctggagagcgaggtggcttcaataagcctggtggacccatggatgaaggaccagatcttgatctaggcccacctgtagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctggacaaggaaacaggaaagcccaaaggcgatgccacagtgtcctatgaagacccacccactgccaaggctgccgtggaatggtttgatgggaaagattttcaagggagcaaacttaaagtctcccttgctcggaagaagcctccaatgaacagtatgcggggtggtctgccaccccgtgagggcagaggcatgccaccaccactccgtggaggtccaggaggcccaggaggtcctgggggacccatgggtcgcatgggaggccgtggaggagatagaggaggcttccctccaagaggaccccggggttcccgagggaacccctctggaggaggaaacgtccagcaccgagctggagactggcagtgtcccaatccgggttgtggaaaccagaacttcgcctggagaacagagtgcaaccagtgtaaggccccaaagcctgaaggcttcctcccgccaccctttccgcccccgggtggtgatcgtggcagaggtggccctggtggcatgcggggaggaagaggtggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggta

SEQ ID NO: 356928 - DNA, 3891 bp, Homo sapiens
tggcgaattcggcacgagggggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatggggttacaaagtgagagccttgtatacacttcaatacttaaaaagtacccgtactcagtactcagccggcagcataatgaaaagtgggactagacacggtgtccatatggagaggaaaaatatacatagaatatttttaacaaaatgtattcattgtataaatggaatccttctgtaactttggtaactgcatacttgttgtttggtaatgaaccagaggaggtataatactctagaattgtgtaacattaaagtgtaaacttttgtgtttaaagagagagaacattttatggtgtgtacttttaaaaaggaaacaaagctgcatgcaacagcttgaaattgtatattcaggtattaaaggtgcaatactggttagaaaaaactcagggcctcccactggggagctgcctttatttaattttaaagaaaacaaaatctaacccaaaaagtccaattcatatttccctctcccctctttaagtaattttacatggccatagtcattattctaactgatatgtctataaagttgcacccccagtccgttgagccttggtatttgttgtaaattctcctttcacagcgattgttaaatctattcgtgccctgagatgtatggctttatgctgaagattggctggatgcgtcctctgatgtgtgttgtaggaatttaatgtggttgtctcctgcttttattatactgtgacttgttaggaaaccctgggcctcatttggctctcccttgggagaggttgagggtgcacctttatgaacatggaaaggtttatcacagcagttaacccccacttgctcctcccctctataccaagctcttctggtttttcacctgacggggtgggtgtttgggatctattttttcttgctaatttgccaagtattgcactattaataccagcccccgaaatgaaaggaaccaaccacactggtgtgtacaatcagacaagcaaggttgtatattgaggaaatttgagcaagctgccctgaagaaaggcatagtgacaagatgagagagatgcattgtttggagatgtgtttagccagtgcccttcttccccacgagcccccccaaggctcagagcggtactggcttttaaagggaaaggccttcatttcttcgtttatccccccagcagcgctggagagcgaggtggcttcaataagcctggtggtaagtttttgagtattaccatagatagtgtttaaaaaaaaatgcagtcagtttttagaaaactataatttttttattagtttcataagtggtttaaaaatgatctatacaaaagagactaatgggtactgccggcattgtcttaggggttaataaggttaacctatggttacaaaacaaagggtaacttgaagtattgagtaactgcttctgtaatatgggggagaataaatttttaaatttggtttatttagaggaaaaattttgacttaaatttaacactgatttggcacataagcattgagagtgtatttggttaatggtttagaagcaaaccagcaaaggaaaaaagcaaaccctagcaaacctttcacaaatgttaaagagacactgctccattttagcagtgcgggtcattttgagtttaatgaatccccatcaaatggtggtatagtagatagctatgtgtgtttgtaaggtttgtagcttgcaagacgtgcactaataatattttatatgatctttcctggttggcaggacccatggatgaaggaccagatcttgatctaggcccacctgtagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctggacaaggaaacaggaaagcccaaaggcgatgccacagtgtcctatgaagacccacccactgccaaggctgccgtggaatggtttgatgggaaagattttcaagggagcaaacttaaagtctcccttgctcggaagaagcctccaatgaacagtatgcggggtggtctgccaccccgtgagggcagaggcatgccaccaccactccgtggaggtccaggaggcccaggaggtcctgggggacccatgggtcgcatgggaggccgtggaggagatagaggaggcttccctccaagaggaccccggggttcccgagggaacccctctggaggaggaaacgtccagcaccgagctggagactggcagtgtcccaatccgggttgtggaaaccagaacttcgcctggagaacagagtgcaaccagtgtaaggccccaaagcctgaaggcttcctcccgccaccctttccgcccccgggtggtgatcgtggcagaggtggccctggtggcatgcggggaggaagaggtggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggta

SEQ ID NO: 356929 - DNA, 2381 bp, Homo sapiens
tggcgaattcggcacgagggggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatgggcagcgctggagagcgaggtggcttcaataagcctggtggacccatggatgaaggaccagatcttgatctaggcccacctgtagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctggacaaggaaacaggaaagcccaaaggcgatgccacagtgtcctatgaagacccacccactgccaaggctgccgtggaatggtttgatgggaaagattttcaagggagcaaacttaaagtctcccttgctcggaagaagcctccaatgaacagtatgcggggtggtctgccaccccgtgagggcagaggcatgccaccaccactccgtggaggtccaggaggcccaggaggtcctgggggacccatgggtcgcatgggaggccgtggaggagatagaggaggcttccctccaagaggaccccggggttcccgagggaacccctctggaggaggaaacgtccagcaccgagctggagactggcagtgtcccaatccgggttgtggaaaccagaacttcgcctggagaacagagtgcaaccagtgtaaggccccaaagcctgaaggcttcctcccgccaccctttccgcccccgggtggtgatcgtggcagaggtggccctggtggcatgcggggaggaagaggtggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggtagtgtgcggagtttttttttcttccttcttttaaaaatggttgtttaagactttaacaatgggaaccccttgtgagcatgctcagtatcattgtggagaaccaagagggcctcttaactgtaacaatgttcatggttgtgatgtttttttttttttttaaataaaattccaaatgtt

SEQ ID NO: 356930 - DNA, 2604 bp, Homo sapiens
tggcgaattcggcacgagggggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatgggcagcgctggagagcgaggtggcttcaataagcctggtggacccatggatgaaggaccagatcttgatctaggcccacctgtagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctggacaaggaaacaggaaagcccaaaggcgatgccacagtgtcctatgaagacccacccactgccaaggctgccgtggaatggtttgatgggaaagattttcaagggagcaaacttaaagtctcccttgctcggaagaagcctccaatgaacagtatgcggggtggtctgccaccccgtgagggcagaggcatgccaccaccactccgtggaggtccaggaggcccaggaggtcctgggggacccatgggtcgcatgggaggccgtggaggagatagaggaggcttccctccaagaggaccccggggttcccgagggaacccctctggaggaggaaacgtccagcaccgagctggagactggcagtgtcccaatccgggttgtggaaaccagaacttcgcctggagaacagagtgcaaccagtgtaaggccccaaagcctgaaggcttcctcccgccaccctttccgcccccgggtggtgatcgtggcagaggtggccctggtggcatgcggggaggaagaggtggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggtagtgtgcggagtttttttttcttccttcttttaaaaatggttgtttaagactttaacaatgggaaccccttgtgagcatgctcagtatcattgtggagaaccaagagggcctcttaactgtaacaatgttcatggttgtgatgttttttttttttaaataaaattccaaaaaacaagcaataaaacacacaacaacggtgtggcggggcggaggcacctcggaaaagtttttacacccactcgtggggcgcgggcgccagtgtaggtggaccgggccaagggttcgcaaggagaaccggcgcagcacagggggtgcttcccaccataaaaaagccggcggcgccccggcttggaacactccagagggtcgggccaggctttaacacgagtccaggagaag

SEQ ID NO: 356931 - DNA, 2134 bp, Homo sapiens
tggcgaattcggcacgagggggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcaggacccatggatgaaggaccagatcttgatctaggcccacctgtagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctggacaaggaaacaggaaagcccaaaggcgatgccacagtgtcctatgaagacccacccactgccaaggctgccgtggaatggtttgatgggaaagattttcaagggagcaaacttaaagtctcccttgctcggaagaagcctccaatgaacagtatgcggggtggtctgccaccccgtgagggcagaggcatgccaccaccactccgtggaggtccaggaggcccaggaggtcctgggggacccatgggtcgcatgggaggccgtggaggagatagaggaggcttccctccaagaggaccccggggttcccgagggaacccctctggaggaggaaacgtccagcaccgagctggagactggcagtgtcccaatccgggttgtggaaaccagaacttcgcctggagaacagagtgcaaccagtgtaaggccccaaagcctgaaggcttcctcccgccaccctttccgcccccgggtggtgatcgtggcagaggtggccctggtggcatgcggggaggaagaggtggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggta

SEQ ID NO: 356932 - DNA, 2534 bp, Homo sapiens
tggcgaattcggcacgagggggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatgggcagcgctggagagcgaggtggcttcaataagcctggtggacccatggatgaaggaccagatcttgatctaggcccacctgtagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctggacaaggaaacaggaaagcccaaaggcgatgccacagtgtcctatgaagacccacccactgccaaggctgccgtggaatggtttgatgggaaagattttcaagggagcaaacttaaagtctcccttgctcggaagaagcctccaatgaacagtatgcggggtggtctgccaccccgtgagggcagaggcatgccaccaccactccgtggaggtccaggaggcccaggaggtcctgggggacccatgggtcgcatgggaggccgtggaggagatagaggaggcttccctccaagaggaccccggggttcccgagggaacccctctggaggaggaaacgtccagcaccgagctggagactggcagtgtcccaatccgggttgtggaaaccagaacttcgcctggagaacagagtgcaaccagtgtaaggccccaaagcctgaaggcttcctcccgccaccctttccgcccccgggtggtgatcgtggcagaggtggccctggtggcatgcggggaggaagaggtggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggtagaaaaaaaaaaaaaaaaaaaaaaaaaaatttttggggggtttgggcctttgggaaggtttttaaacacatttgggttgggcgggggggcccattatggttacgtggagccttgtgggcaataaggtgtccctaagggaaactcggggccaattgacactatggcgttggattttttacgcaattaaaaaaaaggcgcgggggaaaccgcggagttttctggaaccaaatttcccaaatggggatttcggggaggctccaaagcggggttctttcacgcggggaggtcccaggggactccgaactctatttagcggggccgcgtgagatg

SEQ ID NO: 356933 - DNA, 2183 bp, Homo sapiens
  misc_feature (2097)..(2097): n is a, c, g, or t
  misc_feature (2109)..(2109): n is a, c, g, or t
  misc_feature (2113)..(2113): n is a, c, g, or t
tggcgaattcggcacgagggggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatgggcagcgctggagagcgaggtggcttcaataagcctggtggacccatggatgaaggaccagatcttgatctaggcccacctgtagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctggacaaggaaacaggaaagcccaaaggcgatgccacagtgtcctatgaagacccacccactgccaaggctgccgtggaatggtttgatgggaaagattttcaagggagcaaacttaaagtctcccttgctcggaagaagcctccaatgaacagtatgcggggtggtctgccaccccgtgagggcagaggcatgccaccaccactccgtggaggtccaggaggcccaggaggtcctgggggacccatgggtcgcatgggaggccgtggaggagatagaggaggcttccctccaagaggaccccggggttcccgagggaacccctctggaggaggaaacgtccagcaccgagctggagactggcagtgtcccaatccgggttgtggaaaccagaacttcgcctggagaacagagtgcaaccagtgtaaggccccaaagcctgaaggcttcctcccgccaccctttccgcccccgggtggtgatcgtggcagaggtggccctggtggcatgcggggaggaagaggtggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaatnttattcctattntatngtggcccacttttatattctggtctgtcttagtatttcccttgtgaggcacttaaccgttctggacaccc

SEQ ID NO: 356934 - DNA, 2154 bp, Homo sapiens
tggcgaattcggcacgagggggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatgggcagcgctggagagcgaggtggcttcaataagcctggtggacccatggatgaaggaccagatcttgatctaggcccacctgtagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctggacaaggaaacaggaaagcccaaaggcgatgccacagtgtcctatgaagacccacccactgccaaggctgccgtggaatggtttgatgggaaagattttcaagggagcaaacttaaagtctcccttgctcggaagaagcctccaatgaacagtatgcggggtggtctgccaccccgtgagggcagaggcatgccaccaccactccgtggaggtccaggaggcccaggaggtcctgggggacccatgggtcgcatgggaggccgtggaggagatagaggaggcttccctccaagaggaccccggggttcccgagggaacccctctggaggaggaaacgtccagcaccgagctggagactggcagtgtcccaatccgggttgtggaaaccagaacttcgcctggagaacagagtgcaaccagtgtggtgatcgtggcagaggtggccctggtggcatgcggggaggaagaggtggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggta

SEQ ID NO: 356935 - DNA, 2193 bp, Homo sapiens
tggcgaattcggcacgagggggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatgggcagcgctggagagcgaggtggcttcaataagcctggtggacccatggatgaaggaccagatcttgatctaggcccacctgtagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctggacaaggaaacaggaaagcccaaaggcgatgccacagtgtcctatgaagacccacccactgccaaggctgccgtggaatggtttgatgggaaagattttcaagggagcaaacttaaagtctcccttgctcggaagaagcctccaatgaacagtatgcggggtggtctgccaccccgtgagggcagaggcatgccaccaccactccgtggaggtccaggaggcccaggaggtcctgggggacccatgggtcgcatgggaggccgtggaggagatagaggaggcttccctccaagaggaccccggggttcccgagggaacccctctggaggaggaaacgtccagcaccgagctggagactggcagtgtcccaatccttcaattggtgatttctgctgtgatgtaattgtatgcaggggttgtggaaaccagaacttcgcctggagaacagagtgcaaccagtgtggtgatcgtggcagaggtggccctggtggcatgcggggaggaagaggtggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggta

SEQ ID NO: 356936 - DNA, 2204 bp, Homo sapiens
  misc_feature (1642)..(1642): n is a, c, g, or t
  misc_feature (1647)..(1647): n is a, c, g, or t
  misc_feature (1652)..(1652): n is a, c, g, or t
  misc_feature (1655)..(1656): n is a, c, g, or t
  misc_feature (1658)..(1659): n is a, c, g, or t
  misc_feature (1661)..(1663): n is a, c, g, or t
  misc_feature (1666)..(1666): n is a, c, g, or t
tggcgaattcggcacgagggggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatgggcagcgctggagagcgaggtggcttcaataagcctggtggacccatggatgaaggaccagatcttgatctaggcccacctgtagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctggacaaggaaacaggaaagcccaaaggcgatgccacagtgtcctatgaagacccacccactgccaaggctgccgtggaatggtttgatgggaaagattttcaagggagcaaacttaaagtctcccttgctcggaagaagcctccaatgaacagtatgcggggtggtctgccaccccgtgagggcagaggcatgccaccaccactccgtggaggtccaggaggcccaggaggtcctgggggacccatgggtcgcatgggaggccgtggaggagatagaggaggcttccctccaagaggaccccggggttcccgagggaacccctctggaggaggaaacgtccagcaccgagctggagactggcagtgtcccaatccggnttggnaaacnagnncnncnnntgnagaacagagtgcaaccagtgtaaggccccaaagcctgaaggcttcctcccgccaccctttccgcccccgggtggtgatcgtggcagaggtggccctggtggcatgcggggaggaagaggtggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggta

SEQ ID NO: 356937 - DNA, 2133 bp, Homo sapiens
tggcgaattcggcacgagggggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatgggcagcgctggagagcgaggtggcttcaataagcctggtggacccatggatgaaggaccagatcttgatctaggcccacctgtagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctggacaaggaaacaggaaagcccaaaggcgatgccacagtgtcctatgaagacccacccactgccaaggctgccgtggaatggtttgatgggaaagattttcaagggagcaaacttaaagtctcccttgctcggaagaagcctccaatgaacagtatgcggggtggtctgccaccccgtgagggcagaggcatgccaccaccactccgtggaggtccaggaggcccaggaggtcctgggggacccatgggtcgcatgggaggccgtggaggagatagaggaggcttccctccaagaggaccccggggttcccgagggaacccctctggaggaggaaacgtccagcaccgagctggagactggcagtgtcccaatccgggttgtggaaaccagaacttcgcctggggtgatcgtggcagaggtggccctggtggcatgcggggaggaagaggtggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggta

SEQ ID NO: 356938 - DNA, 2809 bp, Homo sapiens
tggcgaattcggcacgagggggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatgggcagcgctggagagcgaggtggcttcaataagcctggtggacccatggatgaaggaccagatcttgatctaggcccacctgtagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctggacaaggaaacaggaaagcccaaaggcgatgccacagtgtcctatgaagacccacccactgccaaggctgccgtggaatggtttgatgggaaagattttcaagggagcaaacttaaagtctcccttgctcggaagaagcctccaatgaacagtatgcggggtggtctgccaccccgtgagggcagaggcatgccaccaccactccgtggaggtccaggaggcccaggaggtcctgggggacccatgggtcgcatgggaggccgtggaggagatagaggaggcttccctccaagaggaccccggggttcccgagggaacccctctggaggaggaaacgtccagcaccgagctggagactggcagtgtcccaatccgtatgtacttgtcttggcaaattgataccctacgagtgaagccacccttccctcaccccatccccactctagagtggattgctctgtctagaggaacagaatgatgaccctgatggctggttagggacactagtcagccattcactggacgcttcagagccttctgaagattgatttgacctgtcctgtgggtgcaatgctgcctgaggctgtgccctaaagcatgggtgtacatagatcctcttgatagtgagtgtgtacctgttcacacaccacctttccttgtttatcttccttagttcaattggtgatttctgctgtgatgtaattgtatgcaggggttgtggaaaccagaacttcgcctggagaacagagtgcaaccagtgtaaggccccaaagcctgaaggcttcctcccgccaccctttccgcccccgggtaggtgcaggtttcatgagtgtcccctcagcttcctggtgctaaacctcttttcttatttgtgggcttggtaaactgcagttgccctctgcttaacaactttgagttgtcgtgtcctcatttctaaattgtcagcccgatgccgagattgagtgaagtgtctggtttgttctgctgtgagagaaggaagcagagcagcttccacagtgtccacagggcctctgcagccacccactgactgctttcgccctgctattctcaccttaggggtgatcgtggcagaggtggccctggtggcatgcggggaggaagaggtggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggta

SEQ ID NO: 356939 - DNA, 2653 bp, Homo sapiens
tggcgaattcggcacgagggggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatgggcagcgctggagagcgaggtggcttcaataagcctggtggacccatggatgaaggaccagatcttgatctaggcccacctgtagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctggacaaggaaacaggaaagcccaaaggcgatgccacagtgtcctatgaagacccacccactgccaaggctgccgtggaatggtttgatgggaaagattttcaagggagcaaacttaaagtctcccttgctcggaagaagcctccaatgaacagtatgcggggtggtctgccaccccgtgagggcagaggcatgccaccaccactccgtggaggtccaggaggcccaggaggtcctgggggacccatgggtcgcatgggaggccgtggaggagatagaggaggcttccctccaagaggaccccggggttcccgagggaacccctctggaggaggaaacgtccagcaccgagctggagactggcagtgtcccaatccgggttgtggaaaccagaacttcgcctggagaacagagtgcaaccagtgtaaggccccaaagcctgaaggcttcctcccgccaccctttccgcccccgggtaggtgcaggtttcatgagtgtcccctcagcttcctggtgctaaacctcttttcttatttgtgggcttggtaaactgcagttgccctctgcttaacaactttgagttgtcgtgtcctcatttctaaattgtcagcccgatgccgagattgagtgaagtgtctggtttgttctgctgtgagagaaggaagcagagcagcttccacagtgtccacagggcctctgcagccacccactgactgctttcgccctgctattctcaccttaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacactatgggcaaccgaggtggctttggtggaggaagacgaggtggccctggggggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggta

SEQ ID NO: 356940 - DNA, 1976 bp, Homo sapiens
tggcgaattcggcacgagggggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatgggcagcgctggagagcgaggtggcttcaataagcctggtggacccatggatgaaggaccagatcttgatctaggcccacctgtagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctggacaaggaaacaggaaagcccaaaggcgatgccacagtgtcctatgaagacccacccactgccaaggctgccgtggaatggtttgatgggaaagattttcaagggagcaaacttaaagtctcccttgctcggaagaagcctccaatgaacagtatgcggggtggtctgccaccccgtgagggcagaggcatgccaccaccactccgtggaggtccaggaggcccaggaggtcctgggggacccatgggtcgcatgggaggccgtggaggagatagaggaggcttccctccaagaggaccccggggttcccgagggaacccctctggaggaggaaacgtccagcaccgagctggagactggcagtgtcccaatccgggttgtggaaaccagaacttcgcctggagaacagagtgcaaccagtgtggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggta

SEQ ID NO: 356941 - DNA, 3366 bp, Homo sapiens
tggcgaattcggcacgagggggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatgggtgtggcatccagtgcccctcccctgactggcaagcgaggccggggccgcccaaggaaggccaacctgctggactcaatgtttgggtccccagggggcctgagggaggcaggcatccttccatgcggtctatgtggtaaggtgttcactgatgccaaccggctccggcagcacgaggcccagcacggtgtcaccagcctccagctgggctacatcgaccttcctcctccgaggctgggtgagaatgggctacccatctctgaagaccccgacggcccccgaaagaggagccggaccaggaagcaggtggcttgtgagatctgcggcaagatcttccgtgatgtgtatcatcttaaccggcacaagctgtcccactctggggagaagccctactcctgccctgtgtgtgggttgcggttcaagagaaaagaccgcatgtcctaccatgtgcggtcccatgatgggtccgtgggcaagccttacatctgccagagctgtgggaaaggcttctccaggcctgatcacttgaacggacatatcaagcaggtgcacacttctgagcggcctcacaagtgtcagacctgcaatgcttcttttgccacccgagaccgtctgcgctcccacctggcctgtcatgaagacaaggtgccctgccaggtgtgtgggaagtacttgcgggcagcatacatggcagaccacctgaagaagcacagcgaggggcccagcaacttctgcagtatctgtaaccgaggtctccaggcaccaggagcccatcctgaatgggggagcagcgttccactgcgccaggacctatggcaacaaagaaggccagaaatgctcacatcaggatccgattgagagctctgactcctatggtgacctctcagatgccagcgacctgaagacgccagagaagcagagtgccaatggctctttctcctgcgacatggcagtccccaaaaacaaaatggagtctgatggggagaagaagtacccatgccctgaatgtgggagcttcttccgctctaagtcctacttgaacaaacacatccagaaggtgcatgtccgggctctcgggggccccctgggggacctgggccctgcccttggctcacctttctctcctcagcagaacatgtctctcctcgagtcctttgggtttcagattgttcagtcggcatttgcgtcatctttagtagatcctgaggttgaccagcagcccatggggcctgaagggaaatgaggcagctgctgtgtccccacggaaacaaccatctggggactgctgggaaatgctgtgaatgcggagggaagtgatgtttgggttctgtagctgagagatttttattcatttttaactgccccccaaccccactccaactccttctccaccacccattctcccaatggtctttagaaatagattttcatctgatattctgcagaaatatcaatgagacttggtatgggacaggggcagaaaacactacataggcctccaaggcaaaaccagtcccagtttctttaatgggaagaagctggaattcctggtgctcaattcttagtgaccccaatcctatacccaaatctatgatattctgggacctcagtgattttggtcccctcccacttctctagttcgtcatcctcccttcccatatccttcaaaagaaccacactagggtctccacctacttatacaatgcggatgcccaactgtttttaaggaagccagaagcatcccatggaccatggggtgagtgtcctccaagagccccctgagctcagccctctgcctggagggctccagacctttctgagccctgcttggaggcgagcattttcactgctaggacaagctcagctgttgaggacacccccaccccaaatttcagttcttacgtgattttaaccattcaacatgctgttgggttttaattctctaattattattattattgttattattttttaggaccagttgtagtgaattgctactgaaagctatcccaggtgatacagagctctttgtaaaccgcagtcacacattagggttagtattaaactttgtttagatgtaccataattaacttggctagttgattgtttgaagtctatggaagaaatagttttatgcaaaattttaaaaaatgccagtctggtcagggaagtagggggtttcaatgctgttgggaaccaggaaggtgggacagccggcaggtagggacattgtgtacctcagttgtgtcacatgtgagcaagcccaggttgaccttgtgatgtgaattgatctgatcagactgtattaaaaatgttagtacattactctatctgc

SEQ ID NO: 356942 - DNA, 2049 bp, Homo sapiens
tggcgaattcggcacgagggggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatgggcagcgctggagagcgaggtggcttcaataagcctggtggacccatggatgaaggaccagatcttgatctaggcccacctgtagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctggacaaggaaacaggaaagcccaaaggcgatgccacagtgtcctatgaagacccacccactgccaaggctgccgtggaatggtttgatgggaaagattttcaagggagcaaacttaaagtctcccttgctcggaagaagcctccaatgaacagtatgcggggtggtctgccaccccgtgagggcagaggcatgccaccaccactccgtggaggtccaggaggcccaggaggtcctgggggacccatgggtcgcatgggaggccgtggaggagatagaggaggcttccctccaagaggaccccggggttcccgagggaacccctctggaggaggaaacgtccagcaccgagctggagactggcagtgtcccaatccttcaattggtgatttctgctgtgatgtaattgtatgcaggggttgtggaaaccagaacttcgcctggagaacagagtgcaaccagtgtggtgatcgtggcagaggtggccctggtggcatgcggggaggaagaggtggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggttcgaatatcatgtctagtttattatagttgtcactgcttgttacactctcctcttgcggattcgccgtgcttgctctcttttattcttgttctcttttccctcgcccttctc

SEQ ID NO: 356943 - DNA, 1553 bp, Homo sapiens
tggcgaattcggcacgagggggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatgggcagcgctggagagcgaggtggcttcaataagcctggtggacccatggatgaaggaccagatcttgatctaggcccacctgtagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctgggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggta

SEQ ID NO: 356944 - DNA, 2302 bp, Homo sapiens
tggcgaattcggcacgagggggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatgggtgtggcatccagtgcccctcccctgactggcaagcgaggccggggccgcccaaggaaggccaacctgctggactcaatgtttgggtccccagggggcctgagggaggcaggcatccttccatgcggtctatgtggtaaggtgttcactgatgccaaccggctccggcagcacgaggcccagcacggtgtcaccagcctccagctgggctacatcgaccttcctcctccgaggctgggtgagaatgggctacccatctctgaagaccccgacggcccccgaaagaggagccggaccaggaagcaggtggcttgtgagatctgcggcaagatcttccgtgatgtgtatcatcttaaccggcacaagctgtcccactctggggagaagccctactcctgccctgtgtgtgggttgcggttcaagagaaaagaccgcatgtcctaccatgtgcggtcccatgatgggtccgtgggcaagccttacatctgccagagctgtgggaaaggcttctccaggcctgatcacttgaacggacatatcaagcaggtgcacacttctgagcggcctcacaagtgtcaggtgtgggttgggagcagcagcggcctgccgcccctggaacctcttcctagcgacctgccatcatgggactttgcccagcctgctttgtggaggtcgtcccattcggttcctgacaccgccttttccctttctctaaaaaaatcattcccagcccttgaaaacctgggcccagcacactccagcaacactctcttctgcccagccccgccgggatatctgaggcagggctggaccaccccagagggcagcagggcctttacccagtggcctgttggctagcctgggcctcccctggcatcacttcccataggcctggggtttctagactggggcctggccacccctttccccactccacgagtgagtcggcctccagagaagactggcacaattccaactagagtcaacccatgctgccctctgcccttcccactcagatctagatcctgctttcatttctggctagtgaagtagacttttgtgtttttgaggtttattagcaggtctgctcaggaaccaaactaatgagtagctttatattgggccaccccaatatatggctttgggggctgaaaaagcagatgtagaccccctccctcggatccttattggtgtgccctttagcactccgcagactctgcggggtgaacaggagtgatgataaaatttttcattctaacatattgaggctt

SEQ ID NO: 356945 - DNA, 2247 bp, Homo sapiens
tggcgaattcggcacgagggggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatgggtgtggcatccagtgcccctcccctgactggcaagcgaggccggggccgcccaaggaaggccaacctgctggactcaatgtttgggtccccagggggcctgagggaggcaggcatccttccatgcggtctatgtggtaaggtgttcactgatgccaaccggctccggcagcacgaggcccagcacggtgtcaccagcctccagctgggctacatcgaccttcctcctccgaggctgggtgagaatgggctacccatctctgaagaccccgacggcccccgaaagaggagccggaccaggaagcaggtggcttgtgagatctgcggcaagatcttccgtgatgtgtatcatcttaaccggcacaagctgtcccactctggggagaagccctactcctgccctgtgtgtgggttgcggttcaagagaaaagaccgcatgtcctaccatgtgcggtcccatgatgggtccgtgggcaagccttacatctgccagagctgtgggaaaggcttctccaggcctgatcacttgaacggacatatcaagcaggtgcacacttctgagcggcctcacaagtgtcagacctgcaatgcttcttttgccacccgagaccgtctgcgctcccacctggcctgtcatgaagacaaggtgccctgccaggtgtgtgggaagtacttgcgggcagcatacatggcagaccacctgaagaagcacagcgaggggcccagcaacttctgcagtatctgtaaccgaggtaatctgcccactgtttcctcacttccagaggatgggcctgagcgtgtatgggaggcctaggggtgtctcaatcaccctgcctcagactccactctttgcacagccaccccctacttcccactgaatgataaacaccttcatcacccaactagctatttgctacctcttccttcccaagaagcttggggtgcttagaatgggaagtcccaggagaccagcaggtcaaaacagaaggagagaggttcttcccaagcttgggcccataactctcacctgctactcagatggcaggatggatgcattttgcagacaccactgaaccactgaggttggtgggggagttagtaggtcccaaagtgagagaaaaagaggttggtccggcttgagagcttttgctggttgattcactggcatatgaaattcagcagccagggaaggaggttgagtctgaaggcagtctgga

SEQ ID NO: 356946 - DNA, 1938 bp, Homo sapiens
tggcgaattcggcacgagggggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatggggtaagagcaaaccttttctccttttacctaattttgtttcatccataggattttcagtggaaagaagggactgaaagacataagaaattaatttctgcatttccatggacaatctgttgagctcaagccatcttctaaaacatggaaatgtcatctttgtggcatatattaagtggcagtttattttctttccctgccagtatacttcgttgggtcggggagaacaaagaatggttttgaaaccagagctttcagttcccttcatggtttccagaggtgagaagcctctgtgggtagtagatttgggatggaacacacacaacccttctcccatccccttttccctatctggtgtctgtactttgatgaaggtgagctataatattggtggttaacataatccagaaggcttagttctgtgtgtgttctgtccctatataaactggtaaagaaaaaaaaaagttatgcagaatgttagatatttacatttgatacggtgtgccactattcaaggaaaaattaaatagcattttttaaaaaacagaatgaacttcaaaattaaagttgatttttaacttccatattagcaaatactcttcactactgaaagacagtactattttgcatattctgcataactttaagaaagtctttagtgaaatctttattggaagaaagtcatttgacaacaggcaaaaatttaatgattcggtatgaagtaaaatcaatcttctgatttggaaaatactctattataaaggtttcacttctttttggatgttttaaaatagacatagacacttgaaagtactatcatcacgtctcaaatcacctagaattcctagtatttttaaattgcaaatacaatttcaagtttatttaaatactccagaagttataatcct

SEQ ID NO: 356947 - DNA, 2040 bp, Homo sapiens
tggcgaattcggcacgagggggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagcagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatgggcagcgctggagagcgaggtggcttcaataagcctggtggacccatggatgaaggaccagatcttgatctaggcccacctgtagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctggacaaggaaacaggaaagcccaaaggcgatgccacagtgtcctatgaagacccacccactgccaaggctgccgtggaatggtttgatgggaaagattttcaagggagcaaacttaaagtctcccttgctcggaagaagcctccaatgaacagtatgcggggtggtctgccaccccgtgagggcagaggcatgccaccaccactccgtggaggtccaggaggcccaggaggtcctgggggacccatgggtcgcatgggaggccgtggaggagatagaggaggcttccctccaagaggaccccggggttcccgagggaacccctctggaggaggaaacgtccagcaccgagctggagactggcagtgtcccaatccgggttgtggaaaccagaacttcgcctggagaacagagtgcaaccagtgtaaggccccaaagcctgaaggcttcctcccgccaccctttccgcccccgggtggtgatcgtggcagaggtggccctggtggcatgcggggaggaagaggtggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggta

SEQ ID NO: 356948 - DNA, 1491 bp, Homo sapiens
  misc_feature (966)..(966): n is a, c, g, or t
  misc_feature (969)..(969): n is a, c, g, or t
  misc_feature (981)..(981): n is a, c, g, or t
  misc_feature (987)..(987): n is a, c, g, or t
  misc_feature (1002)..(1002): n is a, c, g, or t
  misc_feature (1005)..(1005): n is a, c, g, or t
  misc_feature (1008)..(1008): n is a, c, g, or t
  misc_feature (1015)..(1015): n is a, c, g, or t
  misc_feature (1021)..(1021): n is a, c, g, or t
  misc_feature (1029)..(1029): n is a, c, g, or t
  misc_feature (1041)..(1041): n is a, c, g, or t
  misc_feature (1044)..(1044): n is a, c, g, or t
  misc_feature (1062)..(1062): n is a, c, g, or t
  misc_feature (1071)..(1071): n is a, c, g, or t
  misc_feature (1077)..(1077): n is a, c, g, or t
  misc_feature (1087)..(1087): n is a, c, g, or t
  misc_feature (1098)..(1099): n is a, c, g, or t
  misc_feature (1107)..(1107): n is a, c, g, or t
  misc_feature (1113)..(1113): n is a, c, g, or t
  misc_feature (1125)..(1125): n is a, c, g, or t
  misc_feature (1131)..(1131): n is a, c, g, or t
  misc_feature (1137)..(1137): n is a, c, g, or t
  misc_feature (1143)..(1143): n is a, c, g, or t
  misc_feature (1155)..(1155): n is a, c, g, or t
  misc_feature (1164)..(1164): n is a, c, g, or t
  misc_feature (1167)..(1167): n is a, c, g, or t
  misc_feature (1173)..(1173): n is a, c, g, or t
  misc_feature (1182)..(1182): n is a, c, g, or t
  misc_feature (1185)..(1185): n is a, c, g, or t
  misc_feature (1188)..(1188): n is a, c, g, or t
  misc_feature (1191)..(1191): n is a, c, g, or t
  misc_feature (1194)..(1195): n is a, c, g, or t
  misc_feature (1197)..(1197): n is a, c, g, or t
  misc_feature (1200)..(1200): n is a, c, g, or t
  misc_feature (1203)..(1203): n is a, c, g, or t
  misc_feature (1209)..(1209): n is a, c, g, or t
  misc_feature (1212)..(1212): n is a, c, g, or t
  misc_feature (1224)..(1224): n is a, c, g, or t
  misc_feature (1227)..(1227): n is a, c, g, or t
  misc_feature (1236)..(1236): n is a, c, g, or t
  misc_feature (1239)..(1239): n is a, c, g, or t
  misc_feature (1245)..(1245): n is a, c, g, or t
  misc_feature (1248)..(1248): n is a, c, g, or t
  misc_feature (1251)..(1252): n is a, c, g, or t
  misc_feature (1254)..(1254): n is a, c, g, or t
  misc_feature (1260)..(1260): n is a, c, g, or t
  misc_feature (1263)..(1264): n is a, c, g, or t
  misc_feature (1278)..(1278): n is a, c, g, or t
  misc_feature (1281)..(1281): n is a, c, g, or t
  misc_feature (1285)..(1285): n is a, c, g, or t
  misc_feature (1288)..(1288): n is a, c, g, or t
  misc_feature (1290)..(1290): n is a, c, g, or t
  misc_feature (1297)..(1299): n is a, c, g, or t
  misc_feature (1305)..(1305): n is a, c, g, or t
  misc_feature (1308)..(1308): n is a, c, g, or t
  misc_feature (1316)..(1317): n is a, c, g, or t
  misc_feature (1324)..(1324): n is a, c, g, or t
tggcgaattcggcacgagggggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagtcctccccttggaggggcacaaacgatcagtaagaatacagagcaacggccccagccagatccgtatcagatcctgggcccgaccagcagtcgcctagccaaccctggagagnggncagatccagctntggcanttcctcctggagctnctntcngacagcnccaacnccagctgnatcacctggganggnaccaacggggagttcaanatgacggancccgangaggtggccnggcgctggggnnagcggaanagcaancccaacatgaantacganaagctnagccgngccctccgttantactatganaanaacatnatgaccaangtncanggnaanngntangcntacaanttngacttccacggnatngcccaggcnctncagccncanccnncngagtcntcnntgtacaagtacccntcngacntcncntacatgnnntcctancangcccaccnncagaagntgaactttgtccctccccatccatcctccatgcctgtcacttcctccagcttctttggagccgcatcacaatactggacctcccccacggggggaatctaccccaaccccaacgtcccccgccatcctaacacccacgtgccttcacacttaggcagctactactag

SEQ ID NO: 356949 - DNA, 1062 bp, Homo sapiens
tggcgaattcggcacgagggggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagtgagaaaccataccagtgtgacttcaaggactgtgaacgaaggttttctcgttcagaccagctcaaaagacaccaaaggagacatacaggtgtgaaaccattccagtgtaaaacttgtcagcgaaagttctcccggtccgaccacctgaagacccacaccaggactcatacaggtaaaacaagtgaaaagcccttcagctgtcggtggc

SEQ ID NO: 356950 - DNA, 1127 bp, Homo sapiens
tggcgaattcggcacgagggggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcaccgagctggagactggcagtgtcccaatccttcaattggtgatttctgctgtgatgtaattgtatgcaggggttgtggaaaccagaacttcgcctgggagaaccagagtgcaaaccagtgggtgatcgtggcagaggtggccctggtggcatgcggggaggaagaggtggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggta

SEQ ID NO: 356951 - DNA, 355 bp, Homo sapiens
gcacatctccacgagagggtagtatgctgctgtacaaaagaatgagaaagttctctatatactaatgcagaaaggtctccaagatatgttgagaagtgaaaaaaacaaggtgaaaaaatgttatttgtgtaaaaaagggtacgacaagaatatatatatataatctacattttcttatatatgcatacagaatctggaaggacacacaagcaacaaataaatatcattacccgtgggaggtgggaaggttggcaagttggtgatgggaacagcagtgagaaagactccacagtgctttttaaaatatcatgtgatatgttactattaaaaaataaaattaaaacaaacaaactgc

SEQ ID NO: 356952 - DNA, 684 bp, Homo sapiens
cagtaggtacccgacactgaaactgagaggagaatgcatgaagtgaaatcatctgtttatcatcatcaaagagtttggaccacagacaactagggactcttctgcctcagttactgacaagccaaacacctgaaacactgagatcaaaccaacttgtttcttaacttctttaacttaggcccacatcttaatccacagaaaaaggaggaggagaagttactcaagaatttccacaaatagccatgatggagtaacagagattagatttgttgtcccagtttatactaccagaaaactggataaaacagatgaaacaatggcttttagatattagataccagtcagagcaggagtgggattcctgagaaaagatgaaaaaatgatgtgagtcctacatttgcctgacctcacacccttgaagcaatttacaggatgtagtgtaaagaagggagatggggcttaaacagaaccttacagtctcaaagagttgaggtcacaaagattgacacttagtggggccaaggcagccagaatttgtggactagcctaacagaaagaaactacatacagagacagtgccttggagacatgcaaaggagttcccacaagctgttaggagagtgctgatatgtcctgtgtggaaggaaaccacctgaggttggagaaaggactagcaaacaaaaa

SEQ ID NO: 356953 - DNA, 269 bp, Homo sapiens
attttttcaagaaatggttctggaataaataggtacccatgttgaaaaacaaatgaatctcaactcttacaccatctaaaacaacttgaagtagatcattaactgaatataagagctaaaatgtacagaaaaaatgtagaatattttagtgactttgggttaggcaaagatttttaaaatagggcacaaaaagcaccaactataaaaataaaaattcaataaattggacctcatcaaaatttacatttgctcttcaaaaggcactatga

SEQ ID NO: 356954 - DNA, 852 bp, Homo sapiens
tgcacacggcgagtctgggcgactgcgcacgcgcggctggttataaacaacttgtgaaatgagtgatttggaagatgatgagacaccccagctttctgcccatgccttagcagctctccaggaattttatgctgagcaaaagcaacaaattgagccaggcgaggatgataaatataacattggaataatagaagagaattggcaactgagccagttttggtatagtcaggaaactgctctgcagctggcacaggaggcaattgcagctgtaggagaaggtggcagaatcgcatgtgtgagtgcccctagtgtttaccagaaactcagagagctgtgcagagaaaacttttcgatatacatctttgaatatgacaaaagatttgccatgtatggagaggagtttattttctatgattacaataatccattggacttacccgaaagaattgctgcacatagttttgacatcgtaatagcagatcctccctatctttcggaggaatgtctcagaaaaacatcggaaaccgtcaagtacctgacgcggggcaagattctgctgtgcacaggtgccatcatggaagaacaggcagcagaactccttggagtgaagatgtgcacgtttgttccaagacacacccggaacttggcaaatgagtttcgctgttatgtgaattatgattctgggctggactgtgggatctgattacagacggtgacataacacaggaaggaaccctgtcacattcctctttttgtattttcgtagtagatttaaaagttataatctcttcccctccccccaaactggagctgtccctggcctggttttcaaaataaagtgtgcgatcttca

SEQ ID NO: 356955 - DNA, 840 bp, Homo sapiens
aacgaacacgacatgatgactgggagcaaccgcacttaagacgcgcgatcacacagtaaacccagggcgaagggagccacatgtcagacaggaaggccttccttataggggttgtggttacatggggcgtacatcacaacgtcgcactgcacacgtacgacctgcatttcattgtaagcattacctcctttttaaagttaatttaaaaacaggataaatagaattctggaaagcaagaaggaaggaactgtttgaggcagggggactcaaagatgaaaacagaatgaaaacctttggcccttttctggacgtaaattggattaaggggagaatcatccagcaatttataaaaagtatttggagaatatctaggccttacccattcatagagggagccttgctctcctgcggtttactggagtctgggatggctcctaggttaatgctctttgctctgaatcacactatcttaacctaatttcacacaagaatgaatgttgaaattacagtatggtggttttgccctaagtaaatttgataacatggaaattgagtaattttatccaaaaagagactaaccacagcccctgagaagccagctaatccctgcttatgctgcaagctaacgtgtccgcccctttgctcatgctgttccatctttctgaagtcttcactcttcatccttaccttttcctgaggccgagttgaagctccacctgctctttcactcctctccccactcaggccctccactctgatcccatggcgtgaatggtgcttctctatagagggcctccaccttaccgttggtgttcgccatgtgtctgcctaacctagaat

SEQ ID NO: 356956 - DNA, 335 bp, Homo sapiens
tggcaaaagggagtggcaatacattcgcacctgtgtttgcaagattggatattactgaaaaaggctcttggctcaacgttgggaaatgtagtttttagtaattatttttgctttccatatgtgtgtatatatatatagtacgtgtgtgtgtgtgtgtgtgtataatctgcttctaaatttctaagtgtctcggctttgcagaggtaggaaaataattcattcaataaaaaagacatggaaaaaagttggtaaattgcaaaaatattggagaaggtgaaagggaatgtaaagaacactcgctccctccccccacttgtgaattgtcaactaattgc

SEQ ID NO: 356957 - DNA, 832 bp, Homo sapiens
tgcacacggcgagtctgggcgactgcgcacgcgcggctgggagtggcgggttcgggcgcagctgtagggttggctgcgcgccgccgaggcgttttggactgggttataaacaacttgtgaaatgagtgatttggaagatgatgagacaccccagctttctgcccatgccttagcagctctccaggaattttatgctgagcaaaagcaacaaattgagccaggcgaggatgataaatataacattggaataatagaagagaattggaatcgcatgtgtgagtgcccctagtgtttaccagaaactcagagagctgtgcagagaaaacttttcgatatacatctttgaatatgacaaaagatttgccatgtatggagaggagtttattttctatgattacaataatccattggacttacccgaaagaattgctgcacatagttttgacatcgtaatagcagatcctccctatctttcggaggaatgtctcagaaaaacatcggaaaccgtcaagtacctgacgcggggcaagattctgctgtgcacaggtgccatcatggaagaacaggcagcagaactccttggagtgaagatgtgcacgtttgttccaagacacacccggaacttggcaaatgagtttcgctgttatgtgaattatgattctgggctggactgtgggatctgattacagacggtgacataacacaggaaggaaccctgtcacattcctctttttgtattttcgtagtagatttaaaagttataatctcttcccctccccccaaactggagctgtccctggcctggttttcaaaataaagtgtgcgatcttca

SEQ ID NO: 356958 - DNA, 1000 bp, Homo sapiens
tgcacacggcgagtctgggcgactgcgcacgcgcggctgggagtggcgggttcgggcgcagctgtagggttggctgcgcgccgccgaggcgttttggactgggttataaacaacttgtgaaatgagtgatttggaagatgatgagacaccccagctttctgcccatgccttagcagctctccaggaattttatgctgagcaaaagcaacaaattgagccaggcgaggatgataaatataacattggaataatagaagagaattgggtgccatcatggaagaacaggcagcagaactccttggagtgaagatgtgcacgtttgttccaagacacacccggaacttggcaaatgagtttcgctgttatgtgaattatgattctgggctggactgtgggatctgattacagacggtgacataacacaggaaggaaccctgtcacattcctctttttgtattttcgtagtagatttaaaagttataatctcttcccctccccccaaactggagctgtccctggcctggttttcaaaataaagtgtgcgatcttcacattattgtttccttagggagggcgtccctagagctcagtcttctgccaacctgaatccatggaattcgagttggaagaaaccttagaatctgcctgatcttctctcctcatttaacatgtgtaaaaacagaagaacagttgtgtggcttgcccaagggctcctgaatgagacaggaccttggcctctgcctcgggccagagcagtctggtagcatcctagggcttgtgaggaaccccacccccatgtcccaccccagccctccaaggagacagacttgcctccatgcaaaaaggcaataatccagtaactagcgtctgaatgcctcttagagctctcctcctcctccaggttctaggtgggctgcgagggatgacaggtgcccaggtgccctccctgcgtggctcagactcagcaccctccctctgaactgcctgagaaaatgaaaga

SEQ ID NO: 356959 - DNA, 962 bp, Homo sapiens
tgcacacggcgagtctgggcgactgcgcacgcgcggctggttataaacaacttgtgaaatgagtgatttggaagatgatgagacaccccagctttctgcccatgccttagcagctctccaggaattttatgctgagcaaaagcaacaaattgagccaggcgaggatgataaatataacattggaataatagaagagaattgggtaagtaaatgcatttcacagccatcaggaagtattgatgtggaacctactctgtgcattagtccagtgtttgtctgtctcacctaaaaccggaatctctgtcacctgtcatttgggatctgaacttctctatggggagctaagacagaaagcagtcagtgaacattttagaacagtgtaacagcttttcttgaacagctgttcttgattctgactatcaggctggttggtgatcagaagatggggtttttcagataaggagataatgatgcaggatttctcctcttggtcactttgcaagccggggaccctcagctggcaacacccctcctgggccttgctcggccacgctggtgtgccccagcttggctgtgttatagctcgtacccacgttcggcggttcccaagttcttctactgcgtccaagaagaatgaggatatgagggacattggagggtgaagagggtggggaagaatgttaatgaatagctgaaaacttcccaagtctagcaagagattaacacatccagatacaggaagcttagagattcccaaacagattaaattcaaaaaagcattcttcatgccacattattgtcaaactgtcagaagtcaaaagtcaaagagagaattctaaaaacagcaagacaaaagtgactagtcacttaaaagggaaacttcatcagactaacagcatattctcagcagaaatcttacatgccaggagggaatggggtgatatattcaaaatattgaaaga

SEQ ID NO: 356960 - DNA, 954 bp, Homo sapiens
tgcacacggcgagtctgggcgactgcgcacgcgcggctgggagtggcgggttcgggcgcagctgtagggttggctgcgcgccgccgaggcgttttggactgggttaggtgccttttgtgtgtttgtttctcaccttttttccagggtggtagtggtggaagagtttaattagcagtggctggcggattcctgagggaaggagctggcgccggcctgagagtggatcctggttgctgtgttaggcgctgttgggcctcgcgtcccggtcgccggaaggcgccgcgtcctgtgccgcgcacgttggcgcccgggccttaggcagccttggtgctgacggggaaattaacccccaggctacggcagcgcgtggaggcctcccttccctccgagtagaaacaggactcggcctgctgtccttttcatctttgccctcagaagttcgctgatggagtttgcgaaatgcccaggcctgactgtccgctcctggagggcgggcacccgcggcgcctgtcgctggggcttctgaggcaggtcccttgcaggatgcgggtgctgcgaggtggagtagactaggacgcgggcggctttactgcgaaacgggcagtagcttcggaggtgcagaagaagtgctgggacgatagcgggtccctaccgggagggagccacatgtcagacaggaaggccttccttataggggttgtggttacatggggcgtacatcacaacgtcgcactgcacacgtacgacctgcatttcattgctggagtgcaatggcgagatctcagctgactgcaacctccatctcctgggttcaagcgattctcctgtctcagcctcctgagtagctggcgctataggtgcctgccaccacacctgggtaatttttgtatttttagtagagacagggtttcaccatgttggccaggctgatcccgaattctttacctaaggtga

SEQ ID NO: 356961 - DNA, 456 bp, Homo sapiens
aaaaaattttttttactgccacttgtggggcagggccagccatagacagtgtgcccagagtagccagaaaaaatttaaaaataataataatataacacagtacttcccagctcttttggatttgaaaaatctcataaacccccttagaaattttaaaaacaataaagatatgataaaatagtgatttaaaaaatagttaaaaataggttcatttaatttaattttttttttttgaaatgtagtctcactcctgtcattcaggctggagtgcaatggcgagatctcagctgactgcaacctccatctcctgggttcaagcgattctcctgtctcagcctcctgagtagctggcgctataggtgcctgccaccacacctgggtaatttttgtatttttagtagagacagggtttcaccatgttggccaggctgatcccgaattctttacctaaggtga

SEQ ID NO: 356962 - DNA, 915 bp, Homo sapiens
tgcacacggcgagtctgggcgactgcgcacgcgcggctgggagtggcgggttcgggcgcagctgtagggttggctgcgcgccgccgaggcgttttggactgggttataaacaacttgtgaaatgagtgatttggaagatgatgagacaccccagctttctgcccatgccttagcagctctccaggaattttatgctgagcaaaagcaacaaattgagccaggcgaggatgataaatataacattggaataatagaagagaattggcaactgagccagttttggtatagtcaggaaactgctctgcagctggcacaggaggcaattgcagctgtaggagaaggtggcagaatcgcatgtgtgagtgcccctagtgtttaccagaaactcagagagctgtgcagagaaaacttttcgatatacatctttgaatatgacaaaagatttgccatgtatggagaggagtttattttctatgattacaataatccattggacttacccgaaagaattgctgcacatagttttgacatcgtaatagcagatcctccctatctttcggaggaatgtctcagaaaaacatcggaaaccgtcaagtacctgacgcggggcaagattctgctgtgcacaggtgccatcatggaagaacaggcagcagaactccttggagtgaagatgtgcacgtttgttccaagacacacccggaacttggcaaatgagtttcgctgttatgtgaattatgattctgggctggactgtgggatctgattacagacggtgacataacacaggaaggaaccctgtcacattcctctttttgtattttcgtagtagatttaaaagttataatctcttcccctccccccaaactggagctgtccctggcctggttttcaaaataaagtgtgcgatcttca

SEQ ID NO: 356963 - DNA, 1364 bp, Homo sapiens
tgcacacggcgagtctgggcgactgcgcacgcgcggctgggagtggcgggttcgggcgcagctgtagggttggctgcgcgccgccgaggcgttttggactgggttataaacaacttgtgaaatgagtgatttggaagatgatgagacaccccagctttctgcccatgccttagcagctctccaggaattttatgctgagcaaaagcaacaaattgagccaggcgaggatgataaatataacattggaataatagaagagaattggcaactgagccagttttggtatagtcaggaaactgctctgcagctggcacaggaggcaattgcagctgtaggagaaggtggcagaatcgcatgtgtgagtgcccctagtgtttaccagaaactcagagagctgtgcagagaaaacttttcgatatacatctttgaatatgacaaaagatttgccatgtatggagaggagtttattttctatgattacaataatccattggacttacccgaaagaattgctgcacatagttttgacatcgtaatagcagatcctccctatctttcggaggaatgtctcagaaaaacatcggaaaccgtcaagtacctgacgcggggcaagattctgctgtgcacaggtgccatcatggaagaacaggcagcagaactccttggagtgaagatgtgcacgtttgttccaagacacacccggaacttggcaaatgagtttcgctgttatgtgaattatgattctgggctggactgtgggatctgattacagacggtgacataacacaggaaggaaccctgtcacattcctctttttgtattttcgtagtagatttaaaagttataatctcttcccctccccccaaactggagctgtccctggcctggttttcaaaataaagtgtgcgatcttcacattattgtttccttagggagggcgtccctagagctcagtcttctgccaacctgaatccatggaattcgagttggaagaaaccttagaatctgcctgatcttctctcctcatttaacatgtgtaaaaacagaagaacagttgtgtggcttgcccaagggctcctgaatgagacaggaccttggcctctgcctcgggccagagcagtctggtagcatcctagggcttgtgaggaaccccacccccatgtcccaccccagccctccaaggagacagacttgcctccatgcaaaaaggcaataatccagtaactagcgtctgaatgcctcttagagctctcctcctcctccaggttctaggtgggctgcgagggatgacaggtgcccaggtgccctccctgcgtggctcagactcagcaccctccctctgaactgcctgagaaaatgaaaga

SEQ ID NO: 356964 - DNA, 465 bp, Homo sapiens
atattcattcttgtttacttcctcattgttcttgctatattaatcttttaattttcagccacttattgctaatgattttgtttaaatttaaaaaatccagttttgttgaactccctttattctaataataatttttatagatttccttatattttctatatagatttcttatcatttgcagataataaaattttttgcccctttagctcaattattgaaactaatttatttttcctctcctatagcattggctaggatcatcaatatactgtaaataatggtaatcttatggttgactttaaagaaaacatttctaacatttttgttgctacatttttatgaggggtaaacagtggttcatattgtacttgaatttaaagttaatttgtttttgcaaaagaaagataatcttagtgaacatctttttaaaaaagtttaactttttcaccttttcttagaaaaaag

SEQ ID NO: 356965 - DNA, 1434 bp, Homo sapiens
agtcacatttcagccactgctctgagaatttgtgagcagcccctaacaggctgttacttcactacaactgacgatatgatcatcttaatttacttatttctcttgctatgggaagacactcaaggatggggattcaaggatggaatttttcataactccatatggcttgaacgagcagccggtgtgtaccacagagaagcacggtctggcaaatacaagctcacctacgcagaagctaaggcggtgtgtgaatttgaaggcggccatctcgcaacttacaagcagctagaggcagccagaaaaattggatttcatgtctgtgctgctggatggatggctaagggcagagttggataccccattgtgaagccagggcccaactgtggatttggaaaaactggcattattgattatggaatccgtctcaataggagtgaaagatgggatgcctattgctacaacccacacgcaaaggagtgtggtggcgtctttacagatccaaagcaaatttttaaatctccaggcttcccaaatgagtacgaagataaccaaatctgctactggcacattagactcaagtatggtcagcgtattcacctgagttttttagattttgaccttgaagatgacccaggttgcttggctgattatgttgaaatatatgacagttacgatgatgtccatggctttgtgggaagatactgtggagatgagcttccagatgacatcatcagtacaggaaatgtcatgaccttgaagtttctaagtgatgcttcagtgacagctggaggtttccaaatcaaatatgttgcaatggatcctgtatccaaatccagtcaaggaaaaaatacaagtactacttctactggaaataaaaactttttagctggaagatttagccacttataaaaaaaaaaaaaggatgatcaaaacacacagtgtttatgttggaatcttttggaactcctttgatctcactgttattattaacatttatttattatttttctaaatgtgaaagcaatacataatttagggaaaattggaaaatataggaaactttaaacgagaaaatgaaacctctcataatcccactgcatagaaataacaagcgttaacattttcatatttttttctttcagtcatttttctatttgtggtatatgtatatatgtacctatatgtatttgcatttgaaattttggaatcctgctctatgtacagttttgtattatactttttaaatcttgaactttataaacattttctgaaatcattgattattctacaaaaacatgattttaaacagctgtaaaatattctatgatatgaatgttttatgcattatttaagcctgtctctattgttggaatttcaggtcattttcataaatattgttgcaataaatatccttgaacacacaaatttgtgcac

SEQ ID NO: 356966 - DNA, 511 bp, Homo sapiens
tcgtgccgaattcggcacgagctcactgttattattaacatttatttatgtattgctttcacatttagaaaaataataaataaatgttaataataacagtgagattaatttagggaaaattggaaaatataggaaactttaaacgagaaaatgaaacctctcataatcccactgcatagaaataacaagcgttaacattttcatatttttttctttcagtcatttttctatttgtggtatatgtatatatgtacctatatgtatttgcatttgaaattttggaatcctgctctatgtacagttttgtattatactttttaaatcttgaactttataaacattttctgaaatcattgattattctacaaaaacatgattttaaacagctgtaaaatattctatgatatgaatgttttatgcattatttaagcctgtctctattgttggaatttcaggtcattttcataaatattgttgcaataaatatccttgaacacacaaatttgtgcac

SEQ ID NO: 356967 - DNA, 417 bp, Homo sapiens
  misc_feature (53)..(54): n is a, c, g, or t
  misc_feature (75)..(75): n is a, c, g, or t
gttgtgaggtccaggagtcataccgctatacaaccaaaacaaacctgaggggnnacaacacccccgttactcggnataaaccggatgttgggactcagacgataccctaaagtatgacactttgggatactgagtactttgagctaaaggagactggaaggcctcagaagcaagatctctgtgaccttctccttccatcttccctcttgccccaagtcttcctcttccaaagcaagtcataaaaaccagaattcaccgggcgcagtggctcactcctgtaatcccatcactttggaaggccgaggcagaggatctcttgagctcaggagttcaaaaccaggctgggcaacatagcaagacctcatctctatgaaaaaaattttaaattaaaaaattaaaaattatctgggcatagtg

SEQ ID NO: 356968 - DNA, 894 bp, Homo sapiens
agtcacatttcagccactgctctgagaatttgtgagcagcccctaacaggctgttacttcactacaactgacgatatgatcatcttaatttacttatttctcttgctatgggaagacactcaaggatggggattcaaggatggaatttttcataactccatatggcttgaacgagcagccggtgtgtaccacagagaagcacggtctggcaaatacaagctcacctacgcagaagctaaggcggtgtgtgaatttgaaggcggccatctcgcaacttacaagcagctagaggcagccagaaaaattggatttcatgtctgtgctgctggatggatggctaagggcagagttggataccccattgtgaagccagggcccaactgtggatttggaaaaactggcattattgattatggaatccgtctcaataggagtgaaagatgggatgcctattgctacaacccacacgcaaaggagtgtggtggcgtctttacagatccaaagcaaatttttaaatctccaggcttcccaaatgagtacgaagataaccaaatctgctactggcacattagactcaagtatggtcagcgtattcacctgagttttttagattttgaccttgaagatgacccaggttgcttggctgattatgttgaaatatatgacagttacgatgatgtccatggctttgtgggaagatactgtggagatgagcttccagatgacatcatcagtacaggtaaggttttaaattgaggaccaaaactatgatttgtttctttacagtgtccctgaaagtaaagggacactgttaaatagtaaatagtagttattattcactttttaaagttgaaagaaccaacaccagatgcagcttgctaggttgtaaaatgc

SEQ ID NO: 356969 - DNA, 1108 bp, Homo sapiens
agtcacatttcagccactgctctgagaatttgtgagcagcccctaacaggctgttacttcactacaactgacgatatgatcatcttaatttacttatttctcttgctatgggaagacactcaaggatggggattcaaggatggaatttttcataactccatatggcttgaacgagcagccggtgtgtaccacagagaagcacggtctggcaaatacaagctcacctacgcagaagctaaggcggtgtgtgaatttgaaggcggccatctcgcaacttacaagcagctagaggcagccagaaaaattggatttcatgtctgtgctgctggatggatggctaagggcagagttggataccccattgtgaagccagggcccaactgtggatttggaaaaactggcattattgattatggaatccgtctcaataggagtgaaagatgggatgcctattgctacaacccacacgcaaaggagtgtggtggcgtctttacagatccaaagcaaatttttaaatctccaggcttcccaaatgagtacgaagataaccaaatctgctactggcacattagactcaagtatggtcagcgtattcacctgagttttttagattttgaccttgaagatgacccaggttgcttggctgattatgttgaaatatatgacagttacgatgatgtccatggctttgtgggaagatactgtggagatgagcttccagatgacatcatcagtacagggagaaaaaaacacagttgttactcggtaatgagggatgttgggactcagacgataccctaaagtatgacactttgggatactgagtactttgagctaaaggagactggaaggcctcagaagcaagatctctgtgaccttctccttccatcttccctcttgccccaagtcttcctcttccaaagcaagtcataaaaaccagaattcaccgggcgcagtggctcactcctgtaatcccatcactttggaaggccgaggcagaggatctcttgagctcaggagttcaaaaccaggctgggcaacatagcaagacctcatctctatgaaaaaaattttaaattaaaaaattaaaaattatctgggcatagtg

SEQ ID NO: 356970 - DNA, 1250 bp, Homo sapiens
agtcacatttcagccactgctctgagaatttgtgagcagcccctaacaggctgttacttcactacaactgacgatatgatcatcttaatttacttatttctcttgctatgggaagacactcaaggatggggattcaaggatggaatttttcataactccatatggcttgaacgagcagccggtgtgtaccacagagaagcacggtctggcaaatacaagctcacctacgcagaagctaaggcggtgtgtgaatttgaaggcggccatctcgcaacttacaagcagctagaggcagccagaaaaattggatttcatgtctgtgctgctggatggatggctaagggcagagttggataccccattgtgaagccagggcccaactgtggatttggaaaaactggcattattgattatggaatccgtctcaataggagtgaaagatgggatgcctattgctacaacccacacgcaaaggagtgtggtggcgtctttacagatccaaagcaaatttttaaatctccaggcttcccaaatgagtacgaagataaccaaatctgctactggcacattagactcaagtatggtcagcgtattcacctgagttttttagattttgaccttgaagatgacccaggttgcttggctgattatgttgaaatatatgacagttacgatgatgtccatggctttgtgggaagatactgtggagatgagcttccagatgacatcatcagtacaggaaatgtcatgaccttgaagtttctaagtgatgcttcagtgacagctggaggtttccaaatcaaatatgttgcaatggatcctgtatccaaatccagtcaaggaaaaaatacaagtactacttctactggaaataaaaactttttagctggaagatttagccacttataaaaaaaaaaaaaggatgatcaaaacacacagtgtttatgttggaatcttttggaactcctttgatctcactgttattattaacatttatttattatttttctaaatgtgaaagcaatacataatttagggaaaattggaaaatataggaaactttaaacgagaaaatgaaacctctcataatcccactgcatagaaataacaagcgttaacattttcatatttttttctttcagtcatttttctatttgtggtatatgtatatatgtaccacaaatagaaaaatgactgaaagaaaaaaatatgacaatgttaacgcttgttatttctatgcagtgtcgagc

SEQ ID NO: 356971 - DNA, 1013 bp, Homo sapiens
agtcacatttcagccactgctctgagaatttgtgagcagcccctaacaggctgttacttcactacaactgacgatatgatcatcttaatttacttatttctcttgctatgggaagacactcaaggatggggattcaaggatggaatttttcataactccatatggcttgaacgagcagccggtgtgtaccacagagaagcacggtctggcaaatacaagctcacctacgcagaagctaaggcggtgtgtgaatttgaaggcggccatctcgcaacttacaagcagctagaggcagccagaaaaattggatttcatgtctgtgctgctggatggatggctaagggcagagttggataccccattgtgaagccagggcccaactgtggatttggaaaaactggcattattgattatggaatccgtctcaataggagtgaaagatgggatgcctattgctacaacccacacgcaaaggagtgtggtggcgtctttacagatccaaagcaaatttttaaatctccaggcttcccaaatgagtacgaagataaccaaatctgctactggcacattagactcaagtatggtcagcgtattcacctgagttttttagattttgaccttgaagatgacccaggttgcttggctgattatgttgaaatatatgacagttacgatgatgtccatggctttgtgggaagatactgtggagatgagcttccagatgacatcatcagtacagaccctcattccagaagagtcctgccccacacccagaaggaaggagtgttacacagagaggccaagaagaatctagacagacaggccttactgggcctccccacttggtctattgccatgagatcacatgatttgtccaatcacatttctacatggccgtctattcttcatcaaacctaaacataaaaatacaattttccttgggtctttgagtcttcatttctgtaggctcccatgtcacataaaattttgattaaataaatttataatgcttt

SEQ ID NO: 356972 - DNA, 762 bp, Homo sapiens
atgccacaggcatgcaataaattcccatttattgacagtctgaccttgctggcaggatggttccaaagttctgttggaagccagctctatatcctcaatctagcaagatgagcagttttccagggcacaccatggtaagggggcccacccaatcctgcccatctgatcccacaggctggcccccggataggtaacttggtggcaactctagtctctcatcatgtacagggggtaaaccagttcatgcgaagatcatgtattaagctgcctaacatatacaaaaacactgctaggtcctgaggaaacagagatgaataaattacagtcttcctctgaggagtttgaaattagcaagggagacagacacataagaagtaaaataacactacagtgagatatgctataaacaaacctgggaggagatgtaagggaaggctttatagagaaggtgacatttgcactgttcaaaaaaaaggataaggccaggtgcagtggctcatgcctgtaatcccagcactttgggaggtcaaggcgggcggatcacgaagtcaggagttcgagaccagcctggccaacatggtgaaaccccatctccactaaaaaatacaaaaattagccgggcatggtggtgcgcacctgtagtcccagctactcgggaggctggggcaggagaatcgcttgaactcggaggtggaggttgcagtgaactgagatcacaccactacactccagcctggttgacagtgagactgtctcaaaaaa

SEQ ID NO: 356973 - DNA, 362 bp, Homo sapiens
aacacagtataatgggctgcattatcttacagtttatggagactgccttgcagacgaggcagggaggcaggaactgtgagatggagagaatgtggtgcaataaaaaggaaattttggagctccccatcccagccttaaaagtacctgaaatgccagctcattatcattttttcaccactactgctgagcttttcaagtgtaaagaatcttatgattcaacatgacgaaaccctgtctctactaaaaatacaaaaatcagctgggtgtggtggcaggtgcctgtagtcccagctactcaggaggctgaaacaggagaatcgcttgaacccaggaggcagaggttgcagtgagcaaggctgcac

SEQ ID NO: 356974 - DNA, 645 bp, Homo sapiens
acaggaacagcacttctggactttatgttctgacgtttatgttgggaccttgaaattaatagtagcacctgatgctgatgctaggtggattttaagccaaacacataatatttttactcaggctggagtgagacagctctacgtacagattgactttgcagccatgtagtgaatggaaagaaattatgcaccttttatggaccaaatttttctggtactgtacgatccaaaacattgtacccagctttttaaaagagagaaattatcactacaactcccgagcactaagtagacggggtagagtcagccgttcatgctttgtggggagttcacagctaagggatcagatttaagaggatatctcctggacttttggtctttttttttgtgctctttcctccaaatctttttgacttctgaggtttttagcttaggatgttaatttgtccttttgtctttctttttttgtttttgttttctgtttgtttgttttcatgttgaatgcccacaccaccatcctctcatcccagccagtaagaatttcagttgtgggcctccagtcttctggaatgtcttcactgcagctgctggaaatcactgctttcattcccacaaaaccagtattacttttttttaaaaaaagaa

SEQ ID NO: 356975 - DNA, 506 bp, Homo sapiens
acaggaacagcacttctggactttatgttctgacgtttatgttgggaccttgaaattaatagtagcacctgatgctgatgctaggtggattttaagccaaacacataatatttttactcaggaaactggaagaggaaaatgagaatctgtaaaacttgaagctgtcctcatcgggccagatggataaagcaaaatgacttttttttcttttttttttctgttagactgagcttttgtggaaagctgtaagccctcaggggaaggatatcagcttgagtaattaactcatgattatgcaaagaaaatttacctagcctctttgtttttcctttctttgttattgccttgggctacttcattttttattaccatcttctctgtttagggctaggagtaaggaaaatgacagagacaataaaaagagcccaagttttgcccattttgctttcactaacaatgttgttgaaaaataaaagaaattaagacaatttatttgaacaatattt

SEQ ID NO: 356976 - DNA, 261 bp, Homo sapiens
cactgatgttgctgtgtgctacagggccccagcacactggaggggaggaggacctggaagttaagggaaaatagcaggcttgggacaaagggtgcagccagagaggggtctggctgcccataagagcccctggggggctgtcaccttatattattactagagcttgcgggatgtgtgttctgagtttgaagcagcaaagacccttcatgagcccacagtgacttctccagctccatggtgagaaagccaccaaaggcagga

SEQ ID NO: 356977 - DNA, 2826 bp, Homo sapiens
gcgatgcctgttttgaaagttgatggagcgaactgcttttccaaagactcttttgaaaaactttttaagtaggccattctgactttaacatttctctttgtcttaacattagacaaaaagtaaccttcctgaagaggacatgtgattggaagttgtcaattgttgaagcattggtaactccagtctctaacgttttagaaaatcataacaagcggttctctaccctgtaaaggtgaactactgagttcttcattatgtctgatggagattatgattacctcatcaagtttttagctttgggagactctggtgtagggaagaccagtgtactttaccaatatacagatggtaaatttaactccaaatttatcacaacagtgggcattgatttcagggaaaaaagagtggtgtacagagccagtgggccggatggagccactggcagaggccagagaatccacctgcagttatgggacacagcagggcaggagaggtttcgtagcttaacgacagcgttcttcagagatgctatgggttttcttctactttttgatctgacaaatgagcaaagtttcctcaatgtcagaaactggataagccagctacagatgcatgcatattgtgaaaacccagatatagtgctgtgtggaaacaagagtgatctggaggaccagagagtagtgaaagaggaggaagccatagcactcgcagagaaatatggaatcccctactttgaaactagtgctgccaatgggacaaacataagccaagcaattgagatgcttctggacctgataatgaagcgaatggaacggtgtgtggacaagtcctggattcctgaaggagtggtgcgatcaaatggtcatgcctctacggatcagttaagtgaagaaaaggagaaaggggcatgtggctgttgagaagtcaagtaagcgacatagtagttcaggtggcccatgcctgggatcttctctatgattgatacatggcacagtgagagattaatgggcattgtgtacaaattgcttctcaccatccccattagacctacgaataaagcatccggttctaaaattaatttgttgcagctttgtaaatatttctttaagattcagcctgagagttaggagaaatatttcagagccaaaagtgccttatacaaccttagcctattatagtaaatcattcaaggattcagaattttgcagtcacagaagagtgtatttattatgtagaatgaatgagggtactgtcacctgccttaatgtaggtaggcccagagtcttacatttaagatcttacatgcagttataaaaccgccacagtcttcaatccagatttgaagactcatgccataggtgacattctaaaataccattaaagccacttaaatgttaaataagaatatacatgcacatcagctcaatgtctttgagtattaattttatgtaagcattctatttaacatgaatataggacaaatcatggctatatctatagaccttggataaactggattgaccaattatacactcacggtgacttttttattggtgggaaggggattggggtggggcaggctggcttaatgtaatatgagcaaccaaagtgggacttctgtctccccgctatattcccattgctctgaatggttgattgaagggtcagggaactagattttatggctttagttcactgtgattgtacatttatacttggcctatgtgctggccgcacctgaacatagctggtgcttatgccgagttatttgcgatgagtaaatatttagtttctttttcttcatatttataatgttgatctggcatcctcaggctgcagctttattagcttataacttactcatctctatctttaccagcaggctctgtattgttgatatttgcaacttgttttgcttttccattggtggaattgaaataattagtttttaattacataagatgcctgtttgctatttggtggaagatagatgttcatattgaagcagtcacatttgtactgtagttcaataaaagaaaaatgaagtattctgtagcctatatttttcatagagctcatgagcatttactgtacttgctgggtcttgccaagatcatttattccgctgcattgccaaagtgtcttcataccaaattaaaggtggttttaatatatgtttcatggaagttgtttataaaattcaaaggtatttcatttaggtgaaaagtcttatttattaaagtggtttgaataaagtagatcaaaacttccagagatcttaatggctatataggaagaaatatcactcaccataatttaaataaagaataaaaatacttgtattttgtggtggcaaatgtttggtagaactgtaattagaaaaatacaagtatatttgcgtgatggttacactagaagcccagactttacgactacacaatatattcatgtatctaaactgtacttgtaccccctaaatttatttttaaaaaaggaaaaataaaagtatcatgaaaaaacctatttttttttccactgtccttccactactcccataacaaacttatccatggttggtaaaattttacatatttctatccttgaaatgaaggcttcttttaaattccaaagaagtcatggaggcctgtgcatttgaattgtatatgctagtgaggaaaagatttagacatttcaagagcagggttggccaggcgcggtggctcacacctgtaatcccagcactttgggaggccgaggagggcggatcacgaggtcaggagatcgagaccatcctggctaacacagtgaaaccccatctctactaaa

SEQ ID NO: 356978 - DNA, 1038 bp, Homo sapiens
  misc_feature (45)..(45): n is a, c, g, or t
actaagacgagggggacaaagagcaggcggggaccgggccggaanccgggattggcggtctctgtgctcgggggtccgaaaactgctggaaggcccccggtctctggaggggagcaggcggtagcgagtttagtgacgtggagcaggcgcagaacagtcggaggtacctgagtggttattaaaaacggtaacggtaattgtagacgtcagtgttggtgttaacatttcagatttgaagagatttcctgggtgtggagtgtgactttccaaaaccagcttttccttgagctgtatttgttgcagcaatgtttaggagattgacttttgcacaactgctttttgccactgtccttggaattgctggaggagtatatatttttcaaccagtatttgaacagtatgccaaagatcagaaggaattaaaagaaaagatgcagttggtacaagaatcagaagagaagaaaagttaatactacatggagttaggcctggcgcagtggctcacgcctgtaatcccagcactttgggaggccgaggcgggtggatcaggtggtcaggagttcaagaccagcctgaccaacatggtgaaaccctgtctctactgaaaatacaaaaatcagccaggcttggtggcatgcgcctgtaatcccagctacttgggaggctgaggcaggagcatcacttgaacctgggaggcagaggtggcagtgagtcaagatcacgctgctgcactccagcctgggtgacagagcgagactccatctaaaaaaacaaaaagcaaaaaaacccacaaatacctcatggagatgaactgtaataattgcttaaagttccatttaattatgttaactctaatctagcaaaaacatagatgtacttaaaaataaatcatggataatgattttttaacctaaaactgttaattttaatgtttattgtatatttgtcattttatgtctttttaccaggacagataagtaatttccttttaaacaaaagtgaatattttaggaatattttctacttgaggtttatttt

SEQ ID NO: 356979 - DNA, 1024 bp, Homo sapiens
agctcccacccgacgtggtggcctccttgcggtttcctttcgccgtttccgaaccgagggattgctactcgcctttggcttggcggtctctgtgctcgggggtccgaaaactgctggaaggcccccggtctctggaggggagcaggcggtagcgagtttagtgacgtggagcaggcgcagaacagtcggaggtacctgagtggttattaaaaacggatttgaagagatttcctgggtgtggagtgtgactttccaaaaccagcttttccttgagctgtatttgttgcagcaatgtttaggagattgacttttgcacaactgctttttgccactgtccttggaattgctggaggagtatatatttttcaaccagtatttgaacagtatgccaaagatcagaaggaattaaaagaaaagatgcagttggtacaagaatcagaagagaagaaaagttaatactacatggagttaggcctggcgcagtggctcacgcctgtaatcccagcactttgggaggccgaggcgggtggatcaggtggtcaggagttcaagaccagcctgaccaacatggtgaaaccctgtctctactgaaaatacaaaaatcagccaggcttggtggcatgcgcctgtaatcccagctacttgggaggctgaggcaggagcatcacttgaacctgggaggcagaggtggcagtgagtcaagatcacgctgctgcactccagcctgggtgacagagcgagactccatctaaaaaaacaaaaagcaaaaaaacccacaaatacctcatggagatgaactgtaataattgcttaaagttccatttaattatgttaactctaatctagcaaaaacatagatgtacttaaaaataaatcatggataatgattttttaacctaaaactgttaattttaatgtttattgtatatttgtcattttatgtctttttaccaggacagataagtaatttccttttaaacaaaagtgaatattttaggaatattttctacttgaggtttatttt

SEQ ID NO: 356980 - DNA, 630 bp, Homo sapiens
acgtggggaccagaaaaccaaataagtggtttattatagccatctaagaaataataaaaacttggagtaggagcaagaagatgaatatccttaggacttggtggccaattggaagtgggaggggcagagagggaggagttaatgagagccatcagatttctggctgtgttgggattgtgtgattcaagacacaggaagagaagtgggtttgaagcaaggttgtggagaaaagcaaaggaggtgagtacgggacatgctggatttgagatgccagcaagatatctgggtggactcccttgtaggcagttttacttatgaaattggaggccagctgcaaggtctggtaagtaatctagccccatccctcctgccacttccatttgatcccccatattgtttgtttggatcaggcattgtatttgtaagcaacaatatgaatataacctttaagggccttgagaatacaaggcactttctcaagaaaacaaatgttctactgttttgattcacggggtaggtgggcggaagaaagagctgaagtgcagagtcttctaacaccagaagaggttaataaagccgccctctgagtggccagtcgaactggaacttggtaagcttgaaaggggcaaa

SEQ ID NO: 356981 - DNA, 3816 bp, Homo sapiens
agctcccacccgacgtggtggcctccttgcggtttcctttcgccgtttccgaaccgagggattgctactcgcctttggcttggcggtctctgtgctcgggggtccgaaaactgctggaaggcccccggtctctggaggggagcaggcggtagcgagtttagtgacgtggagcaggcgcagaacagtcggagatacagtctcgctgtgatgcccaggctggagtgcaatggcgtgattttggctcactgcaacctctcccacccaggttcaagtgattctcctgcctcagcctcccgagcagctgggattacaggtgcctgctaccacacccggaatcctgggcattcccttgccccggaaacgccgtgtccaggccgacctaagccaggagccgcaggggcgggaagccgggggcagggccgggcctgggacgccgcctcaggagccgcgcggactcgggaacctcgggcggggccggcgtgagtacgcccggcacctccggctgctacggtggcgaccgcgaactgatgccgtggaaaacacccttagaacatggctttttggggaggtgaataggggagagtccccaaacgacacctcgccgcgcaccggtccttggtgcagtttgtaaatgtccctcctgtgtcccaaaacgaaaacactcctatattttgtagcgccttccagaatggggcagcggaaactagtgttgggacaaaggaggcgagcggggccttttcggggctcacagaggacccctcggaggcgcggccgccggggagagcgcgacagcaccccgccccccgccagccgggcgggggccgctcccgaggtgacaggagaaggcgggaggtggaggagagaaggtcccgccccacctcgctctcctttacgggaagtgatgtggggccaggcggaaaatacccgccaacgacccaaaaaaggccggcggcgggtggacgcggcgcgcgaggacccgagccaggcggggacaggacggcggggcgagccagacaaaaagtaaccttcctgaagaggacatgtgattggaagttgtcaattgttgaagcattggtaactccagtctctaacgttttagaaaatcataacaagcggttctctaccctgtaaagaacagaaacctggaaatctaaggctcaaagacatccaagtaattggtatctgggagatttgggattcaaacccagctctgcttgacttggtgaactactgagttcttcattatgtctgatggagattatgattacctcatcaagtttttagctttgggagactctggtgtagggaagaccagtgtactttaccaatatacagatggtaaatttaactccaaatttatcacaacagtgggcattgatttcagggaaaaaagagtggtgtacagagccagtgggccggatggagccactggcagaggccagagaatccacctgcagttatgggacacagcagggcaggagaggtttcgtagcttaacgacagcgttcttcagagatgctatgggttttcttctactttttgatctgacaaatgagcaaagtttcctcaatgtcagaaactggataagccagctacagatgcatgcatattgtgaaaacccagatatagtgctgtgtggaaacaagagtgatctggaggaccagagagtagtgaaagaggaggaagccatagcactcgcagagaaatatggaatcccctactttgaaactagtgctgccaatgggacaaacataagccaagcaattgagatgcttctggacctgataatgaagcgaatggaacggtgtgtggacaagtcctggattcctgaaggagtggtgcgatcaaatggtcatgcctctacggatcagttaagtgaagaaaaggagaaaggggcatgtggctgttgagaagtcaagtaagcgacatagtagttcaggtggcccatgcctgggatcttctctatgattgatacatggcacagtgagagattaatgggcattgtgtacaaattgcttctcaccatccccattagacctacgaataaagcatccggttctaaaattaatttgttgcagctttgtaaatatttctttaagattcagcctgagagttaggagaaatatttcagagccaaaagtgccttatacaaccttagcctattatagtaaatcattcaaggattcagaattttgcagtcacagaagagtgtatttattatgtagaatgaatgagggtactgtcacctgccttaatgtaggtaggcccagagtcttacatttaagatcttacatgcagttataaaaccgccacagtcttcaatccagatttgaagactcatgccataggtgacattctaaaataccattaaagccacttaaatgttaaataagaatatacatgcacatcagctcaatgtctttgagtattaattttatgtaagcattctatttaacatgaatataggacaaatcatggctatatctatagaccttggataaactggattgaccaattatacactcacggtgacttttttattggtgggaaggggattggggtggggcaggctggcttaatgtaatatgagcaaccaaagtgggacttctgtctccccgctatattcccattgctctgaatggttgattgaagggtcagggaactagattttatggctttagttcactgtgattgtacatttatacttggcctatgtgctggccgcacctgaacatagctggtgcttatgccgagttatttgcgatgagtaaatatttagtttctttttcttcatatttataatgttgatctggcatcctcaggctgcagctttattagcttataacttactcatctctatctttaccagcaggctctgtattgttgatatttgcaacttgttttgcttttccattggtggaattgaaataattagtttttaattacataagatgcctgtttgctatttggtggaagatagatgttcatattgaagcagtcacatttgtactgtagttcaataaaagaaaaatgaagtattctgtagcctatatttttcatagagctcatgagcatttactgtacttgctgggtcttgccaagatcatttattccgctgcattgccaaagtgtcttcataccaaattaaaggtggttttaatatatgtttcatggaagttgtttataaaattcaaaggtatttcatttaggtgaaaagtcttatttattaaagtggtttgaataaagtagatcaaaacttccagagatcttaatggctatataggaagaaatatcactcaccataatttaaataaagaataaaaatacttgtattttgtggtggcaaatgtttggtagaactgtaattagaaaaatacaagtatatttgcgtgatggttacactagaagcccagactttacgactacacaatatattcatgtatctaaactgtacttgtaccccctaaatttatttttaaaaaaggaaaaataaaagtatcatgaaaaaacctatttttttttccactgtccttccactactcccataacaaacttatccatggttggtaaaattttacatatttctatccttgaaatgaaggcttcttttaaattccaaagaagtcatggaggcctgtgcatttgaattgtatatgctagtgaggaaaagatttagacatttcaagagcagggttggccaggcgcggtggctcacacctgtaatcccagcactttgggaggccgaggagggcggatcacgaggtcaggagatcgagaccatcctggctaacacagtgaaaccccatctctactaaa

SEQ ID NO: 356982 - DNA, 3057 bp, Homo sapiens
acgtggggaccagaaaaccaaataagtggtttattatagccatctaagaaataataaaaacttggagtaggagcaagaagatgaatatccttaggacttggtggccaattggaagtgggaggggcagagagggaggagttaatgagagccatcagatttctggctgtgttgggattgtgtgattcaagacacaggaagagaagtgggtttgaagcaaggttgtggagaaaagcaaaggaggtgagtacgggacatgctggatttgagatgccagcaagatatctgggtggactcccttgtaggcagttttacttatgaaattggaggccagctgcaaggtctgacaaaaagtaaccttcctgaagaggacatgtgattggaagttgtcaattgttgaagcattggtaactccagtctctaacgttttagaaaatcataacaagcggttctctaccctgtaaaggtgaactactgagttcttcattatgtctgatggagattatgattacctcatcaagtttttagctttgggagactctggtgtagggaagaccagtgtactttaccaatatacagatggtaaatttaactccaaatttatcacaacagtgggcattgatttcagggaaaaaagagtggtgtacagagccagtgggccggatggagccactggcagaggccagagaatccacctgcagttatgggacacagcagggcaggagaggtttcgtagcttaacgacagcgttcttcagagatgctatgggttttcttctactttttgatctgacaaatgagcaaagtttcctcaatgtcagaaactggataagccagctacagatgcatgcatattgtgaaaacccagatatagtgctgtgtggaaacaagagtgatctggaggaccagagagtagtgaaagaggaggaagccatagcactcgcagagaaatatggaatcccctactttgaaactagtgctgccaatgggacaaacataagccaagcaattgagatgcttctggacctgataatgaagcgaatggaacggtgtgtggacaagtcctggattcctgaaggagtggtgcgatcaaatggtcatgcctctacggatcagttaagtgaagaaaaggagaaaggggcatgtggctgttgagaagtcaagtaagcgacatagtagttcaggtggcccatgcctgggatcttctctatgattgatacatggcacagtgagagattaatgggcattgtgtacaaattgcttctcaccatccccattagacctacgaataaagcatccggttctaaaattaatttgttgcagctttgtaaatatttctttaagattcagcctgagagttaggagaaatatttcagagccaaaagtgccttatacaaccttagcctattatagtaaatcattcaaggattcagaattttgcagtcacagaagagtgtatttattatgtagaatgaatgagggtactgtcacctgccttaatgtaggtaggcccagagtcttacatttaagatcttacatgcagttataaaaccgccacagtcttcaatccagatttgaagactcatgccataggtgacattctaaaataccattaaagccacttaaatgttaaataagaatatacatgcacatcagctcaatgtctttgagtattaattttatgtaagcattctatttaacatgaatataggacaaatcatggctatatctatagaccttggataaactggattgaccaattatacactcacggtgacttttttattggtgggaaggggattggggtggggcaggctggcttaatgtaatatgagcaaccaaagtgggacttctgtctccccgctatattcccattgctctgaatggttgattgaagggtcagggaactagattttatggctttagttcactgtgattgtacatttatacttggcctatgtgctggccgcacctgaacatagctggtgcttatgccgagttatttgcgatgagtaaatatttagtttctttttcttcatatttataatgttgatctggcatcctcaggctgcagctttattagcttataacttactcatctctatctttaccagcaggctctgtattgttgatatttgcaacttgttttgcttttccattggtggaattgaaataattagtttttaattacataagatgcctgtttgctatttggtggaagatagatgttcatattgaagcagtcacatttgtactgtagttcaataaaagaaaaatgaagtattctgtagcctatatttttcatagagctcatgagcatttactgtacttgctgggtcttgccaagatcatttattccgctgcattgccaaagtgtcttcataccaaattaaaggtggttttaatatatgtttcatggaagttgtttataaaattcaaaggtatttcatttaggtgaaaagtcttatttattaaagtggtttgaataaagtagatcaaaacttccagagatcttaatggctatataggaagaaatatcactcaccataatttaaataaagaataaaaatacttgtattttgtggtggcaaatgtttggtagaactgtaattagaaaaatacaagtatatttgcgtgatggttacactagaagcccagactttacgactacacaatatattcatgtatctaaactgtacttgtaccccctaaatttatttttaaaaaaggaaaaataaaagtatcatgaaaaaacctatttttttttccactgtccttccactactcccataacaaacttatccatggttggtaaaattttacatatttctatccttgaaatgaaggcttcttttaaattccaaagaagtcatggaggcctgtgcatttgaattgtatatgctagtgaggaaaagatttagacatttcaagagcagggttggccaggcgcggtggctcacacctgtaatcccagcactttgggaggccgaggagggcggatcacgaggtcaggagatcgagaccatcctggctaacacagtgaaaccccatctctactaaa

SEQ ID NO: 356983 - DNA, 2685 bp, Homo sapiens
ttctgagactctgcatactgaataataggtgaaataaggaaagactttgagaagcaataagaaatatatctgatttgaccttgtccattaggtgaactactgagttcttcattatgtctgatggagattatgattacctcatcaagtttttagctttgggagactctggtgtagggaagaccagtgtactttaccaatatacagatggtaaatttaactccaaatttatcacaacagtgggcattgatttcagggaaaaaagagtggtgtacagagccagtgggccggatggagccactggcagaggccagagaatccacctgcagttatgggacacagcagggcaggagaggtttcgtagcttaacgacagcgttcttcagagatgctatgggttttcttctactttttgatctgacaaatgagcaaagtttcctcaatgtcagaaactggataagccagctacagatgcatgcatattgtgaaaacccagatatagtgctgtgtggaaacaagagtgatctggaggaccagagagtagtgaaagaggaggaagccatagcactcgcagagaaatatggaatcccctactttgaaactagtgctgccaatgggacaaacataagccaagcaattgagatgcttctggacctgataatgaagcgaatggaacggtgtgtggacaagtcctggattcctgaaggagtggtgcgatcaaatggtcatgcctctacggatcagttaagtgaagaaaaggagaaaggggcatgtggctgttgagaagtcaagtaagcgacatagtagttcaggtggcccatgcctgggatcttctctatgattgatacatggcacagtgagagattaatgggcattgtgtacaaattgcttctcaccatccccattagacctacgaataaagcatccggttctaaaattaatttgttgcagctttgtaaatatttctttaagattcagcctgagagttaggagaaatatttcagagccaaaagtgccttatacaaccttagcctattatagtaaatcattcaaggattcagaattttgcagtcacagaagagtgtatttattatgtagaatgaatgagggtactgtcacctgccttaatgtaggtaggcccagagtcttacatttaagatcttacatgcagttataaaaccgccacagtcttcaatccagatttgaagactcatgccataggtgacattctaaaataccattaaagccacttaaatgttaaataagaatatacatgcacatcagctcaatgtctttgagtattaattttatgtaagcattctatttaacatgaatataggacaaatcatggctatatctatagaccttggataaactggattgaccaattatacactcacggtgacttttttattggtgggaaggggattggggtggggcaggctggcttaatgtaatatgagcaaccaaagtgggacttctgtctccccgctatattcccattgctctgaatggttgattgaagggtcagggaactagattttatggctttagttcactgtgattgtacatttatacttggcctatgtgctggccgcacctgaacatagctggtgcttatgccgagttatttgcgatgagtaaatatttagtttctttttcttcatatttataatgttgatctggcatcctcaggctgcagctttattagcttataacttactcatctctatctttaccagcaggctctgtattgttgatatttgcaacttgttttgcttttccattggtggaattgaaataattagtttttaattacataagatgcctgtttgctatttggtggaagatagatgttcatattgaagcagtcacatttgtactgtagttcaataaaagaaaaatgaagtattctgtagcctatatttttcatagagctcatgagcatttactgtacttgctgggtcttgccaagatcatttattccgctgcattgccaaagtgtcttcataccaaattaaaggtggttttaatatatgtttcatggaagttgtttataaaattcaaaggtatttcatttaggtgaaaagtcttatttattaaagtggtttgaataaagtagatcaaaacttccagagatcttaatggctatataggaagaaatatcactcaccataatttaaataaagaataaaaatacttgtattttgtggtggcaaatgtttggtagaactgtaattagaaaaatacaagtatatttgcgtgatggttacactagaagcccagactttacgactacacaatatattcatgtatctaaactgtacttgtaccccctaaatttatttttaaaaaaggaaaaataaaagtatcatgaaaaaacctatttttttttccactgtccttccactactcccataacaaacttatccatggttggtaaaattttacatatttctatccttgaaatgaaggcttcttttaaattccaaagaagtcatggaggcctgtgcatttgaattgtatatgctagtgaggaaaagatttagacatttcaagagcagggttggccaggcgcggtggctcacacctgtaatcccagcactttgggaggccgaggagggcggatcacgaggtcaggagatcgagaccatcctggctaacacagtgaaaccccatctctactaaa

SEQ ID NO: 356984 - DNA, 3613 bp, Homo sapiens
tcattgctctaacactcttagaaatttacagtggttttatattcttgaattacacagtgtgagcagagactccgtttgccatttcctcccggaattacattgatttttttcctgcgaaattttttacttatttttctcccatgttatttccaggaatcctgggcattcccttgccccggaaacgccgtgtccaggccgacctaagccaggagccgcaggggcgggaagccgggggcagggccgggcctgggacgccgcctcaggagccgcgcggactcgggaacctcgggcggggccggcgtgagtacgcccggcacctccggctgctacggtggcgaccgcgaactgatgccgtggaaaacacccttagaacatggctttttggggaggtgaataggggagagtccccaaacgacacctcgccgcgcaccggtccttggtgcagtttgtaaatgtccctcctgtgtcccaaaacgaaaacactcctatattttgtagcgccttccagaatggggcagcggaaactagtgttgggacaaaggaggcgagcggggccttttcggggctcacagaggacccctcggaggcgcggccgccggggagagcgcgacagcaccccgccccccgccagccgggcgggggccgctcccgaggtgacaggagaaggcgggaggtggaggagagaaggtcccgccccacctcgctctcctttacgggaagtgatgtggggccaggcggaaaatacccgccaacgacccaaaaaaggccggcggcgggtggacgcggcgcgcgaggacccgagccaggcggggacaggacggcggggcgagccagacaaaaagtaaccttcctgaagaggacatgtgattggaagttgtcaattgttgaagcattggtaactccagtctctaacgttttagaaaatcataacaagcggttctctaccctgtaaagaacagaaacctggaaatctaaggctcaaagacatccaagtaattggtatctgggagatttgggattcaaacccagctctgcttgacttggtgaactactgagttcttcattatgtctgatggagattatgattacctcatcaagtttttagctttgggagactctggtgtagggaagaccagtgtactttaccaatatacagatggtaaatttaactccaaatttatcacaacagtgggcattgatttcagggaaaaaagagtggtgtacagagccagtgggccggatggagccactggcagaggccagagaatccacctgcagttatgggacacagcagggcaggagaggtttcgtagcttaacgacagcgttcttcagagatgctatgggttttcttctactttttgatctgacaaatgagcaaagtttcctcaatgtcagaaactggataagccagctacagatgcatgcatattgtgaaaacccagatatagtgctgtgtggaaacaagagtgatctggaggaccagagagtagtgaaagaggaggaagcaatcccctactttgaaactagtgctgccaatgggacaaacataagccaagcaattgagatgcttctggacctgataatgaagcgaatggaacggtgtgtggacaagtcctggattcctgaaggagtggtgcgatcaaatggtcatgcctctacggatcagttaagtgaagaaaaggagaaaggggcatgtggctgttgagaagtcaagtaagcgacatagtagttcaggtggcccatgcctgggatcttctctatgattgatacatggcacagtgagagattaatgggcattgtgtacaaattgcttctcaccatccccattagacctacgaataaagcatccggttctaaaattaatttgttgcagctttgtaaatatttctttaagattcagcctgagagttaggagaaatatttcagagccaaaagtgccttatacaaccttagcctattatagtaaatcattcaaggattcagaattttgcagtcacagaagagtgtatttattatgtagaatgaatgagggtactgtcacctgccttaatgtaggtaggcccagagtcttacatttaagatcttacatgcagttataaaaccgccacagtcttcaatccagatttgaagactcatgccataggtgacattctaaaataccattaaagccacttaaatgttaaataagaatatacatgcacatcagctcaatgtctttgagtattaattttatgtaagcattctatttaacatgaatataggacaaatcatggctatatctatagaccttggataaactggattgaccaattatacactcacggtgacttttttattggtgggaaggggattggggtggggcaggctggcttaatgtaatatgagcaaccaaagtgggacttctgtctccccgctatattcccattgctctgaatggttgattgaagggtcagggaactagattttatggctttagttcactgtgattgtacatttatacttggcctatgtgctggccgcacctgaacatagctggtgcttatgccgagttatttgcgatgagtaaatatttagtttctttttcttcatatttataatgttgatctggcatcctcaggctgcagctttattagcttataacttactcatctctatctttaccagcaggctctgtattgttgatatttgcaacttgttttgcttttccattggtggaattgaaataattagtttttaattacataagatgcctgtttgctatttggtggaagatagatgttcatattgaagcagtcacatttgtactgtagttcaataaaagaaaaatgaagtattctgtagcctatatttttcatagagctcatgagcatttactgtacttgctgggtcttgccaagatcatttattccgctgcattgccaaagtgtcttcataccaaattaaaggtggttttaatatatgtttcatggaagttgtttataaaattcaaaggtatttcatttaggtgaaaagtcttatttattaaagtggtttgaataaagtagatcaaaacttccagagatcttaatggctatataggaagaaatatcactcaccataatttaaataaagaataaaaatacttgtattttgtggtggcaaatgtttggtagaactgtaattagaaaaatacaagtatatttgcgtgatggttacactagaagcccagactttacgactacacaatatattcatgtatctaaactgtacttgtaccccctaaatttatttttaaaaaaggaaaaataaaagtatcatgaaaaaacctatttttttttccactgtccttccactactcccataacaaacttatccatggttggtaaaattttacatatttctatccttgaaatgaaggcttcttttaaattccaaagaagtcatggaggcctgtgcatttgaattgtatatgctagtgaggaaaagatttagacatttcaagagcagggttggccaggcgcggtggctcacacctgtaatcccagcactttgggaggccgaggagggcggatcacgaggtcaggagatcgagaccatcctggctaacacagtgaaaccccatctctactaaa

SEQ ID NO: 356985 - DNA, 3617 bp, Homo sapiens
tcattgctctaacactcttagaaatttacagtggttttatattcttgaattacacagtgtgagcagagactccgtttgccatttcctcccggaattacattgatttttttcctgcgaaattttttacttatttttctcccatgttatttccaggaatcctgggcattcccttgccccggaaacgccgtgtccaggccgacctaagccaggagccgcaggggcgggaagccgggggcagggccgggcctgggacgccgcctcaggagccgcgcggactcgggaacctcgggcggggccggcgtgagtacgcccggcacctccggctgctacggtggcgaccgcgaactgatgccgtggaaaacacccttagaacatggctttttggggaggtgaataggggagagtccccaaacgacacctcgccgcgcaccggtccttggtgcagtttgtaaatgtccctcctgtgtcccaaaacgaaaacactcctatattttgtagcgccttccagaatggggcagcggaaactagtgttgggacaaaggaggcgagcggggccttttcggggctcacagaggacccctcggaggcgcggccgccggggagagcgcgacagcaccccgccccccgccagccgggcgggggccgctcccgaggtgacaggagaaggcgggaggtggaggagagaaggtcccgccccacctcgctctcctttacgggaagtgatgtggggccaggcggaaaatacccgccaacgacccaaaaaaggccggcggcgggtggacgcggcgcgcgaggacccgagccaggcggggacaggacggcggggcgagccagacaaaaagtaaccttcctgaagaggacatgtgattggaagttgtcaattgttgaagcattggtaactccagtctctaacgttttagaaaatcataacaagcggttctctaccctgtaaagaacagaaacctggaaatctaaggctcaaagacatccaagtaattggtatctgggagatttgggattcaaacccagctctgcttgacttggtgaactactgagttcttcattatgtctgatggagattatgattacctcatcaagtttttagctttgggagactctggtgtagggaagaccagtgtactttaccaatatacagatggtaaatttaactccaaatttatcacaacagtgggcattgatttcagggaaaaaagagtggtgtacagagccagtgggccggatggagccactggcagaggccagagaatccacctgcagttatgggacacagcagggcaggagaggtttcgtagcttaacgacagcgttcttcagagatgctatgggttttcttctactttttgatctgacaaatgagcaaagtttcctcaatgtcagaaactggataagccagctacagatgcatgcatattgtgaaaacccagatatagtgctgtgtggaaacaagagtgatctggaggaccagagagtagtgaaagaggaggaagccatagcactcgcagagaaatatggaatcccctactttgaaactagtgctgccaatgggacaaacataagccaagcaattgagatgcttctggacctgataatgaagcgaatggaacggtgtgtggacaagtcctggattcctgaaggagtggtgcgatcaaatggtcatgcctctacggatcagttaagtgaagaaaaggagaaaggggcatgtggctgttgagaagtcaagtaagcgacatagtagttcaggtggcccatgcctgggatcttctctatgattgatacatggcacagtgagagattaatgggcattgtgtacaaattgcttctcaccatccccattagacctacgaataaagcatccggttctaaaattaatttgttgcagctttgtaaatatttctttaagattcagcctgagagttaggagaaatatttcagagccaaaagtgccttatacaaccttagcctattatagtaaatcattcaaggattcagaattttgcagtcacagaagagtgtatttattatgtagaatgaatgagggtactgtcacctgccttaatgtaggtaggcccagagtcttacatttaagatcttacatgcagttataaaaccgccacagtcttcaatccagatttgaagactcatgccataggtgacattctaaaataccattaaagccacttaaatgttaaataagaatatacatgcacatcagctcaatgtctttgagtattaattttatgtaagcattctatttaacatgaatataggacaaatcatggctatatctatagaccttggataaactggattgaccaattatacactcacggtgacttttttattggtgggaaggggattggggtggggcaggctggcttaatgtaatatgagcaaccaaagtgggacttctgtctccccgctatattcccattgctctgaatggttgattgaagggtcagggaactagattttatggctttagttcactgtgattgtacatttatacttggcctatgtgctggccgcacctgaacatagctggtgcttatgccgagttatttgcgatgagtaaatatttagtttctttttcttcatatttataatgttgatctggcatcctcaggctgcagctttattagcttataacttactcatctctatctttaccagcaggctctgtattgttgatattaattacataagatgcctgtttgctatttggtggaagatagatgttcatattgaagcagtcacatttgtactgtagttcaataaaagaaaaatgaagtattctgtagcctatatttttcatagagctcatgagcatttactgtacttgctgggtcttgccaagatcatttattccgctgcattgccaaagtgtcttcataccaaattaaaggtggttttaatatatgtttcatggaagttgtttataaaattcaaaggtatttcatttaggtgaaaagtcttatttattaaagtggtttgaataaagtagatcaaaacttccagagatcttaatggctatataggggacgacacttattcacttcaccccatacattttaccattaacggaactaaaccattacgtttgtattttgttgggtgccacactgtgtcgggtagcacactgcacatttcgacacccttcacagtatatttgcgtgatggttacactagaagcccagactttacgactacacaatatattcatgtatctaaactgtacttgtaccccctaaatttatttttaaaaaaggaaaaataaaagtatcatgaaaaaacctatttttttttccactgtccttccactactcccataacaaacttatccatggttggtaaaattttacatatttctatccttgaaatgaaggcttcttttaaattccaaagaagtcatggaggcctgtgcatttgaattgtatatgctagtgaggaaaagatttagacatttcaagagcagggttggccaggcgcggtggctcacacctgtaatcccagcactttgggaggccgaggagggcggatcacgaggtcaggagatcgagaccatcctggctaacacagtgaaaccccatctctactaaa

SEQ ID NO: 356986 - DNA, 999 bp, Homo sapiens
agctcccacccgacgtggtggcctccttgcggtttcctttcgccgtttccgaaccgagggattgctactcgcctttggcttggcggtctctgtgctcgggggtccgaaaactgctggaaggcccccggtctctggaggggagcaggcggtagcgagtttagtgacgtggagcaggcgcagaacagtcggagatttgaagagatttcctgggtgtggagtgtgactttccaaaaccagcttttccttgagctgtatttgttgcagcaatgtttaggagattgacttttgcacaactgctttttgccactgtccttggaattgctggaggagtatatatttttcaaccagtatttgaacagtatgccaaagatcagaaggaattaaaagaaaagatgcagttggtacaagaatcagaagagaagaaaagttaatactacatggagttaggcctggcgcagtggctcacgcctgtaatcccagcactttgggaggccgaggcgggtggatcaggtggtcaggagttcaagaccagcctgaccaacatggtgaaaccctgtctctactgaaaatacaaaaatcagccaggcttggtggcatgcgcctgtaatcccagctacttgggaggctgaggcaggagcatcacttgaacctgggaggcagaggtggcagtgagtcaagatcacgctgctgcactccagcctgggtgacagagcgagactccatctaaaaaaacaaaaagcaaaaaaacccacaaatacctcatggagatgaactgtaataattgcttaaagttccatttaattatgttaactctaatctagcaaaaacatagatgtacttaaaaataaatcatggataatgattttttaacctaaaactgttaattttaatgtttattgtatatttgtcattttatgtctttttaccaggacagataagtaatttccttttaaacaaaagtgaatattttaggaatattttctacttgaggtttatttt

SEQ ID NO: 356987 - DNA, 970 bp, Homo sapiens
tcattgctctaacactcttagaaatttacagtggttttatattcttgaattacacagtgtgagcagagactccgtttgccatttcctcccggaattacattgatttttttcctgcgaaattttttacttatttttctcccatgttatttccaggaatcctgggcattcccttgccccggaaacgccgtgtccaggccgacctaagccaggagccgcaggggcgggaagccgggggcagggccgggcctgggacgccgcctcaggagccgcgcggactcgggaacctcgggcggggccggcgtgagtacgcccggcacctccggctgctacggtggcgaccgcgaactgatgccgtggaaaacacccttagaacatggctttttggggaggtgaataggggagagtccccaaacgacacctcgccgcgcaccggtccttggtgcagtttgtaaatgtccctcctgtgtcccaaaacgaaaacactcctatattttgtagcgccttccagaatggggcagcggaaactagtgttgggacaaaggaggcgagcggggccttttcggggctcacagaggacccctcggaggcgcggccgccggggagagcgcgacagcaccccgccccccgccagccgggcgggggccgctcccgaggtgacaggagaaggcgggaggtggaggagagaaggtcccgccccacctcgctctcctttacgggaagtgatgtggggccaggcggaaaatacccgccaacgacccaaaaaaggccggcggcgggtggacgcggcgcgcgaggacccgagccaggcggggacaggacggcggggcgagccaggtgagggggcctgaggagcgggaggcgcgcggcgggtccggtccctccgggagggccgagcgaggcgtccccctggggccgtcctagggctggggtccgagtgcgccgcccttcctccccgcctccaggcgcccga

SEQ ID NO: 356988 - DNA, 628 bp, Homo sapiens
tcatcttgtatatttgtattctatcgattctctaatttgaattatcaagagcaaaggtcactctcctttccctccacatgttgttacctcagttgtctctgtcttccagaatcccctactttgaaactagtgctgccaatgggacaaacataagccaagcaattgagatgcttctggacctgataatgaagcgaatggaacggtgtgtggacaagtcctggattcctgaaggagtggtgcgatcaaatggtcatgcctctacggatcagttaagtgaagaaaaggagaaaggggcatgtggctgttgagaagtcaagtaagcgacatagtagttcaggtggcccatgcctgggatcttctctatgattgatacatggcacagtgagagattaatgggcattgtgtacaaattgcttctcaccatccccattagacctacgaataaagcatccggttctaaaattaatttgttgcagctttgtaaatatttctttaagattcagcctgagagttaggagaaatatttcagagccaaaagtgccttatacaaccttagcctattatagtaaatcattcaaggattcagaattttgcagtcacagaagagtgtatttattatgtagaatga

SEQ ID NO: 356989 - DNA, 316 bp, Homo sapiens
ccttccctaattcacttcctgtactccttatgtatttatattcttgttttaattagtaacatattataaaaatattgttcactccagtgcaaagtagtgacataacatcttttaaaaggacattgtactaagtgatggctttgctttccatttttgtatgcagatttgaagagatttcctgggtgtggagtgtgactttccaaaaccagcttttccttgagctgtatttgttgcagcaatgtttaggagattgacttttgcacaactgctttttgccactgtccttggaattgctggaggagtatatatttttcaa

SEQ ID NO: 356990 - DNA, 379 bp, Homo sapiens
gaggcgggtggatcaggtggtcaggagttcaagaccagcctgaccaacatggtgaaaccctgtctctactgaaaatacaaaaatcagccaggcttggtggcatgcgcctgtaatcccagctacttgggaggctgaggcaggagcatcacttgaacctgggaggcagaggtggcagtgagtcaagatcacgctgctgcactccagcctgggtgacagagcgagactccatctaaaaaaacaaaaagcaaaaaaacccacaaatacctcatggagatgaactgtaataattgcttaaagttccatttaattatgttaactctaatctagcaaaaacatagatgtacttaaaaataaatcatggataatgattttttaacct

SEQ ID NO: 356991 - DNA, 3637 bp, Homo sapiens
tcattgctctaacactcttagaaatttacagtggttttatattcttgaattacacagtgtgagcagagactccgtttgccatttcctcccggaattacattgatttttttcctgcgaaattttttacttatttttctcccatgttatttccaggaatcctgggcattcccttgccccggaaacgccgtgtccaggccgacctaagccaggagccgcaggggcgggaagccgggggcagggccgggcctgggacgccgcctcaggagccgcgcggactcgggaacctcgggcggggccggcgtgagtacgcccggcacctccggctgctacggtggcgaccgcgaactgatgccgtggaaaacacccttagaacatggctttttggggaggtgaataggggagagtccccaaacgacacctcgccgcgcaccggtccttggtgcagtttgtaaatgtccctcctgtgtcccaaaacgaaaacactcctatattttgtagcgccttccagaatggggcagcggaaactagtgttgggacaaaggaggcgagcggggccttttcggggctcacagaggacccctcggaggcgcggccgccggggagagcgcgacagcaccccgccccccgccagccgggcgggggccgctcccgaggtgacaggagaaggcgggaggtggaggagagaaggtcccgccccacctcgctctcctttacgggaagtgatgtggggccaggcggaaaatacccgccaacgacccaaaaaaggccggcggcgggtggacgcggcgcgcgaggacccgagccaggcggggacaggacggcggggcgagccagacaaaaagtaaccttcctgaagaggacatgtgattggaagttgtcaattgttgaagcattggtaactccagtctctaacgttttagaaaatcataacaagcggttctctaccctgtaaagaacagaaacctggaaatctaaggctcaaagacatccaagtaattggtatctgggagatttgggattcaaacccagctctgcttgacttggtgaactactgagttcttcattatgtctgatggagattatgattacctcatcaagtttttagctttgggagactctggtgtagggaagaccagtgtactttaccaatatacagatggtaaatttaactccaaatttatcacaacagtgggcattgatttcagggaaaaaagagtggtgtacagagccagtgggccggatggagccactggcagaggccagagaatccacctgcagttatgggacacagcagggcaggagaggtttcgtagcttaacgacagcgttcttcagagatgctatgggttttcttctactttttgatctgacaaatgagcaaagtttcctcaatgtcagaaactggataagccagctacagatgcatgcatattgtgaaaacccagatatagtgctgtgtggaaacaagagtgatctggaggaccagagagtagtgaaagaggaggaagccatagcactcgcagagaaatatggaatcccctactttgaaactagtgctgccaatgggacaaacataagccaagcaattgagatgcttctggacctgataatgaagcgaatggaacggtgtgtggacaagtcctggattcctgaaggagtggtgcgatcaaatggtcatgcctctacggatcagttaagtgaagaaaaggagaaaggggcatgtggctgttgagaagtcaagtaagcgacatagtagttcaggtggcccatgcctgggatcttctctatgattgatacatggcacagtgagagattaatgggcattgtgtacaaattgcttctcaccatccccattagacctacgaataaagcatccggttctaaaattaatttgttgcagctttgtaaatatttctttaagattcagcctgagagttaggagaaatatttcagagccaaaagtgccttatacaaccttagcctattatagtaaatcattcaaggattcagaattttgcagtcacagaagagtgtatttattatgtagaatgaatgagggtactgtcacctgccttaatgtaggtaggcccagagtcttacatttaagatcttacatgcagttataaaaccgccacagtcttcaatccagatttgaagactcatgccataggtgacattctaaaataccattaaagccacttaaatgttaaataagaatatacatgcacatcagctcaatgtctttgagtattaattttatgtaagcattctatttaacatgaatataggacaaatcatggctatatctatagaccttggataaactggattgaccaattatacactcacggtgacttttttattggtgggaaggggattggggtggggcaggctggcttaatgtaatatgagcaaccaaagtgggacttctgtctccccgctatattcccattgctctgaatggttgattgaagggtcagggaactagattttatggctttagttcactgtgattgtacatttatacttggcctatgtgctggccgcacctgaacatagctggtgcttatgccgagttatttgcgatgagtaaatatttagtttctttttcttcatatttataatgttgatctggcatcctcaggctgcagctttattagcttataacttactcatctctatctttaccagcaggctctgtattgttgatatttgcaacttgttttgcttttccattggtggaattgaaataattagtttttaattacataagatgcctgtttgctatttggtggaagatagatgttcatattgaagcagtcacatttgtactgtagttcaataaaagaaaaatgaagtattctgtagcctatatttttcatagagctcatgagcatttactgtacttgctgggtcttgccaagatcatttattccgctgcattgccaaagtgtcttcataccaaattaaaggtggttttaatatatgtttcatggaagttgtttataaaattcaaaggtatttcatttaggtgaaaagtcttatttattaaagtggtttgaataaagtagatcaaaacttccagagatcttaatggctatataggaagaaatatcactcaccataatttaaataaagaataaaaatacttgtattttgtggtggcaaatgtttggtagaactgtaattagaaaaatacaagtatatttgcgtgatggttacactagaagcccagactttacgactacacaatatattcatgtatctaaactgtacttgtaccccctaaatttatttttaaaaaaggaaaaataaaagtatcatgaaaaaacctatttttttttccactgtccttccactactcccataacaaacttatccatggttggtaaaattttacatatttctatccttgaaatgaaggcttcttttaaattccaaagaagtcatggaggcctgtgcatttgaattgtatatgctagtgaggaaaagatttagacatttcaagagcagggttggccaggcgcggtggctcacacctgtaatcccagcactttgggaggccgaggagggcggatcacgaggtcaggagatcgagaccatcctggctaacacagtgaaaccccatctctactaaa

SEQ ID NO: 356992 - DNA, 3548 bp, Homo sapiens
tcattgctctaacactcttagaaatttacagtggttttatattcttgaattacacagtgtgagcagagactccgtttgccatttcctcccggaattacattgatttttttcctgcgaaattttttacttatttttctcccatgttatttccaggaatcctgggcattcccttgccccggaaacgccgtgtccaggccgacctaagccaggagccgcaggggcgggaagccgggggcagggccgggcctgggacgccgcctcaggagccgcgcggactcgggaacctcgggcggggccggcgtgagtacgcccggcacctccggctgctacggtggcgaccgcgaactgatgccgtggaaaacacccttagaacatggctttttggggaggtgaataggggagagtccccaaacgacacctcgccgcgcaccggtccttggtgcagtttgtaaatgtccctcctgtgtcccaaaacgaaaacactcctatattttgtagcgccttccagaatggggcagcggaaactagtgttgggacaaaggaggcgagcggggccttttcggggctcacagaggacccctcggaggcgcggccgccggggagagcgcgacagcaccccgccccccgccagccgggcgggggccgctcccgaggtgacaggagaaggcgggaggtggaggagagaaggtcccgccccacctcgctctcctttacgggaagtgatgtggggccaggcggaaaatacccgccaacgacccaaaaaaggccggcggcgggtggacgcggcgcgcgaggacccgagccaggcggggacaggacggcggggcgagccagacaaaaagtaaccttcctgaagaggacatgtgattggaagttgtcaattgttgaagcattggtaactccagtctctaacgttttagaaaatcataacaagcggttctctaccctgtaaaggtgaactactgagttcttcattatgtctgatggagattatgattacctcatcaagtttttagctttgggagactctggtgtagggaagaccagtgtactttaccaatatacagatggtaaatttaactccaaatttatcacaacagtgggcattgatttcagggaaaaaagagtggtgtacagagccagtgggccggatggagccactggcagaggccagagaatccacctgcagttatgggacacagcagggcaggagaggtttcgtagcttaacgacagcgttcttcagagatgctatgggttttcttctactttttgatctgacaaatgagcaaagtttcctcaatgtcagaaactggataagccagctacagatgcatgcatattgtgaaaacccagatatagtgctgtgtggaaacaagagtgatctggaggaccagagagtagtgaaagaggaggaagccatagcactcgcagagaaatatggaatcccctactttgaaactagtgctgccaatgggacaaacataagccaagcaattgagatgcttctggacctgataatgaagcgaatggaacggtgtgtggacaagtcctggattcctgaaggagtggtgcgatcaaatggtcatgcctctacggatcagttaagtgaagaaaaggagaaaggggcatgtggctgttgagaagtcaagtaagcgacatagtagttcaggtggcccatgcctgggatcttctctatgattgatacatggcacagtgagagattaatgggcattgtgtacaaattgcttctcaccatccccattagacctacgaataaagcatccggttctaaaattaatttgttgcagctttgtaaatatttctttaagattcagcctgagagttaggagaaatatttcagagccaaaagtgccttatacaaccttagcctattatagtaaatcattcaaggattcagaattttgcagtcacagaagagtgtatttattatgtagaatgaatgagggtactgtcacctgccttaatgtaggtaggcccagagtcttacatttaagatcttacatgcagttataaaaccgccacagtcttcaatccagatttgaagactcatgccataggtgacattctaaaataccattaaagccacttaaatgttaaataagaatatacatgcacatcagctcaatgtctttgagtattaattttatgtaagcattctatttaacatgaatataggacaaatcatggctatatctatagaccttggataaactggattgaccaattatacactcacggtgacttttttattggtgggaaggggattggggtggggcaggctggcttaatgtaatatgagcaaccaaagtgggacttctgtctccccgctatattcccattgctctgaatggttgattgaagggtcagggaactagattttatggctttagttcactgtgattgtacatttatacttggcctatgtgctggccgcacctgaacatagctggtgcttatgccgagttatttgcgatgagtaaatatttagtttctttttcttcatatttataatgttgatctggcatcctcaggctgcagctttattagcttataacttactcatctctatctttaccagcaggctctgtattgttgatatttgcaacttgttttgcttttccattggtggaattgaaataattagtttttaattacataagatgcctgtttgctatttggtggaagatagatgttcatattgaagcagtcacatttgtactgtagttcaataaaagaaaaatgaagtattctgtagcctatatttttcatagagctcatgagcatttactgtacttgctgggtcttgccaagatcatttattccgctgcattgccaaagtgtcttcataccaaattaaaggtggttttaatatatgtttcatggaagttgtttataaaattcaaaggtatttcatttaggtgaaaagtcttatttattaaagtggtttgaataaagtagatcaaaacttccagagatcttaatggctatataggaagaaatatcactcaccataatttaaataaagaataaaaatacttgtattttgtggtggcaaatgtttggtagaactgtaattagaaaaatacaagtatatttgcgtgatggttacactagaagcccagactttacgactacacaatatattcatgtatctaaactgtacttgtaccccctaaatttatttttaaaaaaggaaaaataaaagtatcatgaaaaaacctatttttttttccactgtccttccactactcccataacaaacttatccatggttggtaaaattttacatatttctatccttgaaatgaaggcttcttttaaattccaaagaagtcatggaggcctgtgcatttgaattgtatatgctagtgaggaaaagatttagacatttcaagagcagggttggccaggcgcggtggctcacacctgtaatcccagcactttgggaggccgaggagggcggatcacgaggtcaggagatcgagaccatcctggctaacacagtgaaaccccatctctactaaa

SEQ ID NO: 356993 - DNA, 3651 bp, Homo sapiens
tcattgctctaacactcttagaaatttacagtggttttatattcttgaattacacagtgtgagcagagactccgtttgccatttcctcccggaattacattgatttttttcctgcgaaattttttacttatttttctcccatgttatttccaggaatcctgggcattcccttgccccggaaacgccgtgtccaggccgacctaagccaggagccgcaggggcgggaagccgggggcagggccgggcctgggacgccgcctcaggagccgcgcggactcgggaacctcgggcggggccggcgtgagtacgcccggcacctccggctgctacggtggcgaccgcgaactgatgccgtggaaaacacccttagaacatggctttttggggaggtgaataggggagagtccccaaacgacacctcgccgcgcaccggtccttggtgcagtttgtaaatgtccctcctgtgtcccaaaacgaaaacactcctatattttgtagcgccttccagaatggggcagcggaaactagtgttgggacaaaggaggcgagcggggccttttcggggctcacagaggacccctcggaggcgcggccgccggggagagcgcgacagcaccccgccccccgccagccgggcgggggccgctcccgaggtgacaggagaaggcgggaggtggaggagagaaggtcccgccccacctcgctctcctttacgggaagtgatgtggggccaggcggaaaatacccgccaacgacccaaaaaaggccggcggcgggtggacgcggcgcgcgaggacccgagccaggcggggacaggacggcggggcgagccagacaaaaagtaaccttcctgaagaggacatgtgattggaagttgtcaattgttgaagcattggtaactccagtctctaacgttttagaaaatcataacaagcggttctctaccctgtaaagatttatgtgatcccaatgcaatgcaatgcaattccaataagaatccccatatggtttttgaggaactcagatggaaatgtgaagggttcatgtccttggtaaggtgaactactgagttcttcattatgtctgatggagattatgattacctcatcaagtttttagctttgggagactctggtgtagggaagaccagtgtactttaccaatatacagatggtaaatttaactccaaatttatcacaacagtgggcattgatttcagggaaaaaagagtggtgtacagagccagtgggccggatggagccactggcagaggccagagaatccacctgcagttatgggacacagcagggcaggagaggtttcgtagcttaacgacagcgttcttcagagatgctatgggttttcttctactttttgatctgacaaatgagcaaagtttcctcaatgtcagaaactggataagccagctacagatgcatgcatattgtgaaaacccagatatagtgctgtgtggaaacaagagtgatctggaggaccagagagtagtgaaagaggaggaagccatagcactcgcagagaaatatggaatcccctactttgaaactagtgctgccaatgggacaaacataagccaagcaattgagatgcttctggacctgataatgaagcgaatggaacggtgtgtggacaagtcctggattcctgaaggagtggtgcgatcaaatggtcatgcctctacggatcagttaagtgaagaaaaggagaaaggggcatgtggctgttgagaagtcaagtaagcgacatagtagttcaggtggcccatgcctgggatcttctctatgattgatacatggcacagtgagagattaatgggcattgtgtacaaattgcttctcaccatccccattagacctacgaataaagcatccggttctaaaattaatttgttgcagctttgtaaatatttctttaagattcagcctgagagttaggagaaatatttcagagccaaaagtgccttatacaaccttagcctattatagtaaatcattcaaggattcagaattttgcagtcacagaagagtgtatttattatgtagaatgaatgagggtactgtcacctgccttaatgtaggtaggcccagagtcttacatttaagatcttacatgcagttataaaaccgccacagtcttcaatccagatttgaagactcatgccataggtgacattctaaaataccattaaagccacttaaatgttaaataagaatatacatgcacatcagctcaatgtctttgagtattaattttatgtaagcattctatttaacatgaatataggacaaatcatggctatatctatagaccttggataaactggattgaccaattatacactcacggtgacttttttattggtgggaaggggattggggtggggcaggctggcttaatgtaatatgagcaaccaaagtgggacttctgtctccccgctatattcccattgctctgaatggttgattgaagggtcagggaactagattttatggctttagttcactgtgattgtacatttatacttggcctatgtgctggccgcacctgaacatagctggtgcttatgccgagttatttgcgatgagtaaatatttagtttctttttcttcatatttataatgttgatctggcatcctcaggctgcagctttattagcttataacttactcatctctatctttaccagcaggctctgtattgttgatatttgcaacttgttttgcttttccattggtggaattgaaataattagtttttaattacataagatgcctgtttgctatttggtggaagatagatgttcatattgaagcagtcacatttgtactgtagttcaataaaagaaaaatgaagtattctgtagcctatatttttcatagagctcatgagcatttactgtacttgctgggtcttgccaagatcatttattccgctgcattgccaaagtgtcttcataccaaattaaaggtggttttaatatatgtttcatggaagttgtttataaaattcaaaggtatttcatttaggtgaaaagtcttatttattaaagtggtttgaataaagtagatcaaaacttccagagatcttaatggctatataggaagaaatatcactcaccataatttaaataaagaataaaaatacttgtattttgtggtggcaaatgtttggtagaactgtaattagaaaaatacaagtatatttgcgtgatggttacactagaagcccagactttacgactacacaatatattcatgtatctaaactgtacttgtaccccctaaatttatttttaaaaaaggaaaaataaaagtatcatgaaaaaacctatttttttttccactgtccttccactactcccataacaaacttatccatggttggtaaaattttacatatttctatccttgaaatgaaggcttcttttaaattccaaagaagtcatggaggcctgtgcatttgaattgtatatgctagtgaggaaaagatttagacatttcaagagcagggttggccaggcgcggtggctcacacctgtaatcccagcactttgggaggccgaggagggcggatcacgaggtcaggagatcgagaccatcctggctaacacagtgaaaccccatctctactaaa

SEQ ID NO: 356994 - DNA, 2651 bp, Homo sapiens
gaggaaacacactgcagtggcttttggggctcagcattcaggagttttcagcataaggtgaactactgagttcttcattatgtctgatggagattatgattacctcatcaagtttttagctttgggagactctggtgtagggaagaccagtgtactttaccaatatacagatggtaaatttaactccaaatttatcacaacagtgggcattgatttcagggaaaaaagagtggtgtacagagccagtgggccggatggagccactggcagaggccagagaatccacctgcagttatgggacacagcagggcaggagaggtttcgtagcttaacgacagcgttcttcagagatgctatgggttttcttctactttttgatctgacaaatgagcaaagtttcctcaatgtcagaaactggataagccagctacagatgcatgcatattgtgaaaacccagatatagtgctgtgtggaaacaagagtgatctggaggaccagagagtagtgaaagaggaggaagccatagcactcgcagagaaatatggaatcccctactttgaaactagtgctgccaatgggacaaacataagccaagcaattgagatgcttctggacctgataatgaagcgaatggaacggtgtgtggacaagtcctggattcctgaaggagtggtgcgatcaaatggtcatgcctctacggatcagttaagtgaagaaaaggagaaaggggcatgtggctgttgagaagtcaagtaagcgacatagtagttcaggtggcccatgcctgggatcttctctatgattgatacatggcacagtgagagattaatgggcattgtgtacaaattgcttctcaccatccccattagacctacgaataaagcatccggttctaaaattaatttgttgcagctttgtaaatatttctttaagattcagcctgagagttaggagaaatatttcagagccaaaagtgccttatacaaccttagcctattatagtaaatcattcaaggattcagaattttgcagtcacagaagagtgtatttattatgtagaatgaatgagggtactgtcacctgccttaatgtaggtaggcccagagtcttacatttaagatcttacatgcagttataaaaccgccacagtcttcaatccagatttgaagactcatgccataggtgacattctaaaataccattaaagccacttaaatgttaaataagaatatacatgcacatcagctcaatgtctttgagtattaattttatgtaagcattctatttaacatgaatataggacaaatcatggctatatctatagaccttggataaactggattgaccaattatacactcacggtgacttttttattggtgggaaggggattggggtggggcaggctggcttaatgtaatatgagcaaccaaagtgggacttctgtctccccgctatattcccattgctctgaatggttgattgaagggtcagggaactagattttatggctttagttcactgtgattgtacatttatacttggcctatgtgctggccgcacctgaacatagctggtgcttatgccgagttatttgcgatgagtaaatatttagtttctttttcttcatatttataatgttgatctggcatcctcaggctgcagctttattagcttataacttactcatctctatctttaccagcaggctctgtattgttgatatttgcaacttgttttgcttttccattggtggaattgaaataattagtttttaattacataagatgcctgtttgctatttggtggaagatagatgttcatattgaagcagtcacatttgtactgtagttcaataaaagaaaaatgaagtattctgtagcctatatttttcatagagctcatgagcatttactgtacttgctgggtcttgccaagatcatttattccgctgcattgccaaagtgtcttcataccaaattaaaggtggttttaatatatgtttcatggaagttgtttataaaattcaaaggtatttcatttaggtgaaaagtcttatttattaaagtggtttgaataaagtagatcaaaacttccagagatcttaatggctatataggaagaaatatcactcaccataatttaaataaagaataaaaatacttgtattttgtggtggcaaatgtttggtagaactgtaattagaaaaatacaagtatatttgcgtgatggttacactagaagcccagactttacgactacacaatatattcatgtatctaaactgtacttgtaccccctaaatttatttttaaaaaaggaaaaataaaagtatcatgaaaaaacctatttttttttccactgtccttccactactcccataacaaacttatccatggttggtaaaattttacatatttctatccttgaaatgaaggcttcttttaaattccaaagaagtcatggaggcctgtgcatttgaattgtatatgctagtgaggaaaagatttagacatttcaagagcagggttggccaggcgcggtggctcacacctgtaatcccagcactttgggaggccgaggagggcggatcacgaggtcaggagatcgagaccatcctggctaacacagtgaaaccccatctctactaaa

SEQ ID NO: 356995 - DNA, 1519 bp, Homo sapiens
tcattgctctaacactcttagaaatttacagtggttttatattcttgaattacacagtgtgagcagagactccgtttgccatttcctcccggaattacattgatttttttcctgcgaaattttttacttatttttctcccatgttatttccaggaatcctgggcattcccttgccccggaaacgccgtgtccaggccgacctaagccaggagccgcaggggcgggaagccgggggcagggccgggcctgggacgccgcctcaggagccgcgcggactcgggaacctcgggcggggccggcgtgagtacgcccggcacctccggctgctacggtggcgaccgcgaactgatgccgtggaaaacacccttagaacatggctttttggggaggtgaataggggagagtccccaaacgacacctcgccgcgcaccggtccttggtgcagtttgtaaatgtccctcctgtgtcccaaaacgaaaacactcctatattttgtagcgccttccagaatggggcagcggaaactagtgttgggacaaaggaggcgagcggggccttttcggggctcacagaggacccctcggaggcgcggccgccggggagagcgcgacagcaccccgccccccgccagccgggcgggggccgctcccgaggtgacaggagaaggcgggaggtggaggagagaaggtcccgccccacctcgctctcctttacgggaagtgatgtggggccaggcggaaaatacccgccaacgacccaaaaaaggccggcggcgggtggacgcggcgcgcgaggacccgagccaggcggggacaggacggcggggcgagccagacaaaaagtaaccttcctgaagaggacatgtgattggaagttgtcaattgttgaagcattggtaactccagtctctaacgttttagaaaatcataacaagcggttctctaccctgtaaaggtgaactactgagttcttcattatgtctgatggagattatgattacctcatcaagtttttagctttgggagactctggtgtagggaagaccagtgtactttaccaatatacagatggtaaatttaactccaaatttatcacaacagtgggcattgatttcagggaaaaaagagtggtgtacagagccagtgggccggatggagccactggcagaggccagagaatccacctgcagttatgggacacagcagggcaggagaggtttcgtagcttaacgacagcgttcttcagagatgctatgggttttcttctactttttgatctgacaaatgagcaaagtttcctcaatgtcagaaactggataagccagctacagatgcatgcatattgtgaaaacccagatatagtgctgtgtggaaacaagagtgatctggaggaccagagagtagtgaaagaggaggaagccatagcactcgcagagaaatatggatccctactttgaacgatggtgccaagggacaacgcagcaatggaagtctggcccgtagcatgacggggggcaccg

SEQ ID NO: 356996 - DNA, 1066 bp, Homo sapiens
agctcccacccgacgtggtggcctccttgcggtttcctttcgccgtttccgaaccgagggattgctactcgcctttggcttggcggtctctgtgctcgggggtccgaaaactgctggaaggcccccggtctctggaggggagcaggcggtagcgagtttagtgacgtggagcaggcgcagaacagtcggaggtacctgagtggttattaaaaacggtaacggtaattgtagacgtcagtgttggtgttaacatttcagatttgaagagatttcctgggtgtggagtgtgactttccaaaaccagcttttccttgagctgtatttgttgcagcaatgtttaggagattgacttttgcacaactgctttttgccactgtccttggaattgctggaggagtatatatttttcaaccagtatttgaacagtatgccaaagatcagaaggaattaaaagaaaagatgcagttggtacaagaatcagaagagaagaaaagttaatactacatggagttaggcctggcgcagtggctcacgcctgtaatcccagcactttgggaggccgaggcgggtggatcaggtggtcaggagttcaagaccagcctgaccaacatggtgaaaccctgtctctactgaaaatacaaaaatcagccaggcttggtggcatgcgcctgtaatcccagctacttgggaggctgaggcaggagcatcacttgaacctgggaggcagaggtggcagtgagtcaagatcacgctgctgcactccagcctgggtgacagagcgagactccatctaaaaaaacaaaaagcaaaaaaacccacaaatacctcatggagatgaactgtaataattgcttaaagttccatttaattatgttaactctaatctagcaaaaacatagatgtacttaaaaataaatcatggataatgattttttaacctaaaactgttaattttaatgtttattgtatatttgtcattttatgtctttttaccaggacagataagtaatttccttttaaacaaaagtgaatattttaggaatattttctacttgaggtttatttt

SEQ ID NO: 356997 - DNA, 973 bp, Homo sapiens
agctcccacccgacgtggtggcctccttgcggtttcctttcgccgtttccgaaccgagggattgctactcgcctttggcttggcggtctctgtgctcgggggtccgaaaactgctggaaggcccccggtctctggaggggagcaggcggtagcgagtttagtgacgtggagcaggcgcagaacagtcggaggtacctgagtggttattaaaaacggccttgagctgtatttgttgcagcaatgtttaggagattgacttttgcacaactgctttttgccactgtccttggaattgctggaggagtatatatttttcaaccagtatttgaacagtatgccaaagatcagaaggaattaaaagaaaagatgcagttggtacaagaatcagaagagaagaaaagttaatactacatggagttaggcctggcgcagtggctcacgcctgtaatcccagcactttgggaggccgaggcgggtggatcaggtggtcaggagttcaagaccagcctgaccaacatggtgaaaccctgtctctactgaaaatacaaaaatcagccaggcttggtggcatgcgcctgtaatcccagctacttgggaggctgaggcaggagcatcacttgaacctgggaggcagaggtggcagtgagtcaagatcacgctgctgcactccagcctgggtgacagagcgagactccatctaaaaaaacaaaaagcaaaaaaacccacaaatacctcatggagatgaactgtaataattgcttaaagttccatttaattatgttaactctaatctagcaaaaacatagatgtacttaaaaataaatcatggataatgattttttaacctaaaactgttaattttaatgtttattgtatatttgtcattttatgtctttttaccaggacagataagtaatttccttttaaacaaaagtgaatattttaggaatattttctacttgaggtttatttt

SEQ ID NO: 356998 - DNA, 640 bp, Homo sapiens
aaaaaaattacgtttctgagtcctgaaaaattattaataaatatttgttatatagtttctttgaacatgtggtcactctgcctgcaaacgtaaagacttttaattttcatagagtgaaatatacacatattcctctgaagataaaccttaggtgtaagaaaattatgaagtgagtgtttggtaaatatgcatttgtacatattttcagaagaaaacacaattattggaacaaaataagtttttaggtgattaatggaaaactaaacaccttgaatatgctgaaagcaaatgtatactttctgctttgtatggaatttattaatataaaattttatggcttatggctcggattctccccagaatccgtgtattaaagcacaggcaactttgtctccagaaataacactcttgagtacaacaataaaagccctcttcaaacacactcaaaaaattatttttaacgcttattttaataaaaatttaaccaaaattgaataattggatacatttttattgttctatgtgtgtgtgaatgtataaaatgacacataaaggaataataatttaagccagaaaaaaagatgttagttaatatttgtaatgaataaaactggaaagtagttattatttgcagatgaca

SEQ ID NO: 356999 - DNA, 1587 bp, Homo sapiens
acagaattaccttaaaagggagtcttatgaaactgtattataaaatactttgttaagcaaaattgcatgtgtgtgttgaacccccaaacactcaaagtactttgcttaacaaaagtattttataatacagtttcatacagaattaccttaaaagggagtcttatgttttcaactacagatagttgtaagggatcatacagaagatattgatgatagttgaaatattcttagaaggggtgtgtatgtctagctgtgtctaccatgtgtatgtattcttgacaagcagtataaaatacctgtgatttttctttacattagggataatgcataaggaattaatcttcatatatattatcatccctaatgtagcagggggaagtatttaattgcccatgatatgtattttacttatactatgccagagaggaaactataaagtaattacacatgtaatcttgggtttttcacatatgtaggtattcattttgagtaggttgaagaagaaaaaaaatatttaaatgaattgaattcctgatgggatagtatcaataagtatttaaaagccagtattctaaaaataataaagggtagggtcatttttgagtttgtttttcttttgctattgttaatattcaaaattaaagtgttacattggtacctgttgtcttaatgcatttattgagaacagcattgagatgatgaacaaggggttagcaatagcaaactctataattattttgactaattacttaagaggaaaacagtataagtatctcattcagtatttagcaattctgtaaaataagtattatctctatttttcagatgaggaagtaagggtttagcaaggttaagagatctatccaatttacacagcaagttagtagttgagcctgaccatgagtcttctgactctgttcttttcactatgcaatacgcaaacaataaaatgttatacaaatggaatataaagttatttattctttaaaaatgcacatatgatatgatttcagtaagtgtgtggctgtttattttggctatgttaagaatacgggatacagtagatgacaggggaaccatcctcaaaacaggggacatttacatgatggataagaaagccagaatcctccttttcttactgaatcctggcagccagatctttaccatcccatggtggaataccgaagagtcttctctgtgaaatctgaccaatgcaagtgaaaaggcctcattaagatcttgatgtcagacatgtcccggctaaactgcccagctagatgacactacagtgaaaatcatagttggcaatcccaccatcccacgcattatgtctagaccttgcagttagtcttttagtcctgtgctcttaaaaatgagcaaacaaccaaggattacaaataaatgaaagagaaaaaacagtctggggaaaacagaggaaacaggctatgaagggtaaggagaacatcaaaagaaaaagtattttcagaaggatgttgcaaccatgagtgagtcaagggcagggtacttttaaaaagttgggtttcaaaaaaacaaaaagagctcttagaaaataatatgacagcatag

SEQ ID NO: 357000 - DNA, 596 bp, Homo sapiens
gctgaagaaaagccttggaggaagtagaccaaattttaaacaggagctgtttttgagtggtgggactattggtaattttttaaacacttttgtgtcttatctatatttttctttaatgggaaaatgagtttgctcagcattttattggaaatattttgttttttagttttgataaaagtatggttgataagcaattaacatagtaccaagtaattttaatgtaattaacaagcttttaattaacaagatttttgtttttattttatttttaggccagaaatgtacacacaggagagctggctgcagtaaaaatcattaaattggagcctggagatgatttttctttgattcaacaagaaatatttatggttaaagaatgtaaacattgtaacatcgttgcctactttgggagttatcttaggtaagagaaaaaaaagcatcatctctctctgtattttatatattctttgctactacactctctcccttgtatgtaagtgctactatatttgtatgtttttaaacactgcaaagttctaaattttttaaggttttcctatttctacggttttcccctattacatattaataatggt

SEQ ID NO: 357001 - DNA, 499 bp, Homo sapiens
taatcccggctacttgggaggcggaggcaagtgaatcacttgaacccaggagatggcagctgcagtgagccaaaatcactgccactgcactccagcctgggcagtgagactctgtctcaaaaacaaaaacaaatctttaaaatatagtaaacattgatttacttatctaggtttttttctccccaaaaaagacattctagtttttcttattcaataagaatttaagtagaaaatttaggagtcacatttacagttttgctgatacattctttttttttttttttaaacttttagggtcttgcctatttgcatactaaaggcaaaatgcatagagatatcaaaggtgctaatattttattgacagaccatggcgatgtaaaattagctgactttggtgtggctgcaaaaataacagctaccattgcaaaacgaaaatctttcattggcaccccttactggtaagacattactgtgattgaatttgatccattttcatttc

SEQ ID NO: 357002 - DNA, 4926 bp, Homo sapiens
ggcgccgacccatgctggctgggaacgtgtctcccggtgacgcagccccgggtggggaacgtggtgcggcggcggcggcggcggcgactgtacgcgcctccgccgcccccgagaggacgcgccgtgcagcggctgagtggcggcggcggcgacggcaaacccggagctgccggccggcgcgcgggaggaggacgcgggtgcggtctaggaaacggagctgcgggcggaggctccatgttgggaagcggcgccgttcgtgcttgttagcgggaatccgggagccgcggggtgagctggcgggggccgggccctaagtgaagatggaggccccgctgcggcctgccgcggacatcctgaggcggaacccgcagcaggactacgaactcgtccagagggtcggcagcggcacctacggggacgtctataaggccagaaatgtacacacaggagagctggctgcagtaaaaatcattaaattggagcctggagatgatttttctttgattcaacaagaaatatttatggttaaagaatgtaaacattgtaacatcgttgcctactttgggagttatcttagtcgggaaaaactatggatttgtatggaatactgtggtggcggatcacttcaagatatttaccatgttactggaccattatcagaattgcaaatagcctatgtatgcagagaaaccttacagggtcttgcctatttgcatactaaaggcaaaatgcatagagatatcaaaggtgctaatattttattgacagaccatggcgatgtaaaattagctgactttggtgtggctgcaaaaataacagctaccattgcaaaacgaaaatctttcattggcaccccttactggatggccccagaagttgcagcagtagagaagaatggtggctacaaccaactctgtgatatctgggcagtaggaataacagcaattgaacttggagaacttcagccacctatgtttgatctccacccaatgagggctctcttcttaatgtcaaaaagtaattttcagcctccaaaactaaaggacaaaacaaaatggtcatcaacattccataattttgtcaaaatagcactaaccaaaaacccaaaaaaaagaccaactgctgaaagacttctgactcacacttttgttgcacagccaggtctctctagagccctagcagttgaactgttagacaaagtgaacaatccagataaccacgcacattacactgaagcagatgacgatgactttgagccccatgcaatcattcgtcataccattagatctacaaacaggaatgccagagctgaacggacagcttcagaaataaattttgacaaattacaatttgaacctcctctgagaaaagaaacagaagcacgagatgaaatgggattgtcatcagacccaaatttcatgttacagtggaatccttttgttgatggtgcaaatactggcaaatcaacctcaaaacgtgcaataccacctcccctacctcctaagccaaggataagcagttaccctgaagacaactttccggatgaagaaaaagcatcaaccataaaacattgtcctgattcagaaagcagagctccccaaattctcagaagacagagtagcccaagttgtgggcctgtggcagagacttcttctattggaaatggtgatggtatttcaaaactgatgagtgaaaatacagaaggatcagcacaagcaccacagttaccacgaaaaaaggacaaacgagacttccctaaaccagccatcaatggccttccacccaccccaaaagttctgatgggagcatgcttttcaaaagtttttgatggctgtcctttgaaaattaattgtgcaacatcctggatacatcctgatacaaaagatcagtacattatttttggaactgaagatggtatttacacactgaatctcaatgagctacatgaggcaacgatggaacagttatttccacggaagtgtacttggctgtatgttatcaataatactttaatgtcattatcagaaggaaaaacctttcagctctactctcacaatcttatagctttgtttgaacatgccaaaaaaccaggattagctgcccatattcaaactcacaggtttccagaccgaatactaccaagaaaattcgctttaacaacaaagattcctgatacaaaaggctgccacaaatgttgcatagtcagaaacccttacacgggacataaatacctctgtggagctttacagtctggaattgttttacttcagtggtatgagccaatgcagaaattcatgttgataaagcactttgattttcctttgccaagtcctttgaatgtttttgaaatgctggtgatacctgaacaggaataccctatggtctgtgtagctattagcaaaggcactgaatcgaatcaggtagttcagtttgagacaatcaatttgaactctgcatcttcatggtttacagaaattggtgcaggcagccagcagttagattccattcatgtaacacagttggagagagataccgttttagtgtgtttagacaaatttgtgaaaattgtaaatctacaaggaaaattaaaatcaagtaagaaactggcctctgagttaagttttgattttcgcattgaatctgtagtatgccttcaagacagtgtgttggctttctggaaacatgggatgcagggtaaaagcttcaagtcagatgaggttacccaggagatttcagatgaaacaagagttttccgcttattaggatcagacagggttgtcgttttggaaagtaggccaacagaaaatcctactgcacacagcaatctctacatcttggctggacatgaaaatagttactaagcaacagaaactgatctcaaatgacaggaaaatgaatatactccattgaaaggaaaaataaggaaattcaatacaaactgcactatgatttgctttaactattatgggttatattgcaaatgatctgtactttagggtagaattcaatattttctgcagctggaaacagctagtctatctcttgccactgtgtggtggttatatcaagtttgcttaataaaagctatgagacaaatagtcctctagttccaggaaacacagtctttttttaaaaaaaacaatgtttgtaacaagggtgccatggtatttttagataactcgtgattatcttaagagaggtaaatttagtgatcattttatatcatgtcttattccttcttaatgaacataatttgttaaattctcaagcaaggttttcacttttatattggccattctgtatgtttttgtatctaacttttagcaaaggagggttgcagagcagcttaaattttttttataatgtataagaattttgtttatcttttaagagtagtaaagtactttgagtgtttgggggttcaacacacacatgcaattttgcttaacaaaagtattttataatacagtttcatacagaattaccttaaaagggagtcttatgttttcaactacagatagttgtaagggatcatacagaagatattgatgatagttgaaatattcttagaaggggtgtgtatgtctagctgtgtctaccatgtgtatgtattcttgacaagcagtataaaatacctgtgatttttctttacattagggataatgcataaggaattaatcttcatatatattatcatccctaatgtagcagggggaagtatttaattgcccatgatatgtattttacttatactatgccagagaggaaactataaagtaattacacatgtaatcttgggtttttcacatatgtaggtattcattttgagtaggttgaagaagaaaaaaaatatttaaatgaattgaattcctgatgggatagtatcaataagtatttaaaagccagtattctaaaaataataaagggtagggtcatttttgagtttgtttttcttttgctattgttaatattcaaaattaaagtgttacattggtacctgttgtcttaatgcatttattgagaacagcattgagatgatgaacaaggggttagcaatagcaaactctataattattttgactaattacttaagaggaaaacagtataagtatctcattcagtatttagcaattctgtaaaataagtattatctctatttttcagatgaggaagtaagggtttagcaaggttaagagatctatccaatttacacagcaagttagtagttgagcctgaccatgagtcttctgactctgttcttttcactatgcaatacgcaaacaataaaatgttatacaaatggaatataaagttatttattctttaaaaatgcacatatgatatgatttcagtaagtgtgtggctgtttattttggctatgttaagaatacgggatacagtagatgacaggggaaccatcctcaaaacaggggacatttacatgatggataagaaagccagaatcctccttttcttactgaatcctggcagccagatctttaccatcccatggtggaataccgaagagtcttctctgtgaaatctgaccaatgcaagtgaaaaggcctcattaagatcttgatgtcagacatgtcccggctaaactgcccagctagatgacactacagtgaaaatcatagttggcaatcccaccatcccacgcattatgtctagaccttgcagttagtcttttagtcctgtgctcttaaaaatgagcaaacaaccaaggattacaaataaatgaaagagaaaaaacagtctggggaaaacagaggaaacaggctatgaagggtaaggagaacatcaaaagaaaaagtattttcagaaggatgttgcaaccatgagtgagtcaagggcagggtacttttaaaaagttgggtttcaaaaaaacaaaaagagctcttagaaaataatatgacagcatag

SEQ ID NO: 357003 - DNA, 4050 bp, Homo sapiens
ggcgccgacccatgctggctgggaacgtgtctcccggtgacgcagccccgggtggggaacgtggtgcggcggcggcggcggcggcgactgtacgcgcctccgccgcccccgagaggacgcgccgtgcagcggctgagtggcggcggcggcgacggcaaacccggagctgccggccggcgcgcgggaggaggacgcgggtgcggtctaggaaacggagctgcgggcggaggctccatgttgggaagcggcgccgttcgtgcttgttagcgggaatccgggagccgcggggtgagctggcgggggccgggccctaagtgaagatggaggccccgctgcggcctgccgcggacatcctgaggcggaacccgcagcaggactacgaactcgtccagagggtcggcagcggcacctacggggacgtctataaggccagaaatgtacacacaggagagctggctgcagtaaaaatcattaaattggagcctggagatgatttttctttgattcaacaagaaatatttatggttaaagaatgtaaacattgtaacatcgttgcctactttgggagttatcttagtcgggaaaaactatggatttgtatggaatactgtggtggcggatcacttcaagatatttaccatgttactggaccattatcagaattgcaaatagcctatgtatgcagagaaaccttacagggtcttgcctatttgcatactaaaggcaaaatgcatagagatatcaaaggtgctaatattttattgacagaccatggcgatgtaaaattagctgactttggtgtggctgcaaaaataacagctaccattgcaaaacgaaaatctttcattggcaccccttactggatggccccagaagttgcagcagtagagaagaatggtggctacaaccaactctgtgatatctgggcagtaggaataacagcaattgaacttggagaacttcagccacctatgtttgatctccacccaatgagggctctcttcttaatgtcaaaaagtaattttcagcctccaaaactaaaggacaaaacaaaatggtcatcaacattccataattttgtcaaaatagcactaaccaaaaacccaaaaaaaagaccaactgctgaaagacttctgactcacacttttgttgcacagccaggtctctctagagccctagcagttgaactgttagacaaagtgaacaatccagataaccacgcacattacactgaagcagatgacgatgactttgagccccatgcaatcattcgtcataccattagatctacaaacaggaatgccagagctgaacggacagcttcagaaataaattttgacaaattacaatttgaacctcctctgagaaaagaaacagaagcacgagatgaaatgggattgtcatcagacccaaatttcatgttacagtggaatccttttgttgatggtgcaaatactggcaaatcaacctcaaaacgtgcaataccacctcccctacctcctaagccaaggataagcagttaccctgaagacaactttccggatgaagaaaaagcatcaaccataaaacattgtcctgattcagaaagcagagctccccaaattctcagaagacagagtagcccaagttgtgggcctgtggcagagacttcttctattggaaatggtgatggtatttcaaaactgatgagtgaaaatacagaaggatcagcacaagcaccacagttaccacgaaaaaaggacaaacgagacttccctaaaccagccatcaatggccttccacccaccccaaaagttctgatgggagcatgcttttcaaaagtttttgatggctgtcctttgaaaattaattgtgcaacatcctggatacatcctgatacaaaagatcagtacattatttttggaactgaagatggtatttacacactgaatctcaatgagctacatgaggcaacgatggaacagttatttccacggaagtgtacttggctgtatgttatcaataatactttaatgtcattatcagaaggaaaaacctttcagctctactctcacaatcttatagctttgtttgaacatgccaaaaaaccaggattagctgcccatattcaaactcacaggtttccagaccgaatactaccaagaaaattcgctttaacaacaaagattcctgatacaaaaggctgccacaaatgttgcatagtcagaaacccttacacgggacataaatacctctgtggagctttacagtctggaattgttttacttcagtggtatgagccaatgcagaaattcatgttgataaagcactttgattttcctttgccaagtcctttgaatgtttttgaaatgctggtgatacctgaacaggaataccctatggtctgtgtagctattagcaaaggcactgaatcgaatcaggtagttcagtttgagacaatcaatttgaactctgcatcttcatggtttacagaaattggtgcaggcagccagcagttagattccattcatgtaacacagttggagagagataccgttttagtgtgtttagacaaatttgtgaaaattgtaaatctacaaggaaaattaaaatcaagtaagaaactggcctctgagttaagttttgattttcgcattgaatctgtagtatgccttcaagacagtgtgttggctttctggaaacatgggatgcagggtaaaagcttcaagtcagatgaggttacccaggagatttcagatgaaacaagagttttccgcttattaggatcagacagggttgtcgttttggaaagtaggccaacagaaaatcctactgcacacagcaatctctacatcttggctggacatgaaaatagttactaagcaacagaaactgatctcaaatgacaggaaaatgaatatactccattgaaaggaaaaataaggaaattcaatacaaactgcactatgatttgctttaactattatgggttatattgcaaatgatctgtactttagggtagaattcaatattttctgcagctggaaacagctagtctatctcttgccactgtgtggtggttatatcaagtttgcttaataaaagctatgagacaaatagtcctctagttccaggaaacacagtctttttttaaaaaaaacaatgtttgtaacaagggtgccatggtatttttagataactcgtgattatcttaagagaggtaaatttagtgatcattttatatcatgtcttattccttcttaatgaacataatttgttaaattctcaagcaaggttttcacttttatattggccattctgtatgtttttgtaaaacagaatatttaatccttatttattaatctcttgctggagtggtgtaatgtatctaacttttagcaaaggagggttgcagagcagcttaaattttttttataatgtataagaattttgtttatcttttaagagtagtaaagtactttgagtgtttgggggttcaacacacacatgcaattttgcttaacaaaagtattttataatacagtttcatacagaattaccttaaaagggagtcttatgttttcaactacagatagttgtaagggatcatacagaagatattgatgatagttgaaatattcttagaaggggtgtgtatgtctagctgtgtctaccatgtgtatgtattcttgacaagcagtataaaatacctgtgatttttctttacattagggataatgcataaggaattaatcttcatatatattatcatccctaatgtagcagggggaagtatttaattgcccatgatatgtattttacttatactatgccagagaggaaactataaagtaattacacatgtaatcttgggtttttcacatatgtaggtattcattttgagtaggttgaagaagaaaaaaaatatttaaatgaattgaattcctgatgggatagtatcaataagtatttaaaagccagtattctaaaaataataaagggtagggtcatttttgagtttgtttttcttttgctattgttaatattcaaaattaaagtgttacattggta

SEQ ID NO: 357004 - DNA, 5028 bp, Homo sapiens
ggcgccgacccatgctggctgggaacgtgtctcccggtgacgcagccccgggtggggaacgtggtgcggcggcggcggcggcggcgactgtacgcgcctccgccgcccccgagaggacgcgccgtgcagcggctgagtggcggcggcggcgacggcaaacccggagctgccggccggcgcgcgggaggaggacgcgggtgcggtctaggaagtaggtcccgggctccgcgctcaacaaagacggggccgcccccattagacggagctgcgggcggaggctccatgttgggaagcggcgccgttcgtgcttgttagcgggaatccgggagccgcggggtgagctggcgggggccgggccctaagtgaagatggaggccccgctgcggcctgccgcggacatcctgaggcggaacccgcagcaggactacgaactcgtccagagggtcggcagcggcacctacggggacgtctataaggccagaaatgtacacacaggagagctggctgcagtaaaaatcattaaattggagcctggagatgatttttctttgattcaacaagaaatatttatggttaaagaatgtaaacattgtaacatcgttgcctactttgggagttatcttagtcgggaaaaactatggatttgtatggaatactgtggtggcggatcacttcaagatatttaccatgttactggaccattatcagaattgcaaatagcctatgtatgcagagaaaccttacagggtcttgcctatttgcatactaaaggcaaaatgcatagagatatcaaaggtgctaatattttattgacagaccatggcgatgtaaaattagctgactttggtgtggctgcaaaaataacagctaccattgcaaaacgaaaatctttcattggcaccccttactggatggccccagaagttgcagcagtagagaagaatggtggctacaaccaactctgtgatatctgggcagtaggaataacagcaattgaacttggagaacttcagccacctatgtttgatctccacccaatgagggctctcttcttaatgtcaaaaagtaattttcagcctccaaaactaaaggacaaaacaaaatggtcatcaacattccataattttgtcaaaatagcactaaccaaaaacccaaaaaaaagaccaactgctgaaagacttctgactcacacttttgttgcacagccaggtctctctagagccctagcagttgaactgttagacaaagtgaacaatccagataaccacgcacattacactgaagcagatgacgatgactttgagccccatgcaatcattcgtcataccattagatctacaaacaggaatgccagagctgaacggacagcttcagaaataaattttgacaaattacaatttgaacctcctctgagaaaagaaacagaagcacgagatgaaatgggattgtcatcagacccaaatttcatgttacagtggaatccttttgttgatggtgcaaatactggcaaatcaacctcaaaacgtgcaataccacctcccctacctcctaagccaaggataagcagttaccctgaagacaactttccggatgaagaaaaagcatcaaccataaaacattgtcctgattcagaaagcagagctccccaaattctcagaagacagagtagcccaagttgtgggcctgtggcagagacttcttctattggaaatggtgatggtatttcaaaactgatgagtgaaaatacagaaggatcagcacaagcaccacagttaccacgaaaaaaggacaaacgagacttccctaaaccagccatcaatggccttccacccaccccaaaagttctgatgggagcatgcttttcaaaagtttttgatggctgtcctttgaaaattaattgtgcaacatcctggatacatcctgatacaaaagatcagtacattatttttggaactgaagatggtatttacacactgaatctcaatgagctacatgaggcaacgatggaacagttatttccacggaagtgtacttggctgtatgttatcaataatactttaatgtcattatcagaaggaaaaacctttcagctctactctcacaatcttatagctttgtttgaacatgccaaaaaaccaggattagctgcccatattcaaactcacaggtttccagaccgaatactaccaagaaaattcgctttaacaacaaagattcctgatacaaaaggctgccacaaatgttgcatagtcagaaacccttacacgggacataaatacctctgtggagctttacagtctggaattgttttacttcagtggtatgagccaatgcagaaattcatgttgataaagcactttgattttcctttgccaagtcctttgaatgtttttgaaatgctggtgatacctgaacaggaataccctatggtctgtgtagctattagcaaaggcactgaatcgaatcaggtagttcagtttgagacaatcaatttgaactctgcatcttcatggtttacagaaattggtgcaggcagccagcagttagattccattcatgtaacacagttggagagagataccgttttagtgtgtttagacaaatttgtgaaaattgtaaatctacaaggaaaattaaaatcaagtaagaaactggcctctgagttaagttttgattttcgcattgaatctgtagtatgccttcaagacagtgtgttggctttctggaaacatgggatgcagggtaaaagcttcaagtcagatgaggttacccaggagatttcagatgaaacaagagttttccgcttattaggatcagacagggttgtcgttttggaaagtaggccaacagaaaatcctactgcacacagcaatctctacatcttggctggacatgaaaatagttactaagcaacagaaactgatctcaaatgacaggaaaatgaatatactccattgaaaggaaaaataaggaaattcaatacaaactgcactatgatttgctttaactattatgggttatattgcaaatgatctgtactttagggtagaattcaatattttctgcagctggaaacagctagtctatctcttgccactgtgtggtggttatatcaagtttgcttaataaaagctatgagacaaatagtcctctagttccaggaaacacagtctttttttaaaaaaaacaatgtttgtaacaagggtgccatggtatttttagataactcgtgattatcttaagagaggtaaatttagtgatcattttatatcatgtcttattccttcttaatgaacataatttgttaaattctcaagcaaggttttcacttttatattggccattctgtatgtttttgtaaaacagaatatttaatccttatttattaatctcttgctggagtggtgtaatgtatctaacttttagcaaaggagggttgcagagcagcttaaattttttttataatgtataagaattttgtttatcttttaagagtagtaaagtactttgagtgtttgggggttcaacacacacatgcaattttgcttaacaaaagtattttataatacagtttcatacagaattaccttaaaagggagtcttatgttttcaactacagatagttgtaagggatcatacagaagatattgatgatagttgaaatattcttagaaggggtgtgtatgtctagctgtgtctaccatgtgtatgtattcttgacaagcagtataaaatacctgtgatttttctttacattagggataatgcataaggaattaatcttcatatatattatcatccctaatgtagcagggggaagtatttaattgcccatgatatgtattttacttatactatgccagagaggaaactataaagtaattacacatgtaatcttgggtttttcacatatgtaggtattcattttgagtaggttgaagaagaaaaaaaatatttaaatgaattgaattcctgatgggatagtatcaataagtatttaaaagccagtattctaaaaataataaagggtagggtcatttttgagtttgtttttcttttgctattgttaatattcaaaattaaagtgttacattggtacctgttgtcttaatgcatttattgagaacagcattgagatgatgaacaaggggttagcaatagcaaactctataattattttgactaattacttaagaggaaaacagtataagtatctcattcagtatttagcaattctgtaaaataagtattatctctatttttcagatgaggaagtaagggtttagcaaggttaagagatctatccaatttacacagcaagttagtagttgagcctgaccatgagtcttctgactctgttcttttcactatgcaatacgcaaacaataaaatgttatacaaatggaatataaagttatttattctttaaaaatgcacatatgatatgatttcagtaagtgtgtggctgtttattttggctatgttaagaatacgggatacagtagatgacaggggaaccatcctcaaaacaggggacatttacatgatggataagaaagccagaatcctccttttcttactgaatcctggcagccagatctttaccatcccatggtggaataccgaagagtcttctctgtgaaatctgaccaatgcaagtgaaaaggcctcattaagatcttgatgtcagacatgtcccggctaaactgcccagctagatgacactacagtgaaaatcatagttggcaatcccaccatcccacgcattatgtctagaccttgcagttagtcttttagtcctgtgctcttaaaaatgagcaaacaaccaaggattacaaataaatgaaagagaaaaaacagtctggggaaaacagaggaaacaggctatgaagggtaaggagaacatcaaaagaaaaagtattttcagaaggatgttgcaaccatgagtgagtcaagggcagggtacttttaaaaagttgggtttcaaaaaaacaaaaagagctcttagaaaataatatgacagcatag

SEQ ID NO: 357005 - DNA, 4886 bp, Homo sapiens
  misc_feature (56)..(56): n is a, c, g, or t
taaggatccggactgttggatgccagaagtgcagcagtagagagaatgtgctacancactctgtgatatctggcgtaggatacagcattgacttggggactcagccacttatgtttgatctccaccaatgagggctctcttcttatgtcaaaagtaatttcagcctccaaaactaaaggacaaaacgaaatggtcattcacattccataatttttgtcaaaatagcactaaccaaaaacccaaaaaaaagaccaactgctgaaagacttctgactcacacttttgttgcacagccaggtctctctagagccctagcagttgaactgttagacaaagtgaacaatccagataaccacgcacattacactgaagcagatgacgatgactttgaggagatgatttttctttgattcaacaagaaatatttatggttaaagaatgtaaacattgtaacatcgttgcctactttgggagttatcttagtcgggaaaaactatggatttgtatggaatactgtggtggcggatcacttcaagatatttaccatgttactggaccattatcagaattgcaaatagcctatgtatgcagagaaaccttacagggtcttgcctatttgcatactaaaggcaaaatgcatagagatatcaaaggtgctaatattttattgacagaccatggcgatgtaaaattagctgactttggtgtggctgcaaaaataacagctaccattgcaaaacgaaaatctttcattggcaccccttactggatggccccagaagttgcagcagtagagaagaatggtggctacaaccaactctgtgatatctgggcagtaggaataacagcaattgaacttggagaacttcagccacctatgtttgatctccacccaatgagggctctcttcttaatgtcaaaaagtaattttcagcctccaaaactaaaggacaaaacaaaatggtcatcaacattccataattttgtcaaaatagcactaaccaaaaacccaaaaaaaagaccaactgctgaaagacttctgactcacacttttgttgcacagccaggtctctctagagccctagcagttgaactgttagacaaagtgaacaatccagataaccacgcacattacactgaagcagatgacgatgactttgagccccatgcaatcattcgtcataccattagatctacaaacaggaatgccagagctgaacggacagcttcagaaataaattttgacaaattacaatttgaacctcctctgagaaaagaaacagaagcacgagatgaaatgggattgtcatcagacccaaatttcatgttacagtggaatccttttgttgatggtgcaaatactggcaaatcaacctcaaaacgtgcaataccacctcccctacctcctaagccaaggataagcagttaccctgaagacaactttccggatgaagaaaaagcatcaaccataaaacattgtcctgattcagaaagcagagctccccaaattctcagaagacagagtagcccaagttgtgggcctgtggcagagacttcttctattggaaatggtgatggtatttcaaaactgatgagtgaaaatacagaaggatcagcacaagcaccacagttaccacgaaaaaaggacaaacgagacttccctaaaccagccatcaatggccttccacccaccccaaaagttctgatgggagcatgcttttcaaaagtttttgatggctgtcctttgaaaattaattgtgcaacatcctggatacatcctgatacaaaagatcagtacattatttttggaactgaagatggtatttacacactgaatctcaatgagctacatgaggcaacgatggaacagttatttccacggaagtgtacttggctgtatgttatcaataatactttaatgtcattatcagaaggaaaaacctttcagctctactctcacaatcttatagctttgtttgaacatgccaaaaaaccaggattagctgcccatattcaaactcacaggtttccagaccgaatactaccaagaaaattcgctttaacaacaaagattcctgatacaaaaggctgccacaaatgttgcatagtcagaaacccttacacgggacataaatacctctgtggagctttacagtctggaattgttttacttcagtggtatgagccaatgcagaaattcatgttgataaagcactttgattttcctttgccaagtcctttgaatgtttttgaaatgctggtgatacctgaacaggaataccctatggtctgtgtagctattagcaaaggcactgaatcgaatcaggtagttcagtttgagacaatcaatttgaactctgcatcttcatggtttacagaaattggtgcaggcagccagcagttagattccattcatgtaacacagttggagagagataccgttttagtgtgtttagacaaatttgtgaaaattgtaaatctacaaggaaaattaaaatcaagtaagaaactggcctctgagttaagttttgattttcgcattgaatctgtagtatgccttcaagacagtgtgttggctttctggaaacatgggatgcagggtaaaagcttcaagtcagatgaggttacccaggagatttcagatgaaacaagagttttccgcttattaggatcagacagggttgtcgttttggaaagtaggccaacagaaaatcctactgcacacagcaatctctacatcttggctggacatgaaaatagttactaagcaacagaaactgatctcaaatgacaggaaaatgaatatactccattgaaaggaaaaataaggaaattcaatacaaactgcactatgatttgctttaactattatgggttatattgcaaatgatctgtactttagggtagaattcaatattttctgcagctggaaacagctagtctatctcttgccactgtgtggtggttatatcaagtttgcttaataaaagctatgagacaaatagtcctctagttccaggaaacacagtctttttttaaaaaaaacaatgtttgtaacaagggtgccatggtatttttagataactcgtgattatcttaagagaggtaaatttagtgatcattttatatcatgtcttattccttcttaatgaacataatttgttaaattctcaagcaaggttttcacttttatattggccattctgtatgtttttgtaaaacagaatatttaatccttatttattaatctcttgctggagtggtgtaatgtatctaacttttagcaaaggagggttgcagagcagcttaaattttttttataatgtataagaattttgtttatcttttaagagtagtaaagtactttgagtgtttgggggttcaacacacacatgcaattttgcttaacaaaagtattttataatacagtttcatacagaattaccttaaaagggagtcttatgttttcaactacagatagttgtaagggatcatacagaagatattgatgatagttgaaatattcttagaaggggtgtgtatgtctagctgtgtctaccatgtgtatgtattcttgacaagcagtataaaatacctgtgatttttctttacattagggataatgcataaggaattaatcttcatatatattatcatccctaatgtagcagggggaagtatttaattgcccatgatatgtattttacttatactatgccagagaggaaactataaagtaattacacatgtaatcttgggtttttcacatatgtaggtattcattttgagtaggttgaagaagaaaaaaaatatttaaatgaattgaattcctgatgggatagtatcaataagtatttaaaagccagtattctaaaaataataaagggtagggtcatttttgagtttgtttttcttttgctattgttaatattcaaaattaaagtgttacattggtacctgttgtcttaatgcatttattgagaacagcattgagatgatgaacaaggggttagcaatagcaaactctataattattttgactaattacttaagaggaaaacagtataagtatctcattcagtatttagcaattctgtaaaataagtattatctctatttttcagatgaggaagtaagggtttagcaaggttaagagatctatccaatttacacagcaagttagtagttgagcctgaccatgagtcttctgactctgttcttttcactatgcaatacgcaaacaataaaatgttatacaaatggaatataaagttatttattctttaaaaatgcacatatgatatgatttcagtaagtgtgtggctgtttattttggctatgttaagaatacgggatacagtagatgacaggggaaccatcctcaaaacaggggacatttacatgatggataagaaagccagaatcctccttttcttactgaatcctggcagccagatctttaccatcccatggtggaataccgaagagtcttctctgtgaaatctgaccaatgcaagtgaaaaggcctcattaagatcttgatgtcagacatgtcccggctaaactgcccagctagatgacactacagtgaaaatcatagttggcaatcccaccatcccacgcattatgtctagaccttgcagttagtcttttagtcctgtgctcttaaaaatgagcaaacaaccaaggattacaaataaatgaaagagaaaaaacagtctggggaaaacagaggaaacaggctatgaagggtaaggagaacatcaaaagaaaaagtattttcagaaggatgttgcaaccatgagtgagtcaagggcagggtacttttaaaaagttgggtttcaaaaaaacaaaaagagctcttagaaaataatatgacagcatag

SEQ ID NO: 357006 - DNA, 4795 bp, Homo sapiens
  misc_feature (56)..(56): n is a, c, g, or t
taaggatccggactgttggatgccagaagtgcagcagtagagagaatgtgctacancactctgtgatatctggcgtaggatacagcattgacttggggactcagccacttatgtttgatctccaccaatgagggctctcttcttatgtcaaaagtaatttcagcctccaaaactaaaggacaaaacgaaatggtcattcacattccataatttttgtcaaaatagcactaaccaaaaacccaaaaaaaagaccaactgctgaaagacttctgactcacacttttgttgcacagccaggtctctctagagccctagcagttgaactgttagacaaagtgaacaatccagataaccacgcacattacactgaagcagatgacgatgactttgaggagatgatttttctttgattcaacaagaaatatttatggttaaagaatgtaaacattgtaacatcgttgcctactttgggagttatcttagtcgggaaaaactatggatttgtatggaatactgtggtggcggatcacttcaagatatttaccatgttactggaccattatcagaattgcaaatagcctatgtatgcagagaaaccttacagctgactttggtgtggctgcaaaaataacagctaccattgcaaaacgaaaatctttcattggcaccccttactggatggccccagaagttgcagcagtagagaagaatggtggctacaaccaactctgtgatatctgggcagtaggaataacagcaattgaacttggagaacttcagccacctatgtttgatctccacccaatgagggctctcttcttaatgtcaaaaagtaattttcagcctccaaaactaaaggacaaaacaaaatggtcatcaacattccataattttgtcaaaatagcactaaccaaaaacccaaaaaaaagaccaactgctgaaagacttctgactcacacttttgttgcacagccaggtctctctagagccctagcagttgaactgttagacaaagtgaacaatccagataaccacgcacattacactgaagcagatgacgatgactttgagccccatgcaatcattcgtcataccattagatctacaaacaggaatgccagagctgaacggacagcttcagaaataaattttgacaaattacaatttgaacctcctctgagaaaagaaacagaagcacgagatgaaatgggattgtcatcagacccaaatttcatgttacagtggaatccttttgttgatggtgcaaatactggcaaatcaacctcaaaacgtgcaataccacctcccctacctcctaagccaaggataagcagttaccctgaagacaactttccggatgaagaaaaagcatcaaccataaaacattgtcctgattcagaaagcagagctccccaaattctcagaagacagagtagcccaagttgtgggcctgtggcagagacttcttctattggaaatggtgatggtatttcaaaactgatgagtgaaaatacagaaggatcagcacaagcaccacagttaccacgaaaaaaggacaaacgagacttccctaaaccagccatcaatggccttccacccaccccaaaagttctgatgggagcatgcttttcaaaagtttttgatggctgtcctttgaaaattaattgtgcaacatcctggatacatcctgatacaaaagatcagtacattatttttggaactgaagatggtatttacacactgaatctcaatgagctacatgaggcaacgatggaacagttatttccacggaagtgtacttggctgtatgttatcaataatactttaatgtcattatcagaaggaaaaacctttcagctctactctcacaatcttatagctttgtttgaacatgccaaaaaaccaggattagctgcccatattcaaactcacaggtttccagaccgaatactaccaagaaaattcgctttaacaacaaagattcctgatacaaaaggctgccacaaatgttgcatagtcagaaacccttacacgggacataaatacctctgtggagctttacagtctggaattgttttacttcagtggtatgagccaatgcagaaattcatgttgataaagcactttgattttcctttgccaagtcctttgaatgtttttgaaatgctggtgatacctgaacaggaataccctatggtctgtgtagctattagcaaaggcactgaatcgaatcaggtagttcagtttgagacaatcaatttgaactctgcatcttcatggtttacagaaattggtgcaggcagccagcagttagattccattcatgtaacacagttggagagagataccgttttagtgtgtttagacaaatttgtgaaaattgtaaatctacaaggaaaattaaaatcaagtaagaaactggcctctgagttaagttttgattttcgcattgaatctgtagtatgccttcaagacagtgtgttggctttctggaaacatgggatgcagggtaaaagcttcaagtcagatgaggttacccaggagatttcagatgaaacaagagttttccgcttattaggatcagacagggttgtcgttttggaaagtaggccaacagaaaatcctactgcacacagcaatctctacatcttggctggacatgaaaatagttactaagcaacagaaactgatctcaaatgacaggaaaatgaatatactccattgaaaggaaaaataaggaaattcaatacaaactgcactatgatttgctttaactattatgggttatattgcaaatgatctgtactttagggtagaattcaatattttctgcagctggaaacagctagtctatctcttgccactgtgtggtggttatatcaagtttgcttaataaaagctatgagacaaatagtcctctagttccaggaaacacagtctttttttaaaaaaaacaatgtttgtaacaagggtgccatggtatttttagataactcgtgattatcttaagagaggtaaatttagtgatcattttatatcatgtcttattccttcttaatgaacataatttgttaaattctcaagcaaggttttcacttttatattggccattctgtatgtttttgtaaaacagaatatttaatccttatttattaatctcttgctggagtggtgtaatgtatctaacttttagcaaaggagggttgcagagcagcttaaattttttttataatgtataagaattttgtttatcttttaagagtagtaaagtactttgagtgtttgggggttcaacacacacatgcaattttgcttaacaaaagtattttataatacagtttcatacagaattaccttaaaagggagtcttatgttttcaactacagatagttgtaagggatcatacagaagatattgatgatagttgaaatattcttagaaggggtgtgtatgtctagctgtgtctaccatgtgtatgtattcttgacaagcagtataaaatacctgtgatttttctttacattagggataatgcataaggaattaatcttcatatatattatcatccctaatgtagcagggggaagtatttaattgcccatgatatgtattttacttatactatgccagagaggaaactataaagtaattacacatgtaatcttgggtttttcacatatgtaggtattcattttgagtaggttgaagaagaaaaaaaatatttaaatgaattgaattcctgatgggatagtatcaataagtatttaaaagccagtattctaaaaataataaagggtagggtcatttttgagtttgtttttcttttgctattgttaatattcaaaattaaagtgttacattggtacctgttgtcttaatgcatttattgagaacagcattgagatgatgaacaaggggttagcaatagcaaactctataattattttgactaattacttaagaggaaaacagtataagtatctcattcagtatttagcaattctgtaaaataagtattatctctatttttcagatgaggaagtaagggtttagcaaggttaagagatctatccaatttacacagcaagttagtagttgagcctgaccatgagtcttctgactctgttcttttcactatgcaatacgcaaacaataaaatgttatacaaatggaatataaagttatttattctttaaaaatgcacatatgatatgatttcagtaagtgtgtggctgtttattttggctatgttaagaatacgggatacagtagatgacaggggaaccatcctcaaaacaggggacatttacatgatggataagaaagccagaatcctccttttcttactgaatcctggcagccagatctttaccatcccatggtggaataccgaagagtcttctctgtgaaatctgaccaatgcaagtgaaaaggcctcattaagatcttgatgtcagacatgtcccggctaaactgcccagctagatgacactacagtgaaaatcatagttggcaatcccaccatcccacgcattatgtctagaccttgcagttagtcttttagtcctgtgctcttaaaaatgagcaaacaaccaaggattacaaataaatgaaagagaaaaaacagtctggggaaaacagaggaaacaggctatgaagggtaaggagaacatcaaaagaaaaagtattttcagaaggatgttgcaaccatgagtgagtcaagggcagggtacttttaaaaagttgggtttcaaaaaaacaaaaagagctcttagaaaataatatgacagcatag

SEQ ID NO: 357007 - DNA, 3954 bp, Homo sapiens
gaattttatattctacgaacatacaagacacgcagcactaccctcttaaccaccaatggaagatgtaaacctataactcgtaaaaaagaccaactgctgaaagacttctgactcacacttttgttgcacagccaggtctctctagagccctagcagttgaactgttagacaaagtgaacaatccagataaccacgcacattacactgaagcagatgacgatgactttgagccccatgcaatcattcgtcataccattagatctacaaacaggaatgccagagctgaacggacagcttcagaaataaattttgacaaattacaatttgaacctcctctgagaaaagaaacagaagcacgagatgaaatgggattgtcatcagacccaaatttcatgttacagtggaatccttttgttgatggtgcaaatactggcaaatcaacctcaaaacgtgcaataccacctcccctacctcctaagccaaggataagcagttaccctgaagacaactttccggatgaagaaaaagcatcaaccataaaacattgtcctgattcagaaagcagagctccccaaattctcagaagacagagtagcccaagttgtgggcctgtggcagagacttcttctattggaaatggtgatggtatttcaaaactgatgagtgaaaatacagaaggatcagcacaagcaccacagttaccacgaaaaaaggacaaacgagacttccctaaaccagccatcaatggccttccacccaccccaaaagttctgatgggagcatgcttttcaaaagtttttgatggctgtcctttgaaaattaattgtgcaacatcctggatacatcctgatacaaaagatcagtacattatttttggaactgaagatggtatttacacactgaatctcaatgagctacatgaggcaacgatggaacagttatttccacggaagtgtacttggctgtatgttatcaataatactttaatgtcattatcagaaggaaaaacctttcagctctactctcacaatcttatagctttgtttgaacatgccaaaaaaccaggattagctgcccatattcaaactcacaggtttccagaccgaatactaccaagaaaattcgctttaacaacaaagattcctgatacaaaaggctgccacaaatgttgcatagtcagaaacccttacacgggacataaatacctctgtggagctttacagtctggaattgttttacttcagtggtatgagccaatgcagaaattcatgttgataaagcactttgattttcctttgccaagtcctttgaatgtttttgaaatgctggtgatacctgaacaggaataccctatggtctgtgtagctattagcaaaggcactgaatcgaatcaggtagttcagtttgagacaatcaatttgaactctgcatcttcatggtttacagaaattggtgcaggcagccagcagttagattccattcatgtaacacagttggagagagataccgttttagtgtgtttagacaaatttgtgaaaattgtaaatctacaaggaaaattaaaatcaagtaagaaactggcctctgagttaagttttgattttcgcattgaatctgtagtatgccttcaagacagtgtgttggctttctggaaacatgggatgcagggtaaaagcttcaagtcagatgaggttacccaggagatttcagatgaaacaagagttttccgcttattaggatcagacagggttgtcgttttggaaagtaggccaacagaaaatcctactgcacacagcaatctctacatcttggctggacatgaaaatagttactaagcaacagaaactgatctcaaatgacaggaaaatgaatatactccattgaaaggaaaaataaggaaattcaatacaaactgcactatgatttgctttaactattatgggttatattgcaaatgatctgtactttagggtagaattcaatattttctgcagctggaaacagctagtctatctcttgccactgtgtggtggttatatcaagtttgcttaataaaagctatgagacaaatagtcctctagttccaggaaacacagtctttttttaaaaaaaacaatgtttgtaacaagggtgccatggtatttttagataactcgtgattatcttaagagaggtaaatttagtgatcattttatatcatgtcttattccttcttaatgaacataatttgttaaattctcaagcaaggttttcacttttatattggccattctgtatgtttttgtaaaacagaatatttaatccttatttattaatctcttgctggagtggtgtaatgtatctaacttttagcaaaggagggttgcagagcagcttaaattttttttataatgtataagaattttgtttatcttttaagagtagtaaagtactttgagtgtttgggggttcaacacacacatgcaattttgcttaacaaaagtattttataatacagtttcatacagaattaccttaaaagggagtcttatgttttcaactacagatagttgtaagggatcatacagaagatattgatgatagttgaaatattcttagaaggggtgtgtatgtctagctgtgtctaccatgtgtatgtattcttgacaagcagtataaaatacctgtgatttttctttacattagggataatgcataaggaattaatcttcatatatattatcatccctaatgtagcagggggaagtatttaattgcccatgatatgtattttacttatactatgccagagaggaaactataaagtaattacacatgtaatcttgggtttttcacatatgtaggtattcattttgagtaggttgaagaagaaaaaaaatatttaaatgaattgaattcctgatgggatagtatcaataagtatttaaaagccagtattctaaaaataataaagggtagggtcatttttgagtttgtttttcttttgctattgttaatattcaaaattaaagtgttacattggtacctgttgtcttaatgcatttattgagaacagcattgagatgatgaacaaggggttagcaatagcaaactctataattattttgactaattacttaagaggaaaacagtataagtatctcattcagtatttagcaattctgtaaaataagtattatctctatttttcagatgaggaagtaagggtttagcaaggttaagagatctatccaatttacacagcaagttagtagttgagcctgaccatgagtcttctgactctgttcttttcactatgcaatacgcaaacaataaaatgttatacaaatggaatataaagttatttattctttaaaaatgcacatatgatatgatttcagtaagtgtgtggctgtttattttggctatgttaagaatacgggatacagtagatgacaggggaaccatcctcaaaacaggggacatttacatgatggataagaaagccagaatcctccttttcttactgaatcctggcagccagatctttaccatcccatggtggaataccgaagagtcttctctgtgaaatctgaccaatgcaagtgaaaaggcctcattaagatcttgatgtcagacatgtcccggctaaactgcccagctagatgacactacagtgaaaatcatagttggcaatcccaccatcccacgcattatgtctagaccttgcagttagtcttttagtcctgtgctcttaaaaatgagcaaacaaccaaggattacaaataaatgaaagagaaaaaacagtctggggaaaacagaggaaacaggctatgaagggtaaggagaacatcaaaagaaaaagtattttcagaaggatgttgcaaccatgagtgagtcaagggcagggtacttttaaaaagttgggtttcaaaaaaacaaaaagagctcttagaaaataatatgacagcatag

SEQ ID NO: 357008 - DNA, 3265 bp, Homo sapiens
gagaaataataatatagctttatagaattttccatcttgtattaaaataatcacatgtacatcattgtaactcagtccataacataagattttgtacaacaatttctttttgtgtgctggcatcattaaggtttagtctgcccagatcacctattagtacctaatttatatattctgaattaaaattatctgttaatttaaaaacattttatctattgtctttcaaaatagtattaactgagggtttttttgtgtgtgtttttctattttgcttggctttttgaacattactggactctcgttttagaagaaggaaaaacctttcagctctactctcacaatcttatagctttgtttgaacatgccaaaaaaccaggattagctgcccatattcaaactcacaggtttccagaccgaatactaccaagaaaattcgctttaacaacaaagattcctgatacaaaaggctgccacaaatgttgcatagtcagaaacccttacacgggacataaatacctctgtggagctttacagtctggaattgttttacttcagtggtatgagccaatgcagaaattcatgttgataaagcactttgattttcctttgccaagtcctttgaatgtttttgaaatgctggtgatacctgaacaggaataccctatggtctgtgtagctattagcaaaggcactgaatcgaatcaggtagttcagtttgagacaatcaatttgaactctgcatcttcatggtttacagaaattggtgcaggcagccagcagttagattccattcatgtaacacagttggagagagataccgttttagtgtgtttagacaaatttgtgaaaattgtaaatctacaaggaaaattaaaatcaagtaagaaactggcctctgagttaagttttgattttcgcattgaatctgtagtatgccttcaagacagtgtgttggctttctggaaacatgggatgcagggtaaaagcttcaagtcagatgaggttacccaggagatttcagatgaaacaagagttttccgcttattaggatcagacagggttgtcgttttggaaagtaggccaacagaaaatcctactgcacacagcaatctctacatcttggctggacatgaaaatagttactaagcaacagaaactgatctcaaatgacaggaaaatgaatatactccattgaaaggaaaaataaggaaattcaatacaaactgcactatgatttgctttaactattatgggttatattgcaaatgatctgtactttagggtagaattcaatattttctgcagctggaaacagctagtctatctcttgccactgtgtggtggttatatcaagtttgcttaataaaagctatgagacaaatagtcctctagttccaggaaacacagtctttttttaaaaaaaacaatgtttgtaacaagggtgccatggtatttttagataactcgtgattatcttaagagaggtaaatttagtgatcattttatatcatgtcttattccttcttaatgaacataatttgttaaattctcaagcaaggttttcacttttatattggccattctgtatgtttttgtaaaacagaatatttaatccttatttattaatctcttgctggagtggtgtaatgtatctaacttttagcaaaggagggttgcagagcagcttaaattttttttataatgtataagaattttgtttatcttttaagagtagtaaagtactttgagtgtttgggggttcaacacacacatgcaattttgcttaacaaaagtattttataatacagtttcatacagaattaccttaaaagggagtcttatgttttcaactacagatagttgtaagggatcatacagaagatattgatgatagttgaaatattcttagaaggggtgtgtatgtctagctgtgtctaccatgtgtatgtattcttgacaagcagtataaaatacctgtgatttttctttacattagggataatgcataaggaattaatcttcatatatattatcatccctaatgtagcagggggaagtatttaattgcccatgatatgtattttacttatactatgccagagaggaaactataaagtaattacacatgtaatcttgggtttttcacatatgtaggtattcattttgagtaggttgaagaagaaaaaaaatatttaaatgaattgaattcctgatgggatagtatcaataagtatttaaaagccagtattctaaaaataataaagggtagggtcatttttgagtttgtttttcttttgctattgttaatattcaaaattaaagtgttacattggtacctgttgtcttaatgcatttattgagaacagcattgagatgatgaacaaggggttagcaatagcaaactctataattattttgactaattacttaagaggaaaacagtataagtatctcattcagtatttagcaattctgtaaaataagtattatctctatttttcagatgaggaagtaagggtttagcaaggttaagagatctatccaatttacacagcaagttagtagttgagcctgaccatgagtcttctgactctgttcttttcactatgcaatacgcaaacaataaaatgttatacaaatggaatataaagttatttattctttaaaaatgcacatatgatatgatttcagtaagtgtgtggctgtttattttggctatgttaagaatacgggatacagtagatgacaggggaaccatcctcaaaacaggggacatttacatgatggataagaaagccagaatcctccttttcttactgaatcctggcagccagatctttaccatcccatggtggaataccgaagagtcttctctgtgaaatctgaccaatgcaagtgaaaaggcctcattaagatcttgatgtcagacatgtcccggctaaactgcccagctagatgacactacagtgaaaatcatagttggcaatcccaccatcccacgcattatgtctagaccttgcagttagtcttttagtcctgtgctcttaaaaatgagcaaacaaccaaggattacaaataaatgaaagagaaaaaacagtctggggaaaacagaggaaacaggctatgaagggtaaggagaacatcaaaagaaaaagtattttcagaaggatgttgcaaccatgagtgagtcaagggcagggtacttttaaaaagttgggtttcaaaaaaacaaaaagagctcttagaaaataatatgacagcatag

SEQ ID NO: 357009 - DNA, 2123 bp, Homo sapiens
agcactttgggaggccaaggagggtggatcacgaggtcaggagattgaggccatcctggctaacacggtgaaaccctgtctctactaaaaataaaaaaattagccgggcgtggtggcaggcgcctgtagtcccagctacttgggaggctgaggcaggagaatggtgtgaacccgggaggcggagcttgccactgtgtggtggttatatcaagtttgcttaataaaagctatgagacaaatagtcctctagttccaggaaacacagtctttttttaaaaaaaacaatgtttgtaacaagggtgccatggtatttttagataactcgtgattatcttaagagaggtaaatttagtgatcattttatatcatgtcttattccttcttaatgaacataatttgttaaattctcaagcaaggttttcacttttatattggccattctgtatgtttttgtaaaacagaatatttaatccttatttattaatctcttgctggagtggtgtaatgtatctaacttttagcaaaggagggttgcagagcagcttaaattttttttataatgtataagaattttgtttatcttttaagagtagtaaagtactttgagtgtttgggggttcaacacacacatgcaattttgcttaacaaaagtattttataatacagtttcatacagaattaccttaaaagggagtcttatgttttcaactacagatagttgtaagggatcatacagaagatattgatgatagttgaaatattcttagaaggggtgtgtatgtctagctgtgtctaccatgtgtatgtattcttgacaagcagtataaaatacctgtgatttttctttacattagggataatgcataaggaattaatcttcatatatattatcatccctaatgtagcagggggaagtatttaattgcccatgatatgtattttacttatactatgccagagaggaaactataaagtaattacacatgtaatcttgggtttttcacatatgtaggtattcattttgagtaggttgaagaagaaaaaaaatatttaaatgaattgaattcctgatgggatagtatcaataagtatttaaaagccagtattctaaaaataataaagggtagggtcatttttgagtttgtttttcttttgctattgttaatattcaaaattaaagtgttacattggtacctgttgtcttaatgcatttattgagaacagcattgagatgatgaacaaggggttagcaatagcaaactctataattattttgactaattacttaagaggaaaacagtataagtatctcattcagtatttagcaattctgtaaaataagtattatctctatttttcagatgaggaagtaagggtttagcaaggttaagagatctatccaatttacacagcaagttagtagttgagcctgaccatgagtcttctgactctgttcttttcactatgcaatacgcaaacaataaaatgttatacaaatggaatataaagttatttattctttaaaaatgcacatatgatatgatttcagtaagtgtgtggctgtttattttggctatgttaagaatacgggatacagtagatgacaggggaaccatcctcaaaacaggggacatttacatgatggataagaaagccagaatcctccttttcttactgaatcctggcagccagatctttaccatcccatggtggaataccgaagagtcttctctgtgaaatctgaccaatgcaagtgaaaaggcctcattaagatcttgatgtcagacatgtcccggctaaactgcccagctagatgacactacagtgaaaatcatagttggcaatcccaccatcccacgcattatgtctagaccttgcagttagtcttttagtcctgtgctcttaaaaatgagcaaacaaccaaggattacaaataaatgaaagagaaaaaacagtctggggaaaacagaggaaacaggctatgaagggtaaggagaacatcaaaagaaaaagtattttcagaaggatgttgcaaccatgagtgagtcaagggcagggtacttttaaaaagttgggtttcaaaaaaacaaaaagagctcttagaaaataatatgacagcatag

SEQ ID NO: 357010 - DNA, 4980 bp, Homo sapiens
ggcgccgacccatgctggctgggaacgtgtctcccggtgacgcagccccgggtggggaacgtggtgcggcggcggcggcggcggcgactgtacgcgcctccgccgcccccgagaggacgcgccgtgcagcggctgagtggcggcggcggcgacggcaaacccggagctgccggccggcgcgcgggaggaggacgcgggtgcggtctaggaaacggagctgcgggcggaggctccatgttgggaagcggcgccgttcgtgcttgttagcgggaatccgggagccgcggggtgagctggcgggggccgggccctaagtgaagatggaggccccgctgcggcctgccgcggacatcctgaggcggaacccgcagcaggactacgaactcgtccagagggtcggcagcggcacctacggggacgtctataaggccagaaatgtacacacaggagagctggctgcagtaaaaatcattaaattggagcctggagatgatttttctttgattcaacaagaaatatttatggttaaagaatgtaaacattgtaacatcgttgcctactttgggagttatcttagtcgggaaaaactatggatttgtatggaatactgtggtggcggatcacttcaagatatttaccatgttactggaccattatcagaattgcaaatagcctatgtatgcagagaaaccttacagggtcttgcctatttgcatactaaaggcaaaatgcatagagatatcaaaggtgctaatattttattgacagaccatggcgatgtaaaattagctgactttggtgtggctgcaaaaataacagctaccattgcaaaacgaaaatctttcattggcaccccttactggatggccccagaagttgcagcagtagagaagaatggtggctacaaccaactctgtgatatctgggcagtaggaataacagcaattgaacttggagaacttcagccacctatgtttgatctccacccaatgagggctctcttcttaatgtcaaaaagtaattttcagcctccaaaactaaaggacaaaacaaaatggtcatcaacattccataattttgtcaaaatagcactaaccaaaaacccaaaaaaaagaccaactgctgaaagacttctgactcacacttttgttgcacagccaggtctctctagagccctagcagttgaactgttagacaaagtgaacaatccagataaccacgcacattacactgaagcagatgacgatgactttgagccccatgcaatcattcgtcataccattagatctacaaacaggaatgccagagctgaacggacagcttcagaaataaattttgacaaattacaatttgaacctcctctgagaaaagaaacagaagcacgagatgaaatgggattgtcatcagacccaaatttcatgttacagtggaatccttttgttgatggtgcaaatactggcaaatcaacctcaaaacgtgcaataccacctcccctacctcctaagccaaggataagcagttaccctgaagacaactttccggatgaagaaaaagcatcaaccataaaacattgtcctgattcagaaagcagagctccccaaattctcagaagacagagtagcccaagttgtgggcctgtggcagagacttcttctattggaaatggtgatggtatttcaaaactgatgagtgaaaatacagaaggatcagcacaagcaccacagttaccacgaaaaaaggacaaacgagacttccctaaaccagccatcaatggccttccacccaccccaaaagttctgatgggagcatgcttttcaaaagtttttgatggctgtcctttgaaaattaattgtgcaacatcctggatacatcctgatacaaaagatcagtacattatttttggaactgaagatggtatttacacactgaatctcaatgagctacatgaggcaacgatggaacagttatttccacggaagtgtacttggctgtatgttatcaataatactttaatgtcattatcagaaggaaaaacctttcagctctactctcacaatcttatagctttgtttgaacatgccaaaaaaccaggattagctgcccatattcaaactcacaggtttccagaccgaatactaccaagaaaattcgctttaacaacaaagattcctgatacaaaaggctgccacaaatgttgcatagtcagaaacccttacacgggacataaatacctctgtggagctttacagtctggaattgttttacttcagtggtatgagccaatgcagaaattcatgttgataaagcactttgattttcctttgccaagtcctttgaatgtttttgaaatgctggtgatacctgaacaggaataccctatggtctgtgtagctattagcaaaggcactgaatcgaatcaggtagttcagtttgagacaatcaatttgaactctgcatcttcatggtttacagaaattggtgcaggcagccagcagttagattccattcatgtaacacagttggagagagataccgttttagtgtgtttagacaaatttgtgaaaattgtaaatctacaaggaaaattaaaatcaagtaagaaactggcctctgagttaagttttgattttcgcattgaatctgtagtatgccttcaagacagtgtgttggctttctggaaacatgggatgcagggtaaaagcttcaagtcagatgaggttacccaggagatttcagatgaaacaagagttttccgcttattaggatcagacagggttgtcgttttggaaagtaggccaacagaaaatcctactgcacacagcaatctctacatcttggctggacatgaaaatagttactaagcaacagaaactgatctcaaatgacaggaaaatgaatatactccattgaaaggaaaaataaggaaattcaatacaaactgcactatgatttgctttaactattatgggttatattgcaaatgatctgtactttagggtagaattcaatattttctgcagctggaaacagctagtctatctcttgccactgtgtggtggttatatcaagtttgcttaataaaagctatgagacaaatagtcctctagttccaggaaacacagtctttttttaaaaaaaacaatgtttgtaacaagggtgccatggtatttttagataactcgtgattatcttaagagaggtaaatttagtgatcattttatatcatgtcttattccttcttaatgaacataatttgttaaattctcaagcaaggttttcacttttatattggccattctgtatgtttttgtaaaacagaatatttaatccttatttattaatctcttgctggagtggtgtaatgtatctaacttttagcaaaggagggttgcagagcagcttaaattttttttataatgtataagaattttgtttatcttttaagagtagtaaagtactttgagtgtttgggggttcaacacacacatgcaattttgcttaacaaaagtattttataatacagtttcatacagaattaccttaaaagggagtcttatgttttcaactacagatagttgtaagggatcatacagaagatattgatgatagttgaaatattcttagaaggggtgtgtatgtctagctgtgtctaccatgtgtatgtattcttgacaagcagtataaaatacctgtgatttttctttacattagggataatgcataaggaattaatcttcatatatattatcatccctaatgtagcagggggaagtatttaattgcccatgatatgtattttacttatactatgccagagaggaaactataaagtaattacacatgtaatcttgggtttttcacatatgtaggtattcattttgagtaggttgaagaagaaaaaaaatatttaaatgaattgaattcctgatgggatagtatcaataagtatttaaaagccagtattctaaaaataataaagggtagggtcatttttgagtttgtttttcttttgctattgttaatattcaaaattaaagtgttacattggtacctgttgtcttaatgcatttattgagaacagcattgagatgatgaacaaggggttagcaatagcaaactctataattattttgactaattacttaagaggaaaacagtataagtatctcattcagtatttagcaattctgtaaaataagtattatctctatttttcagatgaggaagtaagggtttagcaaggttaagagatctatccaatttacacagcaagttagtagttgagcctgaccatgagtcttctgactctgttcttttcactatgcaatacgcaaacaataaaatgttatacaaatggaatataaagttatttattctttaaaaatgcacatatgatatgatttcagtaagtgtgtggctgtttattttggctatgttaagaatacgggatacagtagatgacaggggaaccatcctcaaaacaggggacatttacatgatggataagaaagccagaatcctccttttcttactgaatcctggcagccagatctttaccatcccatggtggaataccgaagagtcttctctgtgaaatctgaccaatgcaagtgaaaaggcctcattaagatcttgatgtcagacatgtcccggctaaactgcccagctagatgacactacagtgaaaatcatagttggcaatcccaccatcccacgcattatgtctagaccttgcagttagtcttttagtcctgtgctcttaaaaatgagcaaacaaccaaggattacaaataaatgaaagagaaaaaacagtctggggaaaacagaggaaacaggctatgaagggtaaggagaacatcaaaagaaaaagtattttcagaaggatgttgcaaccatgagtgagtcaagggcagggtacttttaaaaagttgggtttcaaaaaaacaaaaagagctcttagaaaataatatgacagcatag

SEQ ID NO: 357011 - DNA, 4972 bp, Homo sapiens
ggcgccgacccatgctggctgggaacgtgtctcccggtgacgcagccccgggtggggaacgtggtgcggcggcggcggcggcggcgactgtacgcgcctccgccgcccccgagaggacgcgccgtgcagcggctgagtggcggcggcggcgacggcaaacccggagctgccggccggcgcgcgggaggaggacgcgggtgcggtctaggaagtaggtcccgggctccgcgctcaacaaagacggggccgcccccattagacggagctgcgggcggaggctccatgttgggaagcggcgccgttcgtgcttgttagcgggaatccgggagccgcggggtgagctggcgggggccgggccctaagtgaagatggaggccccgctgcggcctgccgcggacatcctgaggcggaacccgcagcaggactacgaactcgtccagagggtcggcagcggcacctacggggacgtctataaggccagaaatgtacacacaggagagctggctgcagtaaaaatcattaaattggagcctggagatgatttttctttgattcaacaagaaatatttatggttaaagaatgtaaacattgtaacatcgttgcctactttgggagttatcttagtcgggaaaaactatggatttgtatggaatactgtggtggcggatcacttcaagatatttaccatgttactggaccattatcagaattgcaaatagcctatgtatgcagagaaaccttacagggtcttgcctatttgcatactaaaggcaaaatgcatagagatatcaaaggtgctaatattttattgacagaccatggcgatgtaaaattagctgactttggtgtggctgcaaaaataacagctaccattgcaaaacgaaaatctttcattggcaccccttactggatggccccagaagttgcagcagtagagaagaatggtggctacaaccaactctgtgatatctgggcagtaggaataacagcaattgaacttggagaacttcagccacctatgtttgatctccacccaatgagggctctcttcttaatgtcaaaaagtaattttcagcctccaaaactaaaggacaaaacaaaatggtcatcaacattccataattttgtcaaaatagcactaaccaaaaacccaaaaaaaagaccaactgctgaaagacttctgactcacacttttgttgcacagccaggtctctctagagccctagcagttgaactgttagacaaagtgaacaatccagataaccacgcacattacactgaagcagatgacgatgactttgagccccatgcaatcattcgtcataccattagatctacaaacaggaatgccagagctgaacggacagcttcagaaataaattttgacaaattacaatttgaacctcctctgagaaaagaaacagaagcacgagatgaaatgggattgtcatcagacccaaatttcatgttacagtggaatccttttgttgatggtgcaaatactggcaaatcaacctcaaaacgtgcaataccacctcccctacctcctaagccaaggataagcagttaccctgaagacaactttccggatgaagaaaaagcatcaaccataaaacattgtcctgattcagaaagcagagctccccaaattctcagaagacagagtagcccaagttgtgggcctgtggcagagacttcttctattggaaatggtgatggtatttcaaaactgatgagtgaaaatacagaaggatcagcacaagcaccacagttaccacgaaaaaaggacaaacgagacttccctaaaccagccatcaatggccttccacccaccccaaaagttctgatgggagcatgcttttcaaaagtttttgatggctgtcctttgaaaattaattgtgcaacatcctggatacatcctgatacaaaagatcagtacattatttttggaactgaagatggtatttacacactgaatctcaatgagctacatgaggcaacgatggaacagttatttccacggaagtgtacttggctgtatgttatcaataatactttaatgtcattatcagaaggaaaaacctttcagctctactctcacaatcttatagctttgtttgaacatgccaaaaaaccaggattagctgcccatattcaaactcacaggtttccagaccgaatactaccaagaaaattcgctttaacaacaaagattcctgatacaaaaggctgccacaaatgttgcatagtcagaaacccttacacgggacataaatacctctgtggagctttacagtctggaattgttttacttcagtggtatgagccaatgcagaaattcatgttgataaagcactttgattttcctttgccaagtcctttgaatgtttttgaaatgctggtgatacctgaacaggaataccctatggtctgtgtagctattagcaaaggcactgaatcgaatcaggtagttcagtttgagacaatcaatttgaactctgcatcttcatggtttacagaaattggtgcaggcagccagcagttagattccattcatgtaacacagttggagagagataccgttttagtgtgtttagacaaatttgtgaaaattgtaaatctacaaggaaaattaaaatcaagtaagaaactggcctctgagttaagttttgattttcgcattgaatctgtagtatgccttcaagacagtgtgttggctttctggaaacatgggatgcagggtaaaagcttcaagtcagatgagggttgtcgttttggaaagtaggccaacagaaaatcctactgcacacagcaatctctacatcttggctggacatgaaaatagttactaagcaacagaaactgatctcaaatgacaggaaaatgaatatactccattgaaaggaaaaataaggaaattcaatacaaactgcactatgatttgctttaactattatgggttatattgcaaatgatctgtactttagggtagaattcaatattttctgcagctggaaacagctagtctatctcttgccactgtgtggtggttatatcaagtttgcttaataaaagctatgagacaaatagtcctctagttccaggaaacacagtctttttttaaaaaaaacaatgtttgtaacaagggtgccatggtatttttagataactcgtgattatcttaagagaggtaaatttagtgatcattttatatcatgtcttattccttcttaatgaacataatttgttaaattctcaagcaaggttttcacttttatattggccattctgtatgtttttgtaaaacagaatatttaatccttatttattaatctcttgctggagtggtgtaatgtatctaacttttagcaaaggagggttgcagagcagcttaaattttttttataatgtataagaattttgtttatcttttaagagtagtaaagtactttgagtgtttgggggttcaacacacacatgcaattttgcttaacaaaagtattttataatacagtttcatacagaattaccttaaaagggagtcttatgttttcaactacagatagttgtaagggatcatacagaagatattgatgatagttgaaatattcttagaaggggtgtgtatgtctagctgtgtctaccatgtgtatgtattcttgacaagcagtataaaatacctgtgatttttctttacattagggataatgcataaggaattaatcttcatatatattatcatccctaatgtagcagggggaagtatttaattgcccatgatatgtattttacttatactatgccagagaggaaactataaagtaattacacatgtaatcttgggtttttcacatatgtaggtattcattttgagtaggttgaagaagaaaaaaaatatttaaatgaattgaattcctgatgggatagtatcaataagtatttaaaagccagtattctaaaaataataaagggtagggtcatttttgagtttgtttttcttttgctattgttaatattcaaaattaaagtgttacattggtacctgttgtcttaatgcatttattgagaacagcattgagatgatgaacaaggggttagcaatagcaaactctataattattttgactaattacttaagaggaaaacagtataagtatctcattcagtatttagcaattctgtaaaataagtattatctctatttttcagatgaggaagtaagggtttagcaaggttaagagatctatccaatttacacagcaagttagtagttgagcctgaccatgagtcttctgactctgttcttttcactatgcaatacgcaaacaataaaatgttatacaaatggaatataaagttatttattctttaaaaatgcacatatgatatgatttcagtaagtgtgtggctgtttattttggctatgttaagaatacgggatacagtagatgacaggggaaccatcctcaaaacaggggacatttacatgatggataagaaagccagaatcctccttttcttactgaatcctggcagccagatctttaccatcccatggtggaataccgaagagtcttctctgtgaaatctgaccaatgcaagtgaaaaggcctcattaagatcttgatgtcagacatgtcccggctaaactgcccagctagatgacactacagtgaaaatcatagttggcaatcccaccatcccacgcattatgtctagaccttgcagttagtcttttagtcctgtgctcttaaaaatgagcaaacaaccaaggattacaaataaatgaaagagaaaaaacagtctggggaaaacagaggaaacaggctatgaagggtaaggagaacatcaaaagaaaaagtattttcagaaggatgttgcaaccatgagtgagtcaagggcagggtacttttaaaaagttgggtttcaaaaaaacaaaaagagctcttagaaaataatatgacagcatag

SEQ ID NO: 357012 - DNA, 2908 bp, Homo sapiens
ggcgccgacccatgctggctgggaacgtgtctcccggtgacgcagccccgggtggggaacgtggtgcggcggcggcggcggcggcgactgtacgcgcctccgccgcccccgagaggacgcgccgtgcagcggctgagtggcggcggcggcgacggcaaacccggagctgccggccggcgcgcgggaggaggacgcgggtgcggtctaggaagtaggtcccgggctccgcgctcaacaaagacggggccgcccccattagacggagctgcgggcggaggctccatgttgggaagcggcgccgttcgtgcttgttagcgggaatccgggagccgcggggtgagctggcgggggccgggccctaagtgaagatggaggccccgctgcggcctgccgcggacatcctgaggcggaacccgcagcaggactacgaactcgtccagagggtcggcagcggcacctacggggacgtctataaggccagaaatgtacacacaggagagctggctgcagtaaaaatcattaaattggagcctggagatgatttttctttgattcaacaagaaatatttatggttaaagaatgtaaacattgtaacatcgttgcctactttgggagttatcttagtcgggaaaaactatggatttgtatggaatactgtggtggcggatcacttcaagatatttaccatgttactggaccattatcagaattgcaaatagcctatgtatgcagagaaaccttacagggtcttgcctatttgcatactaaaggcaaaatgcatagagatatcaaaggtgctaatattttattgacagaccatggcgatgtaaaattagctgactttggtgtggctgcaaaaataacagctaccattgcaaaacgaaaatctttcattggcaccccttactggatggccccagaagttgcagcagtagagaagaatggtggctacaaccaactctgtgatatctgggcagtaggaataacagcaattgaacttggagaacttcagccacctatgtttgatctccacccaatgagggctctcttcttaatgtcaaaaagtaattttcagcctccaaaactaaaggacaaaacaaaatggtcatcaacattccataattttgtcaaaatagcactaaccaaaaacccaaaaaaaagaccaactgctgaaagacttctgactcacacttttgttgcacagccaggtctctctagagccctagcagttgaactgttagacaaagtgaacaatccagataaccacgcacattacactgaagcagatgacgatgactttgagccccatgcaatcattcgtcataccattagatctacaaacaggaatgccagagctgaacggacagcttcagaaataaattttgacaaattacaatttgaacctcctctgagaaaagaaacagaagcacgagatgaaatgggattgtcatcagacccaaatttcatgttacagtggaatccttttgttgatggtgcaaatactggcaaatcaacctcaaaacgtgcaataccacctcccctacctcctaagccaaggataagcagttaccctgaagacaactttccggatgaagaaaaagcatcaaccataaaacattgtcctgattcagaaagcagagctccccaaattctcagaagacagagtagcccaagttgtgggcctgtggcagagacttcttctattggaaatggtgatggtatttcaaaactgatgagtgaaaatacagaaggatcagcacaagcaccacagttaccacgaaaaaaggacaaacgagacttccctaaaccagccatcaatggccttccacccaccccaaaagttctgatgggagcatgcttttcaaaagtttttgatggctgtcctttgaaaattaattgtgcaacatcctggatacatcctgatacaaaagatcagtacattatttttggaactgaagatggtatttacacactgaatctcaatgagctacatgaggcaacgatggaacagttatttccacggaagtgtacttggctgtatgttatcaataatactttaatgtcattatcagaaggaaaaacctttcagctctactctcacaatcttatagctttgtttgaacatgccaaaaaaccaggattagctgcccatattcaaactcacaggtttccagaccgaatactaccaagaaaattcgctttaacaacaaagattcctgatacaaaaggctgccacaaatgttgcatagtcagaaacccttacacgggacataaatacctctgtggagctttacagtctggaattgttttacttcagtggtatgagccaatgcagaaattcatgttgataaagcactttgattttcctttgccaagtcctttgaatgtttttgaaatgctggtgatacctgaacaggaataccctatggtctgtgtagctattagcaaaggcactgaatcgaatcaggtagttcagtttgagacaatcaatttgaactctgcatcttcatggtttacagaaattggtgcaggcagccagcagttagattccattcatgtaacacagttggagagagataccgttttagtgtgtttagacaattgtgacctgtcatctacacgcacattcaatcagctagcaactggcctctgagtaaggttcgatttcgcattgatctgtagatgcttcagaccagggttggcctccggacctggatgccggaaacctacattcagtggggtccgggattcattaacaaaggttccgcttgacacacgagtctccttggagaggcacaaaccctgggatcttctgtggggtagtttacacacgctcgcgatactcggagaacaccttcttatctagacggactgcccgtgtctatatttcattcaaacctcttattg

SEQ ID NO: 357013 - DNA, 2113 bp, Homo sapiens
ggcgccgacccatgctggctgggaacgtgtctcccggtgacgcagccccgggtggggaacgtggtgcggcggcggcggcggcggcgactgtacgcgcctccgccgcccccgagaggacgcgccgtgcagcggctgagtggcggcggcggcgacggcaaacccggagctgccggccggcgcgcgggaggaggacgcgggtgcggtctaggaagtaggtcccgggctccgcgctcaacaaagacggggccgcccccattagacggagctgcgggcggaggctccatgttgggaagcggcgccgttcgtgcttgttagcgggaatccgggagccgcggggtgagctggcgggggccgggccctaagtgaagatggaggccccgctgcggcctgccgcggacatcctgaggcggaacccgcagcaggactacgaactcgtccagagggtcggcagcggcacctacggggacgtctataaggccagaaatgtacacacaggagagctggctgcagtaaaaatcattaaattggagcctggagatgatttttctttgattcaacaagaaatatttatggttaaagaatgtaaacattgtaacatcgttgcctactttgggagttatcttagtcgggaaaaactatggatttgtatggaatactgtggtggcggatcacttcaagatatttaccatgttactggaccattatcagaattgcaaatagcctatgtatgcagagaaaccttacagggtcttgcctatttgcatactaaaggcaaaatgcatagagatatcaaaggtgctaatattttattgacagaccatggcgatgtaaaattagctgactttggtgtggctgcaaaaataacagctaccattgcaaaacgaaaatctttcattggcaccccttactggatggccccagaagttgcagcagtagagaagaatggtggctacaaccaactctgtgatatctgggcagtaggaataacagcaattgaacttggagaacttcagccacctatgtttgatctccacccaatgagggctctcttcttaatgtcaaaaagtaattttcagcctccaaaactaaaggacaaaacaaaatggtcatcaacattccataattttgtcaaaatagcactaaccaaaaacccaaaaaaaagaccaactgctgaaagacttctgactcacacttttgttgcacagccaggtctctctagagccctagcagttgaactgttagacaaagtgaacaatccagataaccacgcacattacactgaagcagatgacgatgactttgagccccatgcaatcattcgtcataccattagatctacaaacaggaatgccagagctgaacggacagcttcagaaataaattttgacaaattacaatttgaacctcctctgagaaaagaaacagaagcacgagatgaaatgggattgtcatcagacccaaatttcatgttacagtggaatccttttgttgatggtgcaaatactggcaaatcaacctcaaaacgtgcaataccacctcccctacctcctaagccaaggataagcagttaccctgaagacaactttccggatgaagaaaaagcatcaaccataaaacattgtcctgattcagaaagcagagctccccaaattctcagaagacagagtagcccaagttgtgggcctgtggcagagacttcttctattggaaatggtgatggtatttcaaaactgatgagtgaaaatacagaaggatcagcacaagcaccacagttaccacgaaaaaaggacaaacgagacttccctaaaccagccatcaatggccttccacccaccccaaaagttctgatgggagcatgcttttcaaaagtttttgatggctgtcctttgaaaattaattgtgcaacatcctggatacatcctgatacaaaagatcagtacattatttttggaactgaagatggtatttacacactgaatctcaatgagctacatgaggcaacgatggaacagttatttccacggaagtgtacttggctgtatgttatcaataatactttaatgtcattatcaggtatgtatgtgatgatgaaaaataaaccatagataagcag

SEQ ID NO: 357014 - DNA, 906 bp, Homo sapiens
cacgagtagaagagaaaaataataatggcgaaagtgatcctatagttaacacttaagcattctatattaagaaattttaagattctgtgtttaaggaagatcacctttacttcatccattccgctagtaaatcagtattttaatctttttcatgtttctcagaaaggggtataatcatgtgccacataaggacattttggtcaacgatggaccccatatacagtggtggtcccataagattagaatggagctgaaaaattcctatcacttagtaatgttgtagctatcataatgtcctagcacagtgctttactcacatgcttgtggtgatgctggtgtaaacaaacttacctcattgccagttgtataaaaggtataacacatggttatatatagtgcctaatacctattcatgctaataaatgattatgttacaggcttatgtatttactctacttcttattgtttttgtagagtgtacctcgtgccgaattcggcacgagtgcacgttggaggtataaggtatctgtcacactgtctggaaaaaaggttacaggacacatactagtttctttgttcggaaataaaggaaactctaagcagtatgaaattttcaagggcactctcaaaccagatagtactcattccaatgaatttgactcagatgtggatgttggggacttgcagatggttaaatttatttggtataacaatgtgatcaacccaactttacctagagtgggagcatccaagattatagtggagacaaatgttggaaaacagttcaacttctgtagtccagaaaccgtcagggaggaagttctgctcaccctcacaccgtgttaggagactactgttatttgaccaatgaattgacttctaataaaatctagtggtgatgcatta

SEQ ID NO: 357015 - DNA, 569 bp, Homo sapiens
  misc_feature (22)..(22): n is a, c, g, or t
ctagataaaatttctggcccanatcatttgttttcccaggatatctatcagcatagtgacccatctgtgggcagcctccacttggacaagggaaacacttgtttgcagtgaagacgttgtaagaggcacagaaattttatctagacactggtgatgccagtaattttgcacgttggaggtataaggtatctgtcacactgtctggaaaaaaggttacaggacacatactagtttctttgttcggaaataaaggaaactctaagcagtatgaaattttcaagggcactctcaaaccagatagtactcattccaatgaatttgactcagatgtggatgttggggacttgcagatggttaaatttatttggtataacaatgtgatcaacccaactttacctagagtgggagcatccaagattatagtggagacaaatgttggaaaacagttcaacttctgtagtccagaaaccgtcagggaggaagttctgctcaccctcacaccgtgttaggagactactgttatttgaccaatgaattgacttctaataaaatctagtggtgatgcatta

SEQ ID NO: 357016 - DNA, 1493 bp, Homo sapiens
agcggccgctcgcgatctagaacggaactgccacgatgctgccactttggactctttcactgctgctgggagcagtagcaggaaaagaagtttgctacgaaagactcggctgcttcagtgatgactccccatggtcaggaattacggaaagacccctccatatattgccttggtctccaaaagatgtcaacacccgcttcctcctatatactaatgagaacccaaacaactttcaagaagttgccgcagattcatcaagcatcagtggctccaatttcaaaacaaatagaaaaactcgctttattattcatggattcatagacaagggagaagaaaactggctggccaatgtgtgcaagaatctgttcaaggtggaaagtgtgaactgtatctgtgtggactggaaaggtggctcccgaactggatacacacaagcctcgcagaacatcaggatcgtgggagcagaagtggcatattttgttgaatttcttcagtcggcgttcggttactcaccttccaacgtgcatgtcattggccacagcctgggtgcccacgctgctggggaggctggaaggagaaccaatgggaccattggacgcatcacagggttggacccagcagaaccttgctttcagggcacacctgaattagtccgattggaccccagcgatgccaaatttgtggatgtaattcacacggatggtgcccccatagtccccaatttggggtttggaatgagccaagtcgtgggccacctagatttctttccaaatggaggagtggaaatgcctggatgtaaaaagaacattctctctcagattgtggacatagacggaatctgggaagggactcgagactttgcggcctgtaatcacttaagaagctacaaatattacactgatagcatcgtcaaccctgatggctttgctggattcccctgtgcctcttacaacgtcttcactgcaaacaagtgtttcccttgtccaagtggaggctgcccacagatgggtcactatgctgatagatatcctgggaaaacaaatgatgtgggccagaaattttatctagacactggtgatgccagtaattttgcacgttggaggtataaggtatctgtcacactgtctggaaaaaaggttacaggacacatactagtttctttgttcggaaataaaggaaactctaagcagtatgaaattttcaagggcactctcaaaccagatagtactcattccaatgaatttgactcagatgtggatgttggggacttgcagatggttaaatttatttggtataacaatgtgatcaacccaactttacctagagtgggagcatccaagattatagtggagacaaatgttggaaaacagttcaacttctgtagtccagaaaccgtcagggaggaagttctgctcaccctcacaccgtgttaggagactactgttatttgaccaatgaattgacttctaataaaatctagtggtgatgcatta

SEQ ID NO: 357017 - DNA, 201 bp, Homo sapiens
  misc_feature (16)..(16): n is a, c, g, or t
  misc_feature (19)..(19): n is a, c, g, or t
  misc_feature (42)..(42): n is a, c, g, or t
gtagatcccccggggngcnggaattcggcacgagtgggagcntccaacattcgtctccactataatcttggataacagttcaacttctgtagtccagaaaccgtcagggaggaagttctgctcaccctcacaccgtgttaggagactactgttatttgaccaatgaattgacttctaataaaatctagtggtgatgcatta

SEQ ID NO: 357018 - DNA, 1917 bp, Homo sapiens
agcggccgctcgcgatctagaacggaactgccacgatgctgccactttggactctttcactgctgctgggagcagtagcaggaaaagaagtttgctacgaaagactcggctgcttcagtgatgactccccatggtcaggaattacggaaagacccctccatatattgccttggtctccaaaagatgtcaacacccgcttcctcctatatactaatgagaacccaaacaactttcaagaagttgccgcagattcatcaagcatcagtggctccaatttcaaaacaaatagaaaaactcgctttattattcatggattcatagacaagggagaagaaaactggctggccaatgtgtgcaagaatctgttcaaggtggaaagtgtgaactgtatctgtgtggactggaaaggtggctcccgaactggatacacacaagcctcgcagaacatcaggatcgtgggagcagaagtggcatattttgttgaatttcttcagtcggcgttcggttactcaccttccaacgtgcatgtcattggccacagcctgggtgcccacgctgctggggaggctggaaggagaaccaatgggaccattggacgcatcacagggttggacccagcagaaccttgctttcagggcacacctgaattagtccgattggaccccagcgatgccaaatttgtggatgtaattcacacggatggtgcccccatagtccccaatttggggtttggaatgagccaagtcgtgggccacctagatttctttccaaatggaggagtggaaatgcctggatgtaaaaagaacattctctctcagattgtggacatagacggaatctgggaagggactcgagactttgcggcctgtaatcacttaagaagctacaaatattacactgatagcatcgtcaaccctgatggctttgctggattcccctgtgcctcttacaacgtcttcactgcaaacaagtgtttcccttgtccaagtggaggctgcccacagatgggtcactatgctgatagatatcctgggaaaacaaatgatgtgggccagaaattttatctagacactggtgatgccagtaattttgcacgttggaggtataaggtatctgtcacactgtctggaaaaaaggttacaggacacatactagtttctttgttcggaaataaaggaaactctaagcagtatgaaattttcaagggcactctcaaaccagatagtactcattccaatgaatttgactcagatgtggatgttggggacttgcagatggttaaatttatttggtataacaatgtgatcaacccaactttacctagagtgggagcatccaagattatagtggagacaaatgttggaaaacagttcaacttctgtagtccagaaaccgtcagggaggaagttctgctcaccctcacaccgtgttaggagactactgttatttgaccaatgaattgacttctaataaaatctagtggtgatgcattaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaaaaaaaaaaaaaaaaaaaaaatttggggggggcggggccggaagaaggtcttcctaaaaaccccatctgggttgtgggcggcgcggggcgccacgatgggtatggtagaccgcgtgcgccaacagcgcgtgttcccaaggagaaacccgggcgccacagaactgcggcggctgtggtcttccccaaaaaaaaaacgcgccggggggggcaccgggcgggctcttctgacaaccccagaaggggggtccagaggggcaccaccggggctcactcccgcgaggccctaggacgccaaataaattgcccaccaagg

SEQ ID NO: 357019 - DNA, 1510 bp, Homo sapiens
  misc_feature (9)..(9): n is a, c, g, or t
  misc_feature (11)..(11): n is a, c, g, or t
  misc_feature (15)..(15): n is a, c, g, or t
  misc_feature (33)..(34): n is a, c, g, or t
  misc_feature (36)..(37): n is a, c, g, or t
gaattgggnangggnctttctaaaaagagcgtnngnntgaggaactgccacgatgctgccactttggactctttcactgctgctgggagcagtagcaggaaaagaagtttgctacgaaagactcggctgcttcagtgatgactccccatggtcaggaattacggaaagacccctccatatattgccttggtctccaaaagatgtcaacacccgcttcctcctatatactaatgagaacccaaacaactttcaagaagttgccgcagattcatcaagcatcagtggctccaatttcaaaacaaatagaaaaactcgctttattattcatggattcatagacaagggagaagaaaactggctggccaatgtgtgcaagaatctgttcaaggtggaaagtgtgaactgtatctgtgtggactggaaaggtggctcccgaactggatacacacaagcctcgcagaacatcaggatcgtgggagcagaagtggcatattttgttgaatttcttcagtcggcgttcggttactcaccttccaacgtgcatgtcattggccacagcctgggtgcccacgctgctggggaggctggaaggagaaccaatgggaccattggacgcatcacagggttggacccagcagaaccttgctttcagggcacacctgaattagtccgattggaccccagcgatgccaaatttgtggatgtaattcacacggatggtgcccccatagtccccaatttggggtttggaatgagccaagtcgtgggccacctagatttctttccaaatggaggagtggaaatgcctggatgtaaaaagaacattctctctcagattgtggacatagacggaatctgggaagggactcgagactttgcggcctgtaatcacttaagaagctacaaatattacactgatagcatcgtcaaccctgatggctttgctggattcccctgtgcctcttacaacgtcttcactgcaaacaagtgtttcccttgtccaagtggaggctgcccacagatgggtcactatgctgatagatatcctgggaaaacaaatgatgtgggccagaaattttatctagacactggtgatgccagtaattttgcacgttggaggtataaggtatctgtcacactgtctggaaaaaaggttacaggacacatactagtttctttgttcggaaataaaggaaactctaagcagtatgaaattttcaagggcactctcaaaccagatagtactcattccaatgaatttgactcagatgtggatgttggggacttgcagatggttaaatttatttggtataacaatgtgatcaacccaactttacctagagtgggagcatccaagattatagtggagacaaatgttggaaaacagttcaacttctgtagtccagaaaccgtcagggaggaagttctgctcaccctcacaccgtgttaggagactactgttatttgaccaatgaattgacttctaataaaatctagtggtgatgcatta

SEQ ID NO: 357020 - DNA, 1864 bp, Homo sapiens
agcggccgctcgcgatctagaacggaactgccacgatgctgccactttggactctttcactgctgctgggagcagtagcaggaaaagaagtttgctacgaaagactcggctgcttcagtgatgactccccatggtcaggaattacggaaagacccctccatatattgccttggtctccaaaagatgtcaacacccgcttcctcctatatactaatgagaacccaaacaactttcaagaagttgccgcagattcatcaagcatcagtggctccaatttcaaaacaaatagaaaaactcgctttattattcatggattcatagacaagggagaagaaaactggctggccaatgtgtgcaagaatctgttcaaggtggaaagtgtgaactgtatctgtgtggactggaaaggtggctcccgaactggatacacacaagcctcgcagaacatcaggatcgtgggagcagaagtggcatattttgttgaatttcttcagtcggcgttcggttactcaccttccaacgtgcatgtcattggccacagcctgggtgcccacgctgctggggaggctggaaggagaaccaatgggaccattggacgcatcacagggttggacccagcagaaccttgctttcagggcacacctgaattagtccgattggaccccagcgatgccaaatttgtggatgtaattcacacggatggtgcccccatagtccccaatttggggtttggaatgagccaagtcgtgggccacctagatttctttccaaatggaggagtggaaatgcctggatgtaaaaagaacattctctctcagattgtggacatagacggaatctgggaagggactcgagactttgcggcctgtaatcacttaagaagctacaaatattacactgatagcatcgtcaaccctgatggctttgctggattcccctgtgcctcttacaacgtcttcactgcaaacaagtgtttcccttgtccaagtggaggctgcccacagatgggtcactatgctgatagatatcctgggaaaacaaatgatgtgggccagaaattttatctagacactggtgatgccagtaattttgcacgttggaggtataaggtatctgtcacactgtctggaaaaaaggttacaggacacatactagtttctttgttcggaaataaaggaaactctaagcagtatgaaattttcaagggcactctcaaaccagatagtactcattccaatgaatttgactcagatgtggatgttggggacttgcagatggttaaatttatttggtataacaatgtgatcaacccaactttacctagagtgggagcatccaagattatagtggagacaaatgttggaaaacagttcaacttctgtagtccagaaaccgtcagggaggaagttctgctcaccctcacaccgtgttaggagactactgttatttgaccaatgaattgacttctaataaaatctagtggtgatgcattaacatgagacaatgtccctgataagaacggtaaggggcagatctcgacataaattcatcctccatctcaaaatgaacttggactcctatgtcccgatatgtataatgctgcccactttaaggggcgcctcaaagtttaaacctaaggtcatggactgtgtctctggcaccatactccctaattcgctgtccaggtttttctaacacataatcactgcctgctggaacactggtgtgccaaacaagggcaagatcttccacgtgtggcaacaaaagccgatgggaattagaaattccgccccggggtcctcgcaccttggcacgtccaggttccgtaacaaaccagcacaacctctcccagactcactttatg

SEQ ID NO: 357021 - DNA, 1319 bp, Homo sapiens
tatccttctgggggattgcaggaaaagaagtttgctacgaaagactcggctgcttcagtgatgactccccatggtcaggaattacggaaagaccctccaatttcaaaacaaatagaaaaactcgctttattattcatggattcatagacaagggagaagaaaactggctggccaatgtgtgcaagaatctgttcaaggtggaaagtgtgaactgtatctgtgtggactggaaaggtggctcccgaactggatacacacaagcctcgcagaacatcaggatcgtgggagcagaagtggcatattttgttgaatttcttcagtcggcgttcggttactcaccttccaacgtgcatgtcattggccacagcctgggtgcccacgctgctggggaggctggaaggagaaccaatgggaccattggacgcatcacagggttggacccagcagaaccttgctttcagggcacacctgaattagtccgattggaccccagcgatgccaaatttgtggatgtaattcacacggatggtgcccccatagtccccaatttggggtttggaatgagccaagtcgtgggccacctagatttctttccaaatggaggagtggaaatgcctggatgtaaaaagaacattctctctcagattgtggacatagacggaatctgggaagggactcgagactttgcggcctgtaatcacttaagaagctacaaatattacactgatagcatcgtcaaccctgatggctttgctggattcccctgtgcctcttacaacgtcttcactgcaaacaagtgtttcccttgtccaagtggaggctgcccacagatgggtcactatgctgatagatatcctgggaaaacaaatgatgtgggccagaaattttatctagacactggtgatgccagtaattttgcacgttggaggtataaggtatctgtcacactgtctggaaaaaaggttacaggacacatactagtttctttgttcggaaataaaggaaactctaagcagtatgaaattttcaagggcactctcaaaccagatagtactcattccaatgaatttgactcagatgtggatgttggggacttgcagatggttaaatttatttggtataacaatgtgatcaacccaactttacctagagtgggagcatccaagattatagtggagacaaatgttggaaaacagttcaacttctgtagtccagaaaccgtcagggaggaagttctgctcaccctcacaccgtgttaggagactactgttatttgaccaatgaattgacttctaataaaatctagtggtgatgcatta

SEQ ID NO: 357022 - DNA, 666 bp, Homo sapiens
  misc_feature (9)..(9): n is a, c, g, or t
  misc_feature (11)..(11): n is a, c, g, or t
  misc_feature (15)..(15): n is a, c, g, or t
  misc_feature (33)..(34): n is a, c, g, or t
  misc_feature (36)..(37): n is a, c, g, or t
gaattgggnangggnctttctaaaaagagcgtnngnntgaggaactgccacgatgctgccactttggactctttcactgctgctgggagcagtagcaggaaaagaagtttgctacgaaagactcggctgcttcagtgatgactccccatggtcaggaattacggaaagacccctccatatattgccttggtctccaaaagatgtcaacacccgcttcctcctatatactaatgagaacccaaacaactttcaagaagttgccgcagattcatcaagcatcagtggctccaatttcaaaacaaatagaaaaactcgcgacacatactagtttctttgttcggaaataaaggaaactctaagcagtatgaaattttcaagggcactctcaaaccagatagtactcattccaatgaatttgactcagatgtggatgttggggacttgcagatggttaaatttatttggtataacaatgtgatcaacccaactttacctagagtgggagcatccaagattatagtggagacaaatgttggaaaacagttcaacttctgtagtccagaaaccgtcagggaggaagttctgctcaccctcacaccgtgttaggagactactgttatttgaccaatgaattgacttctaataaaatctagtggtgatgcatta

SEQ ID NO: 357023 - DNA, 605 bp, Homo sapiens
  misc_feature (9)..(9): n is a, c, g, or t
  misc_feature (11)..(11): n is a, c, g, or t
  misc_feature (15)..(15): n is a, c, g, or t
  misc_feature (33)..(34): n is a, c, g, or t
  misc_feature (36)..(37): n is a, c, g, or t
gaattgggnangggnctttctaaaaagagcgtnngnntgaggaactgccacgatgctgccactttggactctttcactgctgctgggagcagtagcaggaaaagaagtttgctacgaaagactcggctgcttcagtgatgactccccatggtcaggaattacggaaagacccctccatatattgccttggtctccaaaagatgtcaacacccgcttcctcctatatactaatgagaacccaaacaactttcaagaagttgccgcagattcatcaagcatcagtggctccaatttcaaaacaaatagaaaaactcgcgggcactctcaaaccagatagtactcattccaatgaatttgactcagatgtggatgttggggacttgcagatggttaaatttatttggtataacaatgtgatcaacccaactttacctagagtgggagcatccaagattatagtggagacaaatgttggaaaacagttcaacttctgtagtccagaaaccgtcagggaggaagttctgctcaccctcacaccgtgttaggagactactgttatttgaccaatgaattgacttctaataaaatctagtggtgatgcatta

SEQ ID NO: 357024 - DNA, 587 bp, Homo sapiens
  misc_feature (9)..(9): n is a, c, g, or t
  misc_feature (11)..(11): n is a, c, g, or t
  misc_feature (15)..(15): n is a, c, g, or t
  misc_feature (33)..(34): n is a, c, g, or t
  misc_feature (36)..(37): n is a, c, g, or t
gaattgggnangggnctttctaaaaagagcgtnngnntgaggaactgccacgatgctgccactttggactctttcactgctgctgggagcagtagcaggaaaagaagtttgctacgaaagactcggctgcttcagtgatgactccccatggtcaggaattacggaaagacccctccatatattgccttggtctccaaaagatgtcaacacccgcttcctcctatatactaatgagaacccaaacaactttcaagaagttgccgcagattcatcaagcatcagtggctccaatttcaaaacaaatagaaaaactcgctttattattcatggattcatagacaagggagaagaaaactggctggccaatgtgtgcaagaatctgttcaaggtggaaagtgtgaactgtatctgtgtggactggaaaggtggctcccgaactggatacacacaagcctcgcagaacatcaggatcgtgggagcagaagtggcatattttgttgaatttcttcagggtaattactcccggattgcataaaagcctgtacacatggttttccagattatctttccaaaaaaaaaaaaaaaag

SEQ ID NO: 357025 - DNA, 1484 bp, Homo sapiens
  misc_feature (9)..(9): n is a, c, g, or t
  misc_feature (11)..(11): n is a, c, g, or t
  misc_feature (15)..(15): n is a, c, g, or t
  misc_feature (33)..(34): n is a, c, g, or t
  misc_feature (36)..(37): n is a, c, g, or t
gaattgggnangggnctttctaaaaagagcgtnngnntgaggaactgccacgatgctgccactttggactctttcactgctgctgggagcagtagcaggaaaagaagtttgctacgaaagactcggctgcttcagtgatgactccccatggtcaggaattacggaaagacccctccatatattgccttggtctccaaaagatgtcaacacccgcttcctcctatatactaatgagaacccaaacaactttcaagaagttgccgcagattcatcaagcatcagtggctccaatttcaaaacaaatagaaaaactcgctttattattcatggattcatagacaagggagaagaaaactggctggccaatgtgtgcaagaatctgttcaaggtggaaagtgtgaactgtatctgtgtggactggaaaggtggctcccgaaatcaggatcgtgggagcagaagtggcatattttgttgaatttcttcagtcggcgttcggttactcaccttccaacgtgcatgtcattggccacagcctgggtgcccacgctgctggggaggctggaaggagaaccaatgggaccattggacgcatcacagggttggacccagcagaaccttgctttcagggcacacctgaattagtccgattggaccccagcgatgccaaatttgtggatgtaattcacacggatggtgcccccatagtccccaatttggggtttggaatgagccaagtcgtgggccacctagatttctttccaaatggaggagtggaaatgcctggatgtaaaaagaacattctctctcagattgtggacatagacggaatctgggaagggactcgagactttgcggcctgtaatcacttaagaagctacaaatattacactgatagcatcgtcaaccctgatggctttgctggattcccctgtgcctcttacaacgtcttcactgcaaacaagtgtttcccttgtccaagtggaggctgcccacagatgggtcactatgctgatagatatcctgggaaaacaaatgatgtgggccagaaattttatctagacactggtgatgccagtaattttgcacgttggaggtataaggtatctgtcacactgtctggaaaaaaggttacaggacacatactagtttctttgttcggaaataaaggaaactctaagcagtatgaaattttcaagggcactctcaaaccagatagtactcattccaatgaatttgactcagatgtggatgttggggacttgcagatggttaaatttatttggtataacaatgtgatcaacccaactttacctagagtgggagcatccaagattatagtggagacaaatgttggaaaacagttcaacttctgtagtccagaaaccgtcagggaggaagttctgctcaccctcacaccgtgttaggagactactgttatttgaccaatgaattgacttctaataaaatctagtggtgatgcatta

SEQ ID NO: 357026 - DNA, 1029 bp, Homo sapiens
aggagcaacaggctgtaccacacagcccagtcggcgttcggttactcaccttccaacgtgcatgtcattggccacagcctgggtgcccacgctgctggggaggctggaaggagaaccaatgggaccattggacgcatcacagggttggacccagcagaaccttgctttcagggcacacctgaattagtccgattggaccccagcgatgccaaatttgtggatgtaattcacacggatggtgcccccatagtccccaatttggggtttggaatgagccaagtcgtgggccacctagatttctttccaaatggaggagtggaaatgcctggatgtaaaaagaacattctctctcagattgtggacatagacggaatctgggaagggactcgagactttgcggcctgtaatcacttaagaagctacaaatattacactgatagcatcgtcaaccctgatggctttgctggattcccctgtgcctcttacaacgtcttcactgcaaacaagtgtttcccttgtccaagtggaggctgcccacagatgggtcactatgctgatagatatcctgggaaaacaaatgatgtgggccagaaattttatctagacactggtgatgccagtaattttgcacgttggaggtataaggtatctgtcacactgtctggaaaaaaggttacaggacacatactagtttctttgttcggaaataaaggaaactctaagcagtatgaaattttcaagggcactctcaaaccagatagtactcattccaatgaatttgactcagatgtggatgttggggacttgcagatggttaaatttatttggtataacaatgtgatcaacccaactttacctagagtgggagcatccaagattatagtggagacaaatgttggaaaacagttcaacttctgtagtccagaaaccgtcagggaggaagttctgctcaccctcacaccgtgttaggagactactgttatttgaccaatgaattgacttctaataaaatctagtggtgatgcatta

SEQ ID NO: 357027 - DNA, 591 bp, Homo sapiens
  misc_feature (9)..(9): n is a, c, g, or t
  misc_feature (11)..(11): n is a, c, g, or t
  misc_feature (15)..(15): n is a, c, g, or t
  misc_feature (33)..(34): n is a, c, g, or t
  misc_feature (36)..(37): n is a, c, g, or t
gaattgggnangggnctttctaaaaagagcgtnngnntgaggaactgccacgatgctgccactttggactctttcactgctgctgggagcagtagcaggaaaagaagtttgctacgaaagactcggctgcttcagtgatgactccccatggtcaggaattacggaaagacccctccatatattgccttggtctccaaaagatgtcaacacccgcttcctcctatatactaatgagaacccaaacaactttcaagaagttgccgcagattcatcaagcatcagtggctccaatttcaaaacaaatagaaaaactcgctttattattcatggattcatagacaagggagaagaaaactggctggccaatgtgtgcaagaatctgttcaaggtggaaagtgtgaactgtatctgtgtggactggaaaggtggctcccgaactggatacacacaagcctcgcagaacatcaggatcgtgggagcagaagtggcatattttgttgaatttcttcagtaaaggtcgggcggtttcgggtttacttccaaccctttccaaaacgggggcaatgtgtgaatattgggcccaaccaagac

SEQ ID NO: 357028 - DNA, 620 bp, Homo sapiens
  misc_feature (9)..(9): n is a, c, g, or t
  misc_feature (11)..(11): n is a, c, g, or t
  misc_feature (15)..(15): n is a, c, g, or t
  misc_feature (33)..(34): n is a, c, g, or t
  misc_feature (36)..(37): n is a, c, g, or t
gaattgggnangggnctttctaaaaagagcgtnngnntgaggaactgccacgatgctgccactttggactctttcactgctgctgggagcagtagcaggaaaagaagtttgctacgaaagactcggctgcttcagtgatgactccccatggtcaggaattacggaaagacccctccatatattgccttggtctccaaaagatgtcaacacccgcttcctcctatatactaatgagaacccaaacaactttcaagaagttgccgcagattcatcaagcatcagtggctccaatttcaaaacaaatagaaaaactcgcaaaaaaaaaaaatttggggggggcggggccggaagaaggtcttcctaaaaaccccatctgggttgtgggcggcgcggggcgccacgatgggtatggtagaccgcgtgcgccaacagcgcgtgttcccaaggagaaacccgggcgccacagaactgcggcggctgtggtcttccccaaaaaaaaaacgcgccggggggggcaccgggcgggctcttctgacaaccccagaaggggggtccagaggggcaccaccggggctcactcccgcgaggccctaggacgccaaataaattgcccaccaagg

SEQ ID NO: 357029 - DNA, 443 bp, Homo sapiens
tttctaggtgggacattccaagagaaatggccttttttctatgtgctaaatgcttggatttcttatctgccagaggtggtttgaacaatgaataatttaaatggactgagctttgtatagagattggcttcggatgactcactaaaaatgtgtcattttattatgctagatggacttaagtgatattaaaaattcatatataagaaaaaaagagattccattcagttcagagcagaagtggatggcggtgaaatgcagtctgaagactgaggtgagacctttcaatcttcaacctcttctctcaaattgacgatatctgcaaaggcgctattccaaatcaggtcacattcagaggttccgaggttaggacttcaacatatcttttgtggggtacaattcaaccccactaaggagatggtttaggcatttcttccctaatcacc

SEQ ID NO: 357030 - DNA, 4713 bp, Homo sapiens
gaatcaacagaatttgtctttttgtgactggtttatttcacttaacttcatcctcaaggttcaacttaaaggtgtatccatgttgtagcacgtgtcagcattttctttcgttctcaggctaaatagtatttcattgtgtgtgtacaccatgtttcatgcattcattcatcccttgaaagattggtgggttgtttcctcctttttgcttttgtgaacagtgctacgaacatggttgtacaaacatctcttggagccccactagcagttcctttgggtatataccccaaagtggaattgctggatctggtagctccctttttaattttttgaggaatcgccacacagtttccataacagctgcaccattttacattcccaagaccttttttttttttttttttttaagaagaaaagatgtgtttctgcatttctggaagtctatgctgcatttccatttgttgaaatttaagaccagagtcatcttttctgctgtaattataatggtcactggcttgtgccttttcctcctctctctgccccatctgcacggggtctttgaacaagtcccagcaccttggtggacaagcctgtgtccctggcccatcatggaagccgctgcctttcagagtgggagtctgtaccctgttgcctcattccttgctgcgcccatgagtgagcttgtgcctgacctctccttccaggtggacttacacactgggctgtcggagttctcggtgacgcagcgccggctggcccatggctggaatgagtttgttgctgacaacagcgaacctgtgtggaagaaatacctggatcagtttaagaaccccctgatcctgctgctgctgggctctgccctggtgagtgtcctcaccaaggagtatgaggacgccgtcagcatcgccacggcagtgcttgtcgtggtcactgtcgccttcatccaggagtacaggtcggagaaatctctggaagagctgaccaagctggttcctccagaatgtaactgcctaagagaaggaaaactccagcacctgcttgctcgagaactggttcctggtgatgtcgtatctctctcgatcggagaccggatccctgcagacatccgactcactgaggtcacggacctcttggtggatgaatccagtttcaccggggaagccgagccatgtagtaaaacagacagccccttgacaggcggtggggacctcaccaccctcagcaacatcgtcttcatggggaccctggtgcagtatgggaggggccagggggtcgtgattggaacaggggaaagctctcagttcggagaagtgtttaagatgatgcaggctgaagagacacctaaaactcctttgcagaaaagcatggacaggctaggaaagcaactgacactcttctcctttggcataatcggtctcatcatgctcattggctggtcgcaagggaaacaactcctgagtatgttcacgatcggggtcagcctggctgtggcggccattccagagggtctgcccatcgtcgtcatggtgacgctggtcctgggagtgctgcggatggccaagaagcgggtcatcgtgaagaagttacccatcgtggagactttaggttgctgcagcgttctctgttctgacaagacggggactctgactgccaatgaaatgacagtgacccagcttgtaacgtcagatgggcttcgtgccgaggtcagcggagttgggtatgacggtcaagggactgtgtgtcttctaccatccaaggaagtcattaaggaattttccaatgtctcagtgggaaagttagtggaggcgggctgtgttgccaacaatgcggtcatcagaaagaacgccgtgatggggcagcccaccgagggtgcattgatggccctggcgatgaagatggacttaagtgatattaaaaattcatatataagaaaaaaagagattccattcagttcagagcagaagtggatggcggtgaaatgcagtctgaagactgaggatcaggaagacatttacttcatgaaaggggccttggaagaggtgatccgctactgcaccatgtacaacaacgggggcatccccctgccgctgacgccccagcagaggtcattctgcctgcaggaagagaagaggatggggtcgctcggtttgcgggtgctggccctggcttctgggcccgagctggggcggctgacgtttctaggtcttgtgggcatcattgaccccccgagagttggcgtgaaggaagcagtccaggttctctccgagtctggtgtgtctgtgaagatgataacgggggatgccctggagacggccttggccataggaagaaacatcggcctgtgcaacgggaagctgcaagccatgtccggggaggaggtggacagcgtggagaagggcgagctggccgaccgcgtggggaaggtgtccgtgttcttcaggaccagcccaaagcacaagctcaaaatcatcaaggctctgcaggagtcaggggcgatcgtggccatgactggggatggggtgaacgacgcagtggccctgaagtctgcagacattgggatcgccatggggcagacagggacggacgtcagcaaagaggccgccaacatgatcctggtggatgatgacttctcagccatcatgaatgcagtggaggaaggcaagggtattttttacaacatcaaaaactttgtccgattccagctgagcacgagcatctccgccctgagtctcatcactctgtccaccgtgttcaacctgcccagccccctcaacgccatgcagatcctatggatcaacatcatcatggatgggccaccggcgcagagcttgggggtagagcccgttgacaaagacgccttcaggcagccaccacggagtgtgcgggacaccatcctcagcagagccctcatcctgaagatcctcatgtccgcggccatcatcttcagcgggaccctctttatcttctggaaggagatgcctgaagacagagcaagcactccccgcaccacgacgatgacgttcacttgttttgtgtttttcgatctcttcaacgccttgacctgccgctctcagaccaagctgatatttgagatcggctttctcaggaaccacatgttcctctactccgtcctggggtccatcctggggcagctggcggtcatttacatccccccgctgcagagggtcttccagacggagaacctgggagcgcttgatttgctgtttttaactggattggcctcatccgtcttcattttgtcagagctcctcaaactatgtgaaaaatactgttgcagccccaagagagtccagatgcaccctgaagatgtgtagtggaccgcactccgcggcaccttccctaatcatctcgatctggttgtgactgtggcccctgccgtgtctcctcgtcaggggagacttttaggaggccgcagccttccatcaccggatcagtttttcctcttaggaaagctgcaggaacctcgtgggctccagggacccaggcccacatccatccagcgttcccgctggctgtgggacagacagggaggggcctgtacagaaacaccacactgtttattaaatcacaatgatttttattaaccatgtctaactacgtatctgtgccacagcttgcagtgaggcaggccactcgtggcagatacaaggggctcctgagaggcagtgggtaggatggtcacactctgcccattgccctcctggaggccccatttcctcatcataaaatgagggacttttaaataaagtgctatgccgggggataattattttgatgtgtttacctagggtttttcatacaaggggccaggttggaaacccacagccatgtgttaatggccacgtggggtgagcagcaatccatcatgaatggcctacaggaaggcctcggcttttggagataaagagtagggctgggcatggtggctcacgcctgtaatcccagcactttgcaaggccaaggcaggcagattcactttgaggccagcctggccaacacagcaaaaccctgtctgtctctactaaaagtttaaaaaaaaaaacagttgccaggcgtgatgatgcacacctgttaatcccagctactcgggaggctgaggcaggagaatggcttgagtccaggaggtggagattgtaccactgcactgcagcatgggcaacaaagcaagagtctctctcagaaagtggcccttctctccggaaccaggaactgtagtatctcctgctgcctgcagacaagcttgatttcccactgccccaaagacttccaaaaaccgatctgctcttccacgtgacagatggcagaggagagaggtctccatgctgttcttctgcctgaagccacgccagaaccaccaaagggaaccagaagggggactccgtccccatctctcaggaaataaggccagagctagaaccccccatttactagtcaggcctcactagagaaactgaagtgtgccacttccacagtctgctaaggagtgcctccccctgagtcagggacaattcttgctctacttttcaggatccttgggcacactgctggcccgagacatttacttcccatttaaaattaagtaatcaaaataccagggtcgattactctgaactcttgcttatgtaaactttagggataaaactgtagtaagacacaaaatgctaacaataaaatataaattagactacattaaaa

SEQ ID NO: 357031 - DNA, 3963 bp, Homo sapiens
gaatcaacagaatttgtctttttgtgactggtttatttcacttaacttcatcctcaaggttcaacttaaaggtgtatccatgttgtagcacgtgtcagcattttctttcgttctcaggctaaatagtatttcattgtgtgtgtacaccatgtttcatgcattcattcatcccttgaaagattggtgggttgtttcctcctttttgcttttgtgaacagtgctacgaacatggttgtacaaacatctcttggagccccactagcagttcctttgggtatataccccaaagtggaattgctggatctggtagctccctttttaattttttgaggaatcgccacacagtttccataacagctgcaccattttacattcccaagaccttttttttttttttttttttaagaagaaaagatgtgtttctgcatttctggaagtctatgctgcatttccatttgttgaaatttaagaccagagtcatcttttctgctgtaattataatggtcactggcttgtgccttttcctcctctctctgccccatctgcacggggtctttgaacaagtcccagcaccttggtggacaagcctgtgtccctggcccatcatggaagccgctgcctttcagagtgggagtctgtaccctgttgcctcattccttgctgcgcccatgagtgagcttgtgcctgacctctccttccaggtggacttacacactgggctgtcggagttctcggtgacgcagcgccggctggcccatggctggaatgagtttgttgctgacaacagcgaacctgtgtggaagaaatacctggatcagtttaagaaccccctgatcctgctgctgctgggctctgccctggtgagtgtcctcaccaaggagtatgaggacgccgtcagcatcgccacggcagtgcttgtcgtggtcactgtcgccttcatccaggtgagtatttcctgaggtcccagtcagggtaagctgggcgggacaggagcttcatggagtccccacctttaaacagcacatctgatgtgcttcctgccaggagtacaggtcggagaaatctctggaagagctgaccaagctggttcctccagaatgtaactgcctaagagaaggaaaactccagcacctgcttgctcgagaactggttcctggtgatgtcgtatctctctcgatcggagaccggatccctgcagacatccgactcactgaggtcacggacctcttggtggatgaatccagtttcaccggggaagccgagccatgtagtaaaacagacagccccttgacaggcggtggggacctcaccaccctcagcaacatcgtcttcatggggaccctggtgcagtatgggaggggccagggggtcgtgattggaacaggggaaagctctcagttcggagaagtgtttaagatgatgcaggctgaagagacacctaaaactcctttgcagaaaagcatggacaggctaggaaagcaactgacactcttctcctttggcataatcggtctcatcatgctcattggctggtcgcaagggaaacaactcctgagtatgttcacgatcggggtcagcctggctgtggcggccattccagagggtctgcccatcgtcgtcatggtgacgctggtcctgggagtgctgcggatggccaagaagcgggtcatcgtgaagaagttacccatcgtggagactttaggttgctgcagcgttctctgttctgacaagacggggactctgactgccaatgaaatgacagtgacccagcttgtaacgtcagatgggcttcgtgccgaggtcagcggagttgggtatgacggtcaagggactgtgtgtcttctaccatccaaggaagtcattaaggaattttccaatgtctcagtgggaaagttagtggaggcgggctgtgttgccaacaatgcggtcatcagaaagaacgccgtgatggggcagcccaccgagggtgcattgatggccctggcgatgaagatggacttaagtgatattaaaaattcatatataagaaaaaaagagattccattcagttcagagcagaagtggatggcggtgaaatgcagtctgaagactgaggatcaggaagacatttacttcatgaaaggggccttggaagaggtgatccgctactgcaccatgtacaacaacgggggcatccccctgccgctgacgccccagcagaggtcattctgcctgcaggaagagaagaggatggggtcgctcggtttgcgggtgctggccctggcttctgggcccgagctggggcggctgacgtttctaggtcttgtgggcatcattgaccccccgagagttggcgtgaaggaagcagtccaggttctctccgagtctggtgtgtctgtgaagatgataacgggggatgccctggagacggccttggccataggaagaaacatcggcctgtgcaacgggaagctgcaagccatgtccggggaggaggtggacagcgtggagaagggcgagctggccgaccgcgtggggaaggtgtccgtgttcttcaggaccagcccaaagcacaagctcaaaatcatcaaggctctgcaggagtcaggggcgatcgtggccatgactggggatggggtgaacgacgcagtggccctgaagtctgcagacattgggatcgccatggggcagacagggacggacgtcagcaaagaggccgccaacatgatcctggtggatgatgacttctcagccatcatgaatgcagtggaggaaggcaagggtattttttacaacatcaaaaactttgtccgattccagctgagcacgtaagtagaggccagcattccgagtgtcattaagcaccacgcctggcgggcggccgctgactggctgcgtgtgccccgcaggagcatctccgccctgagtctcatcactctgtccaccgtgttcaacctgcccagccccctcaacgccatgcagatcctatggatcaacatcatcatggatgggccaccggcgcagagcttgggggtagagcccgttgacaaagacgccttcaggcagccaccacggagtgtgcgggacaccatcctcagcagagccctcatcctgaagatcctcatgtccgcggccatcatcttcagcgggaccctctttatcttctggaaggagatgcctgaagacagagcaagcactccccgcaccacgacgatgacgttcacttgttttgtgtttttcgatctcttcaacgccttgacctgccgctctcagaccaagctgatatttgagatcggctttctcaggaaccacatgttcctctactccgtcctggggtccatcctggggcagctggcggtcatttacatccccccgctgcagagggtcttccagacggagaacctgggagcgcttgatttgctgtttttaactggattggcctcatccgtcttcattttgtcagagctcctcaaactatgtgaaaaatactgttgcagccccaagagagtccagatgcaccctgaagatgtgtagtggaccgcactccgcggcaccttccctaatcatctcgatctggttgtgactgtggcccctgccgtgtctcctcgtcaggggagacttttaggaggccgcagccttccatcaccggatcagtttttcctcttaggaaagctgcaggaacctcgtgggctccagggacccaggcccacatccatccagcgttcccgctggctgtgggacagacagggaggggcctgtacagaaacaccacactgtttattaaatcacaatgatttttattaaccatgtctaactacgtatctgtgccacagcttgcagtgaggcaggccactcgtggcagatacaaggggctcctgagaggcagtgggtaggatggtcacactctgcccattgccctcctggaggccccatttcctcatcataaaatgagggacttttaaataaagtgctatgccgggggat

SEQ ID NO: 357032 - DNA, 2360 bp, Homo sapiens
ccataggaagaaacatcggcctgtgcaacgggaagctgcaagccatgtccggggaggaggtggacagcgtgaagaagttacccatcgtggagactttaggttgctgcagcgttctctgttctgacaagacggggactctgactgccaatgaaatgacagtgacccagcttgtaacgtcagatgggcttcgtgccgaggtcagcggagttgggtatgacggtcaagggactgtgtgtcttctaccatccaaggaagtcattaaggaattttccaatgtctcagtgggaaagttagtggaggcgggctgtgttgccaacaatgcggtcatcagaaagaacgccgtgatggggcagcccaccgagggtgcattgatggccctggcgatgaagatggacttaagtgatattaaaaattcatatataagaaaaaaagagattccattcagttcagagcagaagtggatggcggtgaaatgcagtctgaagactgaggatcaggaagacatttacttcatgaaaggggccttggaagaggtgatccgctactgcaccatgtacaacaacgggggcatccccctgccgctgacgccccagcagaggtcattctgcctgcaggaagagaagaggatggggtcgctcggtttgcgggtgctggccctggcttctgggcccgagctggggcggctgacgtttctaggtcttgtgggcatcattgaccccccgagagttggcgtgaaggaagcagtccaggttctctccgagtctggtgtgtctgtgaagatgataacgggggatgccctggagacggccttggccataggaagaaacatcggcctgtgcaacgggaagctgcaagccatgtccggggaggaggtggacagcgtggagaagggcgagctggccgaccgcgtggggaaggtgtccgtgttcttcaggaccagcccaaagcacaagctcaaaatcatcaaggctctgcaggagtcaggggcgatcgtggccatgactggggatggggtgaacgacgcagtggccctgaagtctgcagacattgggatcgccatggggcagacagggacggacgtcagcaaagaggccgccaacatgatcctggtggatgatgacttctcagccatcatgaatgcagtggaggaaggcaagggtattttttacaacatcaaaaactttgtccgattccagctgagcacgtaagtagaggccagcattccgagtgtcattaagcaccacgcctggcgggcggccgctgactggctgcgtgtgccccgcaggagcatctccgccctgagtctcatcactctgtccaccgtgttcaacctgcccagccccctcaacgccatgcagatcctatggatcaacatcatcatggatgggccaccggcgcagagcttgggggtagagcccgttgacaaagacgccttcaggcagccaccacggagtgtgcgggacaccatcctcagcagagccctcatcctgaagatcctcatgtccgcggccatcatcttcagcgggaccctctttatcttctggaaggagatgcctgaagacagagcaagcactccccgcaccacgacgatgacgttcacttgttttgtgtttttcgatctcttcaacgccttgacctgccgctctcagaccaagctgatatttgagatcggctttctcaggaaccacatgttcctctactccgtcctggggtccatcctggggcagctggcggtcatttacatccccccgctgcagagggtcttccagacggagaacctgggagcgcttgatttgctgtttttaactggattggcctcatccgtcttcattttgtcagagctcctcaaactatgtgaaaaatactgttgcagccccaagagagtccagatgcaccctgaagatgtgtagtggaccgcactccgcggcaccttccctaatcatctcgatctggttgtgactgtggcccctgccgtgtctcctcgtcaggggagacttttaggaggccgcagccttccatcaccggatcagtttttcctcttaggaaagctgcaggaacctcgtgggctccagggacccaggcccacatccatccagcgttcccgctggctgtgggacagacagggaggggcctgtacagaaacaccacactgtttattaaatcacaatgatttttattaaccatgtctaactacgtatctgtgccacagcttgcagtgaggcaggccactcgtggcagatacaaggggctcctgagaggcagtgggtaggatggtcacactctgcccattgccctcctggaggccccatttcctcatcataaaatgagggacttttaaataaagtgctatgccgggggat

SEQ ID NO: 357033 - DNA, 2734 bp, Homo sapiens
tagttcttttcaaaatattttagtaaaatctggcggtgggggcacccacggtgcgtaattgtttttctacattagtgaccccaggtcaaggtttaaaagggcttccgcgaagagccttctaaagacagaagcaggcgatgtccttcagcctccccatccctccctccttaccgtcctccggacctcatttttaggccgaactggttttgctgcgtctctctctcctctttggtaaatcgcggagatgcacggcgcacttcgggagtctgggcagggatgggggccccctgggctcggccggagagtaattcatggtctgattggaggcatcaggtgtacccttggcacagaagggcgaacatggctcaaggatcagttcccagtggccgaggggcacctgttagaacaccaccgtctcctacaaatgtgtccccaagaatgccagcaaggggaaccagcaggggcccaagtataacatcaatctgggcgagtcaccactgccccttgcagcaaccgatgcactggtccagccctcacgcaggcccgctccgtgagtaaatggctctcttctcttgcaggaatgcagtggaggaaggcaagggtattttttacaacatcaaaaactttgtccgattccagctgagcacgtaagtagaggccagcattccgagtgtcattaagcaccacgcctggcgggcggccgctgactggctgcgtgtgccccgcaggagcatctccgccctgagtctcatcactctgtccaccgtgttcaacctgcccagccccctcaacgccatgcagatcctatggatcaacatcatcatggatgggccaccggcgcagagcttgggggtagagcccgttgacaaagacgccttcaggcagccaccacggagtgtgcgggacaccatcctcagcagagccctcatcctgaagatcctcatgtccgcggccatcatcttcagcgggaccctctttatcttctggaaggagatgcctgaagacagagcaagcactccccgcaccacgacgatgacgttcacttgttttgtgtttttcgatctcttcaacgccttgacctgccgctctcagaccaagctgatatttgagatcggctttctcaggaaccacatgttcctctactccgtcctggggtccatcctggggcagctggcggtcatttacatccccccgctgcagagggtcttccagacggagaacctgggagcgcttgatttgctgtttttaactggattggcctcatccgtcttcattttgtcagagctcctcaaactatgtgaaaaatactgttgcagccccaagagagtccagatgcaccctgaagatgtgtagtggaccgcactccgcggcaccttccctaatcatctcgatctggttgtgactgtggcccctgccgtgtctcctcgtcaggggagacttttaggaggccgcagccttccatcaccggatcagtttttcctcttaggaaagctgcaggaacctcgtgggctccagggacccaggcccacatccatccagcgttcccgctggctgtgggacagacagggaggggcctgtacagaaacaccacactgtttattaaatcacaatgatttttattaaccatgtctaactacgtatctgtgccacagcttgcagtgaggcaggccactcgtggcagatacaaggggctcctgagaggcagtgggtaggatggtcacactctgcccattgccctcctggaggccccatttcctcatcataaaatgagggacttttaaataaagtgctatgccgggggataattattttgatgtgtttacctagggtttttcatacaaggggccaggttggaaacccacagccatgtgttaatggccacgtggggtgagcagcaatccatcatgaatggcctacaggaaggcctcggcttttggagataaagagtagggctgggcatggtggctcacgcctgtaatcccagcactttgcaaggccaaggcaggcagattcactttgaggccagcctggccaacacagcaaaaccctgtctgtctctactaaaagtttaaaaaaaaaaacagttgccaggcgtgatgatgcacacctgttaatcccagctactcgggaggctgaggcaggagaatggcttgagtccaggaggtggagattgtaccactgcactgcagcatgggcaacaaagcaagagtctctctcagaaagtggcccttctctccggaaccaggaactgtagtatctcctgctgcctgcagacaagcttgatttcccactgccccaaagacttccaaaaaccgatctgctcttccacgtgacagatggcagaggagagaggtctccatgctgttcttctgcctgaagccacgccagaaccaccaaagggaaccagaagggggactccgtccccatctctcaggaaataaggccagagctagaaccccccatttactagtcaggcctcactagagaaactgaagtgtgccacttccacagtctgctaaggagtgcctccccctgagtcagggacaattcttgctctacttttcaggatccttgggcacactgctggcccgagacatttacttcccatttaaaattaagtaatcaaaataccagggtcgattactctgaactcttgcttatgtaaactttagggataaaactgtagtaagacacaaaatgctaacaataaaatataaattagactacattaaaa

SEQ ID NO: 357034 - DNA, 5101 bp, Homo sapiens
gaatcaacagaatttgtctttttgtgactggtttatttcacttaacttcatcctcaaggttcaacttaaaggtgtatccatgttgtagcacgtgtcagcattttctttcgttctcaggctaaatagtatttcattgtgtgtgtacaccatgtttcatgcattcattcatcccttgaaagattggtgggttgtttcctcctttttgcttttgtgaacagtgctacgaacatggttgtacaaacatctcttggagccccactagcagttcctttgggtatataccccaaagtggaattgctggatctggtagctccctttttaattttttgaggaatcgccacacagtttccataacagctgcaccattttacattcccaagaccttttttttttttttttttttaagaagaaaagatgtgtttctgcatttctggaagtctatgctgcatttccatttgttgaaatttaagaccagagtcatcttttctgctgtaattataatggtcactggcttgtgccttttcctcctctctctgccccatctgcacggggtctttgaacaagtcccagcaccttggtggacaagcctgtgtccctggcccatcatggaagccgctgcctttcagagtgggagtctgtaccctgttgcctcattccttgctgcgcccatgagtgagcttgtgcctgacctctccttccaggtggacttacacactgggctgtcggagttctcggtgacgcagcgccggctggcccatggctggaatgagtttgttgctgacaacagcgaacctgtgtggaagaaatacctggatcagtttaagaaccccctgatcctgctgctgctgggctctgccctggtgagtgtcctcaccaaggagtatgaggacgccgtcagcatcgccacggcagtgcttgtcgtggtcactgtcgccttcatccaggtgagtatttcctgaggtcccagtcagggtaagctgggcgggacaggagcttcatggagtccccacctttaaacagcacatctgatgtgcttcctgccaggagtacaggtcggagaaatctctggaagagctgaccaagctggttcctccagaatgtaactgcctaagagaaggaaaactccagcacctgcttgctcgagaactggttcctggtgatgtcgtatctctctcgatcggagaccggatccctgcagacatccgactcactgaggtcacggacctcttggtggatgaatccagtttcaccggggaagccgagccatgtagtaaaacagacagccccttgacaggcggtggggacctcaccaccctcagcaacatcgtcttcatggggaccctggtgcagtatgggaggggccagggggtcgtgattggaacaggggaaagctctcagttcggagaagtgtttaagatgatgcaggctgaagagacacctaaaactcctttgcagaaaagcatggacaggctaggaaagcaactgacactcttctcctttggcataatcggtctcatcatgctcattggctggtcgcaagggaaacaactcctgagtatgttcacgatcggggtcagcctggctgtggcggccattccagagggtctgcccatcgtcgtcatggtgacgctggtcctgggagtgctgcggatggccaagaagcgggtcatcgtgaagaagttacccatcgtggagactttaggttgctgcagcgttctctgttctgacaagacggggactctgactgccaatgaaatgacagtgacccagcttgtaacgtcagatgggcttcgtgccgaggtcagcggagttgggtatgacggtcaagggactgtgtgtcttctaccatccaaggaagtcattaaggaattttccaatgtctcagtgggaaagttagtggaggcgggctgtgttgccaacaatgcggtcatcagaaagaacgccgtgatggggcagcccaccgagggtgcattgatggccctggcgatgaagatggacttaagtgatattaaaaattcatatataagaaaaaaagagattccattcagttcagagcagaagtggatggcggtgaaatgcagtctgaagactgaggatcaggaagacatttacttcatgaaaggggccttggaagaggtgatccgctactgcaccatgtacaacaacgggggcatccccctgccgctgacgccccagcagaggtcattctgcctgcaggaagagaagaggatggggtcgctcggtttgcgggtgctggccctggcttctgggcccgagctggggcggctgacgtttctaggtcttgtgggcatcattgaccccccgagagttggcgtgaaggaagcagtccaggttctctccgagtctggtgtgtctgtgaagatgataacgggggatgccctggagacggccttggccataggaagaaacatcggcctgtgcaacgggaagctgcaagccatgtccggggaggaggtggacagcgtggagaagggcgagctggccgaccgcgtggggaaggtgtccgtgttcttcaggaccagcccaaagcacaagctcaaaatcatcaaggctctgcaggagtcaggggcgatcgtggccatgactggggatggggtgaacgacgcagtggccctgaagtctgcagacattgggatcgccatggggcagacagggacggacgtcagcaaagaggccgccaacatgatcctggtggatgatgacttctcagccatcatgaatgcagtggaggaaggcaagggtattttttacaacatcaaaaactttgtccgattccagctgagcacgtaagtagaggccagcattccgagtgtcattaagcaccacgcctggcgggcggccgctgactggctgcgtgtgccccgcaggagcatctccgccctgagtctcatcactctgtccaccgtgttcaacctgcccagccccctcaacgccatgcagatcctatggatcaacatcatcatggatgggccaccggcgcagagcttgggggtagagcccgttgacaaagacgccttcaggcagccaccacggagtgtgcgggacaccatcctcagcagagccctcatcctgaagatcctcatgtccgcggccatcatcttcagcgggaccctctttatcttctggaaggaggaaatgaccttcactctgggtttaactggagtggcatcacctcccagggagacagttacttcctggaggaagtggtgtttcctccacccataggtgccctgcccccatcctcatggtggcagcaaatcagcatgtgctggggagaccctggggtagcagccactgacctcacacctggaggaagctgtgtgaccgattcatgagcttatgcctgaagacagagcaagcactccccgcaccacgacgatgacgttcacttgttttgtgtttttcgatctcttcaacgccttgacctgccgctctcagaccaagctgatatttgagatcggctttctcaggaaccacatgttcctctactccgtcctggggtccatcctggggcagctggcggtcatttacatccccccgctgcagagggtcttccagacggagaacctgggagcgcttgatttgctgtttttaactggattggcctcatccgtcttcattttgtcagagctcctcaaactatgtgaaaaatactgttgcagccccaagagagtccagatgcaccctgaagatgtgtagtggaccgcactccgcggcaccttccctaatcatctcgatctggttgtgactgtggcccctgccgtgtctcctcgtcaggggagacttttaggaggccgcagccttccatcaccggatcagtttttcctcttaggaaagctgcaggaacctcgtgggctccagggacccaggcccacatccatccagcgttcccgctggctgtgggacagacagggaggggcctgtacagaaacaccacactgtttattaaatcacaatgatttttattaaccatgtctaactacgtatctgtgccacagcttgcagtgaggcaggccactcgtggcagatacaaggggctcctgagaggcagtgggtaggatggtcacactctgcccattgccctcctggaggccccatttcctcatcataaaatgagggacttttaaataaagtgctatgccgggggataattattttgatgtgtttacctagggtttttcatacaaggggccaggttggaaacccacagccatgtgttaatggccacgtggggtgagcagcaatccatcatgaatggcctacaggaaggcctcggcttttggagataaagagtagggctgggcatggtggctcacgcctgtaatcccagcactttgcaaggccaaggcaggcagattcactttgaggccagcctggccaacacagcaaaaccctgtctgtctctactaaaagtttaaaaaaaaaaacagttgccaggcgtgatgatgcacacctgttaatcccagctactcgggaggctgaggcaggagaatggcttgagtccaggaggtggagattgtaccactgcactgcagcatgggcaacaaagcaagagtctctctcagaaagtggcccttctctccggaaccaggaactgtagtatctcctgctgcctgcagacaagcttgatttcccactgccccaaagacttccaaaaaccgatctgctcttccacgtgacagatggcagaggagagaggtctccatgctgttcttctgcctgaagccacgccagaaccaccaaagggaaccagaagggggactccgtccccatctctcaggaaataaggccagagctagaaccccccatttactagtcaggcctcactagagaaactgaagtgtgccacttccacagtctgctaaggagtgcctccccctgagtcagggacaattcttgctctacttttcaggatccttgggcacactgctggcccgagacatttacttcccatttaaaattaagtaatcaaaataccagggtcgattactctgaactcttgcttatgtaaactttagggataaaactgtagtaagacacaaaatgctaacaataaaatataaattagactacattaaaa

SEQ ID NO: 357035 - DNA, 5320 bp, Homo sapiens
gaatcaacagaatttgtctttttgtgactggtttatttcacttaacttcatcctcaaggttcaacttaaaggtgtatccatgttgtagcacgtgtcagcattttctttcgttctcaggctaaatagtatttcattgtgtgtgtacaccatgtttcatgcattcattcatcccttgaaagattggtgggttgtttcctcctttttgcttttgtgaacagtgctacgaacatggttgtacaaacatctcttggagccccactagcagttcctttgggtatataccccaaagtggaattgctggatctggtagctccctttttaattttttgaggaatcgccacacagtttccataacagctgcaccattttacattcccaagaccttttttttttttttttttttaagaagaaaagatgtgtttctgcatttctggaagtctatgctgcatttccatttgttgaaatttaagaccagagtcatcttttctgctgtaattataatggtcactggcttgtgccttttcctcctctctctgccccatctgcacggggtctttgaacaagtcccagcaccttggtggacaagcctgtgtccctggcccatcatggaagccgctgcctttcagagtgggagtctgtaccctgttgcctcattccttgctgcgcccatgagtgagcttgtgcctgacctctccttccaggtggacttacacactgggctgtcggagttctcggtgacgcagcgccggctggcccatggctggaatgagtttgttgctgacaacagcgaacctgtgtggaagaaatacctggatcagtttaagaaccccctgatcctgctgctgctgggctctgccctggtgagtgtcctcaccaaggagtatgaggacgccgtcagcatcgccacggcagtgcttgtcgtggtcactgtcgccttcatccaggtgagtatttcctgaggtcccagtcagggtaagctgggcgggacaggagcttcatggagtccccacctttaaacagcacatctgatgtgcttcctgccaggagtacaggtcggagaaatctctggaagagctgaccaagctggttcctccagaatgtaactgcctaagagaaggaaaactccagcacctgcttgctcgagaactggttcctggtgatgtcgtatctctctcgatcggagaccggatccctgcagacatccgactcactgaggtcacggacctcttggtggatgaatccagtttcaccggggaagccgagccatgtagtaaaacagacagccccttgacaggcggtggggacctcaccaccctcagcaacatcgtcttcatggggaccctggtgcagtatgggaggggccagggggtcgtgattggaacaggggaaagctctcagttcggagaagtgtttaagatgatgcaggctgaagagacacctaaaactcctttgcagaaaagcatggacaggctaggaaagcaactgacactcttctcctttggcataatcggtctcatcatgctcattggctggtcgcaagggaaacaactcctgagtatgttcacgatcggggtcagcctggctgtggcggccattccagagggtctgcccatcgtcgtcatggtgacgctggtcctgggagtgctgcggatggccaagaagcgggtcatcgtgaagaagttacccatcgtggagactttaggttgctgcagcgttctctgttctgacaagacggggactctgactgccaatgaaatgacagtgacccagcttgtaacgtcagatgggcttcgtgccgaggtcagcggagttgggtatgacggtcaagggactgtgtgtcttctaccatccaaggaagtcattaaggaattttccaatgtctcagtgggaaagttagtggaggcgggctgtgttgccaacaatgcggtcatcagaaagaacgccgtgatggggcagcccaccgagggtgcattgatggccctggcgatgaagatggacttaagtgatattaaaaattcatatataagaaaaaaagagattccattcagttcagagcagaagtggatggcggtgaaatgcagtctgaagactgaggatcaggaagacatttacttcatgaaaggggccttggaagaggtgatccgctactgcaccatgtacaacaacgggggcatccccctgccgctgacgccccagcagaggtcattctgcctgcaggaagagaagaggatggggtcgctcggtttgcgggtgctggccctggcttctgggcccgagctggggcggctgacgtttctaggtcttgtgggcatcattgaccccccgagagttggcgtgaaggaagcagtccaggttctctccgagtctggtgtgtctgtgaagatgataacgggggatgccctggagacggccttggccataggaagaaacatcggcctgtgcaacgggaagctgcaagccatgtccggggaggaggtggacagcgtggagaagggcgagctggccgaccgcgtggggaaggtgtccgtgttcttcaggaccagcccaaagcacaagctcaaaatcatcaaggctctgcaggagtcaggggcgatcgtggccatgactggggatggggtgaacgacgcagtggccctgaagtctgcagacattgggatcgccatggggcagacagggacggacgtcagcaaagaggccgccaacatgatcctggtggatgatgacttctcagccatcatgaatgcagtggaggaaggcaagggtattttttacaacatcaaaaactttgtccgattccagctgagcacgtaagtagaggccagcattccgagtgtcattaagcaccacgcctggcgggcggccgctgactggctgcgtgtgccccgcaggagcatctccgccctgagtctcatcactctgtccaccgtgttcaacctgcccagccccctcaacgccatgcagatcctatggatcaacatcatcatggatgggccaccggcgcagagcttgggggtagagcccgttgacaaagacgccttcaggcagccaccacggagtgtgcgggacaccatcctcagcagagccctcatcctgaagatcctcatgtccgcggccatcatcttcagcgggaccctctttatcttctggaaggagctctccctctactactgacggccatccttcagccttccttgtaggaaatgaccttcactctgggtttaactggagtggcatcacctcccagggagacagttacttcctggaggaagtggtgtttcctccacccataggtgccctgcccccatcctcatggtggcagcaaatcagcatgtgctggggagaccctggggtagcagccactgacctcacacctggaggaagctgtgtgaccgattcatgagcttatgcctgaagacagagcaagcactccccgcaccacgacgatgacgttcacttgttttgtgtttttcgatctcttcaacgccttgacctgccgctctcaggtgagacccgggctgaccctcctcgctgcagagctgctgtgtgttctcgacagcagcgccccgaccctgcccgcagcattgagcggctctggctcagcgtgggcagtcagagctcccctgcctgtacctggggtgtggacagcacacaatcccccgtgtgaccttctccctgcagaccaagctgatatttgagatcggctttctcaggaaccacatgttcctctactccgtcctggggtccatcctggggcagctggcggtcatttacatccccccgctgcagagggtcttccagacggagaacctgggagcgcttgatttgctgtttttaactggattggcctcatccgtcttcattttgtcagagctcctcaaactatgtgaaaaatactgttgcagccccaagagagtccagatgcaccctgaagatgtgtagtggaccgcactccgcggcaccttccctaatcatctcgatctggttgtgactgtggcccctgccgtgtctcctcgtcaggggagacttttaggaggccgcagccttccatcaccggatcagtttttcctcttaggaaagctgcaggaacctcgtgggctccagggacccaggcccacatccatccagcgttcccgctggctgtgggacagacagggaggggcctgtacagaaacaccacactgtttattaaatcacaatgatttttattaaccatgtctaactacgtatctgtgccacagcttgcagtgaggcaggccactcgtggcagatacaaggggctcctgagaggcagtgggtaggatggtcacactctgcccattgccctcctggaggccccatttcctcatcataaaatgagggacttttaaataaagtgctatgccgggggataattattttgatgtgtttacctagggtttttcatacaaggggccaggttggaaacccacagccatgtgttaatggccacgtggggtgagcagcaatccatcatgaatggcctacaggaaggcctcggcttttggagataaagagtagggctgggcatggtggctcacgcctgtaatcccagcactttgcaaggccaaggcaggcagattcactttgaggccagcctggccaacacagcaaaaccctgtctgtctctactaaaagtttaaaaaaaaaaacagttgccaggcgtgatgatgcacacctgttaatcccagctactcgggaggctgaggcaggagaatggcttgagtccaggaggtggagattgtaccactgcactgcagcatgggcaacaaagcaagagtctctctcagaaagtggcccttctctccggaaccaggaactgtagtatctcctgctgcctgcagacaagcttgatttcccactgccccaaagacttccaaaaaccgatctgctcttccacgtgacagatggcagaggagagaggtctccatgctgttcttctgcctgaagccacgccagaaccaccaaagggaaccagaagggggactccgtccccatctctcaggaaataaggccagagctagaaccccccatttactagtcaggcctcactagagaaactgaagtgtgccacttccacagtctgctaaggagtgcctccccctgagtcagggacaattcttgctctacttttcaggatccttgggcacactgctggcccgagacatttacttcccatttaaaattaagtaatcaaaataccagggtcgattactctgaactcttgcttatgtaaactttagggataaaactgtagtaagacacaaaatgctaacaataaaatataaattagactacattaaaa

SEQ ID NO: 357036 - DNA, 3455 bp, Homo sapiens
gaatcaacagaatttgtctttttgtgactggtttatttcacttaacttcatcctcaaggttcaacttaaaggtgtatccatgttgtagcacgtgtcagcattttctttcgttctcaggctaaatagtatttcattgtgtgtgtacaccatgtttcatgcattcattcatcccttgaaagattggtgggttgtttcctcctttttgcttttgtgaacagtgctacgaacatggttgtacaaacatctcttggagccccactagcagttcctttgggtatataccccaaagtggaattgctggatctggtagctccctttttaattttttgaggaatcgccacacagtttccataacagctgcaccattttacattcccaagaccttttttttttttttttttttaagaagaaaagatgtgtttctgcatttctggaagtctatgctgcatttccatttgttgaaatttaagaccagagtcatcttttctgctgtaattataatggtcactggcttgtgccttttcctcctctctctgccccatctgcacggggtctttgaacaagtcccagcaccttggtggacaagcctgtgtccctggcccatcatggaagccgctgcctttcagagtgggagtctgtaccctgttgcctcattccttgctgcgcccatgagtgagcttgtgcctgacctctccttccaggtggacttacacactgggctgtcggagttctcggtgacgcagcgccggctggcccatggctggaatgagtttgttgctgacaacagcgaacctgtgtggaagaaatacctggatcagtttaagaaccccctgatcctgctgctgctgggctctgccctggtgagtgtcctcaccaaggagtatgaggacgccgtcagcatcgccacggcagtgcttgtcgtggtcactgtcgccttcatccaggtgagtatttcctgaggtcccagtcagggtaagctgggcgggacaggagcttcatggagtccccacctttaaacagcacatctgatgtgcttcctgccaggagtacaggtcggagaaatctctggaagagctgaccaagctggttcctccagaatgtaactgcctaagagaaggaaaactccagcacctgcttgctcgagaactggttcctggtgatgtcgtatctctctcgatcggagaccggatccctgcagacatccgactcactgaggtcacggacctcttggtggatgaatccagtttcaccggggaagccgagccatgtagtaaaacagacagccccttgacaggcggtggggacctcaccaccctcagcaacatcgtcttcatggggaccctggtgcagtatgggaggggccagggggtcgtgattggaacaggggaaagctctcagttcggagaagtgtttaagatgatgcaggctgaagagacacctaaaactcctttgcagaaaagcatggacaggctaggaaagcaactgacactcttctcctttggcataatcggtctcatcatgctcattggctggtcgcaagggaaacaactcctgagtatgttcacgatcggggtcagcctggctgtggcggccattccagagggtctgcccatcgtcgtcatggtgacgctggtcctgggagtgctgcggatggccaagaagcgggtcatcgtgaagaagttacccatcgtggagactttaggttgctgcagcgttctctgttctgacaagacggggactctgactgccaatgaaatgacagtgacccagcttgtaacgtcagatgggcttcgtgccgaggtcagcggagttgggtatgacggtcaagggactgtgtgtcttctaccatccaaggaagtcattaaggaattttccaatgtctcagtgggaaagttagtggaggcgggctgtgttgccaacaatgcggtcatcagaaagaacgccgtgatggggcagcccaccgagggtgcattgatggccctggcgatgaagatggacttaagtgatattaaaaattcatatataagaaaaaaagagattccattcagttcagagcagaagtggatggcggtgaaatgcagtctgaagactgaggatcaggaagacatttacttcatgaaaggggccttggaagaggtgatccgctactgcaccatgtacaacaacgggggcatccccctgccgctgacgccccagcagaggtcattctgcctgcaggaagagaagaggatggggtcgctcggtttgcgggtgctggccctggcttctgggcccgagctggggcggctgacgtttctaggtcttgtgggcatcattgaccccccgagagttggcgtgaaggaagcagtccaggttctctccgagtctggtgtgtctgtgaagatgataacgggggatgccctggagacggccttggccataggaagaaacatcggcctgtgcaacgggaagctgcaagccatgtccggggaggaggtggacagcgtggagaagggcgagctggccgaccgcgtggggaaggtgtccgtgttcttcaggaccagcccaaagcacaagctcaaaatcatcaaggctctgcaggagtcaggggcgatcgtggccatgactggggatggggtgaacgacgcagtggccctgaagtctgcagacattgggatcgccatggggcagacagggacggacgtcagcaaagaggccgccaacatgatcctggtggatgatgacttctcagccatcatgaatgcagtggaggaaggcaagggtattttttacaacatcaaaaactttgtccgattccagctgagcacgtaagtagaggccagcattccgagtgtcattaagcaccacgcctggcgggcggccgctgactggctgcgtgtgccccgcaggagcatctccgccctgagtctcatcactctgtccaccgtgttcaacctgcccagccccctcaacgccatgcagatcctatggatcaacatcatcatggatgggccaccggcgcagaggtgaggcagggccggctgggagccctgtgtctctttacctacctgcggggcttcctccaggggctgctggctgtgccccaaggctatagggatgaacaaatacagccactttccatcaggagttcccagaaaactgaagtgtgttgcactggagtgagactgggagtagaaggcagaggagaaagtacctgggccggcagagctgggtgaggatggaactttctgctccctctgcctggatgctctctctgggcaacctgcatggctcattctcatgcttcattccagtcaccagtcactgccttcaggaagtcttccctgattgcactcccactcaatcccctcaccctgctgtatttttccctagagaggaagatacacacagacacacttttccttatggatctgattgtgatctgtctcccctttagaacatcagtttcatggagg

SEQ ID NO: 357037 - DNA, 1575 bp, Homo sapiens
tccaaatctttataacccagttcccccccccccgctgcagaggggtcttccagacggagaaccctgggagcgctgatttgctgtttttaactggattggcctcatccgtcttcattttgtcagagctcctcaaactatgtgaaaaatactgttgcagccccaagagagtccagatgcaccctgaagatgtgtagtggaccgcactccgcggcaccttccctaatcatctcgatctggttgtgactgtggcccctgccgtgtctcctcgtcaggggagacttttaggaggccgcagccttccatcaccggatcagtttttcctcttaggaaagctgcaggaacctcgtgggctccagggacccaggcccacatccatccagcgttcccgctggctgtgggacagacagggaggggcctgtacagaaacaccacactgtttattaaatcacaatgatttttattaaccatgtctaactacgtatctgtgccacagcttgcagtgaggcaggccactcgtggcagatacaaggggctcctgagaggcagtgggtaggatggtcacactctgcccattgccctcctggaggccccatttcctcatcataaaatgagggacttttaaataaagtgctatgccgggggataattattttgatgtgtttacctagggtttttcatacaaggggccaggttggaaacccacagccatgtgttaatggccacgtggggtgagcagcaatccatcatgaatggcctacaggaaggcctcggcttttggagataaagagtagggctgggcatggtggctcacgcctgtaatcccagcactttgcaaggccaaggcaggcagattcactttgaggccagcctggccaacacagcaaaaccctgtctgtctctactaaaagtttaaaaaaaaaaacagttgccaggcgtgatgatgcacacctgttaatcccagctactcgggaggctgaggcaggagaatggcttgagtccaggaggtggagattgtaccactgcactgcagcatgggcaacaaagcaagagtctctctcagaaagtggcccttctctccggaaccaggaactgtagtatctcctgctgcctgcagacaagcttgatttcccactgccccaaagacttccaaaaaccgatctgctcttccacgtgacagatggcagaggagagaggtctccatgctgttcttctgcctgaagccacgccagaaccaccaaagggaaccagaagggggactccgtccccatctctcaggaaataaggccagagctagaaccccccatttactagtcaggcctcactagagaaactgaagtgtgccacttccacagtctgctaaggagtgcctccccctgagtcagggacaattcttgctctacttttcaggatccttgggcacactgctggcccgagacatttacttcccatttaaaattaagtaatcaaaataccagggtcgattactctgaactcttgcttatgtaaactttagggataaaactgtagtaagacacaaaatgctaacaataaaatataaattagactacattaaaa

SEQ ID NO: 357038 - DNA, 1827 bp, Homo sapiens
gaatcaacagaatttgtctttttgtgactggtttatttcacttaacttcatcctcaaggttcaacttaaaggtgtatccatgttgtagcacgtgtcagcattttctttcgttctcaggctaaatagtatttcattgtgtgtgtacaccatgtttcatgcattcattcatcccttgaaagattggtgggttgtttcctcctttttgcttttgtgaacagtgctacgaacatggttgtacaaacatctcttggagccccactagcagttcctttgggtatataccccaaagtggaattgctggatctggtagctccctttttaattttttgaggaatcgccacacagtttccataacagctgcaccattttacattcccaagaccttttttttttttttttttttaagaagaaaagatgtgtttctgcatttctggaagtctatgctgcatttccatttgttgaaatttaagaccagagtcatcttttctgctgtaattataatggtcactggcttgtgccttttcctcctctctctgccccatctgcacggggtctttgaacaagtcccagcaccttggtggacaagcctgtgtccctggcccatcatggaagccgctgcctttcagagtgggagtctgtaccctgttgcctcattccttgctgcgcccatgagtgagcttgtgcctgacctctccttccaggtggacttacacactgggctgtcggagttctcggtgacgcagcgccggctggcccatggctggaatgagtttgttgctgacaacagcgaacctgtgtggaagaaatacctggatcagtttaagaaccccctgatcctgctgctgctgggctctgccctggtgagtgtcctcaccaaggagtatgaggacgccgtcagcatcgccacggcagtgcttgtcgtggtcactgtcgccttcatccaggtgagtatttcctgaggtcccagtcagggtaagctgggcgggacaggagcttcatggagtccccacctttaaacagcacatctgatgtgcttcctgccaggagtacaggtcggagaaatctctggaagagctgaccaagctggttcctccagaatgtaactgcctaagagaaggaaaactccagcacctgcttgctcgagaactggttcctggtgatgtcgtatctctctcgatcggagaccggatccctgcagacatccgactcactgaggtcacggacctcttggtggatgaatccagtttcaccggggaagccgagccatgtagtaaaacagacagccccttgacaggcggtggggacctcaccaccctcagcaacatcgtcttcatggggaccctggtgcagtatgggaggggccagggggtcgtgattggaacaggggaaagctctcagttcggagaagtgtttaagatgatgcaggctgaagagacacctaaaactcctttgcagaaaagcatggacaggctaggaaagcaactgacactcttctcctttggcataatcggtctcatcatgctcattggctggtcgcaagggaaacaactcctgagtatgttcacgatcggggtcaggtaagagtgctatggccgccccttgccttgccagggtggtcaatgggctctgagcccttccctgccgcaagagaaggtggggaggctgcagaataggaagggttgggaaggtgcagccccgtcacccaaactccagcctcccaatagcatgttctccgacaggtacagagtgcccggcgaatgcttgcaaaatgaatgacagcaaatgatccagggtgtcccttttgtattaggctgttcttgcattgct

SEQ ID NO: 357039 - DNA, 181 bp, Homo sapiens
ggtgacgcagcgccggctggcccatggctggaatgagtttgttgctgacaacagcgaacctgtgtggaagaaatacctggatcaggtaggaccagaggtgtcattctttgcattaacatgcataagccagcgagggtggggcagccattccatctttcaatgttgatggaaggcatccttg

SEQ ID NO: 357040 - DNA, 532 bp, Homo sapiens
tcttccctttgtcttttctaaggatcaggaagacatttacttcatgaaaggggccttggaagaggtgatccgctactgcaccatgtacaacaacgggggcatccccctgccgctgacgccccagcagaggtcattctgcctgcaggaagagaagaggatggggtcgctcggtttgcggggtcagtgcctgtggtcccggcccagagctttaagcttgcatgtaacattgacttttaagtgcattcaagcagggtccctagtcaaggaggtcacccgtcccaaggagtcaggcagcatgctgacggcaataatgtgtgcttggaacctgatggtcacatgaaaggcacagaggtccccacctcatcccagttccttagtgacccccattaatccagagaagagggtaccctcccttgctgagtttcctaaggcaggtgaatgggctgcaccccaaacattgattttcccaataggtctttttgctcattgcctcttgtcaggaaaacccgaagttcttttcagtcaaggaaca

SEQ ID NO: 357041 - DNA, 417 bp, Homo sapiens
gaatcttttctgttttctcccttggcagatttgctgtttttaactggattggcctcatccgtcttcattttgtcagagctcctcaaactatgtgaaaaatactgttgcagccccaagagagtccagatgcaccctgaagatgtgtagtggaccgcactccgcggcaccttccctaatcatctcgatctggttgtgactgtggcccctgccgtgtctcctcgtcaggggagacttttaggaggccgcagccttccatcaccggatcagtttttcctcttaggaaagctgcaggaacctcgtgggctccagggacccaggcccacatccatccagcgttcccgctggctgtgggacagacagggaggggcctgtacagaaacaccacactgtttattaaatcacaatgatttttattaa

SEQ ID NO: 357042 - DNA, 3782 bp, Homo sapiens
gaatcaacagaatttgtctttttgtgactggtttatttcacttaacttcatcctcaaggttcaacttaaaggtgtatccatgttgtagcacgtgtcagcattttctttcgttctcaggctaaatagtatttcattgtgtgtgtacaccatgtttcatgcattcattcatcccttgaaagattggtgggttgtttcctcctttttgcttttgtgaacagtgctacgaacatggttgtacaaacatctcttggagccccactagcagttcctttgggtatataccccaaagtggaattgctggatctggtagctccctttttaattttttgaggaatcgccacacagtttccataacagctgcaccattttacattcccaagaccttttttttttttttttttttaagaagaaaagatgtgtttctgcatttctggaagtctatgctgcatttccatttgttgaaatttaagaccagagtcatcttttctgctgtaattataatggtcactggcttgtgccttttcctcctctctctgccccatctgcacggggtctttgaacaagtcccagcaccttggtggacaagcctgtgtccctggcccatcatggaagccgctgcctttcagagtgggagtctgtaccctgttgcctcattccttgctgcgcccatgagtgagcttgtgcctgacctctccttccaggtggacttacacactgggctgtcggagttctcggtgacgcagcgccggctggcccatggctggaatgagtttgttgctgacaacagcgaacctgtgtggaagaaatacctggatcagtttaagaaccccctgatcctgctgctgctgggctctgccctggtgagtgtcctcaccaaggagtatgaggacgccgtcagcatcgccacggcagtgcttgtcgtggtcactgtcgccttcatccaggagtacaggtcggagaaatctctggaagagctgaccaagctggttcctccagaatgtaactgcctaagagaaggaaaactccagcacctgcttgctcgagaactggttcctggtgatgtcgtatctctctcgatcggagaccggatccctgcagacatccgactcactgaggtcacggacctcttggtggatgaatccagtttcaccggggaagccgagccatgtagtaaaacagacagccccttgacaggcggtggggacctcaccaccctcagcaacatcgtcttcatggggaccctggtgcagtatgggaggggccagggggtcgtgattggaacaggggaaagctctcagttcggagaagtgtttaagatgatgcaggctgaagagacacctaaaactcctttgcagaaaagcatggacaggctaggaaagcaactgacactcttctcctttggcataatcggtctcatcatgctcattggctggtcgcaagggaaacaactcctgagtatgttcacgatcggggtcagcctggctgtggcggccattccagagggtctgcccatcgtcgtcatggtgacgctggtcctgggagtgctgcggatggccaagaagcgggtcatcgtgaagaagttacccatcgtggagactttaggttgctgcagcgttctctgttctgacaagacggggactctgactgccaatgaaatgacagtgacccagcttgtaacgtcagatgggcttcgtgccgaggtcagcggagttgggtatgacggtcaagggactgtgtgtcttctaccatccaaggaagtcattaaggaattttccaatgtctcagtgggaaagttagtggaggcgggctgtgttgccaacaatgcggtcatcagaaagaacgccgtgatggggcagcccaccgagggtgcattgatggccctggcgatgaagatggacttaagtgatattaaaaattcatatataagaaaaaaagagattccattcagttcagagcagaagtggatggcggtgaaatgcagtctgaagactgaggatcaggaagacatttacttcatgaaaggggccttggaagaggtgatccgctactgcaccatgtacaacaacgggggcatccccctgccgctgacgccccagcagaggtcattctgcctgcaggaagagaagaggatggggtcgctcggtttgcgggtgctggccctggcttctgggcccgagctggggcggctgacgtttctaggtcttgtgggcatcattgaccccccgagagttggcgtgaaggaagcagtccaggttctctccgagtctggtgtgtctgtgaagatgataacgggggatgccctggagacggccttggccataggaagaaacatcggcctgtgcaacgggaagctgcaagccatgtccggggaggaggtggacagcgtggagaagggcgagctggccgaccgcgtggggaaggtgtccgtgttcttcaggaccagcccaaagcacaagctcaaaatcatcaaggctctgcaggagtcaggggcgatcgtggccatgactggggatggggtgaacgacgcagtggccctgaagtctgcagacattgggatcgccatggggcagacagggacggacgtcagcaaagaggccgccaacatgatcctggtggatgatgacttctcagccatcatgaatgcagtggaggaaggcaagggtattttttacaacatcaaaaactttgtccgattccagctgagcacgagcatctccgccctgagtctcatcactctgtccaccgtgttcaacctgcccagccccctcaacgccatgcagatcctatggatcaacatcatcatggatgggccaccggcgcagagcttgggggtagagcccgttgacaaagacgccttcaggcagccaccacggagtgtgcgggacaccatcctcagcagagccctcatcctgaagatcctcatgtccgcggccatcatcttcagcgggaccctctttatcttctggaaggagatgcctgaagacagagcaagcactccccgcaccacgacgatgacgttcacttgttttgtgtttttcgatctcttcaacgccttgacctgccgctctcagaccaagctgatatttgagatcggctttctcaggaaccacatgttcctctactccgtcctggggtccatcctggggcagctggcggtcatttacatccccccgctgcagagggtcttccagacggagaacctgggagcgcttgatttgctgtttttaactggattggcctcatccgtcttcattttgtcagagctcctcaaactatgtgaaaaatactgttgcagccccaagagagtccagatgcaccctgaagatgtgtagtggaccgcactccgcggcaccttccctaatcatctcgatctggttgtgactgtggcccctgccgtgtctcctcgtcaggggagacttttaggaggccgcagccttccatcaccggatcagtttttcctcttaggaaagctgcaggaacctcgtgggctccagggacccaggcccacatccatccagcgttcccgctggctgtgggacagacagggaggggcctgtacagaaacaccacactgtttattaaatcacaatgatttttattaaccatgtctaactacgtatctgtgccacagcttgcagtgaggcaggccactcgtggcagatacaaggggctcctgagaggcagtgggtaggatggtcacactctgcccattgccctcctggaggccccatttcctcatcataaaatgagggacttttaaataaagtgctatgccgggggat

SEQ ID NO: 357043 - DNA, 2527 bp, Homo sapiens
gatcgaaaaacacaaaacaagtgaacgtcatcgtcgtggtgcggggagtgcttgctctgtcttcaggcatctccttccagaagataaagagggtcccgctgaacgggggatgccctggagacggccttggccataggaagaaacatcggcctgtgcaacgggaagctgcaagccatgtccggggaggaggtggacagcgtggagaagggcgagctggccgaccgcgtggggaaggtgtccgtgttcttcaggaccagcccaaagcacaagctcaaaatcatcaaggctctgcaggagtcaggggcgatcgtggccatgactggggatggggtgaacgacgcagtggccctgaagtctgcagacattgggatcgccatggggcagacagggacggacgtcagcaaagaggccgccaacatgatcctggtggatgatgacttctcagccatcatgaatgcagtggaggaaggcaagggtattttttacaacatcaaaaactttgtccgattccagctgagcacgagcatctccgccctgagtctcatcactctgtccaccgtgttcaacctgcccagccccctcaacgccatgcagatcctatggatcaacatcatcatggatgggccaccggcgcagagcttgggggtagagcccgttgacaaagacgccttcaggcagccaccacggagtgtgcgggacaccatcctcagcagagccctcatcctgaagatcctcatgtccgcggccatcatcttcagcgggaccctctttatcttctggaaggagatgcctgaagacagagcaagcactccccgcaccacgacgatgacgttcacttgttttgtgtttttcgatctcttcaacgccttgacctgccgctctcagaccaagctgatatttgagatcggctttctcaggaaccacatgttcctctactccgtcctggggtccatcctggggcagctggcggtcatttacatccccccgctgcagagggtcttccagacggagaacctgggagcgcttgatttgctgtttttaactggattggcctcatccgtcttcattttgtcagagctcctcaaactatgtgaaaaatactgttgcagccccaagagagtccagatgcaccctgaagatgtgtagtggaccgcactccgcggcaccttccctaatcatctcgatctggttgtgactgtggcccctgccgtgtctcctcgtcaggggagacttttaggaggccgcagccttccatcaccggatcagtttttcctcttaggaaagctgcaggaacctcgtgggctccagggacccaggcccacatccatccagcgttcccgctggctgtgggacagacagggaggggcctgtacagaaacaccacactgtttattaaatcacaatgatttttattaaccatgtctaactacgtatctgtgccacagcttgcagtgaggcaggccactcgtggcagatacaaggggctcctgagaggcagtgggtaggatggtcacactctgcccattgccctcctggaggccccatttcctcatcataaaatgagggacttttaaataaagtgctatgccgggggataattattttgatgtgtttacctagggtttttcatacaaggggccaggttggaaacccacagccatgtgttaatggccacgtggggtgagcagcaatccatcatgaatggcctacaggaaggcctcggcttttggagataaagagtagggctgggcatggtggctcacgcctgtaatcccagcactttgcaaggccaaggcaggcagattcactttgaggccagcctggccaacacagcaaaaccctgtctgtctctactaaaagtttaaaaaaaaaaacagttgccaggcgtgatgatgcacacctgttaatcccagctactcgggaggctgaggcaggagaatggcttgagtccaggaggtggagattgtaccactgcactgcagcatgggcaacaaagcaagagtctctctcagaaagtggcccttctctccggaaccaggaactgtagtatctcctgctgcctgcagacaagcttgatttcccactgccccaaagacttccaaaaaccgatctgctcttccacgtgacagatggcagaggagagaggtctccatgctgttcttctgcctgaagccacgccagaaccaccaaagggaaccagaagggggactccgtccccatctctcaggaaataaggccagagctagaaccccccatttactagtcaggcctcactagagaaactgaagtgtgccacttccacagtctgctaaggagtgcctccccctgagtcagggacaattcttgctctacttttcaggatccttgggcacactgctggcccgagacatttacttcccatttaaaattaagtaatcaaaataccagggtcgattactctgaactcttgcttatgtaaactttagggataaaactgtagtaagacacaaaatgctaacaataaaatataaattagactacattaaaa

SEQ ID NO: 357044 - DNA, 5145 bp, Homo sapiens
gaatcaacagaatttgtctttttgtgactggtttatttcacttaacttcatcctcaaggttcaacttaaaggtgtatccatgttgtagcacgtgtcagcattttctttcgttctcaggctaaatagtatttcattgtgtgtgtacaccatgtttcatgcattcattcatcccttgaaagattggtgggttgtttcctcctttttgcttttgtgaacagtgctacgaacatggttgtacaaacatctcttggagccccactagcagttcctttgggtatataccccaaagtggaattgctggatctggtagctccctttttaattttttgaggaatcgccacacagtttccataacagctgcaccattttacattcccaagaccttttttttttttttttttttaagaagaaaagatgtgtttctgcatttctggaagtctatgctgcatttccatttgttgaaatttaagaccagagtcatcttttctgctgtaattataatggtcactggcttgtgccttttcctcctctctctgccccatctgcacggggtctttgaacaagtcccagcaccttggtggacaagcctgtgtccctggcccatcatggaagccgctgcctttcagagtgggagtctgtaccctgttgcctcattccttgctgcgcccatgagtgagcttgtgcctgacctctccttccaggtggacttacacactgggctgtcggagttctcggtgacgcagcgccggctggcccatggctggaatgagtttgttgctgacaacagcgaacctgtgtggaagaaatacctggatcagtttaagaaccccctgatcctgctgctgctgggctctgccctggtgagtgtcctcaccaaggagtatgaggacgccgtcagcatcgccacggcagtgcttgtcgtggtcactgtcgccttcatccaggtgagtatttcctgaggtcccagtcagggtaagctgggcgggacaggagcttcatggagtccccacctttaaacagcacatctgatgtgcttcctgccaggagtacaggtcggagaaatctctggaagagctgaccaagctggttcctccagaatgtaactgcctaagagaaggaaaactccagcacctgcttgctcgagaactggttcctggtgatgtcgtatctctctcgatcggagaccggatccctgcagacatccgactcactgaggtcacggacctcttggtggatgaatccagtttcaccggggaagccgagccatgtagtaaaacagacagccccttgacaggcggtggggacctcaccaccctcagcaacatcgtcttcatggggaccctggtgcagtatgggaggggccagggggtcgtgattggaacaggggaaagctctcagttcggagaagtgtttaagatgatgcaggctgaagagacacctaaaactcctttgcagaaaagcatggacaggctaggaaagcaactgacactcttctcctttggcataatcggtctcatcatgctcattggctggtcgcaagggaaacaactcctgagtatgttcacgatcggggtcagcctggctgtggcggccattccagagggtctgcccatcgtcgtcatggtgacgctggtcctgggagtgctgcggatggccaagaagcgggtcatcgtgaagaagttacccatcgtggagactttaggttgctgcagcgttctctgttctgacaagacggggactctgactgccaatgaaatgacagtgacccagcttgtaacgtcagatgggcttcgtgccgaggtcagcggagttgggtatgacggtcaagggactgtgtgtcttctaccatccaaggaagtcattaaggaattttccaatgtctcagtgggaaagttagtggaggcgggctgtgttgccaacaatgcggtcatcagaaagaacgccgtgatggggcagcccaccgagggtgcattgatggccctggcgatgaagatggacttaagtgatattaaaaattcatatataagaaaaaaagagattccattcagttcagagcagaagtggatggcggtgaaatgcagtctgaagactgaggatcaggaagacatttacttcatgaaaggggccttggaagaggtgatccgctactgcaccatgtacaacaacgggggcatccccctgccgctgacgccccagcagaggtcattctgcctgcaggaagagaagaggatggggtcgctcggtttgcgggtgctggccctggcttctgggcccgagctggggcggctgacgtttctaggtcttgtgggcatcattgaccccccgagagttggcgtgaaggaagcagtccaggttctctccgagtctggtgtgtctgtgaagatgataacgggggatgccctggagacggccttggccataggaagaaacatcggcctgtgcaacgggaagctgcaagccatgtccggggaggaggtggacagcgtggagaagggcgagctggccgaccgcgtggggaaggtgtccgtgttcttcaggaccagcccaaagcacaagctcaaaatcatcaaggctctgcaggagtcaggggcgatcgtggccatgactggggatggggtgaacgacgcagtggccctgaagtctgcagacattgggatcgccatggggcagacagggacggacgtcagcaaagaggccgccaacatgatcctggtggatgatgacttctcagccatcatgaatgcagtggaggaaggcaagggtattttttacaacatcaaaaactttgtccgattccagctgagcacgtaagtagaggccagcattccgagtgtcattaagcaccacgcctggcgggcggccgctgactggctgcgtgtgccccgcaggagcatctccgccctgagtctcatcactctgtccaccgtgttcaacctgcccagccccctcaacgccatgcagatcctatggatcaacatcatcatggatgggccaccggcgcagagcttgggggtagagcccgttgacaaagacgccttcaggcagccaccacggagtgtgcgggacaccatcctcagcagagccctcatcctgaagatcctcatgtccgcggccatcatcttcagcgggaccctctttatcttctggaaggagctctccctctactactgacggccatccttcagccttccttgtaggaaatgaccttcactctgggtttaactggagtggcatcacctcccagggagacagttacttcctggaggaagtggtgtttcctccacccataggtgccctgcccccatcctcatggtggcagcaaatcagcatgtgctggggagaccctggggtagcagccactgacctcacacctggaggaagctgtgtgaccgattcatgagcttatgcctgaagacagagcaagcactccccgcaccacgacgatgacgttcacttgttttgtgtttttcgatctcttcaacgccttgacctgccgctctcagaccaagctgatatttgagatcggctttctcaggaaccacatgttcctctactccgtcctggggtccatcctggggcagctggcggtcatttacatccccccgctgcagagggtcttccagacggagaacctgggagcgcttgatttgctgtttttaactggattggcctcatccgtcttcattttgtcagagctcctcaaactatgtgaaaaatactgttgcagccccaagagagtccagatgcaccctgaagatgtgtagtggaccgcactccgcggcaccttccctaatcatctcgatctggttgtgactgtggcccctgccgtgtctcctcgtcaggggagacttttaggaggccgcagccttccatcaccggatcagtttttcctcttaggaaagctgcaggaacctcgtgggctccagggacccaggcccacatccatccagcgttcccgctggctgtgggacagacagggaggggcctgtacagaaacaccacactgtttattaaatcacaatgatttttattaaccatgtctaactacgtatctgtgccacagcttgcagtgaggcaggccactcgtggcagatacaaggggctcctgagaggcagtgggtaggatggtcacactctgcccattgccctcctggaggccccatttcctcatcataaaatgagggacttttaaataaagtgctatgccgggggataattattttgatgtgtttacctagggtttttcatacaaggggccaggttggaaacccacagccatgtgttaatggccacgtggggtgagcagcaatccatcatgaatggcctacaggaaggcctcggcttttggagataaagagtagggctgggcatggtggctcacgcctgtaatcccagcactttgcaaggccaaggcaggcagattcactttgaggccagcctggccaacacagcaaaaccctgtctgtctctactaaaagtttaaaaaaaaaaacagttgccaggcgtgatgatgcacacctgttaatcccagctactcgggaggctgaggcaggagaatggcttgagtccaggaggtggagattgtaccactgcactgcagcatgggcaacaaagcaagagtctctctcagaaagtggcccttctctccggaaccaggaactgtagtatctcctgctgcctgcagacaagcttgatttcccactgccccaaagacttccaaaaaccgatctgctcttccacgtgacagatggcagaggagagaggtctccatgctgttcttctgcctgaagccacgccagaaccaccaaagggaaccagaagggggactccgtccccatctctcaggaaataaggccagagctagaaccccccatttactagtcaggcctcactagagaaactgaagtgtgccacttccacagtctgctaaggagtgcctccccctgagtcagggacaattcttgctctacttttcaggatccttgggcacactgctggcccgagacatttacttcccatttaaaattaagtaatcaaaataccagggtcgattactctgaactcttgcttatgtaaactttagggataaaactgtagtaagacacaaaatgctaacaataaaatataaattagactacattaaaa

SEQ ID NO: 357045 - DNA, 5008 bp, Homo sapiens
gaatcaacagaatttgtctttttgtgactggtttatttcacttaacttcatcctcaaggttcaacttaaaggtgtatccatgttgtagcacgtgtcagcattttctttcgttctcaggctaaatagtatttcattgtgtgtgtacaccatgtttcatgcattcattcatcccttgaaagattggtgggttgtttcctcctttttgcttttgtgaacagtgctacgaacatggttgtacaaacatctcttggagccccactagcagttcctttgggtatataccccaaagtggaattgctggatctggtagctccctttttaattttttgaggaatcgccacacagtttccataacagctgcaccattttacattcccaagaccttttttttttttttttttttaagaagaaaagatgtgtttctgcatttctggaagtctatgctgcatttccatttgttgaaatttaagaccagagtcatcttttctgctgtaattataatggtcactggcttgtgccttttcctcctctctctgccccatctgcacggggtctttgaacaagtcccagcaccttggtggacaagcctgtgtccctggcccatcatggaagccgctgcctttcagagtgggagtctgtaccctgttgcctcattccttgctgcgcccatgagtgagcttgtgcctgacctctccttccaggtggacttacacactgggctgtcggagttctcggtgacgcagcgccggctggcccatggctggaatgagtttgttgctgacaacagcgaacctgtgtggaagaaatacctggatcagtttaagaaccccctgatcctgctgctgctgggctctgccctggtgagtgtcctcaccaaggagtatgaggacgccgtcagcatcgccacggcagtgcttgtcgtggtcactgtcgccttcatccaggtgagtatttcctgaggtcccagtcagggtaagctgggcgggacaggagcttcatggagtccccacctttaaacagcacatctgatgtgcttcctgccaggagtacaggtcggagaaatctctggaagagctgaccaagctggttcctccagaatgtaactgcctaagagaaggaaaactccagcacctgcttgctcgagaactggttcctggtgatgtcgtatctctctcgatcggagaccggatccctgcagacatccgactcactgaggtcacggacctcttggtggatgaatccagtttcaccggggaagccgagccatgtagtaaaacagacagccccttgacaggcggtggggacctcaccaccctcagcaacatcgtcttcatggggaccctggtgcagtatgggaggggccagggggtcgtgattggaacaggggaaagctctcagttcggagaagtgtttaagatgatgcaggctgaagagacacctaaaactcctttgcagaaaagcatggacaggctaggaaagcaactgacactcttctcctttggcataatcggtctcatcatgctcattggctggtcgcaagggaaacaactcctgagtatgttcacgatcggggtcagcctggctgtggcggccattccagagggtctgcccatcgtcgtcatggtgacgctggtcctgggagtgctgcggatggccaagaagcgggtcatcgtgaagaagttacccatcgtggagactttaggttgctgcagcgttctctgttctgacaagacggggactctgactgccaatgaaatgacagtgacccagcttgtaacgtcagatgggcttcgtgccgaggtcagcggagttgggtatgacggtcaagggactgtgtgtcttctaccatccaaggaagtcattaaggaattttccaatgtctcagtgggaaagttagtggaggcgggctgtgttgccaacaatgcggtcatcagaaagaacgccgtgatggggcagcccaccgagggtgcattgatggccctggcgatgaagatggacttaagtgatattaaaaattcatatataagaaaaaaagagattccattcagttcagagcagaagtggatggcggtgaaatgcagtctgaagactgaggatcaggaagacatttacttcatgaaaggggccttggaagaggtgatccgctactgcaccatgtacaacaacgggggcatccccctgccgctgacgccccagcagaggtcattctgcctgcaggaagagaagaggatggggtcgctcggtttgcgggtgctggccctggcttctgggcccgagctggggcggctgacgtttctaggtcttgtgggcatcattgaccccccgagagttggcgtgaaggaagcagtccaggttctctccgagtctggtgtgtctgtgaagatgataacgggggatgccctggagacggccttggccataggaagaaacatcggcctgtgcaacgggaagctgcaagccatgtccggggaggaggtggacagcgtggagaagggcgagctggccgaccgcgtggggaaggtgtccgtgttcttcaggaccagcccaaagcacaagctcaaaatcatcaaggctctgcaggagtcaggggcgatcgtggccatgactggggatggggtgaacgacgcagtggccctgaagtctgcagacattgggatcgccatggggcagacagggacggacgtcagcaaagaggccgccaacatgatcctggtggatgatgacttctcagccatcatgaatgcagtggaggaaggcaagggtattttttacaacatcaaaaactttgtccgattccagctgagcacgtaagtagaggccagcattccgagtgtcattaagcaccacgcctggcgggcggccgctgactggctgcgtgtgccccgcaggagcatctccgccctgagtctcatcactctgtccaccgtgttcaacctgcccagccccctcaacgccatgcagatcctatggatcaacatcatcatggatgggccaccggcgcagagcttgggggtagagcccgttgacaaagacgccttcaggcagccaccacggagtgtgcgggacaccatcctcagcagagccctcatcctgaagatcctcatgtccgcggccatcatcttcagcgggaccctctttatcttctggaaggaggtgccctgcccccatcctcatggtggcagcaaatcagcatgtgctggggagaccctggggtagcagccactgacctcacacctggaggaagctgtgtgaccgattcatgagcttatgcctgaagacagagcaagcactccccgcaccacgacgatgacgttcacttgttttgtgtttttcgatctcttcaacgccttgacctgccgctctcagaccaagctgatatttgagatcggctttctcaggaaccacatgttcctctactccgtcctggggtccatcctggggcagctggcggtcatttacatccccccgctgcagagggtcttccagacggagaacctgggagcgcttgatttgctgtttttaactggattggcctcatccgtcttcattttgtcagagctcctcaaactatgtgaaaaatactgttgcagccccaagagagtccagatgcaccctgaagatgtgtagtggaccgcactccgcggcaccttccctaatcatctcgatctggttgtgactgtggcccctgccgtgtctcctcgtcaggggagacttttaggaggccgcagccttccatcaccggatcagtttttcctcttaggaaagctgcaggaacctcgtgggctccagggacccaggcccacatccatccagcgttcccgctggctgtgggacagacagggaggggcctgtacagaaacaccacactgtttattaaatcacaatgatttttattaaccatgtctaactacgtatctgtgccacagcttgcagtgaggcaggccactcgtggcagatacaaggggctcctgagaggcagtgggtaggatggtcacactctgcccattgccctcctggaggccccatttcctcatcataaaatgagggacttttaaataaagtgctatgccgggggataattattttgatgtgtttacctagggtttttcatacaaggggccaggttggaaacccacagccatgtgttaatggccacgtggggtgagcagcaatccatcatgaatggcctacaggaaggcctcggcttttggagataaagagtagggctgggcatggtggctcacgcctgtaatcccagcactttgcaaggccaaggcaggcagattcactttgaggccagcctggccaacacagcaaaaccctgtctgtctctactaaaagtttaaaaaaaaaaacagttgccaggcgtgatgatgcacacctgttaatcccagctactcgggaggctgaggcaggagaatggcttgagtccaggaggtggagattgtaccactgcactgcagcatgggcaacaaagcaagagtctctctcagaaagtggcccttctctccggaaccaggaactgtagtatctcctgctgcctgcagacaagcttgatttcccactgccccaaagacttccaaaaaccgatctgctcttccacgtgacagatggcagaggagagaggtctccatgctgttcttctgcctgaagccacgccagaaccaccaaagggaaccagaagggggactccgtccccatctctcaggaaataaggccagagctagaaccccccatttactagtcaggcctcactagagaaactgaagtgtgccacttccacagtctgctaaggagtgcctccccctgagtcagggacaattcttgctctacttttcaggatccttgggcacactgctggcccgagacatttacttcccatttaaaattaagtaatcaaaataccagggtcgattactctgaactcttgcttatgtaaactttagggataaaactgtagtaagacacaaaatgctaacaataaaatataaattagactacattaaaa

SEQ ID NO: 357046 - DNA, 2467 bp, Homo sapiens
gaatcaacagaatttgtctttttgtgactggtttatttcacttaacttcatcctcaaggttcaacttaaaggtgtatccatgttgtagcacgtgtcagcattttctttcgttctcaggctaaatagtatttcattgtgtgtgtacaccatgtttcatgcattcattcatcccttgaaagattggtgggttgtttcctcctttttgcttttgtgaacagtgctacgaacatggttgtacaaacatctcttggagccccactagcagttcctttgggtatataccccaaagtggaattgctggatctggtagctccctttttaattttttgaggaatcgccacacagtttccataacagctgcaccattttacattcccaagaccttttttttttttttttttttaagaagaaaagatgtgtttctgcatttctggaagtctatgctgcatttccatttgttgaaatttaagaccagagtcatcttttctgctgtaattataatggtcactggcttgtgccttttcctcctctctctgccccatctgcacggggtctttgaacaagtcccagcaccttggtggacaagcctgtgtccctggcccatcatggaagccgctgcctttcagagtgggagtctgtaccctgttgcctcattccttgctgcgcccatgagtgagcttgtgcctgacctctccttccaggtggacttacacactgggctgtcggagttctcggtgacgcagcgccggctggcccatggctggaatgagtttgttgctgacaacagcgaacctgtgtggaagaaatacctggatcagtttaagaaccccctgatcctgctgctgctgggctctgccctggtgagtgtcctcaccaaggagtatgaggacgccgtcagcatcgccacggcagtgcttgtcgtggtcactgtcgccttcatccaggtgagtatttcctgaggtcccagtcagggtaagctgggcgggacaggagcttcatggagtccccacctttaaacagcacatctgatgtgcttcctgccaggagtacaggtcggagaaatctctggaagagctgaccaagctggttcctccagaatgtaactgcctaagagaaggaaaactccagcacctgcttgctcgagaactggttcctggtgatgtcgtatctctctcgatcggagaccggatccctgcagacatccgactcactgaggtcacggacctcttggtggatgaatccagtttcaccggggaagccgagccatgtagtaaaacagacagccccttgacaggcggtggggacctcaccaccctcagcaacatcgtcttcatggggaccctggtgcagtatgggaggggccagggggtcgtgattggaacaggggaaagctctcagttcggagaagtgtttaagatgatgcaggctgaagagacacctaaaactcctttgcagaaaagcatggacaggctaggaaagcaactgacactcttctcctttggcataatcggtctcatcatgctcattggctggtcgcaagggaaacaactcctgagtatgttcacgatcggggtcagcctggctgtggcggccattccagagggtctgcccatcgtcgtcatggtgacgctggtcctgggagtgctgcggatggccaagaagcgggtcatcgtgaagaagttacccatcgtggagactttaggttgctgcagcgttctctgttctgacaagacggggactctgactgccaatgaaatgacagtgacccagcttgtaacgtcagatgggcttcgtgccgaggtcagcggagttgggtatgacggtcaagggactgtgtgtcttctaccatccaaggaagtcattaaggaattttccaatgtctcagtgggaaagttagtggaggcgggctgtgttgccaacaatgcggtcatcagaaagaacgccgtgatggggcagcccaccgagggtgcattgatggccctggcgatgaagatggacttaagtgatattaaaaattcatatataagaaaaaaagagattccattcagttcagagcagaagtggatggcggtgaaatgcagtctgaagactgaggatcaggaagacatttacttcatgaaaggggccttggaagaggtgatccgctactgcaccatgtacaacaacgggggcatccccctgccgctgacgccccagcagaggtcattctgcctgcaggaagagaagaggatggggtcgctcggtttgcgggtgctggccctggcttctgggcccgagctggggcggctgacgtttctaggtcttgtgggcatcattgaccccccgagagttggcgtgaaggaagcagtccaggttctctccgagtctggtgtgtctgtgaagatgatagaaactggctctgagcgggggaaactggctctgagcgggagaaactggctctgagcgggagaaactggctctgagcggg

SEQ ID NO: 357047 - DNA, 1248 bp, Homo sapiens
gaatcaacagaatttgtctttttgtgactggtttatttcacttaacttcatcctcaaggttcaacttaaaggtgtatccatgttgtagcacgtgtcagcattttctttcgttctcaggctaaatagtatttcattgtgtgtgtacaccatgtttcatgcattcattcatcccttgaaagattggtgggttgtttcctcctttttgcttttgtgaacagtgctacgaacatggttgtacaaacatctcttggagccccactagcagttcctttgggtatataccccaaagtggaattgctggatctggtagctccctttttaattttttgaggaatcgccacacagtttccataacagctgcaccattttacattcccaagaccttttttttttttttttttttaagaagaaaagatgtgtttctgcatttctggaagtctatgctgcatttccatttgttgaaatttaagaccagagtcatcttttctgctgtaattataatggtcactggcttgtgccttttcctcctctctctgccccatctgcacggggtctttgaacaagtcccagcaccttggtggacaagcctgtgtccctggcccatcatggaagccgctgcctttcagagtgggagtctgtaccctgttgcctcattccttgctgcgcccatgagtgagcttgtgcctgacctctccttccaggtggacttacacactgggctgtcggagttctcggtgacgcagcgccggctggcccatggctggaatgagtttgttgctgacaacagcgaacctgtgtggaagaaatacctggatcagtttaagaaccccctgatcctgctgctgctgggctctgccctggtgagtgtcctcaccaaggagtatgaggacgccgtcagcatcgccacggcagtgcttgtcgtggtcactgtcgccttcatccaggtgagtatttcctgaggtcccagtcagggtaagctgggcgggacaggagcttcatggagtccccacctttaaacagcacatctgatgtgcttcctgccaggagtacaggtcggagaaatctctggaagagctgaccaagctggttcctccagaatgtaactggtaagtcagagcctccctgggactttttggttcactggaggagccagggagctggagagtttggcaaatgtttgctgaaagttgtatccttggtagtgtcggacaagagaaccacatctcactgggagttctaaggcctggt

SEQ ID NO: 357048 - DNA, 446 bp, Homo sapiens
ataggatgtttcatgtggtgtatgcatcggggtggagaaaccacccaaatttactgagaaggggaacttggaagtgctgctcttcaccattcagagcaagatgagggccaacaaccagaaggtctacatgccccgggaggggaagctcatctctgacatcaacaaggcctgggaaagactggaaaaagcggaacacgaaagagaactggctttgcggaatgagctcataagacaggagaaactggaacagctcgcccgcagatttgatcgcaaggcagctatgagggagacttggctgagcgaaaaccagcgtctggtgtctcaggacaactttgggtttgaccttcctgcagttgaggcctggtgctcagtcgtacgacctgtacctctcaacttttgccctatctgttaaatatatgctatgtcattaaatgcttttaaatcta

SEQ ID NO: 357049 - DNA, 971 bp, Homo sapiens
  misc_feature (510)..(510): n is a, c, g, or t
aagtcttttttcctaataatccattttccacattgccatgagggtaaagggttccaatcaaaaccaccattaaactgcatagtttctagtcttccctcagccctgatgctaattatgatagtttgcatagacataacttaaacttgtgattctccctccttccagagctttttgtagccctttttccccccaaaattagttttgttcaaaatcaagcattgggcccagccattaagataagacctaataagtgagagatacagttcccaagagtttacagatccaggtgttcacatggtggtggccagtctaccgtttatcttgtcaaggttgttactgctaatttggtgtcactttggtcttgggcagcggtggtgggcgacgtatctaatgagcgtgccattgacttctccatgtttgtctgtgtacgaggggtgcaggttgtctgtaatccactaaagtgtcagccacacccagctttagtaactcgctaatcgcacaccctgggtntatcagccaggggctgctacagttaatggtacacagttgatggtacacaggctgaaaatgataatgaatcaagaccctactacatttccaaagccgaaaagccatgagggttacaatttaaatgagcttgggaaggaacgctcccgaagacgtctccagcctgaagggtcagagccgctggaagcctggctgtctctgggctttctcgtctcagtgcagcaaggcaccgtgatcaaccaacccgtgatggggaaggccctggttctgtctttgtttgggggtaaatagctgtgtggtgttgagtgactgtgattggcttttccagctcctttaacacaaactacaacccactcacgatacaacttcggcagatgtggtcaaattgatgtttgttgacttgcctcatttccttccagctcttaagttccaaagtcttcgggtcgtttgagatcctctagagt

SEQ ID NO: 357050 - DNA, 953 bp, Homo sapiens
  misc_feature (489)..(489): n is a, c, g, or t
gataattctagtacaaagtataataaaaccacttgtacacttaccaatgatttaaagggtttattatacatctacattatattgtacgtttgagataattctagtacaaagtataataaaactagatgtataataaaccctttaaatcattggtaagtgtacaagtggtggaactgaagcatttactggacaaagtaatgttactctaatggttacttgctcgtgcgttgccacactgtgttataatttgcttcatttccttgctatttgatacatagtgtgcatttctctgtcactgtaactattgtaatgacaaattttcatcttactgcacaatcaaaatgacattgataggaatgaactccagaggctgggcctgaacagggaggtggtcgctcaggcctggtgctcagtcgtacgacctgtacctctcaacttttgccctatctgttaaatatatgctatgtcattaaatgcttttaaatctanaaaaaaaaaaaaaaaaaaaaaaaaaaaaaaaaaaaaaaaaaaaaaaaaaaaaaaaaaaaaggggggggggggaaaaataaccccggggggggccattgcccccccttttttttaaaggggggcccccaaaaggggggcgatataaaaaaaagacagacgggggcgggtaaaaaaccgcggcgagcggaaacacggccactggggtcattggggaagagagaccacctcgcgggggggacacagggggcaccaccccacaagatataggccggggaaaaaaaaatgggctttagtgtaccccgaccaatcgcgggggaaaatcgtccggtttattcaaattatgaggctccataaacacgagaagaagacagacagaagaggcgacgcacacagagagagagaagagacgaagtacagaggaagaaaacaagagcagaaagagagcaagacgagaacagcccaca

SEQ ID NO: 357051 - DNA, 604 bp, Homo sapiens
gtcgagctcggtatcccgagtgggtccctgccggatcacagacctgtacactgaccttcgagatggacggatgctcatcaagctgctggaggtcctctctggagagaggctgcctaaacccaccaagggacgaatgcgcatccactgcttagagaatgtggacaaggcccttcagttcctgaaggagcagagagtccatcttgagaacatggggtcccatgacatcgtggatggaaaccaccggctgacccttggcctcatctggaccatcatcctgcgcttccagatccaggatatcagtgtggaaactgaagacaacaaagagaagaaatctgccaaggatgcattgctgttgtggtgccagatgaagacagctgggtaccccaatgtcaacattcacaatttcaccactagctggagggacggcatggccttcaatgcactgatacacaaacaccggcctgacctgatagattttgacaaactaaagaatgttacagcacactacaaccttgcagaatgcatattaattctgtcagtacagcatctcgcactgtcgtgactggcatggcgcattacgaggtaacatcatagaatcagctat

SEQ ID NO: 357052 - DNA, 8513 bp, Homo sapiens
gtgagctgaagcagggcagggcatcaactcacccaggaagtgcaaggggtttggggattttcctttcctagccaagggaaggcatgacagactgtacctggaaaaacaggacactcttgcccaaatactgcactttttgcacagtcttagcaactggcagaccaggagattctctcctgtgcctgattcattgggtcccacacccatagggccttgcttactgccagtgcagcagtctgagattaacaccccatccccgggagaactctaagaaggagctgatgtggaggagcagctgagacagttcaagatgacgaccacagtagccacagactatgacaacattgagatccagcagcagtacagtgatgtcaacaaccgctgggatgtcgacgactgggacaatgagaacagctctgcgcggctttttgagcggtcccgcatcaaggctctggcagatgagcgtgaagccgtgcagaagaagaccttcaccaagtgggtcaattcccaccttgcccgtgtgtcctgccggatcacagacctgtacactgaccttcgagatggacggatgctcatcaagctgctggaggtcctctctggagagaggctgcctaaacccaccaagggacgaatgcgcatccactgcttagagaatgtggacaaggcccttcagttcctgaaggagcagagagtccatcttgagaacatggggtcccatgacatcgtggatggaaaccaccggctgacccttggcctcatctggaccatcatcctgcgcttccagatccaggatatcagtgtggaaactgaagacaacaaagagaagaaatctgccaaggatgcattgctgttgtggtgccagatgaagacagctgggtaccccaatgtcaacattcacaatttcaccactagctggagggacggcatggccttcaatgcactgatacacaaacaccggcctgacctgatagattttgacaaactaaagaaatctaacgcacactacaacctgcagaatgcatttaatctggcagaacagcacctcggcctcactaaactgttggaccccgaagacatcagcgtggaccatcctgatgagaagtccataatcacttatgtggtgacttattaccactacttctctaagatgaaggccttagctgttgaaggaaaacgaattggaaaggtgcttgacaatgctattgaaacagaaaaaatgattgaaaagtatgaatcacttgcctctgaccttctggaatggattgaacaaaccatcatcattctgaacaatcgcaaatttgccaattcactggtcggggttcaacagcagcttcaggcattcaacacttaccgcactgtggagaaaccacccaaatttactgagaaggggaacttggaagtgctgctcttcaccattcagagcaagatgagggccaacaaccagaaggtctacatgccccgggaggggaagctcatctctgacatcaacaaggcctgggaaagactggaaaaagcggaacacgaaagagaactggctttgcggaatgagctcataagacaggagaaactggaacagctcgcccgcagatttgatcgcaaggcagctatgagggagacttggctgagcgaaaaccagcgtctggtgtctcaggacaactttgggtttgaccttcctgcagttgaggccgccacaaaaaagcacgaggccattgagacagacattgccgcatacgaggagcgtgtgcaggctgtggtagccgtggccagggagctcgaggccgagaattaccacgacatcaagcgcatcacagcgaggaaggacaatgtcatccggctctgggaatacctactggaactgctcagggcccggagacagcggctcgagatgaacctggggctgcagaagatattccaggaaatgctctacattatggactggatggatgaaatgaaggtgctagtattgtctcaagactatggcaaacacttacttggtgtggaagacctgttacagaagcacaccctggttgaagcagacattggcatccaggcagagcgggtgagaggtgtcaatgcctccgcccagaagttcgcaacagacggggaaggttacaagccctgtgacccccaggtgatccgagaccgcgtggcccacatggagttctgttatcaagagctttgccagctggcggctgagcgcagggcccgtctggaagagtcccgccgcctctggaagttcttctgggagatggcagaagaggaaggctggatacgggagaaggagaagatcctgtcctcggacgattacgggaaagacctgaccagcgtcatgcgcctgctcagcaagcaccgggcgttcgaggacgagatgagcggccgcagtggccactttgagcaggccatcaaggaaggcgaagacatgatcgcggaggagcacttcgggtcggagaagatccgtgagaggatcatttacatccgggagcagtgggccaacctagagcagctctcggccattcggaagaagcgcctggaggaggcctccctgctgcaccagttccaggcagatgctgatgacattgatgcctggatgctggacatcctcaagattgtctccagcagcgacgtgggccacgatgagtattccacacagtctctggtcaagaaacacaaggacgtggcggaagagatcgccaattacaggcccacccttgacacgctgcacgaacaagccagcgccctcccccaggagcatgccgagtctccagacgtgaggggcaggctgtcgggcatcgaggagcggtataaggaggtggcagagctgacgcggctgcggaagcaggcactccaggacactctggccctgtacaagatgttcagcgaggctgatgcctgtgagctctggatcgacgagaaggagcagtggctcaacaacatgcagatcccagagaagctggaggatctggaggtcatccagcacagatttgagagcctagaaccagaaatgaacaaccaggcttcccgggttgcagtggtgaaccagattgcacgccagctgatgcacagcggccacccaagtgagaaggaaatcaaagcccagcaggacaaactcaacacaaggtggagccagttcagagaactggttgacaggaagaaggatgccctcctgtctgccctgagcatccagaactaccacctcgagtgcaatgaaaccaaatcctggattcgggaaaagaccaaggtcatcgagtccacccaggacctgggcaatgacctggctggcgtcatggccctgcagcgcaagctgaccggcatggagcgggacttggtggccattgaggcaaagctgagtgacctgcagaaggaggcggagaagctggagtccgagcaccccgaccaggcccaggccatcctgtctcggctggccgagatcagcgacgtgtgggaggagatgaagaccaccctgaaaaaccgagaggcctccctgggagaggccagcaagctgcagcagttcctacgggacttggacgacttccagtcctggctctctaggacccagacagcgatcgcctcggaggacatgccaaacaccctgaccgaggctgagaagctgctcacgcagcacgagaacatcaagaacgagatcgacaactacgaggaggactaccagaagatgagggacatgggcgagatggtcacccaggggcagaccgatgcccagtacatgtttctgcggcagcggctgcaggccctggacactggatggaacgagctccacaagatgtgggagaacagacaaaatctcctatcccagtcacatgcctaccagcagttcctcagagacacgaagcaagccgaagcctttcttaacaaccaggagtatgttctggctcacactgaaatgcctaccaccttggaaggagctgaagcagcaattaaaaagcaagaggacttcatgaccaccatggacgccaatgaggagaagatcaatgctgtggtggagactggccggaggctggtgagcgatgggaacatcaactcagatcgcatccaggagaaggtggactctattgatgacagacataggaagaatcgtgagacagccagtgaacttttgatgaggttgaaggacaacagggatctacagaaattcctgcaagattgtcaagagctgtctctctggatcaatgagaagatgctcacagcccaggacatgtcttacgatgaagccagaaatctgcacagtaaatggttgaagcatcaagcatttatggcagaacttgcatccaacaaagaatggcttgacaaaatcgagaaggaaggaatgcagctcatttcagaaaagcctgagacggaagctgtggtgaaggagaaactcactggtttacataaaatgtgggaagtccttgaatccactacccagacaaaggcccagcggctctttgatgcaaacaaggccgaacttttcacccagagctgtgcagatctagacaaatggctgcacggcctggagagtcagattcagtctgatgactatggcaaagacctgaccagtgtcaatatcctgctgaaaaagcaacagatgctggagaatcagatggaagtgcggaagaaggagatcgaagagctccaaagccaagcccaggccctgagtcaggaagggaagagcaccgacgaggtagacagcaagcgcctcaccgtgcagaccaagttcatggagttgctggagcccttgaacgagaggaagcataacctgctggcctccaaagagatccatcagttcaacagggatgtggaggacgagatcttgtgggttggagagaggatgcctttggcaacttccacggatcatggccacaacctccagactgtgcagctgttaataaagaaaaatcagaccctccagaaagaaatccaggggcaccagcctcgcattgacgacatctttgagaggagccaaaacatcgtcactgacagcagcagcctcagcgctgaggccatcagacagaggcttgccgacctgaagcagctgtggggtctcctcattgaggagacagagaaacgccacaggcggctggaggaggcgcacagggcccagcagtactactttgacgctgctgaggccgaagcctggatgagcgagcaggagctgtacatgatgtcagaggagaaggccaaggatgagcagagtgctgtctccatgttgaagaagcaccagatcttagaacaagctgtggaggactatgcagagaccgtgcatcagctctccaagaccagccgggccctggtggccgacagccatcctgaaagtgagcgcattagcatgcggcagtccaaagtggataaactgtacgctggtctgaaagaccttgctgaagagagaagaggcaagctggatgagagacacaggttattccagctcaaccgggaggtggacgacctggagcagtggatcgctgagagggaggtggtcgcagggtcccatgaactgggacaggactatgagcatgtcacgatgttacaagaacgattccgggagtttgcccgagacaccgggaacattgggcaggagcgcgtggacacggtcaatcacctggcagatgagctcatcaactctggacattcagatgccgccaccatcgctgaatggaaggatggcctcaatgaagcctgggccgacctcctggagctcattgacacaagaacacagattcttgccgcttcctatgaactgcacaagttttaccacgatgccaaggagatctttgggcgtatacaggacaaacacaagaaactccctgaggagcttgggagagatcagaacacagtggagaccttacagagaatgcacactacatttgagcatgacatccaggctctgggcacacaggtgaggcagctgcaggaggatgcagcccgcctccaggcggcctatgcgggtgacaaggccgacgatatccagaagcgcgagaacgaggtcctggaagcctggaagtccctcctggacgcctgtgagagccgcagggtgcggctggtggacacaggggacaagttccgcttcttcagcatggtgcgcgacctcatgctctggatggaggatgtcatccggcagatcgaggcccaggagaagccaagggatgtatcatctgttgaactcttaatgaataatcatcaaggcatcaaagctgaaattgatgcacgtaatgacagtttcacaacctgcattgaacttgggaaatccctgttggcgagaaaacactatgcatctgaggagatcaaggaaaaattactgcagttgacggaaaagaggaaagaaatgatcgacaagtgggaagaccgatgggaatggttaagactgattctggaggtccatcagttctcaagagacgccagtgtggccgaggcctggctgcttggacaggagccgtacctatccagccgagagataggccagagcgtggacgaggtggagaagctcatcaagcgccacgaggcatttgaaaagtctgcagcaacctgggatgagaggttctctgccctggaaaggctgactacattggagttactggaagtgcgcagacagcaagaggaagaggagaggaagaggcggccgccttctcccgagccgagcacgaaggtttcagaggaagccgagtcccagcagcagtgggatacttcaaaaggagaacaagtttcccaaaacggtttgccagctgaacagggatctccacggatggcagaaacggtggacacaagcgaaatggtcaacggcgctacagaacaaaggacgagctctaaagagtccagccccatcccctccccgacctctgatcgtaaagccaagactgccctcccagcccagagtgccgccaccttaccagccagaacccaggagacaccttcggcccagatggaaggcttcctcaatcggaaacacgagtgggaggcccacaataagaaagcctcaagcaggtcctggcacaatgtttattgtgtcataaataaccaagaaatgggtttctacaaagatgcaaagactgctgcttctggaattccctaccacagcgaggtccctgtgagtttgaaagaagctgtctgcgaagtggcccttgattacaaaaagaagaaacacgtattcaagctaagactaaatgatggcaatgagtacctcttccaagccaaagacgatgaggaaatgaacacatggatccaggctatctcttccgccatctcctctgataaacacgaggtgtctgccagcacccagagcacgccagcatccagccgcgcgcagaccctccccaccagcgtcgtcaccatcaccagcgagtccagtcccggcaagcgggaaaaggacaaagagaaagacaaagagaagcggttcagcctttttggcaaaaagaaatgaactcctttccttcacctcctgcccttctcttaccttttcagtgaaattccagcatgcaagctcagaaccaacacattactctctgtgcctaatgttcctcaatgtggttgatttttttttttttttaatttatagagcatttcggggggggtgggggaaacacacctaaacactttatctccaagttacaaaagtttgaggtgcagagggaaggccagattttttttttaatgaaattatatagattagatctcagtatttaaactgttcctcaattttgtgaggctgtgttggaaataacccgcctctagtgctgttggtatgcaaggcagcggtgcttaatcaatatttcctgtgctcaccagaggcaaaatgtaccaatatcctgacaccattctctctccatttacttctggtggttaccctgactcttgactcttagaagtgcccgagatggggctaacctttattaaacagatcgcatattatgatcttgctgcagccacagtgcagctccacattaactctacagaccaaaccatttgtatctggcatcacttactaacacacgacatgcggcttttctgcatcaactgctatgacggttaagaatgtcagtatacaagaaggaatagaaaactgatactgttttaaataatctgtaatttcaattttttttttttttgctgaaatacattatattgtacgtttgagataattctagtacaaagtataataaaactagatgtataataaaccctttaaatcattggtaagtgtacaagtggtggaactgaagcatttactggacaaagtaatgttactctaatggttacttgctcgtgcgttgccacactgtgttataatttgcttcatttccttgctatttgatacatagtgtgcatttctctgtcactgtaactattgtaatgacaaattttcatcttactgcacaatcaaaatgacattgataggaatgaactccagaggctgggcctgaacagggaggtggtcgctcaggcctggtgctcagtcgtacgacctgtacctctcaacttttgccctatctgttaaatatatgctatgtcattaaatgcttttaaatcta

SEQ ID NO: 357053 - DNA, 8460 bp, Homo sapiens
gtgagctgaagcagggcagggcatcaactcacccaggaagtgcaaggggtttggggattttcctttcctagccaagggaaggcatgacagactgtacctggaaaaacaggacactcttgcccaaatactgcactttttgcacagtcttagcaactggcagaccaggagattctctcctgtgcctgattcattgggtcccacacccatagggccttgcttactgccagtgcagcagtctgagattaacaccccatccccgggagaactctaagaaggagctgatgtggaggagcagctgagacagttcaagatgacgaccacagtagccacagactatgacaacattgagatccagcagcagtacagtgatgtcaacaaccgctgggatgtcgacgactgggacaatgagaacagctctgcgcggctttttgagcggtcccgcatcaaggctctggcagatgagcgtgaagccgtgcagaagaagaccttcaccaagtgggtcaattcccaccttgcccgtgtgtcctgccggatcacagacctgtacactgaccttcgagatggacggatgctcatcaagctgctggaggtcctctctggagagaggctgcctaaacccaccaagggacgaatgcgcatccactgcttagagaatgtggacaaggcccttcagttcctgaaggagcagagagtccatcttgagaacatggggtcccatgacatcgtggatggaaaccaccggctgacccttggcctcatctggaccatcatcctgcgcttccagatccaggatatcagtgtggaaactgaagacaacaaagagaagaaatctgccaaggatgcattgctgttgtggtgccagatgaagacagctgggtaccccaatgtcaacattcacaatttcaccactagctggagggacggcatggccttcaatgcactgatacacaaacaccggcctgacctgatagattttgacaaactaaagaaatctaacgcacactacaacctgcagaatgcatttaatctggcagaacagcacctcggcctcactaaactgttggaccccgaagacatcagcgtggaccatcctgatgagaagtccataatcacttatgtggtgacttattaccactacttctctaagatgaaggccttagctgttgaaggaaaacgaattggaaaggtgcttgacaatgctattgaaacagaaaaaatgattgaaaagtatgaatcacttgcctctgaccttctggaatggattgaacaaaccatcatcattctgaacaatcgcaaatttgccaattcactggtcggggttcaacagcagcttcaggcattcaacacttaccgcactgtggagaaaccacccaaatttactgagaaggggaacttggaagtgctgctcttcaccattcagagcaagatgagggccaacaaccagaaggtctacatgccccgggaggggaagctcatctctgacatcaacaaggcctgggaaagactggaaaaagcggaacacgaaagagaactggctttgcggaatgagctcataagacaggagaaactggaacagctcgcccgcagatttgatcgcaaggcagctatgagggagacttggctgagcgaaaaccagcgtctggtgtctcaggacaactttgggtttgaccttcctgcagttgaggccgccacaaaaaagcacgaggccattgagacagacattgccgcatacgaggagcgtgtgcaggctgtggtagccgtggccagggagctcgaggccgagaattaccacgacatcaagcgcatcacagcgaggaaggacaatgtcatccggctctgggaatacctactggaactgctcagggcccggagacagcggctcgagatgaacctggggctgcagaagatattccaggaaatgctctacattatggactggatggatgaaatgaaggtgctagtattgtctcaagactatggcaaacacttacttggtgtggaagacctgttacagaagcacaccctggttgaagcagacattggcatccaggcagagcgggtgagaggtgtcaatgcctccgcccagaagttcgcaacagacggggaaggttacaagccctgtgacccccaggtgatccgagaccgcgtggcccacatggagttctgttatcaagagctttgccagctggcggctgagcgcagggcccgtctggaagagtcccgccgcctctggaagttcttctgggagatggcagaagaggaaggctggatacgggagaaggagaagatcctgtcctcggacgattacgggaaagacctgaccagcgtcatgcgcctgctcagcaagcaccgggcgttcgaggacgagatgagcggccgcagtggccactttgagcaggccatcaaggaaggcgaagacatgatcgcggaggagcacttcgggtcggagaagatccgtgagaggatcatttacatccgggagcagtgggccaacctagagcagctctcggccattcggaagaagcgcctggaggaggcctccctgctgcaccagttccaggcagatgctgatgacattgatgcctggatgctggacatcctcaagattgtctccagcagcgacgtgggccacgatgagtattccacacagtctctggtcaagaaacacaaggacgtggcggaagagatcgccaattacaggcccacccttgacacgctgcacgaacaagccagcgccctcccccaggagcatgccgagtctccagacgtgaggggcaggctgtcgggcatcgaggagcggtataaggaggtggcagagctgacgcggctgcggaagcaggcactccaggacactctggccctgtacaagatgttcagcgaggctgatgcctgtgagctctggatcgacgagaaggagcagtggctcaacaacatgcagatcccagagaagctggaggatctggaggtcatccagcacagatttgagagcctagaaccagaaatgaacaaccaggcttcccgggttgcagtggtgaaccagattgcacgccagctgatgcacagcggccacccaagtgagaaggaaatcaaagcccagcaggacaaactcaacacaaggtggagccagttcagagaactggttgacaggaagaaggatgccctcctgtctgccctgagcatccagaactaccacctcgagtgcaatgaaaccaaatcctggattcgggaaaagaccaaggtcatcgagtccacccaggacctgggcaatgacctggctggcgtcatggccctgcagcgcaagctgaccggcatggagcgggacttggtggccattgaggcaaagctgagtgacctgcagaaggaggcggagaagctggagtccgagcaccccgaccaggcccaggccatcctgtctcggctggccgagatcagcgacgtgtgggaggagatgaagaccaccctgaaaaaccgagaggcctccctgggagaggccagcaagctgcagcagttcctacgggacttggacgacttccagtcctggctctctaggacccagacagcgatcgcctcggaggacatgccaaacaccctgaccgaggctgagaagctgctcacgcagcacgagaacatcaagaacgagatcgacaactacgaggaggactaccagaagatgagggacatgggcgagatggtcacccaggggcagaccgatgcccagtacatgtttctgcggcagcggctgcaggccctggacactggatggaacgagctccacaagatgtgggagaacagacaaaatctcctatcccagtcacatgcctaccagcagttcctcagagacacgaagcaagccgaagcctttcttaacaaccaggagtatgttctggctcacactgaaatgcctaccaccttggaaggagctgaagcagcaattaaaaagcaagaggacttcatgaccaccatggacgccaatgaggagaagatcaatgctgtggtggagactggccggaggctggtgagcgatgggaacatcaactcagatcgcatccaggagaaggtggactctattgatgacagacataggaagaatcgtgagacagccagtgaacttttgatgaggttgaaggacaacagggatctacagaaattcctgcaagattgtcaagagctgtctctctggatcaatgagaagatgctcacagcccaggacatgtcttacgatgaagccagaaatctgcacagtaaatggttgaagcatcaagcatttatggcagaacttgcatccaacaaagaatggcttgacaaaatcgagaaggaaggaatgcagctcatttcagaaaagcctgagacggaagctgtggtgaaggagaaactcactggtttacataaaatgtgggaagtccttgaatccactacccagacaaaggcccagcggctctttgatgcaaacaaggccgaacttttcacccagagctgtgcagatctagacaaatggctgcacggcctggagagtcagattcagtctgatgactatggcaaagacctgaccagtgtcaatatcctgctgaaaaagcaacagatgctggagaatcagatggaagtgcggaagaaggagatcgaagagctccaaagccaagcccaggccctgagtcaggaagggaagagcaccgacgaggtagacagcaagcgcctcaccgtgcagaccaagttcatggagttgctggagcccttgaacgagaggaagcataacctgctggcctccaaagagatccatcagttcaacagggatgtggaggacgagatcttgtgggttggagagaggatgcctttggcaacttccacggatcatggccacaacctccagactgtgcagctgttaataaagaaaaatcagaccctccagaaagaaatccaggggcaccagcctcgcattgacgacatctttgagaggagccaaaacatcgtcactgacagcagcagcctcagcgctgaggccatcagacagaggcttgccgacctgaagcagctgtggggtctcctcattgaggagacagagaaacgccacaggcggctggaggaggcgcacagggcccagcagtactactttgacgctgctgaggccgaagcctggatgagcgagcaggagctgtacatgatgtcagaggagaaggccaaggatgagcagagtgctgtctccatgttgaagaagcaccagatcttagaacaagctgtggaggactatgcagagaccgtgcatcagctctccaagaccagccgggccctggtggccgacagccatcctgaaagtgagcgcattagcatgcggcagtccaaagtggataaactgtacgctggtctgaaagaccttgctgaagagagaagaggcaagctggatgagagacacaggttattccagctcaaccgggaggtggacgacctggagcagtggatcgctgagagggaggtggtcgcagggtcccatgaactgggacaggactatgagcatgtcacgatgttacaagaacgattccgggagtttgcccgagacaccgggaacattgggcaggagcgcgtggacacggtcaatcacctggcagatgagctcatcaactctggacattcagatgccgccaccatcgctgaatggaaggatggcctcaatgaagcctgggccgacctcctggagctcattgacacaagaacacagattcttgccgcttcctatgaactgcacaagttttaccacgatgccaaggagatctttgggcgtatacaggacaaacacaagaaactccctgaggagcttgggagagatcagaacacagtggagaccttacagagaatgcacactacatttgagcatgacatccaggctctgggcacacaggtgaggcagctgcaggaggatgcagcccgcctccaggcggcctatgcgggtgacaaggccgacgatatccagaagcgcgagaacgaggtcctggaagcctggaagtccctcctggacgcctgtgagagccgcagggtgcggctggtggacacaggggacaagttccgcttcttcagcatggtgcgcgacctcatgctctggatggaggatgtcatccggcagatcgaggcccaggagaagccaagggatgtatcatctgttgaactcttaatgaataatcatcaaggcatcaaagctgaaattgatgcacgtaatgacagtttcacaacctgcattgaacttgggaaatccctgttggcgagaaaacactatgcatctgaggagatcaaggaaaaattactgcagttgacggaaaagaggaaagaaatgatcgacaagtgggaagaccgatgggaatggttaagactgattctggaggtccatcagttctcaagagacgccagtgtggccgaggcctggctgcttggacaggagccgtacctatccagccgagagataggccagagcgtggacgaggtggagaagctcatcaagcgccacgaggcatttgaaaagtctgcagcaacctgggatgagaggttctctgccctggaaaggctgactacattggagttactggaagtgcgcagacagcaagaggaagaggagaggaagaggcggccgccttctcccgagccgagcacgaaggtttcagaggaagccgagtcccagcagcagtgggatacttcaaaaggagaacaagtttcccaaaacggtttgccagctgaacagggatctccacggatggcagaaacggtggacacaagcgaaatggtcaacggcgctacagaacaaaggacgagctctaaagagtccagccccatcccctccccgacctctgatcgtaaagccaagactgccctcccagcccagagtgccgccaccttaccagccagaacccaggagacaccttcggcccagatggaaggcttcctcaatcggaaacacgagtgggaggcccacaataagaaagcctcaagcaggtcctggcacaatgtttattgtgtcataaataaccaagaaatgggtttctacaaagatgcaaagactgctgcttctggaattccctaccacagcgaggtccctgtgagtttgaaagaagctgtctgcgaagtggcccttgattacaaaaagaagaaacacgtattcaagctaagactaaatgatggcaatgagtacctcttccaagccaaagacgatgaggaaatgaacacatggatccaggctatctcttccgccatctcctctgataaacacgaggtgtctgccagcacccagagcacgccagcatccagccgcgcgcagaccctccccaccagcgtcgtcaccatcaccagcgagtccagtcccggcaagcgggaaaaggacaaagagaaagacaaagagaagcggttcagcctttttggcaaaaagaaatgaactcctttccttcacctcctgcccttctcttaccttttcagtgaaattccagcatgcaagctcagaaccaacacattactctctgtgcctaatgttcctcaatgtggttgatttttttttttttttaatttatagagcatttcggggggggtgggggaaacacacctaaacactttatctccaagttacaaaagtttgaggtgcagagggaaggccagattttttttttaatgaaattatatagattagatctcagtatttaaactgttcctcaattttgtgaggctgtgttggaaataacccgcctctagtgctgttggtatgcaaggcagcggtgcttaatcaatatttcctgtgctcaccagaggcccctgactcttgactcttagaagtgcccgagatggggctaacctttattaaacagatcgcatattatgatcttgctgcagccacagtgcagctccacattaactctacagaccaaaccatttgtatctggcatcacttactaacacacgacatgcggcttttctgcatcaactgctatgacggttaagaatgtcagtatacaagaaggaatagaaaactgatactgttttaaataatctgtaatttcaattttttttttttttgctgaaatacattatattgtacgtttgagataattctagtacaaagtataataaaactagatgtataataaaccctttaaatcattggtaagtgtacaagtggtggaactgaagcatttactggacaaagtaatgttactctaatggttacttgctcgtgcgttgccacactgtgttataatttgcttcatttccttgctatttgatacatagtgtgcatttctctgtcactgtaactattgtaatgacaaattttcatcttactgcacaatcaaaatgacattgataggaatgaactccagaggctgggcctgaacagggaggtggtcgctcaggcctggtgctcagtcgtacgacctgtacctctcaacttttgccctatctgttaaatatatgctatgtcattaaatgcttttaaatcta

SEQ ID NO: 357054 - DNA, 9039 bp, Homo sapiens
gtgagctgaagcagggcagggcatcaactcacccaggaagtgcaaggggtttggggattttcctttcctagccaagggaaggcatgacagactgtacctggaaaaacaggacactcttgcccaaatactgcactttttgcacagtcttagcaactggcagaccaggagattctctcctgtgcctgattcattgggtcccacacccatagggccttgcttactgccagtgcagcagtctgagattaacaccccatccccgggagaactctaagaaggagctgatgtggaggagcagctgagacagttcaagatgacgaccacagtagccacagactatgacaacattgagatccagcagcagtacagtgatgtcaacaaccgctgggatgtcgacgactgggacaatgagaacagctctgcgcggctttttgagcggtcccgcatcaaggctctggcagatgagcgtgaagccgtgcagaagaagaccttcaccaagtgggtcaattcccaccttgcccgtgtgtcctgccggatcacagacctgtacactgaccttcgagatggacggatgctcatcaagctgctggaggtcctctctggagagaggctgcctaaacccaccaagggacgaatgcgcatccactgcttagagaatgtggacaaggcccttcagttcctgaaggagcagagagtccatcttgagaacatggggtcccatgacatcgtggatggaaaccaccggctgacccttggcctcatctggaccatcatcctgcgcttccagatccaggatatcagtgtggaaactgaagacaacaaagagaagaaatctgccaaggatgcattgctgttgtggtgccagatgaagacagctgggtaccccaatgtcaacattcacaatttcaccactagctggagggacggcatggccttcaatgcactgatacacaaacaccggcctgacctgatagattttgacaaactaaagaaatctaacgcacactacaacctgcagaatgcatttaatctggcagaacagcacctcggcctcactaaactgttggaccccgaagacatcagcgtggaccatcctgatgagaagtccataatcacttatgtggtgacttattaccactacttctctaagatgaaggccttagctgttgaaggaaaacgaattggaaaggtgcttgacaatgctattgaaacagaaaaaatgattgaaaagtatgaatcacttgcctctgaccttctggaatggattgaacaaaccatcatcattctgaacaatcgcaaatttgccaattcactggtcggggttcaacagcagcttcaggcattcaacacttaccgcactgtggagaaaccacccaaatttactgagaaggggaacttggaagtgctgctcttcaccattcagagcaagatgagggccaacaaccagaaggtctacatgccccgggaggggaagctcatctctgacatcaacaaggcctgggaaagactggaaaaagcggaacacgaaagagaactggctttgcggaatgagctcataagacaggagaaactggaacagctcgcccgcagatttgatcgcaaggcagctatgagggagacttggctgagcgaaaaccagcgtctggtgtctcaggacaactttgggtttgaccttcctgcagttgaggccgccacaaaaaagcacgaggccattgagacagacattgccgcatacgaggagcgtgtgcaggctgtggtagccgtggccagggagctcgaggccgagaattaccacgacatcaagcgcatcacagcgaggaaggacaatgtcatccggctctgggaatacctactggaactgctcagggcccggagacagcggctcgagatgaacctggggctgcagaagatattccaggaaatgctctacattatggactggatggatgaaatgaaggtgctagtattgtctcaagactatggcaaacacttacttggtgtggaagacctgttacagaagcacaccctggttgaagcagacattggcatccaggcagagcgggtgagaggtgtcaatgcctccgcccagaagttcgcaacagacggggaaggttacaagccctgtgacccccaggtgatccgagaccgcgtggcccacatggagttctgttatcaagagctttgccagctggcggctgagcgcagggcccgtctggaagagtcccgccgcctctggaagttcttctgggagatggcagaagaggaaggctggatacgggagaaggagaagatcctgtcctcggacgattacgggaaagacctgaccagcgtcatgcgcctgctcagcaagcaccgggcgttcgaggacgagatgagcggccgcagtggccactttgagcaggccatcaaggaaggcgaagacatgatcgcggaggagcacttcgggtcggagaagatccgtgagaggatcatttacatccgggagcagtgggccaacctagagcagctctcggccattcggaagaagcgcctggaggaggcctccctgctgcaccagttccaggcagatgctgatgacattgatgcctggatgctggacatcctcaagattgtctccagcagcgacgtgggccacgatgagtattccacacagtctctggtcaagaaacacaaggacgtggcggaagagatcgccaattacaggcccacccttgacacgctgcacgaacaagccagcgccctcccccaggagcatgccgagtctccagacgtgaggggcaggctgtcgggcatcgaggagcggtataaggaggtggcagagctgacgcggctgcggaagcaggcactccaggacactctggccctgtacaagatgttcagcgaggctgatgcctgtgagctctggatcgacgagaaggagcagtggctcaacaacatgcagatcccagagaagctggaggatctggaggtcatccagcacagatttgagagcctagaaccagaaatgaacaaccaggcttcccgggttgcagtggtgaaccagattgcacgccagctgatgcacagcggccacccaagtgagaaggaaatcaaagcccagcaggacaaactcaacacaaggtggagccagttcagagaactggttgacaggaagaaggatgccctcctgtctgccctgagcatccagaactaccacctcgagtgcaatgaaaccaaatcctggattcgggaaaagaccaaggtcatcgagtccacccaggacctgggcaatgacctggctggcgtcatggccctgcagcgcaagctgaccggcatggagcgggacttggtggccattgaggcaaagctgagtgacctgcagaaggaggcggagaagctggagtccgagcaccccgaccaggcccaggccatcctgtctcggctggccgagatcagcgacgtgtgggaggagatgaagaccaccctgaaaaaccgagaggcctccctgggagaggccagcaagctgcagcagttcctacgggacttggacgacttccagtcctggctctctaggacccagacagcgatcgcctcggaggacatgccaaacaccctgaccgaggctgagaagctgctcacgcagcacgagaacatcaagaacgagatcgacaactacgaggaggactaccagaagatgagggacatgggcgagatggtcacccaggggcagaccgatgcccagtacatgtttctgcggcagcggctgcaggccctggacactggatggaacgagctccacaagatgtgggagaacagacaaaatctcctatcccagtcacatgcctaccagcagttcctcagagacacgaagcaagccgaagcctttcttaacaaccaggagtatgttctggctcacactgaaatgcctaccaccttggaaggagctgaagcagcaattaaaaagcaagaggacttcatgaccaccatggacgccaatgaggagaagatcaatgctgtggtggagactggccggaggctggtgagcgatgggaacatcaactcagatcgcatccaggagaaggtggactctattgatgacagacataggaagaatcgtgagacagccagtgaacttttgatgaggttgaaggacaacagggatctacagaaattcctgcaagattgtcaagagctgtctctctggatcaatgagaagatgctcacagcccaggacatgtcttacgatgaagccagaaatctgcacagtaaatggttgaagcatcaagcatttatggcagaacttgcatccaacaaagaatggcttgacaaaatcgagaaggaaggaatgcagctcatttcagaaaagcctgagacggaagctgtggtgaaggagaaactcactggtttacataaaatgtgggaagtccttgaatccactacccagacaaaggcccagcggctctttgatgcaaacaaggccgaacttttcacccagagctgtgcagatctagacaaatggctgcacggcctggagagtcagattcagtctgatgactatggcaaagacctgaccagtgtcaatatcctgctgaaaaagcaacagatgctggagaatcagatggaagtgcggaagaaggagatcgaagagctccaaagccaagcccaggccctgagtcaggaagggaagagcaccgacgaggtagacagcaagcgcctcaccgtgcagaccaagttcatggagttgctggagcccttgaacgagaggaagcataacctgctggcctccaaagagatccatcagttcaacagggatgtggaggacgagatcttgtgggttggagagaggatgcctttggcaacttccacggatcatggccacaacctccagactgtgcagctgttaataaagaaaaatcagaccctccagaaagaaatccaggggcaccagcctcgcattgacgacatctttgagaggagccaaaacatcgtcactgacagcagcagcctcagcgctgaggccatcagacagaggcttgccgacctgaagcagctgtggggtctcctcattgaggagacagagaaacgccacaggcggctggaggaggcgcacagggcccagcagtactactttgacgctgctgaggccgaagcctggatgagcgagcaggagctgtacatgatgtcagaggagaaggccaaggatgagcagagtgctgtctccatgttgaagaagcaccagatcttagaacaagctgtggaggactatgcagagaccgtgcatcagctctccaagaccagccgggccctggtggccgacagccatcctgaaagtgagcgcattagcatgcggcagtccaaagtggataaactgtacgctggtctgaaagaccttgctgaagagagaagaggcaagctggatgagagacacaggttattccagctcaaccgggaggtggacgacctggagcagtggatcgctgagagggaggtggtcgcagggtcccatgaactgggacaggactatgagcatgtcacgatgttacaagaacgattccgggagtttgcccgagacaccgggaacattgggcaggagcgcgtggacacggtcaatcacctggcagatgagctcatcaactctggacattcagatgccgccaccatcgctgaatggaaggatggcctcaatgaagcctgggccgacctcctggagctcattgacacaagaacacagattcttgccgcttcctatgaactgcacaagttttaccacgatgccaaggagatctttgggcgtatacaggacaaacacaagaaactccctgaggagcttgggagagatcagaacacagtggagaccttacagagaatgcacactacatttgagcatgacatccaggctctgggcacacaggtgaggcagctgcaggaggatgcagcccgcctccaggcggcctatgcgggtgacaaggccgacgatatccagaagcgcgagaacgaggtcctggaagcctggaagtccctcctggacgcctgtgagagccgcagggtgcggctggtggacacaggggacaagttccgcttcttcagcatggtgcgcgacctcatgctctggatggaggatgtcatccggcagatcgaggcccaggagaagccaagggatgtatcatctgttgaactcttaatgaataatcatcaaggcatcaaagctgaaattgatgcacgtaatgacagtttcacaacctgcattgaacttgggaaatccctgttggcgagaaaacactatgcatctgaggagatcaaggaaaaattactgcagttgacggaaaagaggaaagaaatgatcgacaagtgggaagaccgatgggaatggttaagactgattctggaggtccatcagttctcaagagacgccagtgtggccgaggcctggctgcttggacaggagccgtacctatccagccgagagataggccagagcgtggacgaggtggagaagctcatcaagcgccacgaggcatttgaaaagtctgcagcaacctgggatgagaggttctctgccctggaaaggctgactacattggagttactggaagtgcgcagacagcaagaggaagaggagaggaagaggcggccgccttctcccgagccgagcacgaaggtttcagaggaagccgagtcccagcagcagtgggatacttcaaaaggagaacaagtttcccaaaacggtttgccagctgaacagggatctccacggatggcagaaacggtggacacaagcgaaatggtcaacggcgctacagaacaaaggacgagctctaaagagtccagccccatcccctccccgacctctgatcgtaaagccaagactgccctcccagcccagagtgccgccaccttaccagccagaacccaggagacaccttcggcccagatggaaggcttcctcaatcggaaacacgagtgggaggcccacaataagaaagcctcaagcaggtcctggcacaatgtttattgtgtcataaataaccaagaaatgggtttctacaaagatgcaaagactgctgcttctggaattccctaccacagcgaggtccctgtgagtttgaaagaagctgtctgcgaagtggcccttgattacaaaaagaagaaacacgtattcaagctaagactaaatgatggcaatgagtacctcttccaagccaaagacgatgaggaaatgaacacatggatccaggctatctcttccgccatctcctctgataaacacgaggtgtctgccagcacccagagcacgccagcatccagccgcgcgcagaccctccccaccagcgtcgtcaccatcaccagcgagtccagtcccggcaagcgggaaaaggacaaagagaaagacaaagagaagcggttcagcctttttggcaaaaagaaatgaactcctttccttcacctcctgcccttctcttaccttttcagtgaaattccagcatgcaagctcagaaccaacacattactctctgtgcctaatgttcctcaatgtggttgatttttttttttttttaatttatagagcatttcggggggggtgggggaaacacacctaaacactttatctccaagttacaaaagtttgaggtgcagagggaaggccagattttttttttaatgaaattatatagattagatctcagtatttaaactgttcctcaattttgtgaggctgtgttggaaataacccgcctctagtgctgttggtatgcaaggcagcggtgcttaatcaatatttcctgtgctcaccagaggcaaaatgtaccaatatcctgacaccattctctctccatttacttctggtggttaccctgactcttgactcttagaagtgcccgagatggggctaacctttattaaacagatcgcatattatgatcttgctgcagccacagtgcagctccacattaactctacagaccaaaccatttgtatctggcatcacttactaacacacgacatgcggcttttctgcatcaactgctatgacggttaagaatgtcagtatacaagaaggaatagaaaactgatactgttttaaataatctgtaatttcaattttttttttttttgctgaaatacattatattgtacgtttgagataattctagtacaaagtataataaaactagatgtataataaaccctttaaatcattggtaagtgtacaagtggtggaactgaagcatttactggacaaagtaatgttactctaatggttacttgctcgtgcgttgccacactgtgttataatttgcttcatttccttgctatttgatacatagtgtgcatttctctgtcactgtaactattgtaatgacaaattttcatcttactgcacaatcaaaatgacattgataggaatgaactccagaggctgggcctgaacagggaggtggtcgctcaggcctggtgctcagtcgtacgacctgtacctctcaacttttgccctatctgttaaatatatgctatgtcattaaatgcttttaaatctagcacggtgactagttgttgttcttcctctgctgcgtgtgcatgcccagtagggaaactgcaaagggagaaatgacaaacaagaaacattttacaaccagtctgggctcacttttgcattttttatgcatgtctggtgcacaagctttgaaaactacagcaaacagtaataaatgtgactgttttgtagttatacattcaggctttatcttttatttatgaaaaagttaccagagcacttgtgaaacctgaactctgagataggggttggcaaatttgttctgtaaagggacagagatagtaaatattttaggctttgtaggccgtaactgtctctgttgctcaattctgctgttgcgtaatacaaaggcagccattgacggtatgtgaatgcctgggcatggctgtgttccagtaaaactatttaaggacataaatttgaatttcatataactttgacatgccatacaatattttgattttcttaatgatttcaaaatgtaaagtctattttatacagatcagacc

SEQ ID NO: 357055 - DNA, 8513 bp, Homo sapiens
  misc_feature (7950)..(7950): n is a, c, g, or t
  misc_feature (7956)..(7956): n is a, c, g, or t
  misc_feature (7959)..(7959): n is a, c, g, or t
  misc_feature (7966)..(7966): n is a, c, g, or t
  misc_feature (7968)..(7968): n is a, c, g, or t
  misc_feature (7970)..(7970): n is a, c, g, or t
  misc_feature (7981)..(7981): n is a, c, g, or t
  misc_feature (7984)..(7984): n is a, c, g, or t
  misc_feature (7987)..(7987): n is a, c, g, or t
  misc_feature (7989)..(7989): n is a, c, g, or t
  misc_feature (7992)..(7992): n is a, c, g, or t
  misc_feature (8007)..(8007): n is a, c, g, or t
  misc_feature (8009)..(8009): n is a, c, g, or t
  misc_feature (8013)..(8013): n is a, c, g, or t
  misc_feature (8015)..(8015): n is a, c, g, or t
  misc_feature (8019)..(8019): n is a, c, g, or t
  misc_feature (8032)..(8034): n is a, c, g, or t
  misc_feature (8042)..(8042): n is a, c, g, or t
  misc_feature (8049)..(8049): n is a, c, g, or t
  misc_feature (8053)..(8053): n is a, c, g, or t
  misc_feature (8075)..(8081): n is a, c, g, or t
  misc_feature (8084)..(8084): n is a, c, g, or t
  misc_feature (8086)..(8086): n is a, c, g, or t
  misc_feature (8090)..(8091): n is a, c, g, or t
gtgagctgaagcagggcagggcatcaactcacccaggaagtgcaaggggtttggggattttcctttcctagccaagggaaggcatgacagactgtacctggaaaaacaggacactcttgcccaaatactgcactttttgcacagtcttagcaactggcagaccaggagattctctcctgtgcctgattcattgggtcccacacccatagggccttgcttactgccagtgcagcagtctgagattaacaccccatccccgggagaactctaagaaggagctgatgtggaggagcagctgagacagttcaagatgacgaccacagtagccacagactatgacaacattgagatccagcagcagtacagtgatgtcaacaaccgctgggatgtcgacgactgggacaatgagaacagctctgcgcggctttttgagcggtcccgcatcaaggctctggcagatgagcgtgaagccgtgcagaagaagaccttcaccaagtgggtcaattcccaccttgcccgtgtgtcctgccggatcacagacctgtacactgaccttcgagatggacggatgctcatcaagctgctggaggtcctctctggagagaggctgcctaaacccaccaagggacgaatgcgcatccactgcttagagaatgtggacaaggcccttcagttcctgaaggagcagagagtccatcttgagaacatggggtcccatgacatcgtggatggaaaccaccggctgacccttggcctcatctggaccatcatcctgcgcttccagatccaggatatcagtgtggaaactgaagacaacaaagagaagaaatctgccaaggatgcattgctgttgtggtgccagatgaagacagctgggtaccccaatgtcaacattcacaatttcaccactagctggagggacggcatggccttcaatgcactgatacacaaacaccggcctgacctgatagattttgacaaactaaagaaatctaacgcacactacaacctgcagaatgcatttaatctggcagaacagcacctcggcctcactaaactgttggaccccgaagacatcagcgtggaccatcctgatgagaagtccataatcacttatgtggtgacttattaccactacttctctaagatgaaggccttagctgttgaaggaaaacgaattggaaaggtgcttgacaatgctattgaaacagaaaaaatgattgaaaagtatgaatcacttgcctctgaccttctggaatggattgaacaaaccatcatcattctgaacaatcgcaaatttgccaattcactggtcggggttcaacagcagcttcaggcattcaacacttaccgcactgtggagaaaccacccaaatttactgagaaggggaacttggaagtgctgctcttcaccattcagagcaagatgagggccaacaaccagaaggtctacatgccccgggaggggaagctcatctctgacatcaacaaggcctgggaaagactggaaaaagcggaacacgaaagagaactggctttgcggaatgagctcataagacaggagaaactggaacagctcgcccgcagatttgatcgcaaggcagctatgagggagacttggctgagcgaaaaccagcgtctggtgtctcaggacaactttgggtttgaccttcctgcagttgaggccgccacaaaaaagcacgaggccattgagacagacattgccgcatacgaggagcgtgtgcaggctgtggtagccgtggccagggagctcgaggccgagaattaccacgacatcaagcgcatcacagcgaggaaggacaatgtcatccggctctgggaatacctactggaactgctcagggcccggagacagcggctcgagatgaacctggggctgcagaagatattccaggaaatgctctacattatggactggatggatgaaatgaaggtgctagtattgtctcaagactatggcaaacacttacttggtgtggaagacctgttacagaagcacaccctggttgaagcagacattggcatccaggcagagcgggtgagaggtgtcaatgcctccgcccagaagttcgcaacagacggggaaggttacaagccctgtgacccccaggtgatccgagaccgcgtggcccacatggagttctgttatcaagagctttgccagctggcggctgagcgcagggcccgtctggaagagtcccgccgcctctggaagttcttctgggagatggcagaagaggaaggctggatacgggagaaggagaagatcctgtcctcggacgattacgggaaagacctgaccagcgtcatgcgcctgctcagcaagcaccgggcgttcgaggacgagatgagcggccgcagtggccactttgagcaggccatcaaggaaggcgaagacatgatcgcggaggagcacttcgggtcggagaagatccgtgagaggatcatttacatccgggagcagtgggccaacctagagcagctctcggccattcggaagaagcgcctggaggaggcctccctgctgcaccagttccaggcagatgctgatgacattgatgcctggatgctggacatcctcaagattgtctccagcagcgacgtgggccacgatgagtattccacacagtctctggtcaagaaacacaaggacgtggcggaagagatcgccaattacaggcccacccttgacacgctgcacgaacaagccagcgccctcccccaggagcatgccgagtctccagacgtgaggggcaggctgtcgggcatcgaggagcggtataaggaggtggcagagctgacgcggctgcggaagcaggcactccaggacactctggccctgtacaagatgttcagcgaggctgatgcctgtgagctctggatcgacgagaaggagcagtggctcaacaacatgcagatcccagagaagctggaggatctggaggtcatccagcacagatttgagagcctagaaccagaaatgaacaaccaggcttcccgggttgcagtggtgaaccagattgcacgccagctgatgcacagcggccacccaagtgagaaggaaatcaaagcccagcaggacaaactcaacacaaggtggagccagttcagagaactggttgacaggaagaaggatgccctcctgtctgccctgagcatccagaactaccacctcgagtgcaatgaaaccaaatcctggattcgggaaaagaccaaggtcatcgagtccacccaggacctgggcaatgacctggctggcgtcatggccctgcagcgcaagctgaccggcatggagcgggacttggtggccattgaggcaaagctgagtgacctgcagaaggaggcggagaagctggagtccgagcaccccgaccaggcccaggccatcctgtctcggctggccgagatcagcgacgtgtgggaggagatgaagaccaccctgaaaaaccgagaggcctccctgggagaggccagcaagctgcagcagttcctacgggacttggacgacttccagtcctggctctctaggacccagacagcgatcgcctcggaggacatgccaaacaccctgaccgaggctgagaagctgctcacgcagcacgagaacatcaagaacgagatcgacaactacgaggaggactaccagaagatgagggacatgggcgagatggtcacccaggggcagaccgatgcccagtacatgtttctgcggcagcggctgcaggccctggacactggatggaacgagctccacaagatgtgggagaacagacaaaatctcctatcccagtcacatgcctaccagcagttcctcagagacacgaagcaagccgaagcctttcttaacaaccaggagtatgttctggctcacactgaaatgcctaccaccttggaaggagctgaagcagcaattaaaaagcaagaggacttcatgaccaccatggacgccaatgaggagaagatcaatgctgtggtggagactggccggaggctggtgagcgatgggaacatcaactcagatcgcatccaggagaaggtggactctattgatgacagacataggaagaatcgtgagacagccagtgaacttttgatgaggttgaaggacaacagggatctacagaaattcctgcaagattgtcaagagctgtctctctggatcaatgagaagatgctcacagcccaggacatgtcttacgatgaagccagaaatctgcacagtaaatggttgaagcatcaagcatttatggcagaacttgcatccaacaaagaatggcttgacaaaatcgagaaggaaggaatgcagctcatttcagaaaagcctgagacggaagctgtggtgaaggagaaactcactggtttacataaaatgtgggaagtccttgaatccactacccagacaaaggcccagcggctctttgatgcaaacaaggccgaacttttcacccagagctgtgcagatctagacaaatggctgcacggcctggagagtcagattcagtctgatgactatggcaaagacctgaccagtgtcaatatcctgctgaaaaagcaacagatgctggagaatcagatggaagtgcggaagaaggagatcgaagagctccaaagccaagcccaggccctgagtcaggaagggaagagcaccgacgaggtagacagcaagcgcctcaccgtgcagaccaagttcatggagttgctggagcccttgaacgagaggaagcataacctgctggcctccaaagagatccatcagttcaacagggatgtggaggacgagatcttgtgggttggagagaggatgcctttggcaacttccacggatcatggccacaacctccagactgtgcagctgttaataaagaaaaatcagaccctccagaaagaaatccaggggcaccagcctcgcattgacgacatctttgagaggagccaaaacatcgtcactgacagcagcagcctcagcgctgaggccatcagacagaggcttgccgacctgaagcagctgtggggtctcctcattgaggagacagagaaacgccacaggcggctggaggaggcgcacagggcccagcagtactactttgacgctgctgaggccgaagcctggatgagcgagcaggagctgtacatgatgtcagaggagaaggccaaggatgagcagagtgctgtctccatgttgaagaagcaccagatcttagaacaagctgtggaggactatgcagagaccgtgcatcagctctccaagaccagccgggccctggtggccgacagccatcctgaaagtgagcgcattagcatgcggcagtccaaagtggataaactgtacgctggtctgaaagaccttgctgaagagagaagaggcaagctggatgagagacacaggttattccagctcaaccgggaggtggacgacctggagcagtggatcgctgagagggaggtggtcgcagggtcccatgaactgggacaggactatgagcatgtcacgatgttacaagaacgattccgggagtttgcccgagacaccgggaacattgggcaggagcgcgtggacacggtcaatcacctggcagatgagctcatcaactctggacattcagatgccgccaccatcgctgaatggaaggatggcctcaatgaagcctgggccgacctcctggagctcattgacacaagaacacagattcttgccgcttcctatgaactgcacaagttttaccacgatgccaaggagatctttgggcgtatacaggacaaacacaagaaactccctgaggagcttgggagagatcagaacacagtggagaccttacagagaatgcacactacatttgagcatgacatccaggctctgggcacacaggtgaggcagctgcaggaggatgcagcccgcctccaggcggcctatgcgggtgacaaggccgacgatatccagaagcgcgagaacgaggtcctggaagcctggaagtccctcctggacgcctgtgagagccgcagggtgcggctggtggacacaggggacaagttccgcttcttcagcatggtgcgcgacctcatgctctggatggaggatgtcatccggcagatcgaggcccaggagaagccaagggatgtatcatctgttgaactcttaatgaataatcatcaaggcatcaaagctgaaattgatgcacgtaatgacagtttcacaacctgcattgaacttgggaaatccctgttggcgagaaaacactatgcatctgaggagatcaaggaaaaattactgcagttgacggaaaagaggaaagaaatgatcgacaagtgggaagaccgatgggaatggttaagactgattctggaggtccatcagttctcaagagacgccagtgtggccgaggcctggctgcttggacaggagccgtacctatccagccgagagataggccagagcgtggacgaggtggagaagctcatcaagcgccacgaggcatttgaaaagtctgcagcaacctgggatgagaggttctctgccctggaaaggctgactacattggagttactggaagtgcgcagacagcaagaggaagaggagaggaagaggcggccgccttctcccgagccgagcacgaaggtttcagaggaagccgagtcccagcagcagtgggatacttcaaaaggagaacaagtttcccaaaacggtttgccagctgaacagggatctccacggatggcagaaacggtggacacaagcgaaatggtcaacggcgctacagaacaaaggacgagctctaaagagtccagccccatcccctccccgacctctgatcgtaaagccaagactgccctcccagcccagagtgccgccaccttaccagccagaacccaggagacaccttcggcccagatggaaggcttcctcaatcggaaacacgagtgggaggcccacaataagaaagcctcaagcaggtcctggcacaatgtttattgtgtcataaataaccaagaaatgggtttctacaaagatgcaaagactgctgcttctggaattccctaccacagcgaggtccctgtgagtttgaaagaagctgtctgcgaagtggcccttgattacaaaaagaagaaacacgtattcaagctaagactaaatgatggcaatgagtacctcttccaagccaaagacgatgaggaaatgaacacatggatccaggctatctcttccgccatctcctctgataaacacgaggtgtctgccagcacccagagcacgccagcatccagccgcgcgcagaccctccccaccagcgtcgtcaccatcaccagcgagtccagtcccggcaagcgggaaaaggacaaagagaaagacaaagagaagcggttcagcctttttggcaaaaagaaatgaactcctttccttcacctcctgcccttctcttaccttttcagtgaaattccagcatgcaagctcagaaccaacacattactctctgtgcctaatgttcctcaatgtggttgatttttttttttttttaatttatagagcatttcggggggggtgggggaaacacacctaaacactttatctccaagttacaaaagtttgaggtgcagagggaaggccagattttttttttaatgaaattatatagattagatctcagtatttaaactgttcctcaattttgtgaggctgtgttggaaataacccgcctctagtgctgttggtatgcaaggcagcggtgcttaatcaatatttcctgtgctcaccagaggcaaaatgtaccaatatcctgacaccattctctctccatttacttctggtggttaccctgactcttgactcttagaagtgcccgagatggggctaacctttattaaacagatcgcatattatgatcttgctgcagccacagtgcagctccacattaactctacagaccaaaccatttncccccngcnccccccncncnccccccccatnccnccncnccncccccaccgccatgncngttnanaatncccgtaccccccnnngaaccccnccccganaccntcttaaataacccccccccccnnnnnnnttntntttnnctgaaatacattatattgtacgtttgagataattctagtacaaagtataataaaactagatgtataataaaccctttaaatcattggtaagtgtacaagtggtggaactgaagcatttactggacaaagtaatgttactctaatggttacttgctcgtgcgttgccacactgtgttataatttgcttcatttccttgctatttgatacatagtgtgcatttctctgtcactgtaactattgtaatgacaaattttcatcttactgcacaatcaaaatgacattgataggaatgaactccagaggctgggcctgaacagggaggtggtcgctcaggcctggtgctcagtcgtacgacctgtacctctcaacttttgccctatctgttaaatatatgctatgtcattaaatgcttttaaatcta

SEQ ID NO: 357056 - DNA, 8707 bp, Homo sapiens
gtgagctgaagcagggcagggcatcaactcacccaggaagtgcaaggggtttggggattttcctttcctagccaagggaaggcatgacagactgtacctggaaaaacaggacactcttgcccaaatactgcactttttgcacagtcttagcaactggcagaccaggagattctctcctgtgcctgattcattgggtcccacacccatagggccttgcttactgccagtgcagcagtctgagattaacaccccatccccgggagaactctaagaaggagctgatgtggaggagcagctgagacagttcaagatgacgaccacagtagccacagactatgacaacattgagatccagcagcagtacagtgatgtcaacaaccgctgggatgtcgacgactgggacaatgagaacagctctgcgcggctttttgagcggtcccgcatcaaggctctggcagatgagcgtgaagccgtgcagaagaagaccttcaccaagtgggtcaattcccaccttgcccgtgtgtcctgccggatcacagacctgtacactgaccttcgagatggacggatgctcatcaagctgctggaggtcctctctggagagaggctgcctaaacccaccaagggacgaatgcgcatccactgcttagagaatgtggacaaggcccttcagttcctgaaggagcagagagtccatcttgagaacatggggtcccatgacatcgtggatggaaaccaccggctgacccttggcctcatctggaccatcatcctgcgcttccagatccaggatatcagtgtggaaactgaagacaacaaagagaagaaatctgccaaggatgcattgctgttgtggtgccagatgaagacagctgggtaccccaatgtcaacattcacaatttcaccactagctggagggacggcatggccttcaatgcactgatacacaaacaccggcctgacctgatagattttgacaaactaaagaaatctaacgcacactacaacctgcagaatgcatttaatctggcagaacagcacctcggcctcactaaactgttggaccccgaagacatcagcgtggaccatcctgatgagaagtccataatcacttatgtggtgacttattaccactacttctctaagatgaaggccttagctgttgaaggaaaacgaattggaaaggtgcttgacaatgctattgaaacagaaaaaatgattgaaaagtatgaatcacttgcctctgaccttctggaatggattgaacaaaccatcatcattctgaacaatcgcaaatttgccaattcactggtcggggttcaacagcagcttcaggcattcaacacttaccgcactgtggagaaaccacccaaatttactgagaaggggaacttggaagtgctgctcttcaccattcagagcaagatgagggccaacaaccagaaggtctacatgccccgggaggggaagctcatctctgacatcaacaaggcctgggaaagactggaaaaagcggaacacgaaagagaactggctttgcggaatgagctcataagacaggagaaactggaacagctcgcccgcagatttgatcgcaaggcagctatgagggagacttggctgagcgaaaaccagcgtctggtgtctcaggacaactttgggtttgaccttcctgcagttgaggccgccacaaaaaagcacgaggccattgagacagacattgccgcatacgaggagcgtgtgcaggctgtggtagccgtggccagggagctcgaggccgagaattaccacgacatcaagcgcatcacagcgaggaaggacaatgtcatccggctctgggaatacctactggaactgctcagggcccggagacagcggctcgagatgaacctggggctgcagaagatattccaggaaatgctctacattatggactggatggatgaaatgaaggtgctagtattgtctcaagactatggcaaacacttacttggtgtggaagacctgttacagaagcacaccctggttgaagcagacattggcatccaggcagagcgggtgagaggtgtcaatgcctccgcccagaagttcgcaacagacggggaaggttacaagccctgtgacccccaggtgatccgagaccgcgtggcccacatggagttctgttatcaagagctttgccagctggcggctgagcgcagggcccgtctggaagagtcccgccgcctctggaagttcttctgggagatggcagaagaggaaggctggatacgggagaaggagaagatcctgtcctcggacgattacgggaaagacctgaccagcgtcatgcgcctgctcagcaagcaccgggcgttcgaggacgagatgagcggccgcagtggccactttgagcaggccatcaaggaaggcgaagacatgatcgcggaggagcacttcgggtcggagaagatccgtgagaggatcatttacatccgggagcagtgggccaacctagagcagctctcggccattcggaagaagcgcctggaggaggcctccctgctgcaccagttccaggcagatgctgatgacattgatgcctggatgctggacatcctcaagattgtctccagcagcgacgtgggccacgatgagtattccacacagtctctggtcaagaaacacaaggacgtggcggaagagatcgccaattacaggcccacccttgacacgctgcacgaacaagccagcgccctcccccaggagcatgccgagtctccagacgtgaggggcaggctgtcgggcatcgaggagcggtataaggaggtggcagagctgacgcggctgcggaagcaggcactccaggacactctggccctgtacaagatgttcagcgaggctgatgcctgtgagctctggatcgacgagaaggagcagtggctcaacaacatgcagatcccagagaagctggaggatctggaggtcatccagcacagatttgagagcctagaaccagaaatgaacaaccaggcttcccgggttgcagtggtgaaccagattgcacgccagctgatgcacagcggccacccaagtgagaaggaaatcaaagcccagcaggacaaactcaacacaaggtggagccagttcagagaactggttgacaggaagaaggatgccctcctgtctgccctgagcatccagaactaccacctcgagtgcaatgaaaccaaatcctggattcgggaaaagaccaaggtcatcgagtccacccaggacctgggcaatgacctggctggcgtcatggccctgcagcgcaagctgaccggcatggagcgggacttggtggccattgaggcaaagctgagtgacctgcagaaggaggcggagaagctggagtccgagcaccccgaccaggcccaggccatcctgtctcggctggccgagatcagcgacgtgtgggaggagatgaagaccaccctgaaaaaccgagaggcctccctgggagaggccagcaagctgcagcagttcctacgggacttggacgacttccagtcctggctctctaggacccagacagcgatcgcctcggaggacatgccaaacaccctgaccgaggctgagaagctgctcacgcagcacgagaacatcaagaacgagatcgacaactacgaggaggactaccagaagatgagggacatgggcgagatggtcacccaggggcagaccgatgcccagtacatgtttctgcggcagcggctgcaggccctggacactggatggaacgagctccacaagatgtgggagaacagacaaaatctcctatcccagtcacatgcctaccagcagttcctcagagacacgaagcaagccgaagcctttcttaacaaccaggagtatgttctggctcacactgaaatgcctaccaccttggaaggagctgaagcagcaattaaaaagcaagaggacttcatgaccaccatggacgccaatgaggagaagatcaatgctgtggtggagactggccggaggctggtgagcgatgggaacatcaactcagatcgcatccaggagaaggtggactctattgatgacagacataggaagaatcgtgagacagccagtgaacttttgatgaggttgaaggacaacagggatctacagaaattcctgcaagattgtcaagagctgtctctctggatcaatgagaagatgctcacagcccaggacatgtcttacgatgaagccagaaatctgcacagtaaatggttgaagcatcaagcatttatggcagaacttgcatccaacaaagaatggcttgacaaaatcgagaaggaaggaatgcagctcatttcagaaaagcctgagacggaagctgtggtgaaggagaaactcactggtttacataaaatgtgggaagtccttgaatccactacccagacaaaggcccagcggctctttgatgcaaacaaggccgaacttttcacccagagctgtgcagatctagacaaatggctgcacggcctggagagtcagattcagtctgatgactatggcaaagacctgaccagtgtcaatatcctgctgaaaaagcaacagatgctggagaatcagatggaagtgcggaagaaggagatcgaagagctccaaagccaagcccaggccctgagtcaggaagggaagagcaccgacgaggtagacagcaagcgcctcaccgtgcagaccaagttcatggagttgctggagcccttgaacgagaggaagcataacctgctggcctccaaagagatccatcagttcaacagggatgtggaggacgagatcttgtgggttggagagaggatgcctttggcaacttccacggatcatggccacaacctccagactgtgcagctgttaataaagaaaaatcagaccctccagaaagaaatccaggggcaccagcctcgcattgacgacatctttgagaggagccaaaacatcgtcactgacagcagcagcctcagcgctgaggccatcagacagaggcttgccgacctgaagcagctgtggggtctcctcattgaggagacagagaaacgccacaggcggctggaggaggcgcacagggcccagcagtactactttgacgctgctgaggccgaagcctggatgagcgagcaggagctgtacatgatgtcagaggagaaggccaaggatgagcagagtgctgtctccatgttgaagaagcaccagatcttagaacaagctgtggaggactatgcagagaccgtgcatcagctctccaagaccagccgggccctggtggccgacagccatcctgaaagtgagcgcattagcatgcggcagtccaaagtggataaactgtacgctggtctgaaagaccttgctgaagagagaagaggcaagctggatgagagacacaggttattccagctcaaccgggaggtggacgacctggagcagtggatcgctgagagggaggtggtcgcagggtcccatgaactgggacaggactatgagcatgtcacgatgttacaagaacgattccgggagtttgcccgagacaccgggaacattgggcaggagcgcgtggacacggtcaatcacctggcagatgagctcatcaactctggacattcagatgccgccaccatcgctgaatggaaggatggcctcaatgaagcctgggccgacctcctggagctcattgacacaagaacacagattcttgccgcttcctatgaactgcacaagttttaccacgatgccaaggagatctttgggcgtatacaggacaaacacaagaaactccctgaggagcttgggagagatcagaacacagtggagaccttacagagaatgcacactacatttgagcatgacatccaggctctgggcacacaggtgaggcagctgcaggaggatgcagcccgcctccaggcggcctatgcgggtgacaaggccgacgatatccagaagcgcgagaacgaggtcctggaagcctggaagtccctcctggacgcctgtgagagccgcagggtgcggctggtggacacaggggacaagttccgcttcttcagcatggtgcgcgacctcatgctctggatggaggatgtcatccggcagatcgaggcccaggagaagccaagggatgtatcatctgttgaactcttaatgaataatcatcaaggcatcaaagctgaaattgatgcacgtaatgacagtttcacaacctgcattgaacttgggaaatccctgttggcgagaaaacactatgcatctgaggagatcaaggaaaaattactgcagttgacggaaaagaggaaagaaatgatcgacaagtgggaagaccgatgggaatggttaagactgattctggaggtccatcagttctcaagagacgccagtgtggccgaggcctggctgcttggacaggagccgtacctatccagccgagagataggccagagcgtggacgaggtggagaagctcatcaagcgccacgaggcatttgaaaagtctgcagcaacctgggatgagaggttctctgccctggaaaggctgactacattggagttactggaagtgcgcagacagcaagaggaagaggagaggaagaggcggccgccttctcccgagccgagcacgaaggtttcagaggaagccgagtcccagcagcagtgggatacttcaaaaggagaacaagtttcccaaaacggtttgccagctgaacagggatctccacggatggcagaaacggtggacacaagcgaaatggtcaacggcgctacagaacaaaggacgagctctaaagagtccagccccatcccctccccgacctctgatcgtaaagccaagactgccctcccagcccagagtgccgccaccttaccagccagaacccaggagacaccttcggcccagatggaaggcttcctcaatcggaaacacgagtgggaggcccacaataagaaagcctcaagcaggtcctggcacaatgtttattgtgtcataaataaccaagaaatgggtttctacaaagatgcaaagactgctgcttctggaattccctaccacagcgaggtccctgtgagtttgaaagaagctgtctgcgaagtggcccttgattacaaaaagaagaaacacgtattcaagctaagactaaatgatggcaatgagtacctcttccaagccaaagacgatgaggaaatgaacacatggatccaggctatctcttccgccatctcctctgataaacacgaggtgtctgccagcacccagagcacgccagcatccagccgcgcgcagaccctccccaccagcgtcgtcaccatcaccagcgagtccagtcccggcaagcgggaaaaggacaaagagaaagacaaagagaagcggttcagcctttttggcaaaaagaaatgaactcctttccttcacctcctgcccttctcttaccttttcagtgaaattccagcatgcaagctcagaaccaacacattactctctgtgcctaatgttcctcaatgtggttgatttttttttttttttaatttatagagcatttcggggggggtgggggaaacacacctaaacactttatctccaagttacaaaagtttgaggtgcagagggaaggccagattttttttttaatgaaattatatagattagatctcagtatttaaactgttcctcaattttgtgaggctgtgttggaaataacccgcctctagtgctgttggtatgcaaggcagcggtgcttaatcaatatttcctgtgctcaccagaggcaaaatgtaccaatatcctgacaccattctctctccatttacttctggtggttaccctgactcttgactcttagaagtgcccgagatggggctaacctttattaaacagatcgcatattatgatcttgctgcagccacagtgcagctccacattaactctacagaccaaaccatttgtatctggcatcacttactaacacacgacatgcggcttttctgcatcaactgctatgacggttaagaatgtcagtatacaagaaggaatagaaaactgatactgttttaaataatctgtaatttcaattttttttttttttgctgaaatacattatattgtacgtttgagataattctagtacaaagtataataaaactagatgtataataaaccctttaaatcattggtaagtgtacaagtggtggaactgaagcatttactggacaaagtaatgttactctaatggttacttgctcgtgcgttgccacactgtgttataatttgcttcatttccttgctatttgatacatagtgtgcatttctctgtcactgtaactattgtaatgacaaattttcatcttactgcacaatcaaaatgacattgatgtttaagaggttaataaccataatattaaaggattaattataaacacctggcaaaaaaccacatcatcccttttcaaaaataaaatgttcatattcctctgagcaaacatcacaagagcagtggccatctgcctcaggcctgccttgtctgtaaacagctgtaaaggaaagctagcacagcgccagggacacatgagctcccaggagggcacagctgtccttccctttcagctttccaaacatgagcacagaaggtgtctagtctgggtgaccaaagctcaaccctggcagcacggtcaacacatctcttgcctctttttcacatactac

SEQ ID NO: 357057 - DNA, 8432 bp, Homo sapiens
  misc_feature (7896)..(7896): n is a, c, g, or t
  misc_feature (7912)..(7912): n is a, c, g, or t
  misc_feature (7917)..(7917): n is a, c, g, or t
  misc_feature (7938)..(7938): n is a, c, g, or t
  misc_feature (7957)..(7957): n is a, c, g, or t
  misc_feature (7985)..(7985): n is a, c, g, or t
  misc_feature (7994)..(7995): n is a, c, g, or t
  misc_feature (8049)..(8049): n is a, c, g, or t
  misc_feature (8061)..(8061): n is a, c, g, or t
  misc_feature (8073)..(8073): n is a, c, g, or t
  misc_feature (8081)..(8081): n is a, c, g, or t
  misc_feature (8092)..(8092): n is a, c, g, or t
  misc_feature (8104)..(8104): n is a, c, g, or t
  misc_feature (8384)..(8384): n is a, c, g, or t
  misc_feature (8429)..(8429): n is a, c, g, or t
gtgagctgaagcagggcagggcatcaactcacccaggaagtgcaaggggtttggggattttcctttcctagccaagggaaggcatgacagactgtacctggaaaaacaggacactcttgcccaaatactgcactttttgcacagtcttagcaactggcagaccaggagattctctcctgtgcctgattcattgggtcccacacccatagggccttgcttactgccagtgcagcagtctgagattaacaccccatccccgggagaactctaagaaggagctgatgtggaggagcagctgagacagttcaagatgacgaccacagtagccacagactatgacaacattgagatccagcagcagtacagtgatgtcaacaaccgctgggatgtcgacgactgggacaatgagaacagctctgcgcggctttttgagcggtcccgcatcaaggctctggcagatgagcgtgaagccgtgcagaagaagaccttcaccaagtgggtcaattcccaccttgcccgtgtgtcctgccggatcacagacctgtacactgaccttcgagatggacggatgctcatcaagctgctggaggtcctctctggagagaggctgcctaaacccaccaagggacgaatgcgcatccactgcttagagaatgtggacaaggcccttcagttcctgaaggagcagagagtccatcttgagaacatggggtcccatgacatcgtggatggaaaccaccggctgacccttggcctcatctggaccatcatcctgcgcttccagatccaggatatcagtgtggaaactgaagacaacaaagagaagaaatctgccaaggatgcattgctgttgtggtgccagatgaagacagctgggtaccccaatgtcaacattcacaatttcaccactagctggagggacggcatggccttcaatgcactgatacacaaacaccggcctgacctgatagattttgacaaactaaagaaatctaacgcacactacaacctgcagaatgcatttaatctggcagaacagcacctcggcctcactaaactgttggaccccgaagacatcagcgtggaccatcctgatgagaagtccataatcacttatgtggtgacttattaccactacttctctaagatgaaggccttagctgttgaaggaaaacgaattggaaaggtgcttgacaatgctattgaaacagaaaaaatgattgaaaagtatgaatcacttgcctctgaccttctggaatggattgaacaaaccatcatcattctgaacaatcgcaaatttgccaattcactggtcggggttcaacagcagcttcaggcattcaacacttaccgcactgtggagaaaccacccaaatttactgagaaggggaacttggaagtgctgctcttcaccattcagagcaagatgagggccaacaaccagaaggtctacatgccccgggaggggaagctcatctctgacatcaacaaggcctgggaaagactggaaaaagcggaacacgaaagagaactggctttgcggaatgagctcataagacaggagaaactggaacagctcgcccgcagatttgatcgcaaggcagctatgagggagacttggctgagcgaaaaccagcgtctggtgtctcaggacaactttgggtttgaccttcctgcagttgaggccgccacaaaaaagcacgaggccattgagacagacattgccgcatacgaggagcgtgtgcaggctgtggtagccgtggccagggagctcgaggccgagaattaccacgacatcaagcgcatcacagcgaggaaggacaatgtcatccggctctgggaatacctactggaactgctcagggcccggagacagcggctcgagatgaacctggggctgcagaagatattccaggaaatgctctacattatggactggatggatgaaatgaaggtgctagtattgtctcaagactatggcaaacacttacttggtgtggaagacctgttacagaagcacaccctggttgaagcagacattggcatccaggcagagcgggtgagaggtgtcaatgcctccgcccagaagttcgcaacagacggggaaggttacaagccctgtgacccccaggtgatccgagaccgcgtggcccacatggagttctgttatcaagagctttgccagctggcggctgagcgcagggcccgtctggaagagtcccgccgcctctggaagttcttctgggagatggcagaagaggaaggctggatacgggagaaggagaagatcctgtcctcggacgattacgggaaagacctgaccagcgtcatgcgcctgctcagcaagcaccgggcgttcgaggacgagatgagcggccgcagtggccactttgagcaggccatcaaggaaggcgaagacatgatcgcggaggagcacttcgggtcggagaagatccgtgagaggatcatttacatccgggagcagtgggccaacctagagcagctctcggccattcggaagaagcgcctggaggaggcctccctgctgcaccagttccaggcagatgctgatgacattgatgcctggatgctggacatcctcaagattgtctccagcagcgacgtgggccacgatgagtattccacacagtctctggtcaagaaacacaaggacgtggcggaagagatcgccaattacaggcccacccttgacacgctgcacgaacaagccagcgccctcccccaggagcatgccgagtctccagacgtgaggggcaggctgtcgggcatcgaggagcggtataaggaggtggcagagctgacgcggctgcggaagcaggcactccaggacactctggccctgtacaagatgttcagcgaggctgatgcctgtgagctctggatcgacgagaaggagcagtggctcaacaacatgcagatcccagagaagctggaggatctggaggtcatccagcacagatttgagagcctagaaccagaaatgaacaaccaggcttcccgggttgcagtggtgaaccagattgcacgccagctgatgcacagcggccacccaagtgagaaggaaatcaaagcccagcaggacaaactcaacacaaggtggagccagttcagagaactggttgacaggaagaaggatgccctcctgtctgccctgagcatccagaactaccacctcgagtgcaatgaaaccaaatcctggattcgggaaaagaccaaggtcatcgagtccacccaggacctgggcaatgacctggctggcgtcatggccctgcagcgcaagctgaccggcatggagcgggacttggtggccattgaggcaaagctgagtgacctgcagaaggaggcggagaagctggagtccgagcaccccgaccaggcccaggccatcctgtctcggctggccgagatcagcgacgtgtgggaggagatgaagaccaccctgaaaaaccgagaggcctccctgggagaggccagcaagctgcagcagttcctacgggacttggacgacttccagtcctggctctctaggacccagacagcgatcgcctcggaggacatgccaaacaccctgaccgaggctgagaagctgctcacgcagcacgagaacatcaagaacgagatcgacaactacgaggaggactaccagaagatgagggacatgggcgagatggtcacccaggggcagaccgatgcccagtacatgtttctgcggcagcggctgcaggccctggacactggatggaacgagctccacaagatgtgggagaacagacaaaatctcctatcccagtcacatgcctaccagcagttcctcagagacacgaagcaagccgaagcctttcttaacaaccaggagtatgttctggctcacactgaaatgcctaccaccttggaaggagctgaagcagcaattaaaaagcaagaggacttcatgaccaccatggacgccaatgaggagaagatcaatgctgtggtggagactggccggaggctggtgagcgatgggaacatcaactcagatcgcatccaggagaaggtggactctattgatgacagacataggaagaatcgtgagacagccagtgaacttttgatgaggttgaaggacaacagggatctacagaaattcctgcaagattgtcaagagctgtctctctggatcaatgagaagatgctcacagcccaggacatgtcttacgatgaagccagaaatctgcacagtaaatggttgaagcatcaagcatttatggcagaacttgcatccaacaaagaatggcttgacaaaatcgagaaggaaggaatgcagctcatttcagaaaagcctgagacggaagctgtggtgaaggagaaactcactggtttacataaaatgtgggaagtccttgaatccactacccagacaaaggcccagcggctctttgatgcaaacaaggccgaacttttcacccagagctgtgcagatctagacaaatggctgcacggcctggagagtcagattcagtctgatgactatggcaaagacctgaccagtgtcaatatcctgctgaaaaagcaacagatgctggagaatcagatggaagtgcggaagaaggagatcgaagagctccaaagccaagcccaggccctgagtcaggaagggaagagcaccgacgaggtagacagcaagcgcctcaccgtgcagaccaagttcatggagttgctggagcccttgaacgagaggaagcataacctgctggcctccaaagagatccatcagttcaacagggatgtggaggacgagatcttgtgggttggagagaggatgcctttggcaacttccacggatcatggccacaacctccagactgtgcagctgttaataaagaaaaatcagaccctccagaaagaaatccaggggcaccagcctcgcattgacgacatctttgagaggagccaaaacatcgtcactgacagcagcagcctcagcgctgaggccatcagacagaggcttgccgacctgaagcagctgtggggtctcctcattgaggagacagagaaacgccacaggcggctggaggaggcgcacagggcccagcagtactactttgacgctgctgaggccgaagcctggatgagcgagcaggagctgtacatgatgtcagaggagaaggccaaggatgagcagagtgctgtctccatgttgaagaagcaccagatcttagaacaagctgtggaggactatgcagagaccgtgcatcagctctccaagaccagccgggccctggtggccgacagccatcctgaaagtgagcgcattagcatgcggcagtccaaagtggataaactgtacgctggtctgaaagaccttgctgaagagagaagaggcaagctggatgagagacacaggttattccagctcaaccgggaggtggacgacctggagcagtggatcgctgagagggaggtggtcgcagggtcccatgaactgggacaggactatgagcatgtcacgatgttacaagaacgattccgggagtttgcccgagacaccgggaacattgggcaggagcgcgtggacacggtcaatcacctggcagatgagctcatcaactctggacattcagatgccgccaccatcgctgaatggaaggatggcctcaatgaagcctgggccgacctcctggagctcattgacacaagaacacagattcttgccgcttcctatgaactgcacaagttttaccacgatgccaaggagatctttgggcgtatacaggacaaacacaagaaactccctgaggagcttgggagagatcagaacacagtggagaccttacagagaatgcacactacatttgagcatgacatccaggctctgggcacacaggtgaggcagctgcaggaggatgcagcccgcctccaggcggcctatgcgggtgacaaggccgacgatatccagaagcgcgagaacgaggtcctggaagcctggaagtccctcctggacgcctgtgagagccgcagggtgcggctggtggacacaggggacaagttccgcttcttcagcatggtgcgcgacctcatgctctggatggaggatgtcatccggcagatcgaggcccaggagaagccaagggatgtatcatctgttgaactcttaatgaataatcatcaaggcatcaaagctgaaattgatgcacgtaatgacagtttcacaacctgcattgaacttgggaaatccctgttggcgagaaaacactatgcatctgaggagatcaaggaaaaattactgcagttgacggaaaagaggaaagaaatgatcgacaagtgggaagaccgatgggaatggttaagactgattctggaggtccatcagttctcaagagacgccagtgtggccgaggcctggctgcttggacaggagccgtacctatccagccgagagataggccagagcgtggacgaggtggagaagctcatcaagcgccacgaggcatttgaaaagtctgcagcaacctgggatgagaggttctctgccctggaaaggctgactacattggagttactggaagtgcgcagacagcaagaggaagaggagaggaagaggcggccgccttctcccgagccgagcacgaaggtttcagaggaagccgagtcccagcagcagtgggatacttcaaaaggagaacaagtttcccaaaacggtttgccagctgaacagggatctccacggatggcagaaacggtggacacaagcgaaatggtcaacggcgctacagaacaaaggacgagctctaaagagtccagccccatcccctccccgacctctgatcgtaaagccaagactgccctcccagcccagagtgccgccaccttaccagccagaacccaggagacaccttcggcccagatggaaggcttcctcaatcggaaacacgagtgggaggcccacaataagaaagcctcaagcaggtcctggcacaatgtttattgtgtcataaataaccaagaaatgggtttctacaaagatgcaaagactgctgcttctggaattccctaccacagcgaggtccctgtgagtttgaaagaagctgtctgcgaagtggcccttgattacaaaaagaagaaacacgtattcaagctaagactaaatgatggcaatgagtacctcttccaagccaaagacgatgaggaaatgaacacatggatccaggctatctcttccgccatctcctctgataaacacgaggtgtctgccagcacccagagcacgccagcatccagccgcgcgcagaccctccccaccagcgtcgtcaccatcaccagcgagtccagtcccggcaagcgggaaaaggacaaagagaaagacaaagagaagcggttcagcctttttggcaaaaagaaatgaactcctttccttcacctcctgcccttctcttaccttttcagtgaaattccagcatgcaagctcagaaccaacacattactctctgtgcctaatgttcctcaatgtggttgatttttttttttttttaatttatagagcatttcggggggggtgggggaaacacacctaaacactttatctccaagttacaaaagtttgaggtgcagagggaaggccagattttttttttaatgaaattatatagattagatctcagtatttaaactgttcctcaattttgtgaggctgtgttggaaataacccgcctctagtgctgttggtatgcaaggcagcggtgcttaatcaatatttcctgtgctcaccagaggcaaaatgtaccaatatcctgacaccattctctctccatttacttctggtggttaccctgactcttgactcttagaagtgcccgagatggggctaacctttattaaacagatcgcccatcccgnccctcccgccgccccngcgcngcgcccccctcccccccccgncccccccctttgcccccgnccccccccccccccccccgacatgcggnggttctgcnncaaccgctacgccggttaagaacccccgtgtacgagaaggaatagaaaactgcnggcggggtaaanaacccccccccncggggggnttttttttttngctgaaacacantatattcgtacgctttgagataatctctagtagcacaagtataaaaaactagatgtataataaaccctttaaatcattggtaagtgtacaagtggtggaactgaagcatttactggacaaagtaatgttactctaatggttacttgctcgtgcgttgccacactgtgttataatttgcttcatttccttgctatttgatacatagtgtgcatttctctgtcactgtaactattgtaatgacaaattttcatcttactgcacaatcaaaatgacgagtganaggaatgaaccccagaggcggggccagaacagtgagggggtcgcncag
